United States Patent 7,625,699 (GENETIC POLYMORPHISMS ASSOCIATED WITH CORONARY STENOSIS, METHODS OF DETECTION AND USES THEREOF) - sequence listing, part 14

SEQ ID NO: 32556 - DNA, 201 bp, Homo sapiens
tgtacatgtgtatacatatgtgtatacatggacacgtatatgtagacgtatacatatggacacgtatatgtagacgtatacatatggacacgtatatgtakacgtatacatatggacacgtatatgtatacgtatacatatggacacgtatatgtatacgtatacatgtacatgtgtatatgtatacgtatacatgtccat

SEQ ID NO: 32557 - DNA, 201 bp, Homo sapiens
gtaacctaaatattttaaactatggtttggaaataatctactagtaggaaaaagatgtgttcaaatgaccattataaagaattccctaagaaacataaaayagctatgcagaatgaaaataagtatatccatacactggcatggtattcagccataaaaaatgacagcataaagaagcacttaatgactagaaagagatgt

SEQ ID NO: 32558 - DNA, 201 bp, Homo sapiens
tatggacacgtatatgtatacgtatacatgtacatgtgtatacatatgtgtatacatggacacgtatatgtagacgtatacatatggacacgtatatgtakacgtatacatatggacacgtatatgtagacgtatacatatggacacgtatatgtatacgtatacatatggacacgtatatgtatacgtatacatgtacat

SEQ ID NO: 32559 - DNA, 201 bp, Homo sapiens
tgtatatatatgtatacatacgtatacatatggacacgtatatgtatacgtatacatgtacatgtgtatacatatgtgtatacatggacacgtatatgtakacgtatacatatggacacgtatatgtagacgtatacatatggacacgtatatgtagacgtatacatatggacacgtatatgtatacgtatacatatggac

SEQ ID NO: 32560 - DNA, 201 bp, Homo sapiens
tgaacctgggaggcgggggttgcagtgagctgagatcacgccactgcactccagcgtggggaacagagtgaggatctgttaaaacaaacaaacaaacaaamaaaaaacacatggactctaataatacatggatacatttagtgaaataaggttaactgagtagagcagcactcataacattttaaaactataagaacatgt

SEQ ID NO: 32561 - DNA, 201 bp, Homo sapiens
cgatgggtgggctgagcgcgcgacccggcagggcggcgggtgtaggatccttctgcgcactggagaccctcggtgcttctgggtaagcgtggagttcccasgtgcaggggcttaagtcgtgacgagcgcagtggaaggcgcagatgctgagcgggtgccgcacgaaattccttgcctttgtgtattcacagcctcggctgg

SEQ ID NO: 32562 - DNA, 201 bp, Homo sapiens
tgcctgtaatcccagctactcaggaggctgaggcaggaaaatcgcttgaacctgggaggcgggggttgcagtgagctgagatcacgccactgcactccagygtggggaacagagtgaggatctgttaaaacaaacaaacaaacaaaaaaaaaacacatggactctaataatacatggatacatttagtgaaataaggttaa

SEQ ID NO: 32563 - DNA, 201 bp, Homo sapiens
cgagattgggcgcattcagggtggtatggctgtaaatcagtatccagttctttttattacttctgaatctgtaagtatcatgtttattatatgtaatattrtatatttgtgctttgtctttattagttcttccagagcttttgttcttattatttaataaagatgttatactgagccacgtgtggtgactcaaacttgtaa

SEQ ID NO: 32564 - DNA, 201 bp, Homo sapiens
tagatgagaatagtattttcaatatttacttctggtaatttggaattaaaaaaaaaacttttgggaaaatttacaataaagtatgattttaacaaaccagkctaggcgtggtggctcacgcttataatcccagcactttgaaaagcagaggcatgcagattgcttgaggccaggagttcaagactagcctgcccaacatgg

SEQ ID NO: 32565 - DNA, 201 bp, Homo sapiens
ttacaaagaatggatctcatccctcttggaaatggtatccttctgatatttgaagaatctagtcatatccttaaaatggctcacagcattccaaacttccrccttcacctagaaatgcttttttttttcttatctcagtctaatgtattttaaactagtctttagctcatttaaccagcccccaatgtcctcttctgttgg

SEQ ID NO: 32566 - DNA, 201 bp, Homo sapiens
actttataaaaatgtacctatgtgttagcaaagattaaaagcaaataatgaatgtaaaaatagctatagtttagtgactcatgagatttctgtcattcatwatttaaactgactgttatttatcctgctcttcctttttccaggaattccttgtgggctaccccccaccatcaccaatggagatttcattagcaccaacag

SEQ ID NO: 32567 - DNA, 201 bp, Homo sapiens
aaagtggactctaataatacatggacacatttagtgaaataaacttaactgagtagagcagaacttataatattttaaaactgtaagaacatgtctgtacmttagcaaatagtagatgagaatagtattttcaatatttacttctggtaatttggaattaaaaaaaaaacttttgggaaaatttacaataaagtatgattt

SEQ ID NO: 32568 - DNA, 201 bp, Homo sapiens
tgaaatctctttccccattcaccccaccattgaatcctagagttgtcctcctagaattacaaagaatggatctcatccctcttggaaatggtatccttctsatatttgaagaatctagtcatatccttaaaatggctcacagcattccaaacttccgccttcacctagaaatgcttttttttttcttatctcagtctaatg

SEQ ID NO: 32569 - DNA, 201 bp, Homo sapiens
cgcttgaacctgggaggcaagggctgcagtgagccaagatcacgccactgcactccagcctggggaacagagtgaggatctgttaaaaaaaaaaaaaaaaagtggactctaataatacatggacacatttagtgaaataaacttaactgagtagagcagaacttataatattttaaaactgtaagaacatgtctgtacatt

SEQ ID NO: 32570 - DNA, 201 bp, Homo sapiens
gtgggcagatcacttgaggtcagtagtttgagaccaccctggccaacataatgaaaccccgcctctactaaaaatacaaaagttagccgagtttggtggcrcatgcctgaaatcccagctactcaggaggctgaggcaggaaaatcgcttgaacctgggaggcaagggctgcagtgagccaagatcacgccactgcactcc

SEQ ID NO: 32571 - DNA, 201 bp, Homo sapiens
gtaaaaagagaaaataaatcatcaacagacctagacattttcaaaagcaaagccatctgaatccatttggagttttttttttttttttatcatggcctgaytatgtttcaattcactgtgacagggctattgttatcactgagattgatgatcaatatcaataagtaatcagtgaaaggtttcacctatttaagatgatta

SEQ ID NO: 32572 - DNA, 201 bp, Homo sapiens
cctgacccagagagtaaaaagagaaaataaatcatcaacagacctagacattttcaaaagcaaagccatctgaatccatttggagttttttttttttttttatcatggcctgactatgtttcaattcactgtgacagggctattgttatcactgagattgatgatcaatatcaataagtaatcagtgaaaggtttcaccta

SEQ ID NO: 32573 - DNA, 201 bp, Homo sapiens
atataccatgctaatgctagtcacagaaagcaggaatagctgtgttaatttcaaacacagcagacttcagaccaagaaaaattattagggataaagagggrcatcatataatgataaaggggccaattatccaagaagacgtaacaatatcccatatgtatgcacctgatggagagacaaaatacgtgaggcaaaacccat

SEQ ID NO: 32574 - DNA, 201 bp, Homo sapiens
cgagattgggcgcatttagggtggtatggttgtagatcagtatccagttctttttattatttctgaatctgtaagtatcatgtttattatatgtaatattrtatatttgtactttgtctttgttagttcttccagagcttttgttcttattatttaataaagatgttatactgagccacatgtggtgactcaaacgtgtaa

SEQ ID NO: 32575 - DNA, 201 bp, Homo sapiens
aatctggtggcagtaataaccggggaacagatgagctggaggcctcatcaggaggggtgtcccttggtggaaggacaccattcccggccttaaaaggagasgcttcagcacggctggggaagcacgtggataccttgtactaaatccactactgcagctcattcttaactgtaagtagaagaggaggacatgctttctgaa

SEQ ID NO: 32576 - DNA, 201 bp, Homo sapiens
tcttgaaaggccccatgcactataaacctcagaagtgaacatatattttaacctacttcttaaaatttatacttaggaaataatcacacactttttaaagyagtttggtataaacttttcattgcagcattatttatattagttaaaatgttagagtaacctaaatattttaaactatggtttggaaataatctactagta

SEQ ID NO: 32577 - DNA, 201 bp, Homo sapiens
atacaggtaacaggtgatgctgggaagtcctgtgaaatggaaggagaacgaagatgaggaatctggtggcagtaataaccggggaacagatgagctggaggcctcatcaggaggggtgtcccttggtggaaggacaccattcccggccttaaaaggagacgcttcagcacggctggggaagcacgtggataccttgtacta

SEQ ID NO: 32578 - DNA, 201 bp, Homo sapiens
tgtgtgttggacatgagagtatttggaggaatacaggtaacaggtgatgctgggaagtcctgtgaaatggaaggagaacgaagatgaggaatctggtggcmgtaataaccggggaacagatgagctggaggcctcatcaggaggggtgtcccttggtggaaggacaccattcccggccttaaaaggagacgcttcagcacg

SEQ ID NO: 32579 - DNA, 201 bp, Homo sapiens
ggcaggctccaaagacatagctgtgtgttggacatgagagtatttggaggaatacaggtaacaggtgatgctgggaagtcctgtgaaatggaaggagaacraagatgaggaatctggtggcagtaataaccggggaacagatgagctggaggcctcatcaggaggggtgtcccttggtggaaggacaccattcccggcctt

SEQ ID NO: 32580 - DNA, 201 bp, Homo sapiens
agggacctattagatgggacatgggcaggggcactcctttattgcttaaaatgcaagactaaattggtgatgcctttctagaaaggaagtatgaagatacraaaatccatcattcctcccaattttgtactgggtgaacagtaattggaagcattctagaaggaactgtccattgtgaaatcttagttgcatactttagat

SEQ ID NO: 32581 - DNA, 201 bp, Homo sapiens
gttctggggcggagtaaagaggcaggctccaaagacatagctgtgtgttggacatgagagtatttggaggaatacaggtaacaggtgatgctgggaagtcytgtgaaatggaaggagaacgaagatgaggaatctggtggcagtaataaccggggaacagatgagctggaggcctcatcaggaggggtgtcccttggtgga

SEQ ID NO: 32582 - DNA, 201 bp, Homo sapiens
cattcatgtagttgcttatttattcttcaaacattcttagccacttacaatgtgccatacattgtgcttatgtgtgttttcttttccatgctaaattaacytctgatgaatagagacaattttttaaagatctccccaatctctgagtataatcaaatgagaaatgttcagtaatcaactgagcacgttaatcaattgaga

SEQ ID NO: 32583 - DNA, 201 bp, Homo sapiens
catcattgttaaaaacaagaaataggggaaaatataaaaaatataaaaattacctgcaataatctctatctagtagtattcttaagcttctttgcatattrttagacatttgcatatacaccttgagattatattgattgcacaatattgaatcctgctttttttaccaaatgacaaacatttctcccatcattataacag

SEQ ID NO: 32584 - DNA, 201 bp, Homo sapiens
ccaggagatccaaaaaggtagggtaggatgtaaaggcttcaatctgttcaagtggatatgagactccctggctccccttacaataagtagcatggattttstctctctgccttacttcctccaaacattctgaatgagaagtgttcaaaccactatttgttcaattgcttaatctactttgggacacaagtttaataaatt

SEQ ID NO: 32585 - DNA, 201 bp, Homo sapiens
ccactgttttggggtgatgactctataagttagtacagtcacagtcactactttttcaaagcattcctataatttcctgtatttatgctatgaaactttgmgaagtagtatgcttttttcttgtggaacccaagaatttgctgcctgcttgtacctccaagtcttccagcttcccttaaatgcacagagtcactttaatgt

SEQ ID NO: 32586 - DNA, 201 bp, Homo sapiens
cattctttgtgacgttgctcacagtaacattatggatacctaataaattttttaaaagacaaaatgttctacgttttgtggcctactctggatggctttawggtaaagtgggtgagtatccctaccctttacatttcaagtgtaggggtgtttagctgtctcttctggctctcatttactgactcttctgggtaaatccat

SEQ ID NO: 32587 - DNA, 201 bp, Homo sapiens
cattcatttggagttggtctcttccaggtggctacccttaacctttgtgctcaaataaactctatccttaaatatattttctgaatctcattatttaaggktgaaaatgtgctaacctaaataattcacaggatttgttttttattctcattttttcctaacctatccacctggttcaaggcacatagattaagaaggaaa

SEQ ID NO: 32588 - DNA, 201 bp, Homo sapiens
cttccttggaatgtagcaatctgtaaccaatcaaaatgctgtaactatgcatggtcccatatggaaaatataatcctgctaaaatttctctgtctctgccyatgtaagtgataccttatgtcctccactttggagtgctgaccccattcatttggagttggtctcttccaggtggctacccttaacctttgtgctcaaata

SEQ ID NO: 32589 - DNA, 201 bp, Homo sapiens
cgaagtcatatagtgtacaataccaagagtggaccctaacataaactatggacttggggtggccatgatgtgtcagtgtaggttcctcaattgcgaaaaaygtaccaccctggtgaaagatgtttataataggggaggttatccatgtataggggcagggagtacataggaaatctctgtatcttctgttcattattgctg

SEQ ID NO: 32590 - DNA, 201 bp, Homo sapiens
aacatatgattccaactatatgccattctggaaaaggcaaaactatggagacagtgaaaatatcagtggttgtcaggggttagggaagaaggggatgaatsggaagagcacagaggattttgagggtagtgaaactactctgtatgatgccataacagtaggtacatgtcataataaatttatccgaagtcatatagtgta

SEQ ID NO: 32591 - DNA, 201 bp, Homo sapiens
atctattgagagaaatagatacttctaaaagcacacaaagataaaaagcacaaattgtaataacaaacaattattgatatgaaaggaaaagcaaagtgtcrgactagaaattattatagggtggggcagagggaagtagtttagattccaaatccctaagagggtcagggaaggcttcagatgagattgggtgtgttcagg

SEQ ID NO: 32592 - DNA, 201 bp, Homo sapiens
ttgcagtccacagtgaagccaagatattaagaagcaatgtgggccaggagaagttagagcagaaatatctctttcaataatgaaagaataagaaaaagaartagaagagctggaaacaataggtaaagtttaggctaggccttagacttctcctgcattgtaatccttctggtttgccacatatgcatgctgtcaggaagt

SEQ ID NO: 32593 - DNA, 201 bp, Homo sapiens
agacaagatcaaaagcaacaaatcttgtatttataaaaaacatgtctcaagtaaaatgacatagtattatacacacacacacacacacacacacacacacmcaaattaagtgaaaatgcaaacaaaaaaaggcaaaaataatatttagagaaagatagaatttaagaaaaaaattgtcaaactggtctacaaaataattgt

SEQ ID NO: 32594 - DNA, 201 bp, Homo sapiens
atggtgtaatctgtcctgtaatgtctaatgtctacctgctattattttctaaatggtgagttaaatgggaaatatgtgtagcgtataaccattttctatcmtttgctttaggtttcgactcattggttccccatctactacttgtctcgtctcaggcaataatgtcacatgggataagaaggcacctatttgtgagagtaa

SEQ ID NO: 32595 - DNA, 201 bp, Homo sapiens
atttgagtgttccttcttctctaaaagagtaaataaaataaaataaagtagaaccaagtcccgcaagagttgttattaatatttgatctccttaggcaccrgaaagtaacctgtcaggtgcagagatgtgataaaacgtacaatcttatttttaggagagaagcatgcccagtaagttaagcaatctgttgtcaacgctta

SEQ ID NO: 32596 - DNA, 201 bp, Homo sapiens
tgttattatgagttactcacagtacccgtaaagtggtatagtgctatttgaaagaggacttagattagctgcaaatagatattgcaaatgtaggacaaccmctgaaaaatgtgaaaaaaagaactataatttatatgttaataagtaagagagaattgcatcatataaaatgctcagttaaaacaataaagatggctgggg

SEQ ID NO: 32597 - DNA, 201 bp, Homo sapiens
ggacatctttgaattatgaatgccgtcctgggtattttgggaaaatgttctctatctcctgcctagaaaacttggtctggtcaagtgttgaagacaactgyagacgtgagtaacccctccctgggaactacttcatgtctgttaaagcataggtgggaccgggcttggtggctcacgcctgtaatcccatcactttgggag

SEQ ID NO: 32598 - DNA, 201 bp, Homo sapiens
agaaaagatgagtagactgactatatagagtttgactctaaaattgagaaaataggtttaaatatctgttgtgtgcatatccatgtgtgtaatatacatgyacatatataaaatgaaattcctcattagaaaaaataataagtttaatttccaaattattagaataactaaaacagctgaatctatctcttccatatagca

SEQ ID NO: 32599 - DNA, 201 bp, Homo sapiens
ggtgtaatgcatgtgacagtgttttgtaatctgaaaacccccatgcatgtctgaaaaaccatgactaagaagtcgtgcaagactgcaggatcaccgaaaarcgagaaatctcaactcctatgatcaggaaaggatgagtgaaaggtatatggctttactagcacttaaagagtgaatctagaaacagattgcatacgacaa

SEQ ID NO: 32600 - DNA, 201 bp, Homo sapiens
gagacagcaagaaaaggtaggctaaacttacattacagaaaagatgagtagactgactatatagagtttgactctaaaattgagaaaataggtttaaatakctgttgtgtgcatatccatgtgtgtaatatacatgcacatatataaaatgaaattcctcattagaaaaaataataagtttaatttccaaattattagaat

SEQ ID NO: 32601 - DNA, 201 bp, Homo sapiens
gcaaatgtttttgtattttatttttctaaaaaagctaaccttggttaataacaaaaatggaaattaagaaagcaaacggaaaagagtaggagaaaactgtrtaaatactataacactatgatcaaagagctatttaaaatgaaaagaatgtggattgagttaatacatgcatgcaaatactataggaaatcatatcagtaa

SEQ ID NO: 32602 - DNA, 201 bp, Homo sapiens
taggatattggtaaaaagaaaaaacaacaataaaaaaatacacacaaaaactcggcaatgtaatcataatttactaataatctctctaaactcatagaacrtatcaataaaactagaaaatgtgagacagcaagaaaaggtaggctaaacttacattacagaaaagatgagtagactgactatatagagtttgactctaaa

SEQ ID NO: 32603 - DNA, 201 bp, Homo sapiens
ggcaagcacagtggctcacatatgtaatcccaacacactgagaggctgaggcaagagtatcacttgagcccaggagctcaagaccagcctagacaacatgrcaaaaacccatctctacaaaaaagtataaaaattagctgggcatggcagcatatgcctgtagtcacagctaggcaggagactaaagtgggaggatcacct

SEQ ID NO: 32604 - DNA, 201 bp, Homo sapiens
gatattgcactaggtaggtcattgataccaaagaatttagaaagtacttcaggagttggaaacttcttttttttttattggattattattgtcatttccamtgttttggggtgatgactctataagttagtacagtcacagtcactactttttcaaagcattcctataatttcctgtatttatgctatgaaactttgagaa

SEQ ID NO: 32605 - DNA, 201 bp, Homo sapiens
aggaggtagggtggaagtctctctgctaactttgatattcctgtggtttttctctccaggtcactgtaaaaccccagagcagtttccatttgccagtcctwcgatcccaattaatgactttgagtttccagtcgggacatctttgaattatgaatgccgtcctgggtattttgggaaaatgttctctatctcctgcctaga

SEQ ID NO: 32606 - DNA, 201 bp, Homo sapiens
agaccagtctgaaaaatcaggagaaattttacaaaagagatttactgccaagaaaccagggaaactttcagaacactctccttttcatatttgtaacaagwttcaattgtacaaatacttctgtgaaactagccatgaagtgtgtacatgaatgaatatatgtattcagtgtgtttatatatttcatttcatacatgtgat

SEQ ID NO: 32607 - DNA, 201 bp, Homo sapiens
agcatttttaaatgcaattggtaaatttcctgactgtaccctcctcatcttgcattgctgaataagtgaggaacctctctatggcatgaagcagaaaaccmttgagcttatgagaagaaacaggaaatacatgtaaaagagaccagtctgaaaaatcaggagaaattttacaaaagagatttactgccaagaaaccaggga

SEQ ID NO: 32608 - DNA, 201 bp, Homo sapiens
tcatcccaaggtaacatcaaggagaagaaaatcttttgctattcttgtaagtctctttgtttctgtgatccacctatcagcttaattgaagagaaagaggmggtagggtggaagtctctctgctaactttgatattcctgtggtttttctctccaggtcactgtaaaaccccagagcagtttccatttgccagtcctacga

SEQ ID NO: 32609 - DNA, 201 bp, Homo sapiens
gtggaaaatggaatattggtatctgacaacagaagcttattttccttaaatgaagttgtggagtttaggtgtcagcctggctttgtcatgaaaggaccccrccgtgtgaagtgccaggccctgaacaaatgggagccagagttaccaagctgctccaggggtgagtctgactgatgcctagaagggccctgccagtgacat

SEQ ID NO: 32610 - DNA, 201 bp, Homo sapiens
cctagaatctgacaaaaattagaataaatccgatgtctccttttctctcttttttttaagcatttttaaatgcaattggtaaatttcctgactgtaccctmctcatcttgcattgctgaataagtgaggaacctctctatggcatgaagcagaaaaccattgagcttatgagaagaaacaggaaatacatgtaaaagagac

SEQ ID NO: 32611 - DNA, 201 bp, Homo sapiens
caggtggccgctgagagaagacttgaaaggagatgagcatagatgtatggacgctctttgttgcaccagtgtgataggtgatggagggacctattagatgrgacatgggcaggggcactcctttattgcttaaaatgcaagactaaattggtgatgcctttctagaaaggaagtatgaagatacaaaaatccatcattcct

SEQ ID NO: 32612 - DNA, 201 bp, Homo sapiens
tgccagcataggcctcacagaccacagcacctagaatctgacaaaaattagaataaatccgatgtctccttttctctcttttttttaagcatttttaaatrcaattggtaaatttcctgactgtaccctcctcatcttgcattgctgaataagtgaggaacctctctatggcatgaagcagaaaaccattgagcttatgag

SEQ ID NO: 32613 - DNA, 201 bp, Homo sapiens
gtaaagaggcaggctccaaagacatagctgtgtgttggacatgagagtatttggaggaatacaggtaacaggtgatgctgggaagtcctgtgaaatggaasgagaacgaagatgaggaatctggtggcagtaataaccggggaacagatgagctggaggcctcatcaggaggggtgtcccttggtggaaggacaccattcc

SEQ ID NO: 32614 - DNA, 201 bp, Homo sapiens
aagcatgcgctttgaaaaccagcacaagacaaggatgccctctctcaccactcctattcaacatagtattggaagctctggccagggcaatcaggcaagaraaaggaataaagggtattcaaataggaagagaggaagtcaaattgtctctgtttgcatatgacatgactgtatatttagaaaaccccattatctcagctt

SEQ ID NO: 32615 - DNA, 201 bp, Homo sapiens
ataggtaaacatcttcagttagaacccttctattattatttttcggctccccagaagtcttcttggttgcctagactcactggcaacatctcatttgaagygacagtcttggttgtttttgtccagcctattcctgacaactccgggttcgcccttctctgccactagacattttacattcattatttgagtgttccttct

SEQ ID NO: 32616 - DNA, 201 bp, Homo sapiens
tactttttccattttataacagttttatgtaatttatttgagatccaaatgtgttttgatttcccaagatcagatcaactacattaagagagagcctgagmtgccgttacaatatgttgtgtgaaattacactctcattatggtgacagtaggtctttcagattttgttcgacagtttcccaccttctcactgaagtgaaa

SEQ ID NO: 32617 - DNA, 201 bp, Homo sapiens
gtggaaggcgcagatgctgagcgggtgccgcacgaaattccttgcctttgtgtattcacagcctcggctggctatagccaagacgtggcgttgatcctagygaaagggaacttggggatccgacaaacctgagttctggtcctagaaacttaactgtgaggcaacttagcacacctgagtctgtttgctcttctgtaaaat

SEQ ID NO: 32618 - DNA, 201 bp, Homo sapiens
cactgcagtgcaaagtcattcatgttgtgcagcttaagtgtcaaaatctcgatgtaaatcctatttactaatcaaaattatgtcagaaatagtgaaatgtrttaaggcatggacatctgcctataaacaatttagagtactctgacagaaaatataggatgattttagtattattttctaatctaagtttttgcttagtat

SEQ ID NO: 32619 - DNA, 201 bp, Homo sapiens
acgagcgcagtggaaggcgcagatgctgagcgggtgccgcacgaaattccttgcctttgtgtattcacagcctcggctggctatagccaagacgtggcgtygatcctagtgaaagggaacttggggatccgacaaacctgagttctggtcctagaaacttaactgtgaggcaacttagcacacctgagtctgtttgctctt

SEQ ID NO: 32620 - DNA, 201 bp, Homo sapiens
ctgtgttcacagtcactcactctctatgagaccctgagcaagatacttatcctcagtaaatttcattttccttgcctgtgaaatggagataataatagttmctaccttacttaacatagtgcctcatttatgatgcatgtcagaaaatgttagctattatttacacatgattgttattactgatattaaaaagtgagtaaa

SEQ ID NO: 32621 - DNA, 201 bp, Homo sapiens
ttcctgggccaactccctcatggccgtgtgctacttccacttaatctccagcttggggcaaaggtgtcctttgtttgcgatgaagggtgagtgtgacccamcgttgagaccaaggactcagtgtggagaatcactctcttgagatcaggggttaatccaattaaggagctgacctagtagataagaagtacccagagagat

SEQ ID NO: 32622 - DNA, 201 bp, Homo sapiens
ctctgcgcgcccgggtccgaaggcagcgcgatgggtgggctgagcgcgcgacccggcagggcggcgggtgtaggatccttctgcgcactggagaccctcgstgcttctgggtaagcgtggagttcccaggtgcaggggcttaagtcgtgacgagcgcagtggaaggcgcagatgctgagcgggtgccgcacgaaattcctt

SEQ ID NO: 32623 - DNA, 201 bp, Homo sapiens; identical to SEQ ID NO: 6307

SEQ ID NO: 32624 - DNA, 201 bp, Homo sapiens
cctatttgtgacagtgagttgaaatatcccttcctatttcttttaccgacacattctaatttttctctggaataataaaaatcttaactgaattccttctrtgcaatctgtccttcacacggctgaagactgcggtaatgttctcgaatattcctatggggttcctggcaactctttctttaagttcttccttatcctggg

SEQ ID NO: 32625 - DNA, 201 bp, Homo sapiens
agatcaaactcatcagttataatagtaaatgtgaatgattccaatccccccttttgaaagacaaaggcttctaaatatggtcagaatcctatttacagtarcatcaaaaagaataaaatacttaggaatcaatttaatcaaggaggcacaagacctgtgcactgaaaactcagtaactgaaaatgagcaaatgatgtgata

SEQ ID NO: 32626 - DNA, 201 bp, Homo sapiens
tttcattgataaaagatgaagtgtttattaacccccaaagaggcagtgtaccataccaagtgagggtgagggctttgcaaccgctaaggcctgtgttcacrgtcactcactctctatgagaccctgagcaagatacttatcctcagtaaatttcattttccttgcctgtgaaatggagataataatagttcctaccttact

SEQ ID NO: 32627 - DNA, 201 bp, Homo sapiens
aaacacctatttgtgacagtgagttgaaatatcccttcctatttcttttaccgacacattctaatttttctctggaataataaaaatcttaactgaattcyttctgtgcaatctgtccttcacacggctgaagactgcggtaatgttctcgaatattcctatggggttcctggcaactctttctttaagttcttccttatc

SEQ ID NO: 32628 - DNA, 201 bp, Homo sapiens
tgtcattctaatttccataagatggtaaagaataactgagtgatgaggaaacagtggtacatgttgaagtgagttaactcttcaagcttccattctaaaayccctaataccaactcatacataaaatctccaggtactggtactgttttatcatttcattgataaaagatgaagtgtttattaacccccaaagaggcagtg

SEQ ID NO: 32629 - DNA, 201 bp, Homo sapiens
aagcacatatgcttaaacgatatcacacttgatttcatgtgccttctcaatcctcagctttccctgattaagaatacctaattactctgcccatttcctcygcaccctccaccttggcctttccactcactattactactatctcctgccttcttggtctctactattctcctcaccatccctgctccctggactatgatc

SEQ ID NO: 32630 - DNA, 201 bp, Homo sapiens
ggaggtggaggttgcagtgagttgagattgtgccactgcactccagcctgggcaacaaaggcaaaactccatctgaaaaaaataaataaataaattaaatwaaataaaacaagaaaagaaactaaagtgatagagaaatagaaggaatacacacacagaaatgatctcaccttctttaaaatgctcctcaaggaggtctac

SEQ ID NO: 32631 - DNA, 201 bp, Homo sapiens
aggagaattgcttgaacccaggaggtggaggttgcagtgagttgagattgtgccactgcactccagcctgggcaacaaaggcaaaactccatctgaaaaamataaataaataaattaaataaaataaaacaagaaaagaaactaaagtgatagagaaatagaaggaatacacacacagaaatgatctcaccttctttaaaa

SEQ ID NO: 32632 - DNA, 201 bp, Homo sapiens
tactactgattggttggggatgggggtgtgggaaatgttcctcatgtgctgtgtccacctctggttgggggccacaggaccagttgagtcatgagtcacargtccaggtagagtcagtcagttgccaaatgcaaaaacctgaaaaacatctcagaagaccaatcttatattctacatagtgatgttatctataggagcaat

SEQ ID NO: 32633 - DNA, 201 bp, Homo sapiens
ggaaggtactgtaagatagaaaactacccacatcatggagcagatgagcaaagttaataatgaacagcctttcttaatccaagttagtgctacactttccyttctccccatctcttatgactcttctaatacatggttctacaccaagattgttcaagatccagttttacaattaatcctgtaaatatgctaatatgactc

SEQ ID NO: 32634 - DNA, 201 bp, Homo sapiens
gtaagctacaggcaggttgagaccttatgtactaaaaaaagtttttagtttactctacttggctccaaaattctgtttctttcctgtaggtaaatcatgtygtaatcctccagatcctgtgaatggcatggtgcatgtgatcaaaggcatccagttcggatcccaaattaaatattcttgtactaaagggtgagttggcat

SEQ ID NO: 32635 - DNA, 201 bp, Homo sapiens
ggacaagaaagagaagtggattaaataactaaaagatgtgacaatcttgggctttgagatctttggattataccagttgaattgaattacagataataacraagtttacatttttctgggaggcataatatggggatgaaacagatctgaaaggaaagttttttttgaaagggagctgatcctgaggcagtctggtgagtt

SEQ ID NO: 32636 - DNA, 201 bp, Homo sapiens
agggatgcaggtgttacctgacaactgccccgcatggaactgtcctcgccccccacaccaagccaccacggccatcatcaccatgcacttaattgacagcrtactttaagacagatgcatgccaggcacttgcggattagaagagcaagggaagccccagaacatgcaatgtaaccgttgcaggtagaagggacagtagat

SEQ ID NO: 32637 - DNA, 201 bp, Homo sapiens; identical to SEQ ID NO: 6285

SEQ ID NO: 32638 - DNA, 201 bp, Homo sapiens; identical to SEQ ID NO: 6287

SEQ ID NO: 32639 - DNA, 201 bp, Homo sapiens
tgattctccctgcaaacctggtaggaaaatattattccctttatgaagatgaaactgaggctcagcaagattaagcggtttgcctaagacctcatagccaytaagtagaagacattgggttcaagattcaatctatgaacccaacatttttaatactatataccattctctttttgtattaatttcctattgctgctgtaa

SEQ ID NO: 32640 - DNA, 201 bp, Homo sapiens
tttctacttctgtaacctctctgtatccaaatcctggtaaatggcctcaagtcttcttggaaaaggctaggggaagatttacaatacatgcttttgattgygtagcatggtgcttcctcaagagaatccagtctcccatccgttggtgctgctctgggtctataaactattcaagtctaggaattgttgatgaacaatgaa

SEQ ID NO: 32641 - DNA, 201 bp, Homo sapiens; identical to SEQ ID NO: 6289

SEQ ID NO: 32642 - DNA, 201 bp, Homo sapiens
tggataaagagtcaagacccattggtgtgctgtattcaggagacccatctcatgtgcaaagacacacataggcgcaaaataaagggatggaggaatatttwccaagcaaatggaaagcaaataaaagcaggggttacagtcctagtctctgataaaacatactttaaaccaacgaagatcaaaagagacaagagcattaca

SEQ ID NO: 32643 - DNA, 201 bp, Homo sapiens
ttcagttgtctaccatgctgttaattaaatgaaaacatcctgttatttcagggtccttccttgacaaagtactatacagctgaagaacatctcgaatacarttttggtgggaaaggagccaattgatttcaacagaatcagatctgagcttcataaagtctttgaagtgacttcacagagacgcagacatgtgcacttgaa

SEQ ID NO: 32644 - DNA, 201 bp, Homo sapiens
agttcagttgtctaccatgctgttaattaaatgaaaacatcctgttatttcagggtccttccttgacaaagtactatacagctgaagaacatctcgaatayaattttggtgggaaaggagccaattgatttcaacagaatcagatctgagcttcataaagtctttgaagtgacttcacagagacgcagacatgtgcacttg

SEQ ID NO: 32645 - DNA, 201 bp, Homo sapiens; identical to SEQ ID NO: 6295

SEQ ID NO: 32646 - DNA, 201 bp, Homo sapiens
acatgtcagaaaggacaactaaactattaccatctgctctttaacggcttcaacacagatgtttagctcctgactgaaatgagcaaaggtatgacaagatygggggaaaatcatctgtatccttgctggaaaccaaggcagagcatatatgaaaagtgtggcattcattgggtgggaaggaagaaaatgggggaagagtat

SEQ ID NO: 32647 - DNA, 201 bp, Homo sapiens
atacacacacagaaatgatctcaccttctttaaaatgctcctcaaggaggtctactttaactatcctagtaaagatgacatgaccccacccccacattccyagtctctcttatcctgctttatttttttcatagccttattctcttttattataattaattaaataattacattccatgtttattctctctctccctccat

SEQ ID NO: 32648 - DNA, 201 bp, Homo sapiens
tgtggaagaacctggactctcatgtaccacgagatcaacacatcctcttgaaaggccccatgcactataaacctcagaagtgaacatatattttaacctayttcttaaaatttatacttaggaaataatcacacactttttaaagtagtttggtataaacttttcattgcagcattatttatattagttaaaatgttagag

SEQ ID NO: 32649 - DNA, 201 bp, Homo sapiens
tttctatcatctgcctaaaaaactcagtctggactggtgctaaggacaggtgcagacgtaagtaactctggagtgggaacccccctgttagtcaaacatcygtaagatctgattcaatttgttcaaattttgtaactgagttgcatatgacaattagtttgccaaggtgcaatacatatgagaattattcttgtagatcat

SEQ ID NO: 32650 - DNA, 201 bp, Homo sapiens
tctgctgcggaggatccctgctggcggttgtggtgctgcttgcgctgccggtggcctggggtgagaggcgggcgggcgtggggaggcgcccgggcggacgrggaacccggggccccgcagagaactcgcgtgcagcgctgagctgcgctgctctgcgcgcccgggtccgaaggcagcgcgatgggtgggctgagcgcgcga

SEQ ID NO: 32651 - DNA, 201 bp, Homo sapiens
tgggggcctcttctccaagaagcccggagcctgtcgggccgccggcgcccggtctccccttctgctgcggaggatccctgctggcggttgtggtgctgctygcgctgccggtggcctggggtgagaggcgggcgggcgtggggaggcgcccgggcggacgaggaacccggggccccgcagagaactcgcgtgcagcgctga

SEQ ID NO: 32652 - DNA, 201 bp, Homo sapiens
gcttggggagaatgggggcctcttctccaagaagcccggagcctgtcgggccgccggcgcccggtctccccttctgctgcggaggatccctgctggcggtygtggtgctgcttgcgctgccggtggcctggggtgagaggcgggcgggcgtggggaggcgcccgggcggacgaggaacccggggccccgcagagaactcgc

SEQ ID NO: 32653 - DNA, 201 bp, Homo sapiens
ggctgtgatttttccagaataaggtagcctgtgcaactctgccatctgctggcctcagatcctcaaaatcctgaaattggggctgggccttagattgtgarctaagtgtcctcttggctgaaacagctcactattcactcctattttcttctttagatttcaattaaaaggcagctctgctagttattgtgtcttggctgg

SEQ ID NO: 32654 - DNA, 201 bp, Homo sapiens
ttggtaatttgtatttccatttatatcatttagattttcaaaatatttaaccccctgtagtctacagttttataaatattctcatatacataaaaatatgyttaaattctttttcctactgtgtatatttgtgttttctctcatcccttatactttatcttttagcaaatgtttttgtattttatttttctaaaaaagcta

SEQ ID NO: 32655 - DNA, 201 bp, Homo sapiens
ttcccttttaataaggacaccagtcacactggattagggcctactttcatgacctcaccttaacttgattgcgtctgcaaagattgtatttccaaataagrtcacatccacagggactggaggttaagacttcagcatacttggggggagacacaattcaacctataacagagcccctttgaaaatgtcaggcatcaggtg

SEQ ID NO: 32656 - DNA, 201 bp, Homo sapiens
gtctgtttccaaagttttcccttttaataaggacaccagtcacactggattagggcctactttcatgacctcaccttaacttgattgcgtctgcaaagatygtatttccaaataagatcacatccacagggactggaggttaagacttcagcatacttggggggagacacaattcaacctataacagagcccctttgaaaa

SEQ ID NO: 32657 - DNA, 201 bp, Homo sapiens
tgcagaaattggccagaattatgcatttaataaagagcagagtgccagtatttgttgtgaagccagacagaattaacatggtactcctgttccctcacagmgtgaccccagtggctccagggctagatcaccgttagcctaattcctaatctttccacagctttccagttgcagagctgttaatcaacagtgaatgcacag

SEQ ID NO: 32658 - DNA, 201 bp, Homo sapiens
agccttcaaacttgattttacttcaataaacgtgaaattatgttgtttctaccacctccagtataataatcatcttgcttggcaaatcagtaaagattttwaaaattgatactcttcaaggttagcgaagctgtggaagaacctggactctcatgtaccacgagatcaacacatcctcttgaaaggccccatgcactataa

SEQ ID NO: 32659 - DNA, 201 bp, Homo sapiens
ctctgggtctgtgtcctcatatgctgttctctctgtgcatgtctgtttccaaagttttcccttttaataaggacaccagtcacactggattagggcctacyttcatgacctcaccttaacttgattgcgtctgcaaagattgtatttccaaataagatcacatccacagggactggaggttaagacttcagcatacttggg

SEQ ID NO: 32660 - DNA, 201 bp, Homo sapiens
taactgtcctctttgcatggtcgatagcagtgcttctccatccagagcattaacaaaatcaccttgttaaaaagattctcaaactccattccatggcctcygattctgttttaaagtggggtcaaaagtctatttttaacaaactcatcagaatgctctgatgcaggaagaccacagaccacacttcaagaaataccactt

SEQ ID NO: 32661 - DNA, 201 bp, Homo sapiens
tctttggcaccatttaatctgagtaaaaacagccttactggtgtctgatgacaccactggaaatttggtattggtcctgatggtaatggtcttgaatcacyaagaaacatttacattgctaaagatgatagctcatgtttattaaagttcatagatttccttgaaacttatggtctctgatgaccaaaactttgtctgtct

SEQ ID NO: 32662 - DNA, 201 bp, Homo sapiens
aggtaaaattcaagcatgagaagtcaatcattgtttgatgtactaggtcttttatatacacataattctgataaatttgggtatctcttcctaaattcatrtcaaactagaagcatcaattgcttttagggaaggaactgttctaagcagactaaaaggaggaagaaatggtggctaataattggaagaaatcaaaaaagg

SEQ ID NO: 32663 - DNA, 201 bp, Homo sapiens
tcgcatatcataaacaatttagtcagcttgttttttagcctgcagtatttaatgacatagggcttcccatgtgccaggactttccatgtgtagaaaaagcratgaatagtgaatgaatagtgaagacacctccctactttcctgggatgtattttcttgttgggaagcagactatgaacaaggaaataaataagtaaacaa

SEQ ID NO: 32664 - DNA, 201 bp, Homo sapiens
ctgtttctacttctgtaacctctctgtatccaaatcctggtaaatggcctcaagtcttcttggaaaaggctaggggaagatttacaatacatgcttttgaytgtgtagcatggtgcttcctcaagagaatccagtctcccatccgttggtgctgctctgggtctataaactattcaagtctaggaattgttgatgaacaat

SEQ ID NO: 32665 - DNA, 201 bp, Homo sapiens
cgtttggtgggtcctgagttgttgtcccgcatccaagaagaacaaggttatactgacaatagaagggtgaggagggtggagaagagttttattgagtgacraaacagcttctcagcggagacgagacacgagggtggaccccagatgaagtcagggggtcattctctctctcagcgtggctggttctggggcttttatgga

SEQ ID NO: 32666 - DNA, 201 bp, Homo sapiens
caagatagcgccactgcactccagcctgggtgatggagccagtctccgtctcaaaaaagaaaaaaaaaagtatggtaatttctccattaactttgatgctkctatggtcttgatctccaggtcaatgcaatgccccagaatggcttccatttgccaggcctaccaacctaactgatgagtttgagtttcccattgggacat

SEQ ID NO: 32667 - DNA, 201 bp, Homo sapiens
tttctccattaactttgatgcttctatggtcttgatctccaggtcaatgcaatgccccagaatggcttccatttgccaggcctaccaacctaactgatgartttgagtttcccattgggacatatctgaactatgaatgccgccctggttattccggaagaccgttttctatcatctgcctaaaaaactcagtctggactg

SEQ ID NO: 32668 - DNA, 201 bp, Homo sapiens
gcttcctcttagccaagggcaaaataggttttggctattttctcctattctcgcagttaaaacggacaatcaacaataaaatatcaatttctttctgattkgtctaatttcagaagtaaattgtagcttcccactgtttatgaatggaatctcgaaggagttagaaatgaaaaaagtatatcactatggagattatgtgac

SEQ ID NO: 32669 - DNA, 201 bp, Homo sapiens
ttaaaaacatgcttcctcttagccaagggcaaaataggttttggctattttctcctattctcgcagttaaaacggacaatcaacaataaaatatcaatttmtttctgatttgtctaatttcagaagtaaattgtagcttcccactgtttatgaatggaatctcgaaggagttagaaatgaaaaaagtatatcactatggag

SEQ ID NO: 32670 - DNA, 201 bp, Homo sapiens
gatccaaaacgggcattacattggaggacacgtatctctatatcttcctgggatgacaatcagctacatttgtgaccccggctacctgttagtgggaaagrgcttcattttctgtacagaccagggaatctggagccaattggatcattattgcaaaggtgacttatttcttggtattccttattcttgctgggttgtatg

SEQ ID NO: 32671 - DNA, 201 bp, Homo sapiens
aaggcttctaaatatggtcagaatcctatttacagtagcatcaaaaagaataaaatacttaggaatcaatttaatcaaggaggcacaagacctgtgcactraaaactcagtaactgaaaatgagcaaatgatgtgatagacatgtctccaagggaaatatacaaatgcccaataaacacatcaaaagatgttcaacatcat

SEQ ID NO: 32672 - DNA, 201 bp, Homo sapiens
acgttggacatagccatatgatcaaaggaatacaaaaaagaaggtacaatatgtattgtattgtaaaccagaggagggcaacatgttcctgtcaaaggtgrtacatgtgaaacctggtcaggcattcattggatgaaaaggagcagcttacaaataaggaaaaggaaaaaaggtagttgaaccatgtaaacctccttaact

SEQ ID NO: 32673 - DNA, 201 bp, Homo sapiens
tgagtgttcaattctttttgatcagcctggatttcctttggttctagttatgtatccccttccttccttccttccttcctttccttccttccttccttcctccctcccttccttcctttccttctttccttctttgctttctttctttcctttttactttcttttttttttttgatacaaggtcttgctttgttgcccagg

SEQ ID NO: 32674 - DNA, 201 bp, Homo sapiens
taagaacctccatatttctatagtgacagtcatttttgcttgtgaaaatggctttgctgtaactgtcagagacagaactacctcccaagtgaatgacaaaygggttatagataggcacgctgtctcaattgttggtattctgatggtccttcctatggggtgaagagtgtgggatggtaaggagagaagggggtggacagt

SEQ ID NO: 32675 - DNA, 201 bp, Homo sapiens
acagggggaaggtttcataagtatatatataatatatatataatataacataaaattcatatatattataaaaataataaatatgatataaatttgatatraaatattatataaatctgatttttaacatattttgattttatactggtgtaaagtactattttctctttattttttacatcaagaatatgtatcccctac

SEQ ID NO: 32676 - DNA, 201 bp, Homo sapiens
tagtattttaagtataaaatgagtgttcaattctttttgatcagcctggatttcctttggttctagttatgtatccccttccttccttccttccttcctttccttccttccttccttcctccctcccttccttcctttccttctttccttctttgctttctttctttcctttttactttcttttttttttttgatacaagg

SEQ ID NO: 32677 - DNA, 201 bp, Homo sapiens
gatattggatgtgttcatgtattcatatgtctatgtttaactgagtgtcttttcttgtgtttgtgtgggaacttgttcttagcctgcccacatccacccargatccaaaacgggcattacattggaggacacgtatctctatatcttcctgggatgacaatcagctacatttgtgaccccggctacctgttagtgggaaag

SEQ ID NO: 32678 - DNA, 201 bp, Homo sapiens
taattccagaagtttaaatacataaaagccttcaaacttgattttacttcaataaacgtgaaattatgttgtttctaccacctccagtataataatcatcytgcttggcaaatcagtaaagatttttaaaattgatactcttcaaggttagcgaagctgtggaagaacctggactctcatgtaccacgagatcaacacatc

SEQ ID NO: 32679 - DNA, 201 bp, Homo sapiens
ctttagtattttaagtataaaatgagtgttcaattctttttgatcagcctggatttcctttggttctagttatgtatccccttccttccttccttccttcctttccttccttccttccttcctccctcccttccttcctttccttctttccttctttgctttctttctttcctttttactttcttttttttttttgataca

SEQ ID NO: 32680 - DNA, 201 bp, Homo sapiens
ttctacatttataggtcagtgatcatttaattgagtcaatactggttatgtgtgtatatgtgtgtagtcacttagccaatatgtgaatattattatcttaygatagaacacagtattcatttatcattttattgcccttaaatctgccattatttcatttctcatgccttatcttttgtgtttccttttctctctttttct

SEQ ID NO: 32681 - DNA, 201 bp, Homo sapiens
aaatgaatgagaatgtatacaaggtgcctcccatatctgccaagaacttgaaattctatgaaataattcaaattatcaaagaattatcagtttactatacraagttttcaaggcatggcaccttttgtagggggttatcttttataaaaaaatttccacttctacatttataggtcagtgatcatttaattgagtcaatac

SEQ ID NO: 32682 - DNA, 201 bp, Homo sapiens
acatatatcaaaacaccacattttaccctataaatatatacaattattgtttgttcataaaaataaaatcagattttaaaaaatattcactgtgtttttttcagccatacataggctggaaccttcttcacattttggctccaacaatctagcttagtcacagcgagcacatctaaaacaacctctaggaggccaaaagtc

SEQ ID NO: 32683 - DNA, 201 bp, Homo sapiens
gaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatatac

SEQ ID NO: 32684 - DNA, 201 bp, Homo sapiens
agaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatata

SEQ ID NO: 32685 - DNA, 201 bp, Homo sapiens
aagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatatat

SEQ ID NO: 32686 - DNA, 201 bp, Homo sapiens
aaaagaaagaaagaaaagaaaaagaaagggaaaaaaaattgctagaagagtagattttaaatattctcaccacacacacacacacacacacacacacacacacaaaacaaatatgagaggtgacggacatgttaattagcttaatttaatcatttgcaacagaaacatatatcaaaacaccacattttaccctataaatat

SEQ ID NO: 32687 - DNA, 201 bp, Homo sapiens
atttggtcaaagggcgcagggtttcagttagacaggaggagtaagtttcagagatctattccacagcatggtgactatagttaataataatgtgtatttcmaaattgctggccgggcacagtgtctcatgcctatagctctttgggaggctgaggcatacgaattgcttaagcctagaagttagaaactaggctgggcaaa

SEQ ID NO: 32688 - DNA, 201 bp, Homo sapiens
aagtggaattcctgggggatatggtaattctgtttaacttttcaaagaattgccagactattttccacagctgctgtaccattttacatccccatcagcartgcacaaatgttccaatttctctacatcctcaccaacacttgtcatttttctggtttaaaaaaaattattattataccaccctaaaaggggctgaagtca

SEQ ID NO: 32689 - DNA, 201 bp, Homo sapiens
gtaataaacatggaattggaataggaattttcctggaaatatgaaaaagattagtaaaatagagaaaacaaaaaatataataatacacctatacctgtatytattttttatctctgtttctacttctgtaacctctctgtatccaaatcctggtaaatggcctcaagtcttcttggaaaaggctaggggaagatttacaat

SEQ ID NO: 32690 - DNA, 201 bp, Homo sapiens
ccctatggaaaagaaatatcttacgcatgcgacacccacccagacagagggatgaccttcaacctcattggggagagctccatccgctgcacaagtgaccstcaagggaatggggtttggagcagccctgcccctcgctgtgaactttctgttcctgctggttagtacctgcttccacatatcctaaatgggttcagaata

SEQ ID NO: 32691 - DNA, 201 bp, Homo sapiens
tctgctttttccagcctctgctacttaccagctggtgtcttggacccagtaagttaagtcacatcactgaccttcagtgtccacatgtataaaatgagcayaactgacatcctgatctctgagagagacgttttgaaaatcagatggtgtaatgcatgtgacagtgttttgtaatctgaaaacccccatgcatgtctgaaa

SEQ ID NO: 32692 - DNA, 201 bp, Homo sapiens
cactctcttgagatcaggggttaatccaattaaggagctgacctagtagataagaagtacccagagagattaatttatggaagggtagttttgaaataagrgtagggactaagtggcaccactttcagaaggcaatgagaaaatggcacatacagctcaatgtcaggtacaaacctaaatacagtcactgatcttgagtac

SEQ ID NO: 32693 - DNA, 201 bp, Homo sapiens
acgttgttaaatttctgaaaacaagtgcaacttaagcatataactaaggagtagatgttaacctggacaaatgaaacatagattgttttgagcaagagacrgcaaaattttttgtcaagagccagatagcaaaattttcaattttgcagaccatgcaatctctattgcaattactcagttctgccattgcagtggaaaaat

SEQ ID NO: 32694 - DNA, 201 bp, Homo sapiens
atataaaaatgaggaaagaatatgcacaggcaattcacaaaaggaaacataaaaatggccttaaaaattgctaaaataaatatttaagcaaaaaagctcarcttcactatggtttggggaaatgcaaattaaagcaacaatatgtcatgttttcacagtcacattaataaaagtttaaaagacggaagtagaggtaaatag

SEQ ID NO: 32695 - DNA, 201 bp, Homo sapiens
gagaaagaggatggtcaccatcccaaccagattggccattagatctatgtatcaacagagtgacatacgggagaattaaaattctagtatgcaaaaatacrccgtatgttaacagaaaatagactgcagggaaatttgtattaggtaaaaccgagagaaagttaagagcatacaacagtagataagcaatagacaacccga

SEQ ID NO: 32696 - DNA, 201 bp, Homo sapiens
cgcctggcctgaagacaagaacttttgaacaagagagcgctaactaacgtattgaaatacataaaacaaatactgatatatagaagagctcattcagctgyttcaaagacagagctctgtaacacatgtactcttacctaaagaactgtctcccaccactggaaaggaggtcttctctgaccaaatacacagcatcttgga

SEQ ID NO: 32697 - DNA, 201 bp, Homo sapiens
gaaaactcagtaactgaaaatgagcaaatgatgtgatagacatgtctccaagggaaatatacaaatgcccaataaacacatcaaaagatgttcaacatcaytagtcattagggaagtgcaagtcaacctgactttgtactaggatgttttgtattaggatggttataatatttttaaaaaataggaaataaaaggtgttgg

SEQ ID NO: 32698 - DNA, 201 bp, Homo sapiens
tactcgggaggctgaggcaggagaatcacttgaacccgggaggcggaggttgcagtgagccgagatggtgccactgcaccccagcctgggcaacaagagcraaactctgtctcaaaaaataataataataataataacaataacaataacaaaaatgtttaagagtgaaaagaattcttgagaccaaaaaagtttaagaac

SEQ ID NO: 32699 - DNA, 201 bp, Homo sapiens
tatttaggggtttttgtggactaatatatgatcacttttacacagatatcatcttatgatatcaaacttagatttgatgaaatgagttggtaagcttcatrtcttttatatgttgtgaaaccttgaaattacatttggaagtatatttttgaatgaattttggtaatttgtatttccatttatatcatttagattttcaaa

SEQ ID NO: 32700 - DNA, 201 bp, Homo sapiens
accctgtctctactaaaaaatacaaaattagccaggtgtggtggcgcatgcctgtaatcccagctactcgggaggctgaggcaggagaatcacttgaaccygggaggcggaggttgcagtgagccgagatggtgccactgcaccccagcctgggcaacaagagcgaaactctgtctcaaaaaataataataataataataa

SEQ ID NO: 32701 - DNA, 201 bp, Homo sapiens
ctgaagaaaaatcaggatgacttgtcactggctgagaggtcctgttcaatcatgttgcatgccagagtgatgttttgtgacttttgtcttccttttaggtrcacatgatgctctcatagttggtaagttttatgaaagttttgctgaggaattctggcatctataacagtaagtacctacctataatgaatgaaatgtaaa

SEQ ID NO: 32702 - DNA, 201 bp, Homo sapiens
taaaagatggacaacattataaaaagaaatagacaaatgtacaataaataaaatattttaacacaactcatttagtatctagtaagacaagtactcccccmaaaatcagtaaagtatctagaagatttgaataaatattaacagattggattcactgaccttgttacaagaaagaattatacatgatgataggagagagga

SEQ ID NO: 32703 - DNA, 201 bp, Homo sapiens
ggataaagaaaatgtggcacatatacaccatggaatactatgcagccataaaaaaggatgagttcatgtcctttgcagggacatttatgaagctagaaacyatcattctcagcaaactaacacaagaacagaaaaccaaccaccgcatgttctcattcctaagtgggagttgaacaatgagaacacatggacacaccgagg

SEQ ID NO: 32704 - DNA, 201 bp, Homo sapiens
gctggactattgggagagtggctcaaacccatgttgcagttctggagtcacacactggacagtctaagtgtcacactcatcaaaaccactgcctcctaggrtgcatcacatgtggcatcaattacacagtgacattaaaagcaattagtgccaccgggttgactgcagattgctcctaccaaagttatttctctggtaagt

SEQ ID NO: 32705 - DNA, 201 bp, Homo sapiens
aaatcttaattgtttctctaaaatgtaggtcctcgggcccctgccaacattcaagtctctttcgatagtggagctctgaaggcatctttttcctgggcackggcagaaggagctttcaattatactgtgatggctttgagcgactcttcagagctgacctgcagtacaactttcagttcctgcaccatctcttccctccag

SEQ ID NO: 32706 - DNA, 201 bp, Homo sapiens
ctactttatctaacagtcagttatgtcattctaagtttaaaaagcttctgaacagaaagaaaaggagctgtcatcaagttgatgcactccattccacaggaaaaaaaaaataaagctattctttcaggcccgcactctcttatagttatgttaaattaaggtcaatgataacaaacttgatgatttggcttctcttttgac

SEQ ID NO: 32707 - DNA, 201 bp, Homo sapiens
cgggttgactgcagattgctcctaccaaagttatttctctggtaagtgaactctagctctagagtagcagtaaggacttgactattatcaatccaggcatragcctttcctcctcatttaaaaagatgctgcatctccacctagtttgcattataaactcagattactttctaaaatggttatagtttccctttgacttag

SEQ ID NO: 32708 - DNA, 201 bp, Homo sapiens
tctgcctggggcatgggatggaagagttggaatataattttggcatcctagaggtagtagaaagagtcttaactgggagtcaaaattagacatggattctwataagctgtgttgcctaatcttccctgattctgtctcctcattgaaaaagacaggaatagtaatattttccttcgaagttgttttgagaatcaaaataaa

SEQ ID NO: 32709 - DNA, 201 bp, Homo sapiens
agactccgtatttccataaggtccaggtgatgctggcgatgccgaggctgctggtctgaccacacatggagtagccaggagttagagagaatctgttaacrgcctgcagagagctacgatgtttgctcctggtttgcatgagtgggtataccccgtggagagagagggtgctgaaagggcagttggaataaagagaaccct

SEQ ID NO: 32710 - DNA, 201 bp, Homo sapiens
tgcactccagcctggcaacagagcgagactccatctccttctcaaaaaaaaaaaaaaaatgttgaagatgggggcaacaaaggatttctttcttattctgaaaaaaaaaaatggtggaaacctgcaacagccagttggtgcagtgcattcttggggaaagtacccactatatacagtgaatgttacatgacgcatcagagg

SEQ ID NO: 32711 - DNA, 201 bp, Homo sapiens
acaatggaaagttggggaatgtaggatattgagtgaaacacaggcaaaataccattctttatcatttttcacaaataatcttcagtggaaataaatctccrattctttttcttttatcccatttaagtgccatgctgtccaaccggtctgacagtaactcaaatcacccagtcagtaatcaacgtgagctggactattggg

SEQ ID NO: 32712 - DNA, 201 bp, Homo sapiens
tagccagaatctaaaattttgaatgatatgtaggtgacaggaggttcaggatggcccttggtgatggaaggaggacagttcctcccaaggggctgttctcrttgtccctggctgtcatgctctgattccttgtttttccattatttggtccacaggacaagctggcccaaagcatagccctatgggaagggacaggaatag

SEQ ID NO: 32713 - DNA, 201 bp, Homo sapiens
aggccctcaccacctctcccctagactactgcaccagtcccatctccctgtcctcactccagcctctgtaatgctaccagagttatcattccaggacactsgtccaattgtgttacttttatgctgccacatcttcaaaacttttccatttccccataagataacattcaatcctctgggcatggtgttcacagtccctta

SEQ ID NO: 32714 - DNA, 201 bp, Homo sapiens
gaaactaacacttaatgaaactaacacttaatgaagacctactatgtctctggcactataagtatgttatttcatttaaatctcatgacaactcagtgagktgggttctattttctctttttttacataagaaaattgaagctcagagaagttaaataattttcctaagggcacaccgataataagtggtagagctgagat

SEQ ID NO: 32715 - DNA, 201 bp, Homo sapiens
gggaggattgcttgagcccaggatttcaagaccagcctgggcaacatagcaacaccccacctcttgctttattcttatttacttgtcttattcttgagagwtctttaggattagccaggaaactataggagggtctgcttggccatatacaaagtggcattttttttttttttttttttttttgagacagagtctctgtca

SEQ ID NO: 32716 - DNA, 201 bp, Homo sapiens; identical to SEQ ID NO: 6319

SEQ ID NO: 32717 - DNA, 201 bp, Homo sapiens
tccgttgccctggtggacaccatggtgtaccatccagatctcccctccagagttgtcctgaatccgggccaggagcactaacattcctttatccaccaatyactggatgtaggtggcccagggagcaggtatgactttgagccaggcagctctcatgagccaagggcaagtctgcaagagactgagcgggagctgtcaacc

SEQ ID NO: 32718 - DNA, 201 bp, Homo sapiens
ccagctactcgggaggctgaggccggagaatggcgtgaacccgggaggcggagtttgcagtgagccgaccagcctgggcaacagagcgagactccgtctcaaaaaaaaaaaaaaaaaaaaaatactaatcagctaccatggatgaagcgtggaccagcaaacttggtcactggcatgttgtataaatggctgcacctaaag

SEQ ID NO: 32719 - DNA, 201 bp, Homo sapiens
cagctactcgggaggctgaggccggagaatggcgtgaacccgggaggcggagtttgcagtgagccgaccagcctgggcaacagagcgagactccgtctcaaaaaaaaaaaaaaaaaaaaaatactaatcagctaccatggatgaagcgtggaccagcaaacttggtcactggcatgttgtataaatggctgcacctaaagt

SEQ ID NO: 32720 - DNA, 201 bp, Homo sapiens
tctgtattaaaaattcatactgcacaccaccttcacacatggatttctctctctctctctttctttctttccctccctccctctcttttctcttttttctytctttctttctgtctgtctttctttctttttctttcttttttttagacaggatctcgctctgtcacctaggctggagtgagtgctgtggcacaatcatag

SEQ ID NO: 32721 - DNA, 201 bp, Homo sapiens
ctctttctttctttccctccctccctctcttttctcttttttctttctttctttctgtctgtctttctttctttttctttcttttttttagacaggatctygctctgtcacctaggctggagtgagtgctgtggcacaatcatagctcacagcagccttgaactcctggccttaagccatcctcctgcctcatcctcccaa

SEQ ID NO: 32722 - DNA, 201 bp, Homo sapiens
tgaaatctggtgtgtcttttgtacttatagtacatttagttcaaactagccatatgttcaatagctacttcagtgtccactgtactggacagagaaattgtttttttttgtggggtttttttgtttgttttttattgagaaagggtcttgctttttcatccaggctagagttcagtggtgcaatcactgctcaatgcagcc

SEQ ID NO: 32723 - DNA, 201 bp, Homo sapiens
gttggttcatttatgtatatcttatcattaaggcattcaatttttaaactaagttttaactacctgcagcattccaggaattgtgctctttaattagattrtaaattattcaggggaaagagttgatctctcatttctttgagtttcctaaaagtccagcacagttcttggcacactggagggaacctcacagttctacgc

SEQ ID NO: 32724 - DNA, 201 bp, Homo sapiens
aggtgtgcacaactaccatgcccggctaatttttgtattttttggtagagatgggggtttcgccatgttggccaggccggtcttgaactcctgacctcagstatctgcccacctgggcctcccaaagtgctgggattacaggtgtgagtcactgcgcccagctgagcttggtatgcttattcttactgcttttcagataaa

SEQ ID NO: 32725 - DNA, 201 bp, Homo sapiens
tggggcattcccctgcagcaaggggcggggccaccccaacgccgcttctgcggccaaagtaggttgggagtggaaggtggtggctgctgctccgcagtgtsgggaagatggcgccgccggtggcagagagggggctaaagagcgtcgtgtggcagagtgagtgcggtggggtaggggttgagagagggaaggccgggaggc

SEQ ID NO: 32726 - DNA, 201 bp, Homo sapiens
ctacaaagtgtaaataaagtagccaggcatggtggcatgtgcctgtagttcccctgtagtcccagctacttgggagggtgaggtgagaagattgcttgagsctgggaattcaaggctgcagtgagctatgatagcaccactgcgctccagcctgggtgacagagtgagacaccagcatcaccagagagctttttagaaatg

SEQ ID NO: 32727 - DNA, 201 bp, Homo sapiens
atgatcacctgagcctaggagtgggcaacaaagtgagaccccatctctacaaaaaaattttaaaattaaccatgtttggtgacatgcacctgtgttcccasctacatgggaggctgaggcaggaggatcccttcagcccaggaggctgaggctgcagtggacattgattgtgccaccgcactccagcctgggtgacagagc

SEQ ID NO: 32728 - DNA, 201 bp, Homo sapiens
agccatgggaatcttgctggtctaaggttttctttgggttttctttgactcttggagtatcctaaagcttttcaaactttttttttttttttttttttttttttgagatggagttttgctctgtcatccaggctggagtgcagtggtgcaatctcagctcactgcaacctccacctctgggattcaagcgattctcgcgcc

SEQ ID NO: 32729 - DNA, 201 bp, Homo sapiens
gtttttccttgatctgaataataagggcaaaacttctgtctgaaggaaggcatgagaatgatttagcttgaagagtaaaatgatgaaagaagtcatcctcrtaggtatcttggctaatgtacaactctaaaacctctttcagctcctgaaatacccactattgatcaggcatattcaaaactcagcaacagtatcactgta

SEQ ID NO: 32730 - DNA, 201 bp, Homo sapiens
gttctgcggtatcatccacaactttcataaacatcgctccaaacctaggtctggcaggttagagaaagaatgaaaccacccaacaggaataaccatcattstttggtatctctgagttcaagataattatggcctagtagtggaaagggagtagcatctaattagtatttcttagtccaacttgttgaacaaaaaacaaat

SEQ ID NO: 32731 - DNA, 201 bp, Homo sapiens
gccatgggaatcttgctggtctaaggttttctttgggttttctttgactcttggagtatcctaaagcttttcaaactttttttttttttttttttttttttttgagatggagttttgctctgtcatccaggctggagtgcagtggtgcaatctcagctcactgcaacctccacctctgggattcaagcgattctcgcgcct

SEQ ID NO: 32732 - DNA, 201 bp, Homo sapiens; identical to SEQ ID NO: 6321

SEQ ID NO: 32733 - DNA, 201 bp, Homo sapiens
ccactttcacaggacccctccatggcagcgccatatggtctggcttttccgaacccatcaaaatttacttgtcttggctcatacacaaacatgcacgtgcrtgcgtgcacacacacacacacacacacactttccaagtgccctaacatacattatttcacttattctttacaacaatcctaaaatgcaggtattttaaat

SEQ ID NO: 32734 - DNA, 201 bp, Homo sapiens
agaatcccactttcacaggacccctccatggcagcgccatatggtctggcttttccgaacccatcaaaatttacttgtcttggctcatacacaaacatgcrcgtgcatgcgtgcacacacacacacacacacacactttccaagtgccctaacatacattatttcacttattctttacaacaatcctaaaatgcaggtatt

SEQ ID NO: 32735 - DNA, 201 bp, Homo sapiens
atgctactcagaatgcacacagcatggctccgccctctaatatccaactcaatttcagcattcacattcgacctcacacaaaagaagatgattcttgttargtttacccatcaccccttgtccctttctgggttcaggccaattagtataagaattgggccaaataggaattcatttgttcagcagatactgagtgagtgt

SEQ ID NO: 32736 - DNA, 201 bp, Homo sapiens
actaaagggcaacatactacataggtgttgatctcatttcattgttgatgctggtcacagcctgccctaaaaccaggtgtaaaacagacaatctctctctycagcctgtgtttgccgcatactcctcagaatcccactttcacaggacccctccatggcagcgccatatggtctggcttttccgaacccatcaaaatttac

SEQ ID NO: 32737 - DNA, 201 bp, Homo sapiens
gaggaatggagatgggtccagctggaggcagtgggatggctgtgggaccaggaggggagatcaatggcaaagcagcctgcaaaagtcacagaatgcccaaytggagtagaatactctggaagaaagcctctcaattattctctctcttcccagagttctttcccgtaattacttctcattcttatttagctcttttaaaag

SEQ ID NO: 32738 - DNA, 201 bp, Homo sapiens
cttcccagagttctttcccgtaattacttctcattcttatttagctcttttaaaagtacaaaaagtgcaaattaccccacaggcaattggggaaaactttraaatcccatccctgaatgagaggtttgagctttctggatctcttctggagagtagctttgtctttctttttctctgtttttccttgatctgaataataag

SEQ ID NO: 32739 - DNA, 201 bp, Homo sapiens
gtgccattgaaataatccttcacacttaacaggtccaggatgttctaaggcagtttgtgtataacacagtcatgatcatagggatgaccttgacttattartaaaagaactatgtttacaaactacggtgtgtctcctggggcccagaagtgtgtaatatatttcgggaagatttccactagagaaaactaaaatttttaa

SEQ ID NO: 32740 - DNA, 201 bp, Homo sapiens
agtctcatgtttattattgatcatttcctagttgcttgtgcacccggaagagtgacgatccaagaagatccccctggccacctgtctgtggcttggtccartgtagatctgggtgactactatgtggtctttgtgaagagtgatgatggcttggaagtacactgcaacacatctctcactcagtgcaacttcttatctgag

SEQ ID NO: 32741 - DNA, 201 bp, Homo sapiens
ttctgtaggggagagagggagcgaagccctttcctatagaattggcttccactggcaagtggctatgatgagcaggcctgagattttcctccagcatatayaagtgtcataattttctttcaatggcaaaagagactatcctgggtgatgttcaaggaatgtctggccagggcacagaggagactttgttcatttttgcag

SEQ ID NO: 32742 - DNA, 201 bp, Homo sapiens
tgtaattccagctactccagaggctaagacctgaaaatcacttgaacccaggaagcagaggttgctgtgagctgagatcacaccactgcactccagcctgrgtggcagagcaagaccctgtctctttgaaaaaacaaaacaacaacaacaacaaaaaaactacttatataactgtgagccctaccccccagttttatttgg

SEQ ID NO: 32743 - DNA, 201 bp, Homo sapiens
aactctggggacagaggaaacagaaggagttgagagacaccagaaaattagaggaaagaaggcatatagcacaggatcattagcttggggagcagaagagrggtgtgtgtgtgtgtgtgtgtgtgtgtgtgtgtgtgtgtgtgtgtgtgttggaagagggagcccctgctggggctttctattctgtaggggagagaggga

SEQ ID NO: 32744 - DNA, 201 bp, Homo sapiens
ctcactcagtgcaacttcttatctgagtgtggcttcacttattttattagtgtttttgcctataacaaggcagggcaaagtcctttgggtgacatattcarttataccacaggtaagtcccatttgatgtttgttaagggagttctgagatctctaacctcagcagcagaatggatcacctattccacttattgacttacc

SEQ ID NO: 32745 - DNA, 201 bp, Homo sapiens
ctcctgcgtgcaccctttcggctctagagtgtgacaccaagtacaacatcacagtgtattcattcaatgaagtccgaggcagcaatatgtcatgtactccscagttcataaccacaggtaaggcacagctatcattccactcactggtgtctgaatgattcaccccagctctgagcctcaggatgggcattcagtgagacc

SEQ ID NO: 32746 - DNA, 201 bp, Homo sapiens
agttccccacgcataggcactatgaatttggcccgcatgcatgacgtggttgaaaactgtgatgatctcactgggggcaaaatcagttttagaccaaatgrcacatgtgatatttttgactcatgctggttcaattaatactctaaaatgtcttagctccttgcagtcctgaaataaaaaatgtttcaagggatgcattct

SEQ ID NO: 32747 - DNA, 201 bp, Homo sapiens
cagaagaggggaatggctttccagtggaggggtcagcaatcttctctgcatagagaacaagggcgcacgtggcgtgggggaattgaggagtctggtgtggmagggagtggggggagtacagcagaaccttatagcttgcaatgaccttcaatgtcatgctgaggatttaccctctatgcagtggcaattaggccaagattg

SEQ ID NO: 32748 - DNA, 201 bp, Homo sapiens
tgtagttgttcaaccttgctctgaaagattgaactcgccacaaagatgtactcagtgagtgttctagcatgtgctgctgccagagagaaggcagtgcctcygtttcaggaggtcactctttccctgagaccaagacagacatacaatggccaagacgctacatggtgtggagggctttggagtaggacacctgggtttaca

SEQ ID NO: 32749 - DNA, 201 bp, Homo sapiens
tgaggcagaagaatcgcttgaacctgggaggtggaggttgactgcactccagcctggcaacagagcgagactccatctccttctcaaaaaaaaaaaaaaartgttgaagatgggggcaacaaaggatttctttcttattctgaaaaaaaaaaatggtggaaacctgcaacagccagttggtgcagtgcattcttggggaaa

SEQ ID NO: 32750 - DNA, 201 bp, Homo sapiens
aaacactgcaggctacccctaccagccctgggcccagcacttccctaaagcagaactgcctctgcagactagctgaccatgcagtgggaaggggcctgtcragatggcccacgggaaaatcatggcagatgcctgccttacagagaatgagttaggtcctcatgtcctcaaagaggccttcccggccgggcacggtagctc

SEQ ID NO: 32751 - DNA, 201 bp, Homo sapiens
aggggctctgccaattacagcactgacctctatggctccaaaggcattttcacgtgcaccccgagtgctggcctcagtttctgtgatgtcactgagatacyctgtggggatgtatacactgtgatggtctcaccagttgctaaaacaggattgaagcttactttctgtccaaaaaaaatatattcaggtaaagcaagttat

SEQ ID NO: 32752 - DNA, 201 bp, Homo sapiens
gcaatctcggttcactgcaagctctgcctcccaggttcaggccattctcctgcctcagcctctccgagcagctgggactacaggcacccgccactaccccyggctaattttttgtatttttagtagagacagggtttcaccgtggtctcgatcacctgacctcatgatccgcccgcctcagcctcccaaagtgctgggatt

SEQ ID NO: 32753 - DNA, 201 bp, Homo sapiens
tttttttagtgttggctgcaccaattctagaagtaagctctccaagttcagactccattcttgtgcagtgggaagctgtatatatggcaattgcattctcygtgtccattatgcgagccaatggcttggggagtatatggaaagagaatactacaaacacctccttgacattcaccagtttagaagccggaactctctaca

SEQ ID NO: 32754 - DNA, 201 bp, Homo sapiens
acaggcacccgccactacccccggctaattttttgtatttttagtagagacagggtttcaccgtggtctcgatcacctgacctcatgatccgcccgcctcrgcctcccaaagtgctgggattacaagcgtgagccaccgcgcccggccggcttcttaaataagtcgactttgggtggacagaatctaactctgccgtctct

SEQ ID NO: 32755 - DNA, 201 bp, Homo sapiens
ccgcgggccccatgacaggcctgtggggagagggtctgtgtcatgctagccttttagatgcctttcaaactgctccgtgaatgcatgatccggcctcctgkgtctgtggccagtttggctgtcattttcccaggaagttagttcattccaatgaacagaactggtaacataggagataagattaactctggggacagagga

SEQ ID NO: 32756 - DNA, 201 bp, Homo sapiens
ctggtaacataggagataagattaactctggggacagaggaaacagaaggagttgagagacaccagaaaattagaggaaagaaggcatatagcacaggatmattagcttggggagcagaagaggggtgtgtgtgtgtgtgtgtgtgtgtgtgtgtgtgtgtgtgtgtgtgtgttggaagagggagcccctgctggggcttt

SEQ ID NO: 32757 - DNA, 201 bp, Homo sapiens
aatataaaaattattaatagatattttgtacatttttcatactgtctttgaaatctggtgtgtcttttgtacttatagtacatttagttcaaactagccayatgttcaatagctacttcagtgtccactgtactggacagagaaattgtttttttttgtggggtttttttgtttgttttttattgagaaagggtcttgctt

SEQ ID NO: 32758 - DNA, 201 bp, Homo sapiens
gtgaagagtgatgatggcttggaagtacactgcaacacatctctcactcagtgcaacttcttatctgagtgtggcttcacttattttattagtgtttttgyctataacaaggcagggcaaagtcctttgggtgacatattcaattataccacaggtaagtcccatttgatgtttgttaagggagttctgagatctctaacc

SEQ ID NO: 32759 - DNA, 201 bp, Homo sapiens; identical to SEQ ID NO: 6318

SEQ ID NO: 32760 - DNA, 201 bp, Homo sapiens
ttaactgatgtctggttctgtccccagaaagtttgatttaatgggtctggggtgagagctgggcatcaggagttgtaaaagctcttcaggtgattctgaartatagccaaggctaagaactgctactttagagccgtgcttctcaaactttattgtgcacacacatcacctggggcctcgttaaagccagattctgatttg

SEQ ID NO: 32761 - DNA, 201 bp, Homo sapiens
aagacctgaaaatcacttgaacccaggaagcagaggttgctgtgagctgagatcacaccactgcactccagcctgggtggcagagcaagaccctgtctctktgaaaaaacaaaacaacaacaacaacaaaaaaactacttatataactgtgagccctaccccccagttttatttggtttactgtctggaaaggctgacagg

SEQ ID NO: 32762 - DNA, 201 bp, Homo sapiens
ttgtactgagttgtacatactatttgatttgttccttattcgtagcatctagtatcttaactctatgcttaagatgctccctggaggatgtaatgggcatragaatgtattctgtcattcagtgcatgagaggctgcagttagaaaaactttccaggttgcacacgggggctcatgcctgtaatctcaacacttcaggagg

SEQ ID NO: 32763 - DNA, 201 bp, Homo sapiens
tgcaacatattactgtgaattgaatgtgtgcttttctcctaataaatgattatctatttgactcccagtacgtagcacgtaactgttgcctgatatatttkaaatttaaaaaagaatgaatcaatgaatatacagctaagtgagtgatggaagtcttttgttctttctcctgctccatgcccacaatttcacccttagaga

SEQ ID NO: 32764 - DNA, 201 bp, Homo sapiens
tttatgaccccacagcacccttatctgtactgcaacatattactgtgaattgaatgtgtgcttttctcctaataaatgattatctatttgactcccagtaygtagcacgtaactgttgcctgatatatttgaaatttaaaaaagaatgaatcaatgaatatacagctaagtgagtgatggaagtcttttgttctttctcct

SEQ ID NO: 32765 - DNA, 201 bp, Homo sapiens
ataatgatagacatcctgggatgttggaaattaggaaacttgaacttttatttgcacagactgagaattatgactgaggaaaagttagaggatcagaaaarataaatttataaatcacaagctaggcttggcaatatgagtgggcagacaatctgtgatcacaaagcatggctgtcagcaactaccatctcaccagagctg

SEQ ID NO: 32766 - DNA, 201 bp, Homo sapiens
gaggtggaggttgactgcactccagcctggcaacagagcgagactccatctccttctcaaaaaaaaaaaaaaaatgttgaagatgggggcaacaaaggatktctttcttattctgaaaaaaaaaaatggtggaaacctgcaacagccagttggtgcagtgcattcttggggaaagtacccactatatacagtgaatgttac

SEQ ID NO: 32767 - DNA, 201 bp, Homo sapiens
caggtcccacttaagaccaactggagttgctgggaatagaatttggatatgaatagtttgtaaaagctccccagttgattctactatgcagtcagggttargtgccattgaaataatccttcacacttaacaggtccaggatgttctaaggcagtttgtgtataacacagtcatgatcatagggatgaccttgacttatta

SEQ ID NO: 32768 - DNA, 201 bp, Homo sapiens
taactctggggacagaggaaacagaaggagttgagagacaccagaaaattagaggaaagaaggcatatagcacaggatcattagcttggggagcagaagakgggtgtgtgtgtgtgtgtgtgtgtgtgtgtgtgtgtgtgtgtgtgtgtgttggaagagggagcccctgctggggctttctattctgtaggggagagaggg

SEQ ID NO: 32769 - DNA, 201 bp, Homo sapiens
ctgtgggaccaggaggggagatcaatggcaaagcagcctgcaaaagtcacagaatgcccaactggagtagaatactctggaagaaagcctctcaattattytctctcttcccagagttctttcccgtaattacttctcattcttatttagctcttttaaaagtacaaaaagtgcaaattaccccacaggcaattggggaaa

SEQ ID NO: 32770 - DNA, 201 bp, Homo sapiens
agggagtcactgtagtcatcagggagggcagtggcagaggctctgggcatgggaggtcaggacacagtgtacccccagctgcattgctcttgatgggaccrccattttccctctgctcctgctttcagctccctgttgtcctagtgacattaaccccgtgttggtgtccagtgacagagttgagattgtctggtctcctgt

SEQ ID NO: 32771 - DNA, 201 bp, Homo sapiens
tcttagctccttgcagtcctgaaataaaaaatgtttcaagggatgcattctccatgattaatgtgcactggcgatccactaatgatgatgctacttacacrgtgactgcccaaggggagaaaggactgtatcagtgcagcagcacaggagagtcctgcaccatgcggggcttgccctgtggctcagtgttctctgtcactg

SEQ ID NO: 32772 - DNA, 201 bp, Homo sapiens
ctttcccaacaggaagtctgatctgttgccagacttcttggttagatggctcatacatttatctagagaagcacactcttgcttgctgtcaaactttagamcaccatggaaggtctaagggcatcctgtgccagggaaactttttaaggaattttatctatgggataaaccccatattccctctagtgtctactggtggct

SEQ ID NO: 32773 - DNA, 201 bp, Homo sapiens
agtgttccacattcccctcaaattcccttttggtgtgctggcattgccatggtgctgctcctgcaagttctcaggaggaactgtggtgtcagggagcagargtttggggttggggtatagtggctgggaggaggggtgcaaagtatgtctcctaacgcttaccctgcctatgtcccctccactgccagctccagcaaggaa

SEQ ID NO: 32774 - DNA, 201 bp, Homo sapiens
cattggatataagtttttaaaccagcagttcccaaactgctgcacagtagaaatgcccaaggatcgttaaaaaatattgacgccaaacactctgatttaaytgagacagggcacaacctaagcactgagatgtttgtaagttgcccaggtgatctaatatgtagcagaatttagggactactcgtttaaacaaatgcttga

SEQ ID NO: 32775 - DNA, 201 bp, Homo sapiens
ccagaggaacccagggtcctcgttggcccggctgggaccattccactgccccagaataccagggggccatgacagcacccactgacagtaagagctcactycccttggctgcccttctcctgcatctcccaggcccccagagtctccccttcgatctttctccctagctctgtgtttggcctactccttctggctttcctc

SEQ ID NO: 32776 - DNA, 201 bp, Homo sapiens
tccactgccagctccagcaaggaagctgccacccaagagagcagagggagacatcaagccatactcctctagtgaccgagaatgtaagaggggcaagggtsgggtgtctgggcctggggtaccttaacacaagggaagagaatgctcaggggacccagggaaaggattcgttctctctaaagactcagatttcttgggctg

SEQ ID NO: 32777 - DNA, 201 bp, Homo sapiens
tcctgattaaccaagggctttgtccatctcatccagaggaacccagggtcctcgttggcccggctgggaccattccactgccccagaataccagggggccrtgacagcacccactgacagtaagagctcacttcccttggctgcccttctcctgcatctcccaggcccccagagtctccccttcgatctttctccctagct

SEQ ID NO: 32778 - DNA, 201 bp, Homo sapiens
gcttgtgtgccaagagtccatcgcagcaggcagggagtgggcatttcctttatttctctccctttctcttcacctctgacttctctgtttttctctccccygccccccgccatttcccatctcccttcctcccatccataacatccttccacagctcccttccccgctctgaggagagtcgatactaacagctaccctctc

SEQ ID NO: 32779 - DNA, 201 bp, Homo sapiens
tccctcagtaagcctccctctattccccaggacctatgatgcctactccactttctacctgaattccagtggcctcatttgtcgccatcgtctagataaaktgagtcctaggtagggctgggtggggtaaagggtagaacatttgtgtgcctcccccaactggcattaacctttctccctgcagctgatgccttcacactc

SEQ ID NO: 32780 - DNA, 201 bp, Homo sapiens
gatcctagtatggaggaacatctgtctgtcatgtatgagagactgagacaagaggtaagtcagtgcaaaagtggccttcgtctacagtgggaaggatgtgsgtaatccttggacgtacagggatagtcaactggattcttttttggaaccatgaggcaggcatagaaatatattataaacattttcctgagaaaatgatgt

SEQ ID NO: 32781 - DNA, 201 bp, Homo sapiens
taaaccagcagttcccaaactgctgcacagtagaaatgcccaaggatcgttaaaaaatattgacgccaaacactctgatttaattgagacagggcacaacytaagcactgagatgtttgtaagttgcccaggtgatctaatatgtagcagaatttagggactactcgtttaaacaaatgcttgaattcagctttgggacca

SEQ ID NO: 32782 - DNA, 201 bp, Homo sapiens
gccggacatggtacattctttcactgaccctctgccgtttcctggcctggaattattttgcacaccttcgtttggaggttttacagctgacccgccaccckgagaactggaccctgcaagcccggtggcggcttgtggggctgcccgtccacttgctctttttgcggttctacaagcgtgacaaagacgagcattaccggt

SEQ ID NO: 32783 - DNA, 201 bp, Homo sapiens
ggctgagatgagagaatcacttcaacctgggaggttgaggttgcagtgagccgtgatcacattactggactccagcctgggtgacagagtgaaaccctgtcacacacacacacacacacacacacacacacacacaaaagtactgaacaaatgaaaagtcctgtctcatatgttgagccttacaacctggtaaatttccgc

SEQ ID NO: 32784 - DNA, 201 bp, Homo sapiens
gctgagatgagagaatcacttcaacctgggaggttgaggttgcagtgagccgtgatcacattactggactccagcctgggtgacagagtgaaaccctgtcacacacacacacacacacacacacacacacacacaaaagtactgaacaaatgaaaagtcctgtctcatatgttgagccttacaacctggtaaatttccgcc

SEQ ID NO: 32785 - DNA, 201 bp, Homo sapiens
ctgagatgagagaatcacttcaacctgggaggttgaggttgcagtgagccgtgatcacattactggactccagcctgggtgacagagtgaaaccctgtcacacacacacacacacacacacacacacacacacaaaagtactgaacaaatgaaaagtcctgtctcatatgttgagccttacaacctggtaaatttccgcct

SEQ ID NO: 32786 - DNA, 201 bp, Homo sapiens
acactttgtagcttttcttaacacaaaagcaccccttctctcctaacttgggctctgaatactttcccaacaggaagtctgatctgttgccagacttcttrgttagatggctcatacatttatctagagaagcacactcttgcttgctgtcaaactttagaacaccatggaaggtctaagggcatcctgtgccagggaaac

SEQ ID NO: 32787 - DNA, 201 bp, Homo sapiens
tgagatgagagaatcacttcaacctgggaggttgaggttgcagtgagccgtgatcacattactggactccagcctgggtgacagagtgaaaccctgtcacacacacacacacacacacacacacacacacacaaaagtactgaacaaatgaaaagtcctgtctcatatgttgagccttacaacctggtaaatttccgcctg

SEQ ID NO: 32788 - DNA, 201 bp, Homo sapiens
gtagaatcccaataaattgttagactcagccacaaacattggatataagtttttaaaccagcagttcccaaactgctgcacagtagaaatgcccaaggatygttaaaaaatattgacgccaaacactctgatttaattgagacagggcacaacctaagcactgagatgtttgtaagttgcccaggtgatctaatatgtagc

SEQ ID NO: 32789 - DNA, 201 bp, Homo sapiens
tctgtattccttggatgtggaattcatcaatgagatcctcaacatacgtaccaagtgagaattggggcacaggtagggcactggggaggaaaagcacccaraggtatatacatgacccttttcacttcccagagaagttcctagactgcttctcacagctgttccccattccttagaagccagtttggttttctaattctg

SEQ ID NO: 32790 - DNA, 201 bp, Homo sapiens
ctagcttcccaagctcttccttcagtcccacgactacagtctgtattccttggatgtggaattcatcaatgagatcctcaacatacgtaccaagtgagaaytggggcacaggtagggcactggggaggaaaagcacccaaaggtatatacatgacccttttcacttcccagagaagttcctagactgcttctcacagctgt

SEQ ID NO: 32791 - DNA, 201 bp, Homo sapiens
ccatgcccaatcttcctttgcttcttcatcataaactgacagcatctccttgtcagggagacttttaaactctactaaatgaaatttccccatcagcaaartggagacaaaattatctaaaattagtaatacaaataaaaattcatattgattgtatgctgactctgtgctagagcttaatgtacatgaatagagtgtcat

SEQ ID NO: 32792 - DNA, 201 bp, Homo sapiens
agtcaatatgctatctccacctttccagagtgtcagtggcagagcagggatgagggacaagacctgacttcctgcatccctgaatgagagatctttaaaamatgattatataaaataattgacaaggaataagtgaacgaatcaccatgaatcgtcatccatttcagttttctaatttaaaaaacctggaaatgaaataat

SEQ ID NO: 32793 - DNA, 201 bp, Homo sapiens
gctgtggcccatgctgacgttgagggaacacctggaggtgtatgctgccgtcaaggggctcaggaaagcggacgcgaggctcgccatcgcaaggtacagaygggacctgcgattcctttgtgtcagaatgcagggagactgtagcactgatgatgaattcactaataaagaaccgagagtcaatatgctatctccaccttt

SEQ ID NO: 32794 - DNA, 201 bp, Homo sapiens
tcagcacaatccagtggaagtacagaggctacagaaagaacattaggctcaccttactcggaaaaactggctttgaggcagccatgaggatctggtgcacraaaggtctttccatttatcctttccatggagactattttttgttcagtcaacagacttactgccattgtccagtgtaatctcaggtgctagatcagatgt

SEQ ID NO: 32795 - DNA, 201 bp, Homo sapiens
tagaccctgcctgataccaacaggggtgtctcaaagctgactccaactgtttcacaccagaagtctgaaacatcaagaagcaggattaggaaatgaagccmtccaaagggaagtccattttgtgacaaaagtgtgaagctcagttttggcttcactgaatcagtggtgctgggagtatatgcaagcacaggttttctgtaa

SEQ ID NO: 32796 - DNA, 201 bp, Homo sapiens
aaatgttaaaaccaaatttttttaaacaaagaattgaagagaggaacagacataggttacttgcttattgagagacagtaagagttgagtaggaggttctyttttctgtggggaattactttgtcactagtgcacacaaagaaattgagatctatgaggaaaatattcaatatgtgaattttatattatttaagtgcaaat

SEQ ID NO: 32797 - DNA, 201 bp, Homo sapiens
acaaaacaggattttttttcctgccaagttatcagataattatcgtgagggaatacttttcaatattttgtcagtcttctaggcaatgttttgaaaagttrtacatacttgattgtggaagtgtatgagaaagagaaacagaaaaaagaaaacactgacttggaaatcaggagaacttgtaaccctggttacatataaatc

SEQ ID NO: 32798 - DNA, 201 bp, Homo sapiens
ttttttttttcctaaccgcttaattaactttgaagaaggaacttttatgttagtacctcagatgttaaaacaaacaaacaaacaaagaaacaaaaaaaaaatcacagtaagagtcttcccttgctgagttcctcattcatttgattttcccatggatttgcgattcaggcctgcggtgtatgctctttaaacaaagacagt

SEQ ID NO: 32799 - DNA, 201 bp, Homo sapiens
gccatagagattcattagagaacaagactattgaaaatactttttttgaggcagagtcttgctgtgttacccaggctggagctcagtggcagtatcttggytcactacacctctgcctcccatgttccagtgactcctgcctcagcctccagagtagctggaattacaagcaggcaccaccatgcccagctaatttttgaa

SEQ ID NO: 32800 - DNA, 201 bp, Homo sapiens
tacaggcgtgagccaccatgctggccaatacttatttttatagagtttaatgccttgaacattatgaggtccacttttcattattcatgagctaaagttgtgttatgagtcaggcctatcacagtatacattttatttttgatagacaccttgtaaaccatggaactggctctataagcctcatgttactaagcagtatat

SEQ ID NO: 32801 - DNA, 201 bp, Homo sapiens
agcctgttgatcatcaataacacaggtgaaaagaaaaataaaatttaaatccagaaataagttatttttattgttgaatagcacaggaggtgggggggggragtgaatcataagagaagaaaatgggtatttaaacttcatttatagaaaacaccttatgaggaacagtgcagatttactctgattttggagatgacaggg

SEQ ID NO: 32802 - DNA, 201 bp, Homo sapiens
taaataaaattcctggagattaatatgctaatttttctttattgtttagattattggtatttggaatcgcaatattccctttgattgttgaaaatataatrtatgctatgttaaatgaaaagatcgattgggaatttaaaaacgaattgtattttctctctcctggacaacttccccaggaaccccgtaccagcctgttga

SEQ ID NO: 32803 - DNA, 201 bp, Homo sapiens
atgtattgaaaatatatgttgtgagaatttatcattgtacagctagtatcaacttaaacgatgctagtcctaggactaaggcaatttgtttactcctcacrggatcatatgtcagaaggtatagtatgttgatattcaatgcagttgtcctttggtgatctgggatccatttggaaggacagtgtaggcaatgtttctcca

SEQ ID NO: 32804 - DNA, 201 bp, Homo sapiens
attacaggcgtgagccaccatgctggccaatacttatttttatagagtttaatgccttgaacattatgaggtccacttttcattattcatgagctaaagttgtgttatgagtcaggcctatcacagtatacattttatttttgatagacaccttgtaaaccatggaactggctctataagcctcatgttactaagcagtat

SEQ ID NO: 32805 - DNA, 201 bp, Homo sapiens
atcctcagatgttccctgcttcttagataccttcaggctgtgaaaggctcttaattaggggaatgaggtctgaatatattttttaaaaataaaaattgctkttagcttgttaatatacaaaattccactaaagtcttagtggggagaattctcagtatccactcttgtatattttaatgggtgataataatcattgtcatt

SEQ ID NO: 32806 - DNA, 201 bp, Homo sapiens
aaaaaagtccttcttttcctcttattcattccatcttgctcaaattattgtctgcagttacttcaggtttgcccagctgtgctcctcagataaggtctctyagtaagtaaatatgggactgttaccctggggacaactgcggctactgtgtgttctgtgtggaacgtggggaggggcctgacgggtcatcttttcccaggt

SEQ ID NO: 32807 - DNA, 201 bp, Homo sapiens
tgcttgctctggtgtgctctaggctgtgaatttttctcagctcgtatttcacggtcagacgttctcatctgctttcttcttcagggtcatatctaaaagtytgatctgatgatggcatcctttttcatttcctaagaaagattatatttatacaacatacatgtatggaatatgtacgtaaatgtttagaataaagtaaaa

SEQ ID NO: 32808 - DNA, 201 bp, Homo sapiens
ctggaggtgtatgctgccgtcaaggggctcaggaaagcggacgcgaggctcgccatcgcaaggtacagacgggacctgcgattcctttgtgtcagaatgcwgggagactgtagcactgatgatgaattcactaataaagaaccgagagtcaatatgctatctccacctttccagagtgtcagtggcagagcagggatgagg

SEQ ID NO: 32809 - DNA, 201 bp, Homo sapiens
tgagacttggtatatcacagaattgcatgaggagcatttagaatatctgtttttagccagggattctaactcagcagttttgggattgaacccaagtatcrtggatttcaaaatagctttgtagatttttctacaaagtttggtacaaagttaatggatcagcgctttaaatagcaatcgtttatttattaacagatgttt

SEQ ID NO: 32810 - DNA, 201 bp, Homo sapiens
atgaaactcagtctatttagaagcaagaaatattttctacattaatgaatgcatattacatttagcagcatgaattactctcaactcaaaatatggtttgscttatgacataaggcatgaaaggttccagcagagacctaaagtctctgaaatttaagaggaaaatcatgctgtcatctcttctagaaacctgttataatt

SEQ ID NO: 32811 - DNA, 201 bp, Homo sapiens
ttcagagctgatgatctttcccctatactactaaatgattgataccttagtagtagatatttaggtgtaatgattggctatttttatgcagaagatttttwaaaaatccctcagaggaatgatactcttgggaatttctttgcttttcaaagattgggcacaatgagatcaccatttttgtgaattattcttttggtatga

SEQ ID NO: 32812 - DNA, 201 bp, Homo sapiens
ctcatttgatgtgtactcttggaaaaatgagtaaattttatgagtctcagtgtcttctatgaaacaagattaatattgactttgtagggttgttatgagayttggtatatcacagaattgcatgaggagcatttagaatatctgtttttagccagggattctaactcagcagttttgggattgaacccaagtatcgtggat

SEQ ID NO: 32813 - DNA, 201 bp, Homo sapiens
gctataattgcaaaaccaacaagacctcatgagttaaataatttaagttagatttgtcgaagaatgcgaagaatgctaaatagagattaagattttaaggkttactctatttgacttagatgtgatggttccatgaggttagccacccctcttctggcaagacaataagctgcttccatgaaactcagtctatttagaagc

SEQ ID NO: 32814 - DNA, 201 bp, Homo sapiens
gaagaaatgacccccaatatcttttctcccttgatttctttcattcagatagaaaagtgatcatgtccaatgggagactgaagtgtgcaggttcttctatstttttgaaaagaaggtggggtcttggatatcacctaaggtaaagactttgggaatagattggatttatgtgtttgcaatactggtatatgaaaaaggtgg

SEQ ID NO: 32815 - DNA, 201 bp, Homo sapiens
ttcatcttgtccccctttctgcctctttctcttgtgcccacctctcttttatacttgctcctttcattctgtgaacccctctctccatggtttcatctggytttatatgataagttggaagaagtaagaaattctgaatcagaaattcttagatcctaatactctcctctctcatttgatgtgtactcttggaaaaatgag

SEQ ID NO: 32816 - DNA, 201 bp, Homo sapiens
gagaaaatgagagtgacatgaattttaaagagaaaggagcagtacctgctgacagatttgaaagggtcaaagattcttaccagaagaatggcaacaacatyaagaaaaggattctggctagtgggacaggagttcttggcaaaagcagaagcaatattgacagtcatcatcacatcatcacctgcacattagagaagagga

SEQ ID NO: 32817 - DNA, 201 bp, Homo sapiens
ttttgatttgcatttctctgatggccagtgatgatgagcattttttcatgtgtcttttggctgcataaatgtcttcttcattttggattttaaaagttgcrtattttctcatataggtacaacgaatattattggaattggacatgcaaaacattcaagataaccttgctaaacatttaagtgaaggacagaaaagaaagc

SEQ ID NO: 32818 - DNA, 201 bp, Homo sapiens
ttctcactgtgatttgaaaaaattatcacaaataaaagatcacagcagaaaatcagacatgacactgagaaacactgtatttttaaaatcaaaacacatayacgtatgattgcatgccttttatcctttgctgccatttatgcttaagttgttatggattcaaataaggcaagacaatattccagaggcaaggtacgtttt

SEQ ID NO: 32819 - DNA, 201 bp, Homo sapiens
gataatttttagtttttgagcatttttaataaagctgctacaaacattctagtacacatttcctactgaatatggacatttcattctgttcattacgttartataacaaacagaatagtggggctgagagtatacaaatattaatcttagtagctaccaccaaatattttcccaaagtggttgcatcaatttagttttaca

SEQ ID NO: 32820 - DNA, 201 bp, Homo sapiens
tttgtaaataagttaacataatttatataactttttgtctttatttaggctctcctggggtctaatctatgctggcttcatctttattatttccatattcrttacaattatcataacattcacccaaattatagtcatgactggcttcatggtcatatttatactcttttttttatatggcttatctttggtaagttgata

SEQ ID NO: 32821 - DNA, 201 bp, Homo sapiens
ttcatgagcttattttattttaaatttaatttatttgtataaatttaatgagtacaagtaccgttttgttacatggatatattatgtagtggtgaagtccrggcttctggtgtattcatcaccaaataatatacattgtacccattaaataatttctcattccccatccccctctgactctctcacccttccgagtcttca

SEQ ID NO: 32822 - DNA, 201 bp, Homo sapiens
tagtaactggggacacctgatgagcaagatagcacagtcctgactttcccaaagcttagtggaggcaaaggcagaccaaacttactcaagttaatacaagraacttaaatgttacaaaggacaagggcaaagggccaagggaggacacacaaggcacagctggtgtgttctagcgagtcagacaattcttctggggacgtt

SEQ ID NO: 32823 - DNA, 201 bp, Homo sapiens
cagtgtataatattgttgattgataaagacatcttgcagaataatacatacatatgatattattgatactgtttaatacaatagtcatactatttacacartacatgcacacagagctgttgcctaacacgtaggtaccaacgaggcacaatggcccagctgtgcttacagtcacttaattaattttggcatccttttttt

SEQ ID NO: 32824 - DNA, 201 bp, Homo sapiens
ctgagtaggcctcaggaaacttacaatcatggcagaagggaaagcaaacacgcccttcttcacatggtggcagcaaggacagatgcagactgaaggcaggraaaagccccttataaaaccatcatatctcatgagaactcactatcatgagaacagcatgagggtaactgcctatgattcagttacctcccactgggtccc

SEQ ID NO: 32825 - DNA, 201 bp, Homo sapiens
tcaagagtcttctgaaagtgttccagaaattgctttaaaactcaaaagtaaggggccaggtgcagtggctcacgcctgtaatcccagcactttgggaggcygaggcaggtggatcacaaggtcaggagttcgagactagcctggccaatatggtgaaactccatctctaataaaaatacaaaaattagccgggcgttggca

SEQ ID NO: 32826 - DNA, 201 bp, Homo sapiens
tacataatgaataataatgacaacgacaacaatagcaataaacacttagatttcattgaggatttggtgtgtgcgggaaactatgctaagtgatttacatstaccattttacatttaggcctgtgaaagacatgttaatatatctctcactttgcagatgacgaaactgaggcttctatttaatttttccagttactgtgg

SEQ ID NO: 32827 - DNA, 201 bp, Homo sapiens
gtcattcattttataagcaaggaaaatgaagttcaaagagaataagagaattgcccaatgtgagatggagggtgagtgccggagctgagactctaacccakgtgccctgactgcagcttgttttctcgcctggtcttcttacagttaacagttgatttctccagactttctcatgttgaagagagtataatcctgtaaaag

SEQ ID NO: 32828 - DNA, 201 bp, Homo sapiens
atcaggtgtttataacaggacttggaatcttaccagaaaccaattaccttttactcatcagtttctcaagaactacctgagcttattaggtctcttttctyctctgcatgtaaaactatatttttatatttgtactttaaatcattttctgtaataaatatatgaagtaatttctatagtatttatttgatgcttaaacaa

SEQ ID NO: 32829 - DNA, 201 bp, Homo sapiens
ttaacctggaagaatacagcctttctcagtgcacactggagaaggtaagtcaagtggtttgactttgtatcatctggtaaatttcacatgaaagcaacatrcattttcctgttcatttggaagaccaacaacttgataatctctcttccttctttccttcttctttgtctcctaattaggtattcttagagctttctaaag

SEQ ID NO: 32830 - DNA, 201 bp, Homo sapiens; identical to SEQ ID NO: 6336

SEQ ID NO: 32831 - DNA, 201 bp, Homo sapiens
tgtcactaattcctcccactaaaatgcaaactatatcaaggcaggagtacttgtctattttcttgactgttctgtttctgccatctaagagtgcctcacaygtagcagattcttagcgtataaatggtgaagtatgcacatgtggatatgtgaatctggtgacaactgtcatgcagactttttggtggggaagtccagcag

SEQ ID NO: 32832 - DNA, 201 bp, Homo sapiens
ttcttaataataaattgagttttagaagaaaaaatgtctctatgatgcttaaaacttcaaggcattctgcattgttgttagcaaggcttctttgcgcattsttttactattactgatcatattttgttgcctcttggttaattagatggagatgagcgccattattctcctttatttttcttgaattcatcatcttgtttc

SEQ ID NO: 32833 - DNA, 201 bp, Homo sapiens
tttgtgtcttcccaaatatttggtttcattcattctcctaaataccttttagatcacattttaaaaaaatttaataaatatgtttattgggtgatacaaayctgtttttcatgagcctattaaggataatgcaacccattgttaagactggaaaaaaaggacatataatggtttccttgttgggtgtccttttctacagat

SEQ ID NO: 32834 - DNA, 201 bp, Homo sapiens
cttaggcggtcaatgttgtagctctttaatggcaaggtggtacacactcactgagtgttaaagcaggtctggggctgcaaggcagtctaaaactgcctttygaccatccaacagtatatgcagtttctaatccacaagttttatctcttctttcttcacagtgatcatttcttagtggcatcattactcttccccacctgt

SEQ ID NO: 32835 - DNA, 201 bp, Homo sapiens
ttagtagagttgtgaaatttcaattttctactacgaaagagactggaggtgctgcctgctgagatccccatggatagtcaaattatcaactgccccagtgyttatagagttacttgattgatcagaggcttttaagttgcttccaattctacaattaggacggtatggcaatatctaacaaagctgaagttacaaaatgct

SEQ ID NO: 32836 - DNA, 201 bp, Homo sapiens
gggaaagaaagtcatttgatgcaaggactattcactaaagcttttggctccattgtggggcacctcaccccagatccacaccaaagcaagaaagtaggctyaggcggtcaatgttgtagctctttaatggcaaggtggtacacactcactgagtgttaaagcaggtctggggctgcaaggcagtctaaaactgccttttga

SEQ ID NO: 32837 - DNA, 201 bp, Homo sapiens
agcccatttcattgctgaacttatttcaaggtcaatcgtatgttcctactacaggatgactgcaaaaattgtagagtcatccaacatatatgtgttgagcrtgcagatgcatgtgtcaaaggacacatgagtaaccaagactgacaggccccagcctcaggtgagattccaggttagcagcaaagacagacattgaacaat

SEQ ID NO: 32838 - DNA, 201 bp, Homo sapiens
atcaagtttcaagtagtttgagcctggattatgatttacaacctatctcttttcataaaagttgattcaatctgaaggtaaaattacaagaaaacactttwttgaggttgtatctagtggatgtaatttattattcagacaaatttaagtaatcagacttttgatgttaatttgattagctctgagatttctgtttaaatg

SEQ ID NO: 32839 - DNA, 201 bp, Homo sapiens
ggctggcatgtaagaagaccttagcaagggcatttgctatatatattgatatttatatcttgccccccactccacattcaatttaaagtgattttgaaatmatgagtgcgtgtacacatacatatgtgctatgtatacatatttacatacattacatatgtatgcatacatgagcatgtgtacacatacatacacacatat

SEQ ID NO: 32840 - DNA, 201 bp, Homo sapiens
atgattcatatattgtattttatcttttttttcttctgcacttagttattttaaatactgttaatttttttgctcactgcaggcaggcaatccaggcagtygttaaaaacacagagagaggtgtcctcctgaccacccataacctggctgaggcggaagccttgtgtgaccgtgtggccatcatggtgtctggaaggctta

SEQ ID NO: 32841 - DNA, 201 bp, Homo sapiens
catggcatacaatgattaagatttgtatctcaggaaaaaaacatctaaataaataaaataggtcatggttattgaacaataatttcataactttgaaaagyagaaatgaataatctgatgattattctgttctgaatatagtacaatcagtaaacatctttaaaagtctttattctaaatgagatcattatgatgtaacca

SEQ ID NO: 32842 - DNA, 201 bp, Homo sapiens
gctcctcttttgaaaggtaggtgtactcatggcaaaaaaagagttactgatagatgtctatatactgttgataagttgtctacacattaatttgaagttamagtcatatattatgctaataacttaagtactaaaatagcatacaaatctggttagattattgctttctctcacaacaactagcctttgaaatattttcag

SEQ ID NO: 32843 - DNA, 201 bp, Homo sapiens
ctttattgaggttgtatctagtggatgtaatttattattcagacaaatttaagtaatcagacttttgatgttaatttgattagctctgagatttctgtttmaatgtaaagaacaagaaatggctattaacaggatgaaattaatttaatcactctattcatgtacttaaagttctctcatacaaggccaaaaatgtgaaat

SEQ ID NO: 32844 - DNA, 201 bp, Homo sapiens
ttattttatggtatttattgtttttcatgctatcttctggatacagttaatgtgaaagagagacatattttatatatcttcattctctgtagattttgctyttagatgaaccaactactggattggatcccttttccagagatcaagtgtggagcctcctgagagagcgtagagcagatcatgtgatccttttcagtaccc

SEQ ID NO: 32845 - DNA, 201 bp, Homo sapiens
gtatgctgactctgtgctagagcttaatgtacatgaatagagtgtcatttaagccctataacaacccatttagtatttccttttcatagatgaggaaggtraagctcagaaagtttagttcacttgaagatggacacacaacaagcatgtggcactgttaggatcttttatacataaaccttgcctttgttctttaagaat

SEQ ID NO: 32846 - DNA, 201 bp, Homo sapiens
agctccagaggggtacttggaaagacttgggagaaggaacttctaatgactcaaacccacacaggaccacaatggtgtccttcctgggcctcctcataaaygcttaacatatataaatatttaaaatttaaaagatgtaaatatttagggtgaattttccccataggaaacaaatggcaattgagataatcaaagagtctt

SEQ ID NO: 32847 - DNA, 201 bp, Homo sapiens
gtcatttgtttggaatggggaagaaatggagcaggaaggacaatgagaaagctccacagtagtctggttgagagacagtatggattgtttggtttttttttataatagccatgtaactttcaacatatacaggtttttattcattagcaatattgttaccttagccataaaaaggtaatccctctatcctcttgtcttgga

SEQ ID NO: 32848 - DNA, 201 bp, Homo sapiens
gttcaagcgattctcctgcctcagcctcccgagtagctgggattacaggcacgtgccatcacgtctgactaattttttttttttttttgtatttttagtaragatggggttttgccatgttggccaggctgtgttgaactcctggcctcaagtgatctgccctccttggcctcccaaagtgctgggattataggtgtgagc

SEQ ID NO: 32849 - DNA, 201 bp, Homo sapiens
taaaatgtgctccacccccaccttcccccaacttctcccttcttctcccacatccccactgtgcctccaaacctagccaatgtatacagtgttgactgggyacacctgtcacttggtctggattcttagctcaggtggagacctgaggctactgacaaaccagggaaagaaagtcatttgatgcaaggactattcactaaa

SEQ ID NO: 32850 - DNA, 201 bp, Homo sapiens
tgccccttcattaagtacaagatacaggaagatgccttattttgttatcccaaacaatgggtaattggttttgtttttgttttgttttgagacagagtctygctctgtcacccaggctggagtgcagtggtgtgatcttggttcaatgcaacctccacctcccacgttcaagcgattctcctgcctcagcctcccgagtag

SEQ ID NO: 32851 - DNA, 201 bp, Homo sapiens
tgaatgtatagctacatttctcccccagcttatgagaatgatccacaactatttacccaaagacaaaacaccaccaacttaattcaaatatttaaataatrtttgtgaacttatgcctaaatataactgtatttctttgctcatagccctactttcagactttgctattcgtttttgttctaagatgcatggaactaaaat

SEQ ID NO: 32852 - DNA, 201 bp, Homo sapiens
gttaccatgtgaagatggcctatctattccccatgccccttcattaagtacaagatacaggaagatgccttattttgttatcccaaacaatgggtaattgrttttgtttttgttttgttttgagacagagtcttgctctgtcacccaggctggagtgcagtggtgtgatcttggttcaatgcaacctccacctcccacgtt

SEQ ID NO: 32853 - DNA, 201 bp, Homo sapiens
tacatgtgccatgttggtgtgctgcacccattaactcgtcatttagcattaggtgtatctcctaatgctatccctcccccctccccctaccccagaacagwccctggtgtgtgatgttccccttcctgtgtccatgtgttctcattgttcaattcccacctatgagtgagaacataaggctaaagaattattaaccgagag

SEQ ID NO: 32854 - DNA, 201 bp, Homo sapiens
aaatcttgttttctgcagaaggcaaaggtcatataaattgtctttgcttcagtaaatctgaaataaggaatccctgactgtatagtaactacaacaattamttctgtttttgtactctcattctcttatgcatacttaatttggcacaattttttctttatgtacctaaaacttgccctgatacttgtcattatgaaaata

SEQ ID NO: 32855 - DNA, 201 bp, Homo sapiens
tcaagtaagtgagattatgcatggggaaggaagcaggtcgaatgtctgcaaaatgtcaagttcttttaccactaaaagtggtagagctttcattgtaatgyatcaagagagaacctgctatgtttaactataaatagaagtatattggagaaaaatggctggatggttattattttatggtatttattgtttttcatgcta

SEQ ID NO: 32856 - DNA, 201 bp, Homo sapiens
aagacatttatacatagtattccataaatattaactttaattatgtatatgacttattttaaaagtttgatatgtattttcttacttttctatggccttcycttattaacttcatattagaatcaaatattgaagattttataaaatcactgaagcatcaaaatatacttttggaagtagatgactttgaaaacagaaatg

SEQ ID NO: 32857 - DNA, 201 bp, Homo sapiens
ttaggagatcctcaagtaagtgagattatgcatggggaaggaagcaggtcgaatgtctgcaaaatgtcaagttcttttaccactaaaagtggtagagcttycattgtaatgcatcaagagagaacctgctatgtttaactataaatagaagtatattggagaaaaatggctggatggttattattttatggtatttattgt

SEQ ID NO: 32858 - DNA, 201 bp, Homo sapiens
gctgggtcaaatggtatttctagttctagatccctgaggagttgccacactgacttgcacaatggttgaactagtttacagtcccaccaacagtgtaaaartgttcctatttctccacatcctctccagcacctgttgtttcctgactttttaatgatcgccatactaactggtgtgaggtgatatctcattgtggttttg

SEQ ID NO: 32859 - DNA, 201 bp, Homo sapiens
aatatcaatgggttgagtatgtctgatacaatatatttgaacttgccttgtaggcctccaccatcatgttttccatcactttaatcaatcattttgacctragtatattgattaccaccatggtattggttccttcatataccttgcttggatttaaaacttttttggaagtggtaagaaatgttaccaactgtgtcatta

SEQ ID NO: 32860 - DNA, 201 bp, Homo sapiens
aaaaagttttaaaattatacctcttcacaaagacctcaagcagtttgcactaaaatttgcatttgcatacaaataacttataatttatttctaaatatgtrttgaaaatatatgttgtgagaatttatcattgtacagctagtatcaacttaaacgatgctagtcctaggactaaggcaatttgtttactcctcacgggat

SEQ ID NO: 32861 - DNA, 201 bp, Homo sapiens
attctgttttctgtcagattagtgagtgctttcaaactgcatgagcagctgaatgttcctgtgcagaaattaacagcaggaatcacgagaaaggtacgtgyggtgtgtgatgctctatggagagctggtgtggtatggcagcaaacaggggtgtttttctacattgcagttgtgttttgtgctgagcctcctgggaaactc

SEQ ID NO: 32862 - DNA, 201 bp, Homo sapiens
gaggaataattccataaaactcagttccagtgtcatcaatccttctttaccagttgagggcacaaaataatattgtattatattattattcaaattataawaattttcagatccaatcttctaacaaaatcttttacttacaaagacctcaaaattttctttgttcttctactgctgcctagtgacctaggaaagaaagta

SEQ ID NO: 32863 - DNA, 201 bp, Homo sapiens
agactggagcgcagtggcatgatcacagctcactgaaacctctgccttctaggttcaagcgatttttctgcctcagcctcccgagtagctgggactacagrcatgcaccaccatgcctggctaatttttttgcatttttagtagagacgggtttcaccatgttggtcgggctggtctggaactcttgacctcaaatgatct

SEQ ID NO: 32864 - DNA, 201 bp, Homo sapiens
caatggtgctggaaaaagttcatctattagaatgatatctgggatcacaaagccaactgctggagaggtagtgaggaaatggtttccatttccaaaacagraatttcatgatacgtatagattatatctttgtaagactatactatttttcttttctttttttttttttttttgcctttggataaattttatttttcccct

SEQ ID NO: 32865 - DNA, 201 bp, Homo sapiens
tagccagttttcccagcaccatttattaaatagggaatcctttccccattgcttgtttttctcaggtttgtcaaagatcagatagttgtagatatgcggcrttatttctgagggctctgttctgttccattgatctatatctctgttttggtaccagtaccatgctgttttggttactgtggccttgtagtatagtttgaa

SEQ ID NO: 32866 - DNA, 201 bp, Homo sapiens
tttcactggagcaaaaggtttatgttgttcagtatttcacttccaatattgatagtctgattctttctttcaggtgaaattttgggattgctaggacccartggtgctggaaaaagttcatctattagaatgatatctgggatcacaaagccaactgctggagaggtagtgaggaaatggtttccatttccaaaacaggaa

SEQ ID NO: 32867 - DNA, 201 bp, Homo sapiens
atatacccagtaatgagatggctgggtcaaatggtatttctagttctagatccctgaggaatcaccacactgacttccacaatggttgaactagtttacaktcccaccaacagtgtaaaagtgttcctatttctccacatcctctccagcgcctgttgtttcttgactttttaatgattgccattctaactggtgtgagat

SEQ ID NO: 32868 - DNA, 201 bp, Homo sapiens
ggtcaggaaaggcttcgagaagagcacttcagtaggaagtggcaagagtgaccccggctcaatccagggtcagccaggccagtgtggttgtgactgaatgmccaaggaagagagtgataagaaagatggccacagaagtcatgggataaagcgagaggtcaggagaaagggtcacacagggtaatctagattactctaaag

SEQ ID NO: 32869 - DNA, 201 bp, Homo sapiens
ttattattatactttaagttttagggtacatgtgcacaatgtgcaggttagttacatacatatacatgtgccatgctggtgtgctgcacccattaactcgycatttagcattaggtatatctcctaatgctatccctcccccctccccccatcccacaacaggccccagagtgtgatgttccccttcctgtgtccatgtgt

SEQ ID NO: 32870 - DNA, 201 bp, Homo sapiens
ataatatgagaaaataacatcaatattaacatagtatatatttatattaattctgtatggctttcattatttcatccttacatcaagcattggcttattcrgctttatttatattaatgatttacatttttattctttatgattttgaaaaaattcttggtaataaattgtaagcatctactattaatactagtctttttt

SEQ ID NO: 32871 - DNA, 201 bp, Homo sapiens
actaatcaaagggaatagttcagaatacctgattttcaacacgcaaaggttttgcataagctgagcacatatataattatgctgagttattaccaggagarctgtctgcaacagccagataccaaaaagcaattcaaaacaatgctgtgatttcatatttaagccatacattaatttgcattacttttattttaagaagaa

SEQ ID NO: 32872 - DNA, 201 bp, Homo sapiens
tggaggaggagtcattggagggttttaagcacagtgataagttcaggcttatgtattaaaaaagtagctcaggatactgtattgagaacagatgtttagarcaagaggggcagagatagcccaagtaggaaggggttgcaacaatccaggtgagacattataatgacctaggcctgggtgggagtatcatgagtaggggtg

SEQ ID NO: 32873 - DNA, 201 bp, Homo sapiens
gtccctgccctcatggagcttatattctggtggaaggacatggataataaactaaatggataatatgtgtggtgtcagatgggtggtcaggaaaggcttcragaagagcacttcagtaggaagtggcaagagtgaccccggctcaatccagggtcagccaggccagtgtggttgtgactgaatgaccaaggaagagagtga

SEQ ID NO: 32874 - DNA, 201 bp, Homo sapiens
agtccagtgagaggaactttccttcaaaaaatggcagaagacagaatctgcattatcatattatgaatgccccttgtatatacggcagcaagtgaatagakgaacaaaagaagaaatttgactttgttctttctaaggaaagatgataatgcagaaccacttcttaggcttgtgaactaacatggtgattaaggtgttctc

SEQ ID NO: 32875 - DNA, 201 bp, Homo sapiens
attgggataagaaggggctctgaaaaggcttgtctgtggcacttaagaaaaatattgtcaacccccagaaattttaccagtgccagcacctctctctgctrtgctttcagtaatagcatattactgtttcagtaataacatatgcttcagtaataacatatgctttctgcaaatgttaaaaccaaatttttttaaacaaag

SEQ ID NO: 32876 - DNA, 201 bp, Homo sapiens
ggccaggagttcaagactgccctggccaaaatagtgaaactccttctctactaaaaagacaaaaaattagctgggtgtggaggtgcatgcctgtggttccrgctactcaggaggctgaggtgtgagaatcacttgcacttggacctgggaggcagaggttgcagtgagccgagatcacgccactgcatgccagcctgggtg

SEQ ID NO: 32877 - DNA, 201 bp, Homo sapiens
ctttttatctagtggggtatctcaacccacattttcttctgcaaatttctgcaagggcatgtgagtaacactgagtctttggagtgttttcagaacctagrtgtgtccagctgtgaaactcagagatgtaactgctgacatcctccctattttgcatctcaggtcacccgatgacccgtgcctttatcacccatgctggtt

SEQ ID NO: 32878 - DNA, 201 bp, Homo sapiens
tgtatcaaaagaagaaaaaacacccccaaaagctggaaattcactgaaggcagagaaaaggggtgcagacgctctgcttctgcttccccagcagttcctcygacccccccaaaatattctccagcgggtttcccaagaggtcaaaggagaatgggtcctggccgccgaagaactccctgaagacgtcggctgggtcgcgga

SEQ ID NO: 32879 - DNA, 201 bp, Homo sapiens; identical to SEQ ID NO: 6480

SEQ ID NO: 32880 - DNA, 201 bp, Homo sapiens
ggtcctgtagatgatctacagggcactggacatgtttatgttgctcctttagtaataagcctgtcattctgatttgatgaaaggagatgaaaggagctggkagtgtgtctgatggtggcctactaacttatgtcttcagcttaaaaagaaagtagcttcaaaagggttccagaaacactttccatggacgtgtcactcttt

SEQ ID NO: 32881 - DNA, 201 bp, Homo sapiens; identical to SEQ ID NO: 6628

SEQ ID NO: 32882 - DNA, 201 bp, Homo sapiens; identical to SEQ ID NO: 6354

SEQ ID NO: 32883 - DNA, 201 bp, Homo sapiens
cggggcacgtccagcacctcgtagtagtccaccatgctggatggccagaacggcccaccaggcactggcacagcgagcggcaaggctgccagcacccaggygcaggcccgagtgctcggagacctgggccgcctggagagacgccccttatgacgcagccacatctcattggtcgaggcctatgagcgcctcgcatcccaa

SEQ ID NO: 32884 - DNA, 201 bp, Homo sapiens
ttttctaaaagtatggcaattttgaaaaattcatctttggtctttcataggtcttgtgtggagctactgcataatgaggccctgatcaggcacctgaatgytacttccttcgatgtggttttaatagacccaatttacctctgtggggcagtgctggctaagtacctatcaattcctgctgtgttttttttgaggaacatt

SEQ ID NO: 32885 - DNA, 201 bp, Homo sapiens
ctgctccttatgcaagccttgcctctgagctttttcagagagaggtgtcagtggtggatcttgtcagccatgcatctgtgtggctgttccgaggggacttygtgatggactaccccaggccgatcatgcccaacatggtcttcattgggggcatcaactgtgccaacgggaagccactatctcaggtctgtattggtgcct

SEQ ID NO: 32886 - DNA, 201 bp, Homo sapiens
ccttttgctctcatgcaaacttttcctcagaggtgaccctagaagatgggaccctttgtgatggactaccccaaggcaatatgccccaaaaggtcttcatytggggcataacccgtgccaacacaaaggtactttctcaattgtgtgtatggtgcctcacccaaacaatattacagatgcacttggctttcatcaacctaa

SEQ ID NO: 32887 - DNA, 201 bp, Homo sapiens; identical to SEQ ID NO: 6557

SEQ ID NO: 32888 - DNA, 201 bp, Homo sapiens
acctgcacatgtactcctgaatctaaaataaaagttgagtatgtataagaggaagtcattcatcataaaggtctccatcctcatcatcttccattgagtgrgctgtggaggaggaggagtagatgttggtcttactgtcttagggtggcagaagcagaagaggtagaggaggtggaagtggaggcaggagaggcaggtgca

SEQ ID NO: 32889 - DNA, 201 bp, Homo sapiens
cagaagattagtgaggaccaaggcttcgagatggccaggagaggaaagcttgggagcagggaaggttgagatatatgtgggttactgggaatgcgtgatgktgaagtcacagatgacccacatggtgtctaagtgctaaagaagaattctgggaaaatgaaatgcatttgggaagggaaaatctaattaaaagcctaaact

SEQ ID NO: 32890 - DNA, 201 bp, Homo sapiens
caacatatcctacattgctttttatctagtggggtatctcaacccacattttcttctgcaaatttctgcaagggcatgtgagtaacactgagtctttggartgttttcagaacctagatgtgtccagctgtgaaactcagagatgtaactgctgacatcctccctattttgcatctcaggtcacccgatgacccgtgcctt

SEQ ID NO: 32891 - DNA, 201 bp, Homo sapiens
atgttccttaaggtgttgcctgacacacactgcttagctcatccatgaaggtatcaagaaaacctgcagaatataattctgtccagtgcaacaaatattcyggttgattttctttgtgcagggctgcatttgtctgtttggattgctgtaaaggatacctgaggctgggtaatttataaagaaaagaggtttaattggctc

SEQ ID NO: 32892 - DNA, 201 bp, Homo sapiens
gctgcctgtcccatcactaccgtaggacatgcagaaggaagaaaggcccccacttcccagggagccaaaggaacgaaatcctgtatcaaaagaagaaaaamcacccccaaaagctggaaattcactgaaggcagagaaaaggggtgcagacgctctgcttctgcttccccagcagttcctctgacccccccaaaatattct

SEQ ID NO: 32893 - DNA, 201 bp, Homo sapiens; identical to SEQ ID NO: 6372

SEQ ID NO: 32894 - DNA, 201 bp, Homo sapiens; identical to SEQ ID NO: 6646

SEQ ID NO: 32895 - DNA, 201 bp, Homo sapiens; identical to SEQ ID NO: 6606

SEQ ID NO: 32896 - DNA, 201 bp, Homo sapiens; identical to SEQ ID NO: 6376

SEQ ID NO: 32897 - DNA, 201 bp, Homo sapiens; identical to SEQ ID NO: 6609

SEQ ID NO: 32898 - DNA, 201 bp, Homo sapiens
cctgtcccatgggttgtgtccaaaggtggaatctgttatcaatgtggatttctaatgggagtaacttcctccataagggaagcctcagcctcaccagcaayggcagacatggccaggcatgtagacacagaggtagtgagatggaaagtgggcacagcccagagagcctgcccacctcatcctggggcgaccaggacaagg

SEQ ID NO: 32899 - DNA, 201 bp, Homo sapiens
gtgcagcccagacccctcctcatctccagaccctggaagctgatgccttgggcagctcctcctatttcccaggcaccaggaatgtgagcttctccctcccyacagtcctgctgtcctcagggcccctatgtctctgaaggcaccaccatcttccaagatacatgggcctccgcagggtctaggagtgccagacacgtaacc

SEQ ID NO: 32900 - DNA, 201 bp, Homo sapiens
ttacatttcagtattctaatgtgtgtgtgttgattagtgatgtgtaaataattcagcagaacattgaaatagttttaatgagaaaaagaggaagtcactcytagtctctttgaatttttggtgagttccaacagaattgatgactggttttaggggaaaagaattcaggcttcatctataccatccatggtaggtgcagct

SEQ ID NO: 32901 - DNA, 201 bp, Homo sapiens
agtgctgaactgaacattctgtcctaccactagcaaataatcattgtctgcctcaggcttaagtttaataaatagcaaattgcatacagatattttacaaygattgaaagacaaacagaggtcctatccgtgtagtcccaacgataagaacaggtgttggcatgaagtgtttataaattcttgggtacagctgttctgaaa

SEQ ID NO: 32902 - DNA, 201 bp, Homo sapiens
ggagaacatggaattgtggttttctctttgggatcaatggtctcagaaattccagagaagaaagctatggcaattgctgatgctttgggcaaaatccctcrgacagtaagaagattctataccatggcctcatatctattttcacaggagcgctaatcccagacttccagcttccagattaattctcttaattggaacctt

SEQ ID NO: 32903 - DNA, 201 bp, Homo sapiens
gcccaacatggtcttcattgggggcatcaactgtgccaacgggaagccactatctcaggtctgtattggtgccttcatccaatcaatgttccaggcaaaayactttttaaaaaatgtatttacttacaagtgcttccatatctacttatctttccaaagattttattttggcttctttataacagataaactgttgagggg

SEQ ID NO: 32904 - DNA, 201 bp, Homo sapiens
tggagaacatggaattgtggttttctctttgggatcaatggtctcagaaattccagagaagaaagctatggcaattgctgatgctttgggcaaaatccctyagacagtaagaagattctataccatggcctcatatctattttcacaggagcgctaatcccagacttccagcttccagattaattctcttaattggaacct

SEQ ID NO: 32905 - DNA, 201 bp, Homo sapiens
agaggacccctgttttctagttagtatagcagatttgttttctaatcatattatgttctttctttacgttctgctctttttgcccctcccaggtcctgtgrcggtacactggaacccgaccatcgaatcttgcgaacaacacgatacttgttaagtggctaccccaaaacgatctgcttggtatgttgggcggattggatg

SEQ ID NO: 32906 - DNA, 201 bp, Homo sapiens
ctccaaccagccatggtctccaaaaaggatgggaaaaagaggttggggaaaagagagggccttgactttggctgcctgaagaactgtttttcttaaagtargctttatatcagtctttttcctcggccacaggagggaagagggtggtgggagtgagtttagtctgaccggggctgaagacatcctgttgtttaggactgc

SEQ ID NO: 32907 - DNA, 201 bp, Homo sapiens
aaagggagggagtgtgacgaggcgtgtccagccttctgtcccgtcgtggctgtgactcagttttgaaggtttctttggggtcccgctggccaggagggttygattcacttgttgtgggagacgggcggcacttagtattttcttttcagtttacacgttcctgggcatccctattaagatgtgcagataaacacgcacatg

SEQ ID NO: 32908 - DNA, 201 bp, Homo sapiens
acctctcttctttacacctgctgatttctctgttaacaatttgaacagttggcagtagccactgtgaaaaggcaagggtgaggggatggggataactgaamtggttccagggattctggggcatgaaataaaaacatagaatgtcaggattcttttaattgggacataatatagttgtacacatttggggggttcatgtga

SEQ ID NO: 32909 - DNA, 201 bp, Homo sapiens; identical to SEQ ID NO: 6481

SEQ ID NO: 32910 - DNA, 201 bp, Homo sapiens
gggcagtcttgtaggactgagcccttaacctgtggggtccgtgctaactcagaattcagttcagaatggaattgaattgtaggatacccagctggtgttasagaataggtccgtgtgcaagaaaaattcccgcacatcatggacataacagacaacgtcaatgatgaggaatccagcaagttcgggatagagaattggcag

SEQ ID NO: 32911 - DNA, 201 bp, Homo sapiens
ggtgaggtggggttattcaggtggcagccgatgcaatgattcagaagggacagctgggggttgggggacaggggggctggggccctgaaatgggaccatgrcagctgggtctgagagacagtggtagaaacatccagattcagcacttacttgctggcttggatgcagggtctagaacgaaaagagaagaaaagtcacttc

SEQ ID NO: 32912 - DNA, 201 bp, Homo sapiens
cttgttctttgtactttttcctctggctattcatccgtattgtttgcaatatcctttgtaataaaccaaacctagtaaataaactgttttcttcagttctrtgagccattctagcaaatgattgactccaagaaagagggtgtgtgaacctctgatttttgccaagtcagacagaagttgtgggtaacctggggacctact

SEQ ID NO: 32913 - DNA, 201 bp, Homo sapiens
tcaaaggaagtttggggaacagcaagggatccagaatggctagagggtaagaggcagagggagggggcaagcagaagggctagagaggaggaatgagcttrgacaggtgggctggggtctatcccagagttttgagagcaaggcagaggactctgaattttctgtgcccaggaagctgctgaccaaggttccagaagtggt

SEQ ID NO: 32914 - DNA, 201 bp, Homo sapiens
ctggttatgttccccatgggggccagccctgtccttggagtggcccctctaatcatgttgctcaggcttcttctcccttcctgggccccagaacacctccrgtgccaaacttgtgggtgggaacaggaactcgcgtgccagccaggtgtgcatgactagctctgggcaagtctgttctagtaattcaaggtaccacctctc

SEQ ID NO: 32915 - DNA, 201 bp, Homo sapiens
gtttatataacctctagttacataacctgaaacccggacttggcacttggtaagcacgcaatgaacagtcatagtaagctggccaagggtagagttcagtktgaacaaagcaatttgagaacatcaaaggaagtttggggaacagcaagggatccagaatggctagagggtaagaggcagagggagggggcaagcagaagg

SEQ ID NO: 32916 - DNA, 201 bp, Homo sapiens; identical to SEQ ID NO: 6483

SEQ ID NO: 32917 - DNA, 201 bp, Homo sapiens
attttaagtctcaaacattttgcaggtcctttgaaatcttgcaggtgggtcctggctccattacttatgggtcgtaggtcatacaagggtctgaaagagtkagcaccttagaagcaaacctctccatagggtccacgtttccagaccttcctattcccaacatgaaattaccttcatgcacatctttgggtctctcctcta

SEQ ID NO: 32918 - DNA, 201 bp, Homo sapiens
aactttgaacttcagagagatgatctgaaattggaacttatgtttaaaagggaagcagagcataaaagtttggaaaatttgcagcctgaccatgtggtagmaaagaaaaacccattttatggggagaaattcaaaccagctacagaaatactggctatagaaatttgcataagtaaggaggagccaaatgttaattgccaa

SEQ ID NO: 32919 - DNA, 201 bp, Homo sapiens
tatagcagtgtgagaatggactaatatattaaattggtgccatggagagtggagtactgctataaagatacttgaaaatgtggaagtgactttggaactgrgtaacaggcagaggttggaacagtttggagagctcagaagaagacaggaagatgtgggaaagtttggaacttcctagagacttgttgaatggttttgacc

SEQ ID NO: 32920 - DNA, 201 bp, Homo sapiens
tttcctgaggctcccccctccagccacctggaactgtgagtcaattaaagctctttcctttatgaattaccgagtcttgggtatgtctttatagcagtgtragaatggactaatatattaaattggtgccatggagagtggagtactgctataaagatacttgaaaatgtggaagtgactttggaactgggtaacaggcag

SEQ ID NO: 32921 - DNA, 201 bp, Homo sapiens
agacgggcggcacttagtattttcttttcagtttacacgttcctgggcatccctattaagatgtgcagataaacacgcacatgcttcatgtggcatctccyttagttaaacatcttttttttttttcctttcctgtgagtcttcctgaaacaggtgagcccaggtggagcctccgcctgcgttaggacctaacctttctac

SEQ ID NO: 32922 - DNA, 201 bp, Homo sapiens
agatttatcatgatttggctctgtatcccccaccaaatctcatcttgaattgtaatccccataatccccacgtgtcaaggacaggatctggtgggaggtgmttggatcatgggggcagtttcgcacctgctggtctcatcatagtgagtgagttcttatgagatctgatggttttataaggggccattgtcccttcacttg

SEQ ID NO: 32923 - DNA, 201 bp, Homo sapiens
tgagaggaagaagaggcagacatgaatgtttatcaaaggatggactaggactgatgtgactcatggagactgttcgtttgtaaaggcaccatcttcatggytgtgcatgtccttcattgggaaggagcagggacactacattgagacttgacccatctggattttttgtttgcacaattttcaggggaaagatgatgcaac

SEQ ID NO: 32924 - DNA, 201 bp, Homo sapiens
agagaacactagcaaggctaattttcgagtgtggtaaagaacaggctaatgtattcaatagtgaggccactgactctgtctcaacatgaagtcacactagrtttatcatgatttggctctgtatcccccaccaaatctcatcttgaattgtaatccccataatccccacgtgtcaaggacaggatctggtgggaggtgatt

SEQ ID NO: 32925 - DNA, 201 bp, Homo sapiens
gcatgttccaccctcaccccgggctcatcaggagggttcttaagatgcagacagttttaagggggttggaggaatagttgagaagctgagatgttgcaccyacagctgagaatccctttctagcactctgtgtcctcacaaatccccagaaatcgtcctcccctggggagttctcaagcccttacagacctgccctctctg

SEQ ID NO: 32926 - DNA, 201 bp, Homo sapiens
aatagaacatgggagccccttgaatgtggcaagagcaccctcccaggcatgttccaccctcaccccgggctcatcaggagggttcttaagatgcagacagytttaagggggttggaggaatagttgagaagctgagatgttgcacccacagctgagaatccctttctagcactctgtgtcctcacaaatccccagaaatcg

SEQ ID NO: 32927 - DNA, 201 bp, Homo sapiens
gaggacccctgttttctagttagtatagcagatttgttttctaatcatattatgttctttctttacgttctgctctttttgcccctcccaggtcctgtggyggtacactggaacccgaccatcgaatcttgcgaacaacacgatacttgttaagtggctaccccaaaacgatctgcttggtatgttgggcggattggatgt

SEQ ID NO: 32928 - DNA, 201 bp, Homo sapiens
acgttctgctctttttgcccctcccaggtcctgtggcggtacactggaacccgaccatcgaatcttgcgaacaacacgatacttgttaagtggctaccccraaacgatctgcttggtatgttgggcggattggatgtataggtcaaaccagggtcaaattaagaaaatggcttaagcacagctattctaaaggattgttga

SEQ ID NO: 32929 - DNA, 201 bp, Homo sapiens
tacgttctgctctttttgcccctcccaggtcctgtggcggtacactggaacccgaccatcgaatcttgcgaacaacacgatacttgttaagtggctacccyaaaacgatctgcttggtatgttgggcggattggatgtataggtcaaaccagggtcaaattaagaaaatggcttaagcacagctattctaaaggattgttg

SEQ ID NO: 32930 - DNA, 201 bp, Homo sapiens
agccttcggcattcagaagaggaattcagactgtgcaagatctgaggccaggctccagctcccccagtcccttggtgagcaggagctccctgaacccaccrtgggtctttgctagggttgtcttgcccatgtgtgctttagatagcagcacctcttcttccatggtgtatatggagaatcctcaacaaagtcttcccaaga

SEQ ID NO: 32931 - DNA, 201 bp, Homo sapiens
ctttggagtgttttcagaacctagatgtgtccagctgtgaaactcagagatgtaactgctgacatcctccctattttgcatctcaggtcacccgatgaccsgtgcctttatcacccatgctggttcccatggtgtttatgaaagcatatgcaatggcgttcccatggtgatgatgcccttgtttggtgatcagatggacaa

SEQ ID NO: 32932 - DNA, 201 bp, Homo sapiens; identical to SEQ ID NO: 6685

SEQ ID NO: 32933 - DNA, 201 bp, Homo sapiens
tggagtgttttcagaacctagatgtgtccagctgtgaaactcagagatgtaactgctgacatcctccctattttgcatctcaggtcacccgatgacccgtrcctttatcacccatgctggttcccatggtgtttatgaaagcatatgcaatggcgttcccatggtgatgatgcccttgtttggtgatcagatggacaatgc

SEQ ID NO: 32934 - DNA, 201 bp, Homo sapiens
aagttgtactcagttatattgagaaactgggctctaatgaatgtactttttgagccctgtgaccctgtatctggtgcttgaccttgtttgtgtctcaactstattcccagcatgtcgtcctagagaacattctgtattatgatatgtaattatcaacatgcacttttaattattaggaattaaattaaagtgatcaaaata

SEQ ID NO: 32935 - DNA, 201 bp, Homo sapiens
tggtgatcagatggacaatgcaaagcgcatggagactaagggagctggagtgaccctgaatgttctggaaatgacttctgaagatttagaaaatgctctaraagcagtcatcaatgacaaaaggtaagaaagaagatacagaagaatactttggtcatggcattcatgataaaattgtttcaaatatgaaaacatttacgt

SEQ ID NO: 32936 - DNA, 201 bp, Homo sapiens
aaaatctggtagtcttcttaagcagccatgagcataaagagaggattgttcataccacaggtgttccaggcataacgaaactgtctttgtgtttagttacwaggagaacatcatgcgcctctccagccttcacaaggaccgcccggtggagccgctggacctggccgtgttctgggtggagtttgtgatgaggcacaaggg

SEQ ID NO: 32937 - DNA, 201 bp, Homo sapiens
tccggcattttgttttttgggaccctaatgaaatggttacaggtctccaggtctcttggggctcacagggtcatgcctttccttgcccagtgtacttggtragaaggtacaggtgtttccatggagggtgttcattttagggatttcaagagggtcatctttgcaccacaggaaatgcccccttttacactctgaaaacct

SEQ ID NO: 32938 - DNA, 201 bp, Homo sapiens
aatggcacccatcctcccctatggttaaatgttacgttactatagcatattatcacaactcattaaccaacatttgatacattatgatgaactaaagtctrtgttctctgcagatgtcattaatttttacctaatgtcctttttcatttctaggatcccatcctggataccaaatgacatttagcccatcacgcccccttc

SEQ ID NO: 32939 - DNA, 201 bp, Homo sapiens; identical to SEQ ID NO: 6515

SEQ ID NO: 32940 - DNA, 201 bp, Homo sapiens
aggagggacgtggccgtctcagagggctgcttggtttctgtccaagctggcccttggggaagccctttggccacccaggtggtgattcctgctgtaagaasatgagaggctgagccaccaggcagtcccagatgtcctgaaacaacttatcccagccctgcccagggccttctctctagccctgtgcacctcatcacctgc

SEQ ID NO: 32941 - DNA, 201 bp, Homo sapiens
aaaagctgcattttttataataaaattttatgtagataatcatgatacagaattactctttgacaaattatctatggatgtaatgactctagtttcagactttttttttctgaaatatgtgagcgttccccaacagtctggtctattttcctaccttaattttctacttttggtcttgaatttgttgatagggcacagagg

SEQ ID NO: 32942 - DNA, 201 bp, Homo sapiens
aggggtgcagacgctctgcttctgcttccccagcagttcctctgacccccccaaaatattctccagcgggtttcccaagaggtcaaaggagaatgggtccyggccgccgaagaactccctgaagacgtcggctgggtcgcggaagctgaagacgtactcgaaggggtcctcgaagggcctgccgcctgtgcagccgccctc

SEQ ID NO: 32943 - DNA, 201 bp, Homo sapiens
gttaactctatgcagttatgacttaatgctgcaaacttacctttgttacttttctcttgactacaaatggtgtcatgtatagtctgtaagtgtttgtgtgyataagttttgataaattttaactatttaaaatagatttgtgtctataatatggtagtaaatgataaaatagactcgttgctatatatattttaggcattc

SEQ ID NO: 32944 - DNA, 201 bp, Homo sapiens
ggactttgtgatggattaccccaggccgatcatgcccaacatggtcttcattgggggcatcaactgtgccaacaggaagccactatctcaggtcggtgttygtgccttcatccaatcaatgttccaggcaaaacagtttttaaaaattgtatttacttacaattgcttccatatctacttatctttctggtgcttttattt

SEQ ID NO: 32945 - DNA, 201 bp, Homo sapiens
tccctacagtcctgctgtcctcagggcccctatgtctctgaaggcaccaccatcttccaagatacatgggcctccgcagggtctaggagtgccagacacgwaaccagaaatcagatgacatcactatctaaataaaacaccactacatggaaatagaacaccactacatggaaatagaacatgggagccccttgaatgtgg

SEQ ID NO: 32946 - DNA, 201 bp, Homo sapiens; identical to SEQ ID NO: 6461

SEQ ID NO: 32947 - DNA, 201 bp, Homo sapiens
ttcttccagtttttcaatgtgaacatattctctagtgttaactacattgctcaaaacttcactgtcatctcagtggagcagaacgaattgggaactgtggyacagatcactcttgctatgccccttagagaattagagaacactagcaaggctaattttcgagtgtggtaaagaacaggctaatgtattcaatagtgaggc

SEQ ID NO: 32948 - DNA, 201 bp, Homo sapiens
aagagaagcagcaatatgtatgcattgcagagacacaggcgagccccaatttaggaggttaggaggtcagtgctaagggccttgttttctttgcttagagyatgagttgccatcttctctggacagagagtatttggttgcctaaaggtaaaatctaaattttgctctgggacaaattccaaaaaaaattagctttaatca

SEQ ID NO: 32949 - DNA, 201 bp, Homo sapiens
gcaaacctttcctcagaggtgaccctagaagaagggaccctttgtgatggaaaaggtcttcatttggggcataacctgtgccaacagaaaggtactttctygttgtgtttatggtgcctcacccaaaaaatattacagatacacttggctttcatcaacctaatttgatatgtcccaagcatagcaataggatagttctgt

SEQ ID NO: 32950 - DNA, 201 bp, Homo sapiens
ccatcttctctggacagagagtatttggttgcctaaaggtaaaatctaaattttgctctgggacaaattccaaaaaaaattagctttaatcaaatttactyttactttatctttctgaaccttcaaggtccaaaagcattggttaataattctgcttctaaacttaacattgcagcacagggcatgttctgcccccaaggc

SEQ ID NO: 32951 - DNA, 201 bp, Homo sapiens
tcagcctatccagttcagttgccttttgctctcatgccttatgcaaacctttcctcagaggtgaccctagaagaagggaccctttgtgatggaaaaggtcytcatttggggcataacctgtgccaacagaaaggtactttcttgttgtgtttatggtgcctcacccaaaaaatattacagatacacttggctttcatcaac

SEQ ID NO: 32952 - DNA, 201 bp, Homo sapiens
agtgagtatcttcacacatgtaagttccctcgtctgatgtacaaaaaactgaactcatttttcaaaagccttaacagtctgtcttattctgatacttcttktatggttattgtatgagaatcaactacccaggcacctcggagcatgttgatttcagagttcagtgtcagaccccatgagcccctgtgggatggtgccagc

SEQ ID NO: 32953 - DNA, 201 bp, Homo sapiens
tgaaggagggcactggagtgatggcgtgtttagaatgtgcaagttgagcggtcactgagaggcagctcagcagagtgctctcgcaaggattgggcgggcamcttcccactgcgtgcgatgtatcttaggaaagccatttaaaataggagacggttactttccatcaagtccctggtatggtccatggaagcagggttgtca

SEQ ID NO: 32954 - DNA, 201 bp, Homo sapiens
ctctcaccttctgtcatgattgtaagtttcctgaggcctccccagtcatgtggaactgtgagtcaattaaacctctttcttttataaattacccagtctcrgctgcgtctttatagcaggctgagaatagactaatacaagattggtggtgattgaagttatactgaaagggtttaaaggagagtctgagaaaaggaaatg

SEQ ID NO: 32955 - DNA, 201 bp, Homo sapiens
agcctgaccatgtggtagaaaagaaaaacccattttatggggagaaattcaagccagatgcagaaatactagctaaagaaatttgaataaataaggaggarccaaatgttaatcaccaagacaatggggaaaatggctccagggcatgtcagagacctttgcagcagaccctcccatcacaggcctggaggcctaggaagg

SEQ ID NO: 32956 - DNA, 201 bp, Homo sapiens
atcaaggtcccccatcatctcacctttcctggctcatgggctttattttatgccactcttcatgctcagaagcacctggcggtttagtttttttgtgttgytctaaaggaatacctggggctgggtaatgtataaggaagagataatatctggccctcagttctgcaggctgtataagaatcatggtaccaacatctgttt

SEQ ID NO: 32957 - DNA, 201 bp, Homo sapiens
aactggagcaaaggtcactcttgctaagctttagcaaagaaactcgtggcatttttgcccctgccctagagctctttggaactacgaacttgagagagatratctgaaattggaacttatgtttaaaagggaagcagagcataaaagtttggaaaatttgcagcctgaccatgtggtagaaaagaaaaacccattttatgg

SEQ ID NO: 32958 - DNA, 201 bp, Homo sapiens
gacctcaaacacttcctttaaaaagataagctattttgtagtttaaaaaacatttgttctgtttctttctcattcatcttttcttaagtattttacacggttttttttttttggtcactactgtgaatgtgttatttttttgcatttctatctctagctgattatctactcattactcagctatctcatcaaaatattgat

SEQ ID NO: 32959 - DNA, 201 bp, Homo sapiens
actcacgagggcctggggctggtgagagtggcggggagagagggctcaccttgggagaaggatggtcagtgtctggggctttcctggtcatgttccaaatyaggcttggcaggagtcctgctgtgcaaattgcgtttgctgagccctgtcagaggtctcctgtgtctcacatctagggtgaccagcatcctggcttcctca

SEQ ID NO: 32960 - DNA, 201 bp, Homo sapiens
atggacccaggatgaatttgatcgccttgtgctgggccacactcaactgtactttgaaacagaacattttctgaagacattttctaaaagtatggcaattwtgaaaaattcatctttggtctttcataggtcttgtgtggagctactgcataatgaggccctgatcaggcacctgaatgctacttccttcgatgtggtttt

SEQ ID NO: 32961 - DNA, 201 bp, Homo sapiens
ttcgagatggccaggagaggaaagcttgggagcagggaaggttgagatatatgtgggttactgggaatgcgtgatggtgaagtcacagatgacccacatgktgtctaagtgctaaagaagaattctgggaaaatgaaatgcatttgggaagggaaaatctaattaaaagcctaaactaaaaatacaaaattcttggtaaag

SEQ ID NO: 32962 - DNA, 201 bp, Homo sapiens
ctccccgggaatcatcctcccctggagagttcccaaagcccttgcaggcctgccttctctgtgccttcctgcctgcgccctctggtggacagctccattcrctgcctgtcccatgggttctgtccaaaggtggaatctattatcaatgtggatttctaatgggggtaacttcctccctaagggaagcctcagcttcaccag

SEQ ID NO: 32963 - DNA, 201 bp, Homo sapiens
tctctttgggatcaatggtctcagaaattccagagaagaaagctatggcaattgctgatgctttgggcaaaatccctcagacagtaagaagattctatacyatggcctcatatctattttcacaggagcgctaatcccagacttccagcttccagattaattctcttaattggaaccttagatttggcttttccctgccac

SEQ ID NO: 32964 - DNA, 201 bp, Homo sapiens
caaggctgccagcacccgcgcacaggtcagaggcttggcgacctgggccgcctggagggccgccccttatgacgcagccacatctcattggccgaggcctktgagcgcctcgcatcccaagatgcagtgctcctgggactggccctgctctctgtgaggctctgtgaggccctgtgatgctccaagaccaggccccgccca

SEQ ID NO: 32965 - DNA, 201 bp, Homo sapiens
tgtagatggagaatcctcaacaaagcctttccaagaatctgatcatcacatcttgagctcagcctccctgcagctttttttatattgacagccacttcagrgagagtcctctttgagctttacaagaaatatcctggtgtgaaaaacgaccaaaaccagatagccagcctccccactccctgtttaaagaaagctggctta

SEQ ID NO: 32966 - DNA, 201 bp, Homo sapiens
ctttacaagaaatatcctggtgtgaaaaacgaccaaaaccagatagccagcctccccactccctgtttaaagaaagctggcttagcaatgttgtctgcatyttggatgtgctgtgttacccatatgtgggaagaaagagtattaagagttagcaaatagggtcacatccagcagagaccatatggttggggactagggcaa

SEQ ID NO: 32967 - DNA, 201 bp, Homo sapiens
tctcaggggctatctggttaggtattgcttgctacagagccaaactatgtcaccagaacccatttatatgtttccatttcttgtctctgtttcctcggccrtggcatccttctcagtgtcataatacccaagcagcaggggcttcagcctgagttcttttcccaggattcctagttaaagttcttctgcctcattggctct

SEQ ID NO: 32968 - DNA, 201 bp, Homo sapiens; identical to SEQ ID NO: 6472

SEQ ID NO: 32969 - DNA, 201 bp, Homo sapiens; identical to SEQ ID NO: 6475

SEQ ID NO: 32970 - DNA, 201 bp, Homo sapiens; identical to SEQ ID NO: 6349

SEQ ID NO: 32971 - DNA, 201 bp, Homo sapiens
gcagtggtgtgatcttggcccactgcaacctccgcctcctgggttcaagcagttctcccacctcagccgcccgagcagctggaactacaggtgtgcaccamcatgcctggctaatttttgtattttttatagagacagagttttgccatgttggtcagtctggtctcaaactccttacctcaagtgatccacccgcctcag

SEQ ID NO: 32972 - DNA, 201 bp, Homo sapiens; identical to SEQ ID NO: 6350

SEQ ID NO: 32973 - DNA, 201 bp, Homo sapiens
accataagctactgttgtctggaaaacatacaaatagatatctcagcaaaagctactcatatattcttgttcttttgggtaaatcattgtcagtgactgatttttttttatgaaaggataaaaacacgccctctattggggtcaggttttgtgctggtatttctcccacctactgtatcataggagcttagattcccagct

SEQ ID NO: 32974 - DNA, 201 bp, Homo sapiens
tggtttggctctgtgtcccccaccaaatctcatcttgaattgtaatccccataatccccacgtgttgaggacaggacatggtgggaggtccccacctcctmatctcatcatagtgagtgagttcttatgagatctgatggttttataaggggcccttatcccttcacttgcaagctattcctctttctctctttcatgtaa

SEQ ID NO: 32975 - DNA, 201 bp, Homo sapiens
gtatttagtagtgagtccattgactgtttcccaacatgaggtcacactagatttaatatggtttggctctgtgtcccccaccaaatctcatcttgaattgyaatccccataatccccacgtgttgaggacaggacatggtgggaggtccccacctcctaatctcatcatagtgagtgagttcttatgagatctgatggttt

SEQ ID NO: 32976 - DNA, 201 bp, Homo sapiens
ttcgagtgtggtaaagaacaggctagtgtatttagtagtgagtccattgactgtttcccaacatgaggtcacactagatttaatatggtttggctctgtgycccccaccaaatctcatcttgaattgtaatccccataatccccacgtgttgaggacaggacatggtgggaggtccccacctcctaatctcatcatagtga

SEQ ID NO: 32977 - DNA, 201 bp, Homo sapiens
tccattctcagagctcaaatgccatactaggagaacgagtgctctcttcagagctgtcagacagggatgtttaagtctgctgttccccacatgttcagaakttgtctgctgccttttgttcagatatgccctgcccacagaggtggagtctatagcggcagtagcccttgctgagctgcggtggactctgttcagttccag

SEQ ID NO: 32978 - DNA, 201 bp, Homo sapiens; identical to SEQ ID NO: 6631

SEQ ID NO: 32979 - DNA, 201 bp, Homo sapiens
tgctgtttctgctccttatgcaagccttgcctctgagctttttcagagagaggtgtcagtggtggatcttgtcagccatgcatctgtgtggctgttccgasgggactttgtgatggactaccccaggccgatcatgcccaacatggtcttcattgggggcatcaactgtgccaacgggaagccactatctcaggtctgtat

SEQ ID NO: 32980 - DNA, 201 bp, Homo sapiens
tggtcttcattgggggcatcaactgtgccaacaggaagccactatctcaggtctgtattggtgccttcatccaatcaatgttccaggcaaaacactttttwaaaaaatgtatttatttaaaattgcttccatatttacttatctttccaaatatttcatttctgcttctccttgtcataatagccttcagtgagataaact

SEQ ID NO: 32981 - DNA, 201 bp, Homo sapiens; identical to SEQ ID NO: 6553

SEQ ID NO: 32982 - DNA, 201 bp, Homo sapiens
tgtccgtgtcttctgctgagatggccacaggactccaggttcccctgccgtggctggccacaggactgctgcttctcctcagtgtccagccctgggctgaragtggaaaggtgttggtggtgcccattgatggcagccactggctcagcatgcgggaggtcttgcgggagctccatgccagaggccaccaggcagtggtcc

SEQ ID NO: 32983 - DNA, 201 bp, Homo sapiens
ggctggtgagagtggcggggagagagggctcaccttgggagaaggatggtcagtgtctggggctttcctggtcatgttccaaatcaggcttggcaggagtyctgctgtgcaaattgcgtttgctgagccctgtcagaggtctcctgtgtctcacatctagggtgaccagcatcctggcttcctcaggactgttcaggtttt

SEQ ID NO: 32984 - DNA, 201 bp, Homo sapiens
gagagtggcggggagagagggctcaccttgggagaaggatggtcagtgtctggggctttcctggtcatgttccaaatcaggcttggcaggagtcctgctgkgcaaattgcgtttgctgagccctgtcagaggtctcctgtgtctcacatctagggtgaccagcatcctggcttcctcaggactgttcaggttttagcactg

SEQ ID NO: 32985 - DNA, 201 bp, Homo sapiens
ctggggctttcctggtcatgttccaaatcaggcttggcaggagtcctgctgtgcaaattgcgtttgctgagccctgtcagaggtctcctgtgtctcacatytagggtgaccagcatcctggcttcctcaggactgttcaggttttagcactgaacatcacatgtcctagggaacccctcagtttgggcaagccctgccaca

SEQ ID NO: 32986 - DNA, 201 bp, Homo sapiens
atttctgggtattctattctgttccaatgatctttttgtgaaatatttgattactatagatttgtaataagtcttgaaattaggtaataattgctctccatttttttttctattttttaaaagttatttttgctattgtaggtcttttacatttccctatgaattttagaatcagtttgccaatttgtacaaaaagatagc

SEQ ID NO: 32987 - DNA, 201 bp, Homo sapiens; identical to SEQ ID NO: 6517

SEQ ID NO: 32988 - DNA, 201 bp, Homo sapiens
gactcacgagggcctggggctggtgagagtggcggggagagagggctcaccttgggagaaggatggtcagtgtctggggctttcctggtcatgttccaaawcaggcttggcaggagtcctgctgtgcaaattgcgtttgctgagccctgtcagaggtctcctgtgtctcacatctagggtgaccagcatcctggcttcctc

SEQ ID NO: 32989 - DNA, 201 bp, Homo sapiens
tgataaaattgtttcaaatatgaaaacatttacgtagcatttaatagcgttgtttcaaatataaaaacaaatacataaaaatctggatttttatttcttcyttttttttttttttttttttgagatggagtcttgctctgtcacctaggctggagtgcagtggtgcaatcttggcttactgcaacctccacctcccacgtt

SEQ ID NO: 32990 - DNA, 201 bp, Homo sapiens
actattaagattgctacatggttatacagttttagtttatttatatggtatgttacttagatttatttttaaagcttatttattttatcattaattatggkgaaatacacatagcataaaccttgtcatcttcaccactttaggtgcacagttcagtatccagtgtattcacattgctgtgcaaccaacaccaccattcat

SEQ ID NO: 32991 - DNA, 201 bp, Homo sapiens
aggtcatcactctcaagtttaaagttccacagattcctagagcatggactcaatgcagccaagttctttgttaaggcatagcaagggtgacctttgctcamgttccaaataacttcctcattttcacatgagacctcattagcctggccctcactgctgatttttctatcagtattttggtcacaagcatttaaccagtct

SEQ ID NO: 32992 - DNA, 201 bp, Homo sapiens
cactaatttactttctgtctgtatggatttgcctattctgggcatttcatggaaatggaagcctttatgactggcttctttcacttagttttgtggcttawccatgttgtagcatgaatcagtatttcattcctttacatggccgaatattccattgtatggatttaccgcattttttttatccattcatcagttggtgga

SEQ ID NO: 32993 - DNA, 201 bp, Homo sapiens
tatgtatttatgactatacgtgtaaagccagcggagttctcacagaggaattcagaactcaaagaaggctttccggcaaagagccttggatatggcccaaycacagaagtaaattgtcattgacagaaggatggacacttcatattgctccttccttgtttcagatgccaggatgtgtctgggaaaagcatgcagttggtt

SEQ ID NO: 32994 - DNA, 201 bp, Homo sapiens
aagatgaagaaagcaaatgtagcaggcacagcgtggggtggacagtcagctgtccgtgtcttctgctgagatggccacaggactccaggttcccctgccgyggctggccacaggactgctgcttctcctcagtgtccagccctgggctgagagtggaaaggtgttggtggtgcccattgatggcagccactggctcagcat

SEQ ID NO: 32995 - DNA, 201 bp, Homo sapiens
acagtgatagattaatggttaataattaactagaggagggcactctgtcttccaattacacgttgatttgctaagtggctcagtgacaaggtaattaagaygaagaaagcaaatgtagcaggcacagcgtggggtggacagtcagctgtccgtgtcttctgctgagatggccacaggactccaggttcccctgccgtggct

SEQ ID NO: 32996 - DNA, 201 bp, Homo sapiens
tgttcacagccttgtgttgggaattggatgagaaacaagagcttgaacttggatgttccccagagtgagcacagggtcagacgtgtttttcaagatagtcrtgatcggtcttttccagggtggggcccacagtgaaaaacagtgatagattaatggttaataattaactagaggagggcactctgtcttccaattacacgt

SEQ ID NO: 32997 - DNA, 201 bp, Homo sapiens; identical to SEQ ID NO: 6380

SEQ ID NO: 32998 - DNA, 201 bp, Homo sapiens
tgtagatacttttgtggggctgtgattctgcctaccacagacactaagcttaaagtgaaacccacatcttattcaaggcttggaggttttcctctattcgrccatttaaatttaatttttgttccttttctccatagtcttctattctccaggcttcagagctatcagcttaccattcaattatctccttttttcctgatc

SEQ ID NO: 32999 - DNA, 201 bp, Homo sapiens
cagaacaccaaataccattgttttcacttagaaatgggagctaaatagtgggtacttttgggcataaagatggcaacaatagacactatggactcctaaargggagaggaaaggctgcaagagttgaaaaactattgggtactatgctcagtacttgggtgatgggagcaatcatgccccaaacatcagcatcacacaata

SEQ ID NO: 33000 - DNA, 201 bp, Homo sapiens; identical to SEQ ID NO: 6699

SEQ ID NO: 33001 - DNA, 201 bp, Homo sapiens
atgcaagccttgcctctgagctttttcagagagaggtgtcagtggtggatcttgtcagccatgcatctgtgtggctgttccgaggggactttgtgatggaytaccccaggccgatcatgcccaacatggtcttcattgggggcatcaactgtgccaacgggaagccactatctcaggtctgtattggtgcctttatccaat

SEQ ID NO: 33002 - DNA, 201 bp, Homo sapiens
ttttggaatttcatggtacttttccacttttagggagatgcagtgcagcgtcttcaagtctcccactcttacgcctgtctccttcacttgtaagagccctygtgattacactgtcctgcccagatacccaggacaatctccccatcttaaaactcttaatttaatcatatctgtgaagtctcttccacctgtaacggaaca

SEQ ID NO: 33003 - DNA, 201 bp, Homo sapiens
tgtgtcacctggagacctttgccatgttcgtgccaatttactgagtgcatgaaagatcatttacaccaaaatctttatcatgtattatctgtgacagacaygccattatcatttttattacattgatttcctttgttattttgtcacccttacttacttggtttggttgacccttagatttgaaatttttctacaaatata

SEQ ID NO: 33004 - DNA, 201 bp, Homo sapiens
ggctcatcttggatgctttgtttacttggataagcttaatgatgagagaatctacatctaaattgttatatttagcattattctctgcattttaaagcacrtgcagcaaaaatccagcaccctatttgggccaccgaccttgtgtccagccccactgctcggccctgggcacacttgccagcccctccattgcaatatcga

SEQ ID NO: 33005 - DNA, 201 bp, Homo sapiens
gttatagtgagcacccaataaatattatctgttatcattcttattattttagtttaattgcatttattttatgctgaatttcttccagagccataggtaawttttttcttcagtttcttctgggatatctttttcttctgtgcaacctcatcctcaggtttaggaacaatttgttccttatcagtaaagatcatcttgaat

SEQ ID NO: 33006 - DNA, 201 bp, Homo sapiens
caagagcaccctcccaggcatgttccaccctcaccccgggctcatcaggagggttcttaagatgcagacagttttaagggggttggaggaatagttgagargctgagatgttgcacccacagctgagaatccctttctagcactctgtgtcctcacaaatccccagaaatcgtcctcccctggggagttctcaagccctta

SEQ ID NO: 33007 - DNA, 201 bp, Homo sapiens
gacagcgggaggggctcactttctcagtgcgccactgctcaaacctctaggggagcatacagacgggcaggttgtggggctctgacctcaccggcagtgtytagaggtggatgtttacagctcctgaagctccagtgggcgtgggttatggccttcttttagttttgccctctatagtcagcttgtgttaaccagctcaat

SEQ ID NO: 33008 - DNA, 201 bp, Homo sapiens
cttacaattgcttccatatctacttatctttctggtgcttttatttctgcttgtcgtaatagccttcagtgagataaactgttaaggggtctctagtagcrtatttcaggttttaaatggtcaatgagaggaagaagaggcagacatgaatgtttatcaaaggatggactaggactgatgtgactcatggagactgttcgt

SEQ ID NO: 33009 - DNA, 201 bp, Homo sapiens
tgcagacctggggatggaatatggttacagagcaagaaaagatctgtgcttcccccattcctctaagtttctggctccagtttaagatccaaattcaaagktagcttttggtggacaagactaaggcctcccactaaaattgtttacttcaagtatttattttcaaagttttccaacctatacaaaggagagacttagtgt

SEQ ID NO: 33010 - DNA, 201 bp, Homo sapiens
actgtctttgtgtttagttacaaggagaacatcatgcgcctctccagccttcacaaggaccgcccggtggagccgctggacctggccgtgttctgggtggmgtttgtgatgaggcacaagggcgcgccacacctgcgccccgcagcccacgacctcacctggtaccagtaccattccttggacgtgattggtttcctcttg

SEQ ID NO: 33011 - DNA, 201 bp, Homo sapiens
tccccagcagttcctctgacccccccaaaatattctccagcgggtttcccaagaggtcaaaggagaatgggtcctggccgccgaagaactccctgaagacstcggctgggtcgcggaagctgaagacgtactcgaaggggtcctcgaagggcctgccgcctgtgcagccgccctccgcccccgcctcgccatagcggtcat

SEQ ID NO: 33012 - DNA, 201 bp, Homo sapiens; identical to SEQ ID NO: 6474

SEQ ID NO: 33013 - DNA, 201 bp, Homo sapiens
ttggggcttggtggctttcaaagctctttctataataacagtggcatcttcagtggtgtaatccttctggactttcatgacattctctatccagattctctttcctagtattgacaaccttttccatagaaaactgtgtgtaatgagttctaaatttccttaagacacctgattgagagactgaattagagatgttgggtt

SEQ ID NO: 33014 - DNA, 201 bp, Homo sapiens
atttcattcctttacatggccgaatattccattgtatggatttaccgcattttttttatccattcatcagttggtggacatttgggttgtttcccattttyagccatgaaaaataatgttgttgtgaacatttgtatacgataaaccctgatgttctaattttcgagcccatgtgcctaacctctatacctgactgcctgc

SEQ ID NO: 33015 - DNA, 201 bp, Homo sapiens
ttagccatgaaaaataatgttgttgtgaacatttgtatacgataaaccctgatgttctaattttcgagcccatgtgcctaacctctatacctgactgcctscctgtgttgacaggaaacttcttgggaaatgtcctatctccatccttttgggaatgtcacatgcagtgaaatgcgcctagagtgggtttgacttacatca

SEQ ID NO: 33016 - DNA, 201 bp, Homo sapiens
aataagaccttgtttctacaaaaaatttaaaaattggccagacatagtggtgcatgactaattccagctactctggaggctgaggcaggaggatggcttgmgcccaggagttggaggctgcagttagccatgcttgtgccactacactccagcccgggcaacagggcaagactctgtatctaaaaacaacaacaacaacaa

SEQ ID NO: 33017 - DNA, 201 bp, Homo sapiens
gtgtggtcccattccttccttccagcggcttcttctggccacctcaatgtcaggatgtcctgctcacatatcaataccattaaaacctgacttctttccckgcactgttgaagctccttcttgaggctcacattatggatataattttgattctttcttcagtggtatagataactacttgtaacctaagaacaacttggt

SEQ ID NO: 33018 - DNA, 201 bp, Homo sapiens
attcactatcaagagaacagcatgggaaagacctgcccccatgattcaattttcccaccaggatcctcccacaacagtgggaattgtgggagttacaattsaagatgagatttaggtggggacacagccaaaccatatgattccaccctggtccctcccaaatctcatgtcctcacatttcaaaaccaatcatgccctccc

SEQ ID NO: 33019 - DNA, 201 bp, Homo sapiens
tgaaaaaccaaattcacacaccaatgaatttggtttctaaatccattaagggagccatccttttttttttttttttcttgagactgagcctcgttctgtcrcccaggctggagggcagtggccggatctccgctcactgcaaccttcacctcccgggtttaagaaattctcccacctcagtctcctgagtaactgggactg

SEQ ID NO: 33020 - DNA, 201 bp, Homo sapiens
tattattcactttataaaaggattctttagtttctatataatttatcatataatttatttagaattttatttcccccattagatttaaaactccaatttayataaaaagttgccataatagacatctgatccataagtttcctgcacagaaagaaatactccattataagaagcatagtatctttaagagaaaaacaactc

SEQ ID NO: 33021 - DNA, 201 bp, Homo sapiens; identical to SEQ ID NO: 6398

SEQ ID NO: 33022 - DNA, 201 bp, Homo sapiens
atttgtctttttgcacattagtatgtaaacactctttaatactttctttacattactatatttccatattcgtagcctctgatgaattcttcatcatgtgsatccccagcagctttacttctctcattgaaccctgactgctatagaatggaagtagtggctgtggcaaagtagtgccttgtacactttttgacttgaaat

SEQ ID NO: 33023 - DNA, 201 bp, Homo sapiens
cttcacagttactgatcctcccactctgttaaagactgttccttcagaggacccctgttttctagttagtatagcagatttgttttctaatcatattatgytctttctttacgttctgctctttttgcccctcccaggtcctgtggcggtacactggaacccgaccatcgaatcttgcgaacaacacgatacttgttaagt

SEQ ID NO: 33024 - DNA, 201 bp, Homo sapiens
atacatcataattactgtctgtttttttctctttgatgtatttaaaaatgcttttatacagtactaatccttcttccccatttgctttagtttcagtgccyataagggttcatgttgtaatagaagtcaatagcagtcttaaataactggaagcctttccatgaggcttgtattgtgtaaggccattttttttttctggca

SEQ ID NO: 33025 - DNA, 201 bp, Homo sapiens
atgagttctaaatttccttaagacacctgattgagagactgaattagagatgttgggtttggaagcacgtagaccattttgacaccttcagtgttgaactyatggattctgggtggctagggaatggtccaatatcgaaagaactttaaaagacagtcccttgctggcaatgcattttctgccttcacggacaaagccttg

SEQ ID NO: 33026 - DNA, 201 bp, Homo sapiens
tctgaaattctccaaacacctgttacggagtatgatctctacagccacacatcaatttggttgttgcgaacggactttgttttggactatcccaaacccgwgatgcccaacatgatcttcattggtggtatcaactgccatcagggaaagccgttgcctatggtaagttatctctcctttagcaccttaagaatacttcac

SEQ ID NO: 33027 - DNA, 201 bp, Homo sapiens
cagagacgctcctcacctcccagatggggtctcgccgggcagaggcgctcctcacatcccagatggggcggcggggcagaggcgctccccacatctcagasgatgggcggccgggcagagacgctcctcacttcctagatgtgatggcggctgggaagaggcgctcctcacttcctagatgggatggcggccgggtgaaga

SEQ ID NO: 33028 - DNA, 201 bp, Homo sapiens; identical to SEQ ID NO: 6401

SEQ ID NO: 33029 - DNA, 201 bp, Homo sapiens
tgagttctaaatttccttaagacacctgattgagagactgaattagagatgttgggtttggaagcacgtagaccattttgacaccttcagtgttgaactcrtggattctgggtggctagggaatggtccaatatcgaaagaactttaaaagacagtcccttgctggcaatgcattttctgccttcacggacaaagccttga

SEQ ID NO: 33030 - DNA, 201 bp, Homo sapiens
taaataaacccataaagccatttgagagattcttgggggattcattggaccactgaaaatctacagtgagaaaagaattgccatgttgatgaaacaggaaractttccttgtccccctcacagagcatgtgacagcgggaggggctcactttctcagtgcgccactgctcaaacctctaggggagcatacagacgggcagg

SEQ ID NO: 33031 - DNA, 201 bp, Homo sapiens
caccctgtaattgcctagttgtgagtttgtctctgttcacctgacccctcctttcaggcaaggaccatttctaacttggctttctgtcccgagttcctagmatagtaggtagggctcacacattccataaatatttggtggataagggaattagcaatggattctgctttggttccaaagcagagattaattggattgctt

SEQ ID NO: 33032 - DNA, 201 bp, Homo sapiens; identical to SEQ ID NO: 6403

SEQ ID NO: 33033 - DNA, 201 bp, Homo sapiens; identical to SEQ ID NO: 6404

SEQ ID NO: 33034 - DNA, 201 bp, Homo sapiens
ttaaataactggaagcctttccatgaggcttgtattgtgtaaggccattttttttttctggcactgcttcttctacatcttctttctcatcaagtagtgawtggaaagcactaatctctatcaggtcatctattaattcctcgagtgtggtgtctattgactcttgaatttctccaagattcatattttgaaacactttat

SEQ ID NO: 33035 - DNA, 201 bp, Homo sapiens
acagaaaatcaaacaccgcatgttctcactcataagtgggagttgaacagtgagaatgcgtagacgcagggaggggaacaacacacaccagggcttgtggsggggtgaggggtgaggggaggaacttagaggataggtcaataggtgcagcaaaccaccatggcatatgtatcccagaacttcaagtaaataataataata

SEQ ID NO: 33036 - DNA, 201 bp, Homo sapiens
gtttgcacatgtatgtgtttgtgtatgtgcaggtgtgtttgcgtgcagtgtcccagaccctgcacaggggatttcttgaagatctcctgtaacaaaatctycttgagtctatccaggagaattacagccagggatgtaattaaatactttaacaatgatggcagatggccccatctccaatttcaacatgggatttggagg

SEQ ID NO: 33037 - DNA, 201 bp, Homo sapiens
ccaaagattttattttggcttctttataacagataaactgttgaggggcctagtgtatttcaagttttcagtggtcactgagaggaagaagaggcacggaygagggtctgtcagaggatggacaaggactgctgtgactcacggacagtgtttgtaaaggcaccatcttcatggttgtgcatgtccttcagctcggcagga

SEQ ID NO: 33038 - DNA, 201 bp, Homo sapiens
tggagcattcagtctttcaccatcaaggatgatattaactgtgggtgcctccaagatgtccttcattagtttaagatacttccctttattttccgagtttkttgagaattttttatcacaaatcgattttggatttttgtcaaacactttttccatacctattgagataattatatgcttatacttttttagtttatttat

SEQ ID NO: 33039 - DNA, 201 bp, Homo sapiens
ctctgtttagagaaagctggcttagcaatgttgtatgtcttttggatgtgctgtgttattcacatatgagaagaaagagtttcaagggttagcaaatagcrtcacattcagcagagaacatgtggttggggactagggcaatggtgactcctcagacctcagctgcagcctgataaatatggttaacagagtagaaggcag

SEQ ID NO: 33040 - DNA, 201 bp, Homo sapiens
tgaaaaaagaccaaaaccagatagccagcctgaacactctctgtttagagaaagctggcttagcaatgttgtatgtcttttggatgtgctgtgttattcayatatgagaagaaagagtttcaagggttagcaaatagcgtcacattcagcagagaacatgtggttggggactagggcaatggtgactcctcagacctcagc

SEQ ID NO: 33041 - DNA, 201 bp, Homo sapiens
acctatgccatttcatggacccaggatgaatttgatcgccttgtgctgggccacactcaactgtactttgaaacagaacattttctgaagacattttctaraagtatggcaattttgaaaaattcatctttggtctttcataggtcttgtgtggagctactgcataatgaggccctgatcaggcacctgaatgctacttcc

SEQ ID NO: 33042 - DNA, 201 bp, Homo sapiens
gtctctaaagagaggtctgctgttagtctgatgaacttcttttcgtgtgtaacaggacctttctctctggctgcccttaacatttttccttcatttcaacsttggtgaatctgatgattatgtgtcttggagttgcttttctcgaggagtatctttatggtgttctctgtgtttcctgaatttgaatgttggcctgtcttg

SEQ ID NO: 33043 - DNA, 201 bp, Homo sapiens
aaaagatctgtgctttccccattgctctaagattctggctatagtccaagatccaaattcaaagttaacttttggttgacaagactaaggcctcccactaraattgtttacttcaagtatttattttcaaagttttcaaacatacaaaatgaaaagactatagtgtaatgtgcacctgtatatcaatccttaggctaaata

SEQ ID NO: 33044 - DNA, 201 bp, Homo sapiens
accacctctctcattcctaatattgataatttctttcttctctctttttttttcagatcaaggtggctagagctttaccaaattaattgatctcaacaaaycagctttggtttcattaattttctcaacaaaccagctttggtttcattaattttgcctgttttttaaatgcattttccatttcattgatttctgttctga

SEQ ID NO: 33045 - DNA, 201 bp, Homo sapiens
gcgggtttcccaagaggtcaaaggagaatgggtcctggccgccgaagaactccctgaagacgtcggctgggtcgcggaagctgaagacgtactcgaagggktcctcgaagggcctgccgcctgtgcagccgccctccgcccccgcctcgccatagcggtcatagatatcgcgtttcttggcgtccgacaacacctcgtagg

SEQ ID NO: 33046 - DNA, 201 bp, Homo sapiens; identical to SEQ ID NO: 6601

SEQ ID NO: 33047 - DNA, 201 bp, Homo sapiens
tctgcttctgcttccccagcagttcctctgacccccccaaaatattctccagcgggtttcccaagaggtcaaaggagaatgggtcctggccgccgaagaaytccctgaagacgtcggctgggtcgcggaagctgaagacgtactcgaaggggtcctcgaagggcctgccgcctgtgcagccgccctccgcccccgcctcgc

SEQ ID NO: 33048 - DNA, 201 bp, Homo sapiens
gctgagtgtggtggctcacacatgtaatcacagcactttaggaggccaaggcaggaagatcacttaagcccaggagtttgagaccagcctggacaacatasggagacactgtctctacaaaaaatgttttaaaaattagctgggcctggtggcatatgcctgtggtcccagctactcaggaggctgaggtgggaggatctc

SEQ ID NO: 33049 - DNA, 201 bp, Homo sapiens
tgctttttaaaaatttctcacaccagttaccctaaatcatctttctaaggttcaaagttccacaaatcactaggtcaggggcaaaatgctgccagtctctttgctaaaacataacaagagtcacctttcctccagttcccaacgagttcctcatctccatttgaaaccacctcagtctggactttattgtccatattgcta

SEQ ID NO: 33050 - DNA, 201 bp, Homo sapiens
tgggctgagagtgggaaggtgctggtggtacccattgatggcagccactggctcgcatgcgggaggccgtgcgggagctccatgccagaggccaccaggcrgtggtcctcaccccagaggtgaatatgcacatcaaacaagagaaatttttcaccctgacaacctatgccatttcatggacccaggatgaatttgatcgcc

SEQ ID NO: 33051 - DNA, 201 bp, Homo sapiens
cttgaacttggatgttccccagaggcagcacagggtcagatgagcttttcaagataggcgtgattggtctttcccagggttgggcccataacgaaaggcarttatagattaatgggtaataagtaactggaggagggcactttgtcttccaattacatgctgatttgctaggtggctcaatgacaaggtaattaaggcgaa

SEQ ID NO: 33052 - DNA, 201 bp, Homo sapiens
ggaagatggcaggtgcagcatgaagccaaatgtttggaatcatagcatgttctttcccttcatccctatgtcccagggtctctttacttcataaacatggscaagtggaaatcctactttatgtctcttctgtataatccctttgtcatggcttaacttagtggcctgtgcccctccccactgctcctggaaccacaaccc

SEQ ID NO: 33053 - DNA, 201 bp, Homo sapiens
tagtggcctgtgcccctccccactgctcctggaaccacaacccacattgttacaagcccctgaaggaagttataaacaccttatcttctactaggacaggwgcccctggaactgtctggctgggcaagccatacttacctgcacttccctattccatctgtgagtgattcagacttgactattgttatcacactaaactaa

SEQ ID NO: 33054 - DNA, 201 bp, Homo sapiens; identical to SEQ ID NO: 6423

SEQ ID NO: 33055 - DNA, 201 bp, Homo sapiens; identical to SEQ ID NO: 6426

SEQ ID NO: 33056 - DNA, 201 bp, Homo sapiens; identical to SEQ ID NO: 6427

SEQ ID NO: 33057 - DNA, 201 bp, Homo sapiens
gagctctgttccctttgcaaccttcctggagtcttattgctatctagatgaactcaaagcaagatgctgccgcccccatgactttgatcattgtaagctgscaatcctcttgggaggctgctcccagcttggactgagctgagtcttcgcatgccttgaacaatgaatttgcatcctggttatgttccccatgggggccag

SEQ ID NO: 33058 - DNA, 201 bp, Homo sapiens; identical to SEQ ID NO: 6428

SEQ ID NO: 33059 - DNA, 201 bp, Homo sapiens; identical to SEQ ID NO: 6429

SEQ ID NO: 33060 - DNA, 201 bp, Homo sapiens; identical to SEQ ID NO: 6430

SEQ ID NO: 33061 - DNA, 201 bp, Homo sapiens
ttctaaatttccttaagacacctgattgagagactgaattagagatgttgggtttggaagcacgtagaccattttgacaccttcagtgttgaactcatggrttctgggtggctagggaatggtccaatatcgaaagaactttaaaagacagtcccttgctggcaatgcattttctgccttcacggacaaagccttgatgga

SEQ ID NO: 33062 - DNA, 201 bp, Homo sapiens
gctctgggcaagtctgttctagtaattcaaggtaccacctctcactgggacagcctagtttctacacaggtcttgctctgggaccgccctcagcagtgtgrttagcaggcagggccagtgtgaccctccctttctgggcctcagttgagaaacctgaagctcaggagaggagtcactcccctggcagatgggtggctgggc

SEQ ID NO: 33063 - DNA, 201 bp, Homo sapiens; identical to SEQ ID NO: 6382

SEQ ID NO: 33064 - DNA, 201 bp, Homo sapiens
aaatacctaggagccctgtgatttggagagtgaaaactctttattaccgttgttactttaactctttccaggatggcctgcctccttcgctcatttcagagaatttctgcaggggttttcttcttagcactttggggcatggttgtaggtgacaagctgctggtggtccctcaggacggaagccactggcttagtatgaag

SEQ ID NO: 33065 - DNA, 201 bp, Homo sapiens; identical to SEQ ID NO: 6431

SEQ ID NO: 33066 - DNA, 201 bp, Homo sapiens
gttgacaagactaaggcctcccactaaaattgtttacttcaagtatttattttcaaagttttcaaacatacaaaatgaaaagactatagtgtaatgtgcamctgtatatcaatccttaggctaaataattttcagtgttttgctgtattaattcatctatccccttattctgaccttttaaagaaactttttggctgtcat

SEQ ID NO: 33067 - DNA, 201 bp, Homo sapiens
tcctccagttatattttggctcttgaataggttttgctttatacatagtgattagattggtgcatgtaggtttgaggtttgagacttatattttcttcacwgtttgctgttatcattaaataataatccttaaaatacattttatctgatatcagtaatgtgactcctatgttattttttgaattccccatctcttttaat

SEQ ID NO: 33068 - DNA, 201 bp, Homo sapiens
aggagaacttagactcggccttttccagatgagcttcagtgtaagagtgggtttcatgaagagcaaaggtcctaggaaatttaagtaagccatttaccaaygctcagaagaaagaacttgaagagcacttggaaatgagctgtgtctccccaagaaagagggagagaaagaggggagagatgtggtgcagaccctagggag

SEQ ID NO: 33069 - DNA, 201 bp, Homo sapiens; identical to SEQ ID NO: 6433

SEQ ID NO: 33070 - DNA, 201 bp, Homo sapiens
accatgtattttcaaatggcctgtcttcaagctcagtaattatttcttgtgtttggtccattctgctattaaaggactttgatgcattcttcattatgccrattgcatttttcagctccagaatttctgcttgattctttctaatgatttcaatctctttgttaaatttatatgctggaattctgaattcctcctctgtgt

SEQ ID NO: 33071 - DNA, 201 bp, Homo sapiens
gtctggagtgcagtggtgggatcttggctcattgcaacctccacctcccaggttcaactgattctcctgcctcagcctcccaagtagctggaactacaggygcatggcaccacatccagctaattttctttttttttgtattttttatggagatggagtttcatcatattggccaggctgatctcaaatgcctgatctcaa

SEQ ID NO: 33072 - DNA, 201 bp, Homo sapiens
actgggaatgcgtgatggtgaagtcacagatgacccacatggtgtctaagtgctaaagaagaattctgggaaaatgaaatgcatttgggaagggaaaatckaattaaaagcctaaactaaaaatacaaaattcttggtaaagtttaggagttatgttaaatgtctcattttggctggtgaagtctcatcagaacagggaaa

SEQ ID NO: 33073 - DNA, 201 bp, Homo sapiens
tacaccctttggccgagtgtgaggctctgccacttcctgaacccacactgagtttattgtggcccaaggggtcacccagaggcctttagagatataaaaamgtatatatgattttatatcacctacgatagggagatatccataaaaaaaggaaacattaaactctacatggtttcagttattttgattataaatctttta

SEQ ID NO: 33074 - DNA, 201 bp, Homo sapiens
atccttgtggccatcaccactatgactgtgctggatcagacctgaaaccagcacagctctgggtctcacccaaggcctgctgtaaccacctcctggctactgcctatgtttgctcaacgcccttgggctttacaatcagcaggtgatacagccagccagacctgcatccctcccttcagaatggcaaggtcccccaggccc

SEQ ID NO: 33075 - DNA, 201 bp, Homo sapiens
cagagtgtgagtctcatctgcctgatgagaaggaagcattacttagtgatagagtatgtgtttgcacatgtatgtgtttgtgtatgtgcaggtgtgtttgygtgcagtgtcccagaccctgcacaggggatttcttgaagatctcctgtaacaaaatctccttgagtctatccaggagaattacatccagggatgtaatta

SEQ ID NO: 33076 - DNA, 201 bp, Homo sapiens
tgtggagtgggcactcttacaggtttccatggcgaaagcgggggtacagttgtgttcttttctttctaaaaggctttctaaaaagccttctgtttaatttytggaaaagaagcctaacttgttcactacatagtcgtccttcttcctctctggtaacacttgttggtctgtggaaatactaatttaatggatcctgaggtt

SEQ ID NO: 33077 - DNA, 201 bp, Homo sapiens
atatgagaaaaaattaactgaaaatttttcttctggctctaggaatttgaagcctacattaatgcttctggagaacatggaattgtggttttctctttggratcaatggtctcagaaattccagagaagaaagctatggcaattgctgatgctttgggcaaaatccctcagacagtaagaagattctataccatggcctca

SEQ ID NO: 33078 - DNA, 201 bp, Homo sapiens
actaataaaggcctgtccttggggaagacttctgttcacatgcgctccagtgaatttccctttctggtcattctctaccccagcacgccccccacccccgmcccgccccacccacccacctgttcatttccttcttagcatgcttcacgatttctaagttcctgctcatgtgtttaaattgtgagtctggctcacctcatg

SEQ ID NO: 33079 - DNA, 201 bp, Homo sapiens
cagagatgtaactgctgacatcctccctattttgcatctcaggtcacccgatgacccgtgcctttatcacccatgctggttcccatggtgtttatgaaagsatatgcaatggcgttcccatggtgatgatgcccttgtttggtgatcagatggacaatgcaaagcgcatggagactaagggagctggagtgaccctgaatg

SEQ ID NO: 33080 - DNA, 201 bp, Homo sapiens
taatacttccaattctggctgcacaatacttgccccatagtccatggtcaataaatacaaatttgagttgtttttgctcatctttcccttttgacttcaamtcagtcatcagaatttccccaaatgcctttcccctggatcttgggccagtggaatgagtacaatttaacttaattgaatttgcttatctatttggtttcc

SEQ ID NO: 33081 - DNA, 201 bp, Homo sapiens; identical to SEQ ID NO: 6387

SEQ ID NO: 33082 - DNA, 201 bp, Homo sapiens
tgttccccagagcgagcgcaaggtcagatgagtttttcaagataggagtgatcggtctttcccagggtggggcccataatgcaagacaattatagattaaygggtaataagtaactggaggagggcactctgtcttcaattacatgttgatttgctaggtgtctcagtgacaaggtaattaagacgaaggaaacaattcta

SEQ ID NO: 33083 - DNA, 201 bp, Homo sapiens
ctgaactgaacattctgtcctaccactagcaaataatcattgtctgcctcaggcttaagtttaataaatagcaaattgcatacagatattttacaacgatygaaagacaaacagaggtcctatccgtgtagtcccaacgataagaacaggtgttggcatgaagtgtttataaattcttgggtacagctgttctgaaagtaa

SEQ ID NO: 33084 - DNA, 201 bp, Homo sapiens
tcatttgtgttattaatttcttcttgtgtaaagtctgacagcttgtgtcttttaagaaatttgtccattccatctaagttgtagattttattggcatgaasttgttcatgtttcttattgttttaatacctgtagaatttatggtgatactactgctctcattcctgatattggtaatttatatcttctgtcttttttcct

SEQ ID NO: 33085 - DNA, 201 bp, Homo sapiens
gtgacatgaaatgggtgtccacagccttgtgttgggaattgaatgagaaagaagagcttgaacttggatgttccccagaggcagcacagggtcagatgagyttttcaagataggcgtgattggtctttcccagggttgggcccataacgaaaggcagttatagattaatgggtaataagtaactggaggagggcactttgt

SEQ ID NO: 33086 - DNA, 201 bp, Homo sapiens; identical to SEQ ID NO: 6352

SEQ ID NO: 33087 - DNA, 201 bp, Homo sapiens
gggatatggccataatcaaatgaacatggctttgccattctaatggagaggaaggcattgattagctacaaactgtgaaacatactttgaaagaaaaggaygtaaagagagctgatcatagggggccttgcaggataaggagtggcaatcttgggagaagttggggggatggtgtgccaagcagggaagatggcaggtgca

SEQ ID NO: 33088 - DNA, 201 bp, Homo sapiens; identical to SEQ ID NO: 6353

SEQ ID NO: 33089 - DNA, 201 bp, Homo sapiens
actttgaaagaaaaggacgtaaagagagctgatcatagggggccttgcaggataaggagtggcaatcttgggagaagttggggggatggtgtgccaagcarggaagatggcaggtgcagcatgaagccaaatgtttggaatcatagcatgttctttcccttcatccctatgtcccagggtctctttacttcataaacatgg

SEQ ID NO: 33090 - DNA, 201 bp, Homo sapiens
acagaggtgaaggcttgactaagggaacaggtccaggttaaaatccattttcccaactctgtcccatgctttgtctctggaccttgagccagggaccagcraactacagcctgtgagcccaatctgcccaaaggcctgttttttgtttttttttttccttttatgttgagacctgtttttatatggcccagagctaagaat

SEQ ID NO: 33091 - DNA, 201 bp, Homo sapiens
tacacaggtcttgctctgggaccgccctcagcagtgtggttagcaggcagggccagtgtgaccctccctttctgggcctcagttgagaaacctgaagctcaggagaggagtcactcccctggcagatgggtggctgggccagaagcagataccaggctttctgactcctgctctaggattctcaccacgtactggctagac

SEQ ID NO: 33092 - DNA, 201 bp, Homo sapiens
tctcatttccagttcataattaaatttcccccattttcttgaacaacatctttccatgtagatcaatggaatagaatggagaattcagaaataaacccatwcgttcttggccaattgacaagatgtcaaattttgataagggtgtcaagatcattcaaatgggaaagaatagtctcttcaacagaagacccaccctggggt

SEQ ID NO: 33093 - DNA, 201 bp, Homo sapiens
acacaggtcttgctctgggaccgccctcagcagtgtggttagcaggcagggccagtgtgaccctccctttctgggcctcagttgagaaacctgaagctcaggagaggagtcactcccctggcagatgggtggctgggccagaagcagataccaggctttctgactcctgctctaggattctcaccacgtactggctagact

SEQ ID NO: 33094 - DNA, 201 bp, Homo sapiens
tccagttcataattaaatttcccccattttcttgaacaacatctttccatgtagatcaatggaatagaatggagaattcagaaataaacccatacgttctkggccaattgacaagatgtcaaattttgataagggtgtcaagatcattcaaatgggaaagaatagtctcttcaacagaagacccaccctggggtccttaat

SEQ ID NO: 33095 - DNA, 201 bp, Homo sapiens
cacaggtcttgctctgggaccgccctcagcagtgtggttagcaggcagggccagtgtgaccctccctttctgggcctcagttgagaaacctgaagctcaggagaggagtcactcccctggcagatgggtggctgggccagaagcagataccaggctttctgactcctgctctaggattctcaccacgtactggctagactt

SEQ ID NO: 33096 - DNA, 201 bp, Homo sapiens
taaatttcccccattttcttgaacaacatctttccatgtagatcaatggaatagaatggagaattcagaaataaacccatacgttcttggccaattgacargatgtcaaattttgataagggtgtcaagatcattcaaatgggaaagaatagtctcttcaacagaagacccaccctggggtccttaatctccagcatcaga

SEQ ID NO: 33097 - DNA, 201 bp, Homo sapiens
acaggtcttgctctgggaccgccctcagcagtgtggttagcaggcagggccagtgtgaccctccctttctgggcctcagttgagaaacctgaagctcaggagaggagtcactcccctggcagatgggtggctgggccagaagcagataccaggctttctgactcctgctctaggattctcaccacgtactggctagactta

SEQ ID NO: 33098 - DNA, 201 bp, Homo sapiens
tttccatgtagatcaatggaatagaatggagaattcagaaataaacccatacgttcttggccaattgacaagatgtcaaattttgataagggtgtcaagawcattcaaatgggaaagaatagtctcttcaacagaagacccaccctggggtccttaatctccagcatcagactccaagaccatttgcagagatcatccaga

SEQ ID NO: 33099 - DNA, 201 bp, Homo sapiens
caggtcttgctctgggaccgccctcagcagtgtggttagcaggcagggccagtgtgaccctccctttctgggcctcagttgagaaacctgaagctcaggagaggagtcactcccctggcagatgggtggctgggccagaagcagataccaggctttctgactcctgctctaggattctcaccacgtactggctagacttat

SEQ ID NO: 33100 - DNA, 201 bp, Homo sapiens; identical to SEQ ID NO: 6355

SEQ ID NO: 33101 - DNA, 201 bp, Homo sapiens
cccttcctgccttgcattctggtgcttggtttacttccttgctaataaatgtcttttgtgtcatcttgtttttgtttttgtttttttccagaatagggcaytgtcatctgtattaaaaccctgttcaggcagatatgctttcccctcaataattatcttcatggcatctgggaactcatttgtctccttttgcttggcaga

SEQ ID NO: 33102 - DNA, 201 bp, Homo sapiens
aagtattcagtcttttagcagattaggtcttaactggagattttttgagtagatgccccccacattatgagattgaggaaattttcatctattcctagctygttgagtattcttatcatacctgaggtgtttggttttgtcaaatgctttttctgtgtctattgaaatgaacatggttttctttttggtcccctattctag

SEQ ID NO: 33103 - DNA, 201 bp, Homo sapiens; identical to SEQ ID NO: 6357

SEQ ID NO: 33104 - DNA, 201 bp, Homo sapiens
aggtggttgtagtcaggccagaggtgagttggcaactgggaagatcactgaattgcacagtgaagacttcttcaaccttatacaccctggaggatctggamcaggagttcatggcttttgccaatgctcaatgggaagcagaagtacgacgcttattttctctattaatgagttcatccaaatgtttagaatttaattttt

SEQ ID NO: 33105 - DNA, 201 bp, Homo sapiens
gcttttttttttttttttgcattgagtgaatattttctagtgcaacatgtaaaatcctttaatgtttttctttccactatttaaaaagttgtgttctgagyggttgttctagggcttagcacatcgattttaacttaccagtatctacttcagatttataccaacttaattccagttaaatattgaaatgtcattcctata

SEQ ID NO: 33106 - DNA, 201 bp, Homo sapiens
tcacaggatgagtttggaagtattctctcctcttcatttttctgtaatagtttgagtggaactggtattaattcttttaaaaatggttggtagaattcagyagtgaatccatctggtcctgggcttttctttgatgagagactttttattactgcttcaatcttgttacttatattggtttgttgaggttttctatttctt

SEQ ID NO: 33107 - DNA, 201 bp, Homo sapiens; identical to SEQ ID NO: 6358

SEQ ID NO: 33108 - DNA, 201 bp, Homo sapiens
tctgggacaaattccaaaaaaaattagctttaatcaaatttacttttactttatctttctgaaccttcaaggtccaaaagcattggttaataattctgctwctaaacttaacattgcagcacagggcatgttctgcccccaaggcaaagaccataagctactgttgtctggaaaacatacaaatagatatctcagcaaaag

SEQ ID NO: 33109 - DNA, 201 bp, Homo sapiens
cacctctcttttgctttaagttgtcatataatgactttgcattttctcaaatcacattggcatctataaatacgcctttcttatagcaatgctacacccaygttaaagctgcattttcaatatgagacaaaaacgtatttcagaaaaaaatgcaaggtttggctcctgctggcatagctgcagcaatgtcttcatgaatct

SEQ ID NO: 33110 - DNA, 201 bp, Homo sapiens
ttgctgtgtttcctttttcatttctgattttatctgagtgttttctctttttcttagtctagctcaaggtttgccaattttgtttatcttttttttttttwaaaaaactttttgtttcattggtctttgcattgtttatttagcctcaatttaatttattttttccctgatctttattatttctttccttctacaaagttt

SEQ ID NO: 33111 - DNA, 201 bp, Homo sapiens
agccatcttgtgctcctacaaggattataccccgaggttgtctgcagaatctctcactaaatgttccttaaggtgttgcctgacacacactgcttagctcrtccatgaaggtatcaagaaaacctgcagaatataattctgtccagtgcaacaaatattctggttgattttctttgtgcagggctgcatttgtctgtttgg

SEQ ID NO: 33112 - DNA, 201 bp, Homo sapiens
ggattatttgagcccaggagttcaaggttccagtgagctatgtttgcatcattgcacctcagcctgggcaacagagcaagaccctgaccaactccccaccyccccccaaatcaatgcaacctgtgatcactttatttgggcaacttccccaaattcttgactcagtgaatttgttgcagggcttttcttttttaatctctt

SEQ ID NO: 33113 - DNA, 201 bp, Homo sapiens
tgctgtgtttcctttttcatttctgattttatctgagtgttttctctttttcttagtctagctcaaggtttgccaattttgtttatctttttttttttttwaaaaactttttgtttcattggtctttgcattgtttatttagcctcaatttaatttattttttccctgatctttattatttctttccttctacaaagtttg

SEQ ID NO: 33114 - DNA, 201 bp, Homo sapiens
gcagaagctgtttagtttaattagatcccatttctcaattttggcttttggttgtcattgcttttggtgttttagttatgaagtctttgcccatgcctatktcctgaatggtattgcctaggtttttttctagagttttcatggttttaggtcttatgtttaagtctttaatccatcttgagttaatttttgtataaggtg

SEQ ID NO: 33115 - DNA, 201 bp, Homo sapiens
gattgtcagtactgaatatatcccattgtatgaatacaccacaattttatttatccattctactgttgatgggctttgggttgtatctagcttttcactaytgtgaacaatgttacaacgaacattcttttacattctgaaacacatgtgagtgggtttttagagtatatacctaggggtggagctgctgcgttggagggc

SEQ ID NO: 33116 - DNA, 201 bp, Homo sapiens
tttgcttggtccagaactgagttcaagtcctgaatttccttgtgaattttctgtctcgttgatctgtctaatattgacaatggagtgttaaagtctcccastattattgtatgggagcctaagtctctttgtaggtctctaagaacttgctttatgggtgctcctgtattgggcgcatatatatttaggatggttagctct

SEQ ID NO: 33117 - DNA, 201 bp, Homo sapiens
tgtaggtctgatttctactccccaccccactccttcttgtcactgaaaagtcatggaattctggaatctcagggttgacagtgactgtgaagcagagtgcygtacactggtatccatctctgggagagaaataccatgcaccaattaggttgggttgccaatcccagggcaggactctaaacacctcagcagtctttacta

SEQ ID NO: 33118 - DNA, 201 bp, Homo sapiens
agtttttttttagtggatttcgtaggattttctacattccagatcatgttatctacaaatagagatagcgttacttcttcctttctaataaggataacatktatttcttttgcttatctaattgccctggcttgaacctctagtaccgtgttgaatagaagtggaaagaggagattcttatcttgttcctgatcttaggtg

SEQ ID NO: 33119 - DNA, 201 bp, Homo sapiens
cttttatttctgcttgtcgtaatagccttcagtgagataaactgttaaggggtctctagtagcgtatttcaggttttaaatggtcaatgagaggaagaagrggcagacatgaatgtttatcaaaggatggactaggactgatgtgactcatggagactgttcgtttgtaaaggcaccatcttcatggttgtgcatgtcctt

SEQ ID NO: 33120 - DNA, 201 bp, Homo sapiens
tcttctttctctccttcctccagcccctggcagccattaatcaactttctgtccttatgaatttgcctatttctatggattccattcacaaaatacatgartagctttttccctttagcataaagagttttgtatattgatcttgtacttcaacatttctgaacttgtttatttgttctaatagtttttttttagtggatt

SEQ ID NO: 33121 - DNA, 201 bp, Homo sapiens
taaagtcagctagataaaagaaaatgttattaagaaaattttaaggtttgagaaaaaattttagggttgagaaaaaatgtattaagtattcattaagtggsagtggatcatcataaagatcttccttttgattgtcctccactgagtaggctgaggaggaagaggaggggttggtcttgctttttcagggatggcagatga

SEQ ID NO: 33122 - DNA, 201 bp, Homo sapiens
ctatgtttttttatgttagatttttctcttgtcaataagttaaagatatctttacaggtcaatgcatacagatttgacatgttcttttaataattgcatgrtagtctttactttggatgcaatgtagttttccaaccaattaagattgatagagatttaagtgttttccacttttggggtttatgagcaataataagaatt

SEQ ID NO: 33123 - DNA, 201 bp, Homo sapiens
atttaataagatgtaactatttttcagagtggttgtacatatccctgattgctaaggcattagttatgtacatgactgattatattgagggttttaaaatrtacttatcagtcatttggatttcctcttttgcccattcaagtctattgcccactgggttgtctactcgaattatgtatgcattctggatactagttcttt

SEQ ID NO: 33124 - DNA, 201 bp, Homo sapiens
ttttctatcaaagtttttggagtattacaaattttatttcttttttctttttcttttttaaattttaaccaaccattttcacccccccttccctacttacmctttccaccttctggtaattaccaatgaactctctacctccatgagacccacttttttagctccacatataaatgagaacatgtggtatttgtctttctg

SEQ ID NO: 33125 - DNA, 201 bp, Homo sapiens
ccacagtcctgctctccccagtgctcccatgtcgctgaaggcaccaccatcttccaagatacatgggcctccccagggtctaggagtcctagacgtgggastagaaattagatgacattggtgtctaaacaaaacaccactgcatggagatagaacaggggagccccctgaatgtggtgagagcaccctcccaggtgtgtt

SEQ ID NO: 33126 - DNA, 201 bp, Homo sapiens
tacctcttattttggcggagcatatagttccaaaatattattaatattgttggtctagccagcttaaattaggatttggtcacttgcaattgaaaaagtcktgacaaatacaagagtaagattcttggcaaatgcatagttgctaaatccaggtgaaacacctggtgtctgatctaagtatattattttgttagggatgga

SEQ ID NO: 33127 - DNA, 201 bp, Homo sapiens
agagaagtaggagacagtgacatgaaatgggggttcacagccttgtgttgggaattgaatgagaaacaagagcttgaacttggatgttccccagagcgagygcaaggtcagatgagtttttcaagataggagtgatcggtctttcccagggtggggcccataatgcaagacaattatagattaacgggtaataagtaactg

SEQ ID NO: 33128 - DNA, 201 bp, Homo sapiens
attattttgttagggatggagtatacatttttatctattgttctggcttcttacaaagttcagtagactttgtaacacagtcacattctctctcatattgrcagatgtttggtgaaagagtgactgttcaaccaactcatgggaaaatgcaaccaagcgctttctaaaaatcagggagactacagttgtaggcctttcaaa

SEQ ID NO: 33129 - DNA, 201 bp, Homo sapiens; identical to SEQ ID NO: 6497

SEQ ID NO: 33130 - DNA, 201 bp, Homo sapiens
aaaaactgaactcatttttcaaaagccttaacagtctgtcttattctgatacttcttttatggttattgtatgagaatcaactacccaggcacctcggagyatgttgatttcagagttcagtgtcagaccccatgagcccctgtgggatggtgccagctgactgccatgttcctgctgtttattgcttgggtgccattaca

SEQ ID NO: 33131 - DNA, 201 bp, Homo sapiens
ctgagagccccaaacagagatttacccacatatttattgacagcaagcctgtgataagcatcatttctatagattatagattaactaaaagtattccttaygggaaacaaagggatgggctctggctaattatctgcagcagaaacatgtccttaaggcacagatggctcatgttattatttgtagtttaggaacacctta

SEQ ID NO: 33132 - DNA, 201 bp, Homo sapiens
gagggttcgattcacttgttgtgggagacgggcggcacttagtattttcttttcagtttacacgttcctgggcatccctattaagatgtgcagataaacasgcacatgcttcatgtggcatctcccttagttaaacatcttttttttttttcctttcctgtgagtcttcctgaaacaggtgagcccaggtggagcctccgc

SEQ ID NO: 33133 - DNA, 201 bp, Homo sapiens; identical to SEQ ID NO: 6378

SEQ ID NO: 33134 - DNA, 201 bp, Homo sapiens
gtggaagagtaaggcaggatcacttccctcttattcccatgttggtgtgactttgcgactttgaccaaagccttacctgcctcctctgcccaaggagggacgtggccgtctcagagggctgcttggtttctgtccaagctggcccttggggaagccctttggccacccaggtggtgattcctgctgtaagaacatgagagg

SEQ ID NO: 33135 - DNA, 201 bp, Homo sapiens; identical to SEQ ID NO: 6653

SEQ ID NO: 33136 - DNA, 201 bp, Homo sapiens
ccactatcccaggtgtgtattggagtgggacttttacatgcgtatattctttcagatgtattactttggatcgattaactagccccagatatatgctgagyaagcattctgagataatttaaaatgccctcttttgttaatttttgactcctaggtttgagtctgtctttggcatcatcttctggatgatttcttggtatc

SEQ ID NO: 33137 - DNA, 201 bp, Homo sapiens; identical to SEQ ID NO: 6654

SEQ ID NO: 33138 - DNA, 201 bp, Homo sapiens
ctctaagaggttggacttatcaaagcacttttctcctcgttatcctccattaattacagtaccaagcaccacccatgtgttgcctacaccccacagccttyggccgagttgaggatctgccacttcctgaacccacgctgagtttattgtggctcacagggtcacctagaggcctttaaagatataaaaacctatatatga

SEQ ID NO: 33139 - DNA, 201 bp, Homo sapiens; identical to SEQ ID NO: 6655

SEQ ID NO: 33140 - DNA, 201 bp, Homo sapiens
gcagcagtgttggtacctaagttataaggcaaagtcccctttacctttccttgtgctttcctcaagcagaatgagttttgctccatagccatcacagctgrgaatgtgctgaatctcacctagagccagtaagtctcagaggctcaccaaggcccttgacgtagtacgaggtttcactgctggtattcaggttccaaggtc

SEQ ID NO: 33141 - DNA, 201 bp, Homo sapiens; identical to SEQ ID NO: 6700

SEQ ID NO: 33142 - DNA, 201 bp, Homo sapiens
atagtgggagactttaacaccccactgtcaacattagacagatcaacgagacagaaagttaacaaggatacccaggaattgaactcagctctgcaccaagyggacctaatagacatctacagaactctccaccccaaatcaacagaatatacattcttttcagcaccacaccacacctactccaaaattgaccacatagtt

SEQ ID NO: 33143 - DNA, 201 bp, Homo sapiens
aagaataaataaataaataaataaataaacgctctctcagtgggtgggtgtcagctgagtttggtctgggtttcctttctgctctaacagaatagcactgmtttcagtgcctcccaattgtctcccaccagggctcagggattctctttatgccacaccgccactgtgggttcagggggttgggtgacataggagatgcag

SEQ ID NO: 33144 - DNA, 201 bp, Homo sapiens
ttgctttttaaaaatttctcacaccagttaccctaaatcatctttctaaggttcaaagttccacaaatcactaggtcaggggcaaaatgctgccagtctctttgctaaaacataacaagagtcacctttcctccagttcccaacgagttcctcatctccatttgaaaccacctcagtctggactttattgtccatattgct

SEQ ID NO: 33145 - DNA, 201 bp, Homo sapiens
caacgagaacaaagacacaacataccagaatctctgggacacattcaaagcagtgtgtagagggaaatttatagcactaaatgcccacaagagaaagcagraaagatctaaaattgacaccctaacatcacaattaaaagaactagaaaagcaagagcaaacacattcaaaagctagtaaaaggcaagaaataactaagat

SEQ ID NO: 33146 - DNA, 201 bp, Homo sapiens; identical to SEQ ID NO: 6612

SEQ ID NO: 33147 - DNA, 201 bp, Homo sapiens
gtgtaaacgaaccttgtattcctagaataatcccacttgattgtgttgtataatccttttacatgttactgaatttggtttgacagcattttattgaggasttttgcatcatatccataagagatattggaagtcttattttcttgcggagccttggtctgtgtttgctatctgaatattactggccttgtagaagaaact

SEQ ID NO: 33148 - DNA, 201 bp, Homo sapiens
cagcaggcaaagaaagagagcttgtgcaggaaaacttccatttttaaaaccaccagatctcgtgagacttacttactactatgagaacatcacgggaaacrcccagccccatgattcaattatctccctccaggttccttccatgacacgtggaaattgtgggagttccaattcaagatgagctttgggtggggacacagc

SEQ ID NO: 33149 - DNA, 201 bp, Homo sapiens
ttaatgcagtctgataatctcttttaattgagttgtttaatccattcacatttaatactattattgatgtagatggatttatgtctaccatcatttttttmttttcttttttttttgagacaaaatctcattctgttacccagactggagtgcagtggtgtgatcttggcccactgcaacctccgcctcctgggttcaagc

SEQ ID NO: 33150 - DNA, 201 bp, Homo sapiens
gttagccaggatggtctcgatctcctaacctcgtgatccgcccgccttggcctcccaaagtgctggaattacaggggtgagccaccacacccagcctggaygccatgacttttaaggagagagtaaggaaccacatcttctacttagaggagcatttattttgcccatattttttcaaaaatgccttaaacatagcctctg

SEQ ID NO: 33151 - DNA, 201 bp, Homo sapiens; identical to SEQ ID NO: 6384

SEQ ID NO: 33152 - DNA, 201 bp, Homo sapiens
gggaggaggattgcttgagcccaggagtctgagagcagcctgggcaacatgctgagactccatctctacaaaaaattaaaaaattatccaggtgtgatggygcacacctgtggtcccagctactcgggaggctgaggcaggaggatcacttgatcccaggaggtggaggctgcagtgtgccatgttcacgccacctcactc

SEQ ID NO: 33153 - DNA, 201 bp, Homo sapiens
tgggattacaggtgtgagccactgtgcctggccccattttactttttatgctctatatctctcatgtatttatttgttcctctgttctgcctttattgcttttttttttttttttgcattgagtgaatattttctagtgcaacatgtaaaatcctttaatgtttttctttccactatttaaaaagttgtgttctgagcggt

SEQ ID NO: 33154 - DNA, 201 bp, Homo sapiens
tccgagatacggaaagctatgtgtgattttatatcacctatcatgttaagatatgtataaaataggaaacatattggccatatatcattttatatattttkggttttacatgtctaaaaaatacatgtttttttgtatgtattaaaggataggtatgtataagaggttttatagaagtggaaagttatattttttgcatat

SEQ ID NO: 33155 - DNA, 201 bp, Homo sapiens; identical to SEQ ID NO: 6614

SEQ ID NO: 33156 - DNA, 201 bp, Homo sapiens
aaatgggatattgtttcttcatattaaatagaagtatttctccaaaaagctgttggttagaacactgaatttatgtcttacatttctgctcttatagttcygcatccacttgtttcattaagcaaactttcccttaaagtgcaggaaagtgaaaaaatcctaagtgcacagcttgataaattatcacaaattcacgtagtg

SEQ ID NO: 33157 - DNA, 201 bp, Homo sapiens
aagtggaaagttatattttttgcatatctttatgaattataataaaggaaggaaaattctcaaagaggaattcagatatcaaagagtgccctttgacaaaragccttggttacaacatacctacaaaagtgaactgtcattgaaagacctatggacactggatttctctttccttatttagaagggcaggctgtgtcttgg

SEQ ID NO: 33158 - DNA, 201 bp, Homo sapiens; identical to SEQ ID NO: 6616

SEQ ID NO: 33159 - DNA, 201 bp, Homo sapiens
gatccaccacactcagaagtatcattttctctaagagactcaaaagtgtattagggagaatttatttaaaaataaaataaatgggatattgtttcttcatrttaaatagaagtatttctccaaaaagctgttggttagaacactgaatttatgtcttacatttctgctcttatagttctgcatccacttgtttcattaagc

SEQ ID NO: 33160 - DNA, 201 bp, Homo sapiens
ctgtgcctgtgtgtgtccacgcgtgtttgtgtgtgtgcatgcacacatgtgtcagcatgcagtgtctcagatcctacataggggtttttcctgaaggtctycagtagcaaaaactcattgagtctatccaggggaattacatccaatgctgtaattaaatactttaacaaagatagcagatcatcattcaagagaacatca

SEQ ID NO: 33161 - DNA, 201 bp, Homo sapiens; identical to SEQ ID NO: 6618

SEQ ID NO: 33162 - DNA, 201 bp, Homo sapiens
agatcctacataggggtttttcctgaaggtctccagtagcaaaaactcattgagtctatccaggggaattacatccaatgctgtaattaaatactttaacmaagatagcagatcatcattcaagagaacatcaagatagttttaattaagaaaaaaaaaaggaatcactgccaggcttttttagtttttggtgagttccag

SEQ ID NO: 33163 - DNA, 201 bp, Homo sapiens; identical to SEQ ID NO: 6578

SEQ ID NO: 33164 - DNA, 201 bp, Homo sapiens
gccatatatatatatataagtaggagagggcgaacctctggcaggagcaaaggcgccatggctgtggagtcccagggcggacgcccacttgtcctgggcckgctgctgtgtgtgctgggcccagtggtgtcccatgctgggaagatactgttgatcccagtggatggcagccactggctgagcatgcttggggccatccag

SEQ ID NO: 33165 - DNA, 201 bp, Homo sapiens
ctgtgggttcaattttgtgtgaatcacatcctgctgattgctgagtgggcgtgtgggagggtgtgcctggaggagaacttagactcggccttttccagatragcttcagtgtaagagtgggtttcatgaagagcaaaggtcctaggaaatttaagtaagccatttaccaacgctcagaagaaagaacttgaagagcacttg

SEQ ID NO: 33166 - DNA, 201 bp, Homo sapiens
ttggcagacctatttttcagatgatgaaactgaggcacagaggggttgagtgacttgcccaaggttatgcctcaagtaagtgggggagccagaattcaagmccatacattctttgtaaaaaaaaaaaaaaaaaaaaggaaagaaaaaaaggctgagtgtggtggctcacacatgtaatcacagcactttaggaggccaagg

SEQ ID NO: 33167 - DNA, 201 bp, Homo sapiens
acttcttccacgtactatattataggagcttagaatcccagctgctggctctgggctgaagttctctgatggctcgtgcagggtggactggcctccttccmctatatgtgtgtctactgctgacctgtggctttgccaaggcagggaagctgctggtagtgcccatggatgggagccactggttcaccatgcagtcggtgg

SEQ ID NO: 33168 - DNA, 201 bp, Homo sapiens
gatatgcattttccagcacaattatctccaacctccacaagattaatgatcttaaccatgcattcagactctcttcagaacaacatggtgagatatcaatrttgtcttcttgatgcaagtttcccttgaatgatttaaacttcagatgggtggactgtctccttagggagaatttgcaaattaaatataataaaagctaac

SEQ ID NO: 33169 - DNA, 201 bp, Homo sapiens
tttcataagtacttcagctgtgacacttgcataaacttgggtaaaaactcagcgttatctagattaaatatgataatacatgcagatgactggcatgtggmtatgaatcagcaatacccgtaattgggtgggtgatatgcattttccagcacaattatctccaacctccacaagattaatgatcttaaccatgcattcaga

SEQ ID NO: 33170 - DNA, 201 bp, Homo sapiens
ttatgagtaaatcattggcagtgaatgtgaatttttttttaaatgaatgaataagtacacgccttcttttgagggcaggttctatctgtacttcttccacktactatattataggagcttagaatcccagctgctggctctgggctgaagttctctgatggctcgtgcagggtggactggcctccttccactatatgtgtg

SEQ ID NO: 33171 - DNA, 201 bp, Homo sapiens
cactttttctgcatgattcctgccccagaggggtcaacaagaaagggcatcccactggctgactcatgcagggaagctgtcagtaattaattagcaaggcmgggaagttgtaccccaagtcttggtttcaacactagaggactttaggaggtggttcaatgtagtgtttgagcacgcggaccctggagtcctccaagcctg

SEQ ID NO: 33172 - DNA, 201 bp, Homo sapiens
acgaggcctaccggggtactcccagcacctcgtagtagtccactatgctggactgccaaagagcctgcggggcactggcacagcgagcggcaaggctgccrgcacccgcgcacaggtcagaggcttggcgacctgggccgcctggagggccgccccttatgacgcagccacatctcattggccgaggcctgtgagcgcctc

SEQ ID NO: 33173 - DNA, 201 bp, Homo sapiens; identical to SEQ ID NO: 6518

SEQ ID NO: 33174 - DNA, 201 bp, Homo sapiens
ctaggacaggagcccctggaactgtctggctgggcaagccatacttacctgcacttccctattccatctgtgagtgattcagacttgactattgttatcayactaaactaaactggggttcactcacccagcacagtaagaccaaacatctacactgagatttgcaatgggagaaaggaaggcatttatgtgcagggcaca

SEQ ID NO: 33175 - DNA, 201 bp, Homo sapiens; identical to SEQ ID NO: 6626

SEQ ID NO: 33176 - DNA, 201 bp, Homo sapiens; identical to SEQ ID NO: 6396

SEQ ID NO: 33177 - DNA, 201 bp, Homo sapiens
tgcctcttgctctcttttaggaattctttttcctactgtgatatatgtaagtacttataaatttaaacttaaaattcaaaaaatataccaggatgtgaaakaaacattattaaatataggtgttttgctgtgagtgtttcttggaataggtagggctttgtatagtaggttttggtcttttggtcagcttgggaaaatttt

SEQ ID NO: 33178 - DNA, 201 bp, Homo sapiens; identical to SEQ ID NO: 6397

SEQ ID NO: 33179 - DNA, 201 bp, Homo sapiens; identical to SEQ ID NO: 6673

SEQ ID NO: 33180 - DNA, 201 bp, Homo sapiens
cccttttccatttccatggagatgcagtgcagcatcttcaagtctctaattcttacatctgtctctttcacttgcaagagcccttgtgattacattgtccygcccggacatccagcataatctccccatgtcaaaacccttaatataatcacatctataaagtctcttccacctgtaatggaatatattcccaggtttgcg

SEQ ID NO: 33181 - DNA, 201 bp, Homo sapiens
gaccctggaagctgatgccttgggctgctcctcctatttcctgggcaccaggaatatgagctactccctccccacagtcctgctctccccagtgctcccawgtcgctgaaggcaccaccatcttccaagatacatgggcctccccagggtctaggagtcctagacgtgggagtagaaattagatgacattggtgtctaaac

SEQ ID NO: 33182 - DNA, 201 bp, Homo sapiens
ctgcccggacatccagcataatctccccatgtcaaaacccttaatataatcacatctataaagtctcttccacctgtaatggaatatattcccaggtttgmgcaactacaatgtagatactttgtggggctgtgattctgcctaccacagacactaagcttaaagtgaaacccacatcttattcaaaacttggaggttttc

SEQ ID NO: 33183 - DNA, 201 bp, Homo sapiens
tgaggccaggctccagctcccccggtcccttggtgagcaggagctccctgaacccaccatgggtctttgctagggttgtcttgcacatgtgtgctttagayagcagcacctcttcttccatggtgtagatggagaatcctcaacaaagcctttccaagaatctgatcatcacatcttgagctcagcctccctgcagctttt

SEQ ID NO: 33184 - DNA, 201 bp, Homo sapiens
gataatctgtttacgttttaaaaggggatttatttgaaaaacatataaaaacacgacagaccacttcataggccactttacaccataaaataggtaataayaacatacaggtatctttgcaagcgtaaaccctcaggtgtactaatgaccttcatataggtgtatcaattgtgagaagatgaatcatattcttaaagtaat

SEQ ID NO: 33185 - DNA, 201 bp, Homo sapiens
gtgttacccatatgtgggaagaaagagtattaagagttagcaaatagggtcacatccagcagagaccatatggttggggactagggcaatggtgactcctyagacctcagctgcagcctgataaacgtggttaagagagaagtaggagacagtgacatgaaatgggggttcacagccttgtgttgggaattgaatgagaaa

SEQ ID NO: 33186 - DNA, 201 bp, Homo sapiens
ttcagatgatctgccctcctcagcctcccaaagtcctgggattacaggcatgggccaccacgcccggccaagaaatgttatctttcacagatgcagatgtrcaaaagggacatctcttcattattgaggacatttcaacatttgtacgtacatgcctaatgcttacacacttactcttgtgctaatgcacttccatggagt

SEQ ID NO: 33187 - DNA, 201 bp, Homo sapiens
atttctttccagtttaacaaattattttgtgcgaattcatgtactcatcaattatcaaattttataaaactgcccttcttgaaagtatatgtaataatttraaaattatagatcatattcaggctacattttaaaatacgatgtttagaaaagtaccaaaaaccacagcaagaaatgaaacttccgttttttgttaattct

SEQ ID NO: 33188 - DNA, 201 bp, Homo sapiens
ccttttttcattttttaaaaacaatactttcaaagagcaaaaattttagaatttgatgaggtttattctagtgaagtttttatcgtttgtactttttgtaycctaaggaagctttgtttaccccaagatatagtttctacattctcttaaaaacactaaagagttccagtttatatgtttagctctgtgagattgggagag

SEQ ID NO: 33189 - DNA, 201 bp, Homo sapiens
tactcttgtgctaatgcacttccatggagtcaaatttgtgagcataaaatgaattagaattctccataagtctatacacagtctctgccttcagtattggraatgatatgaagatgaaatacatagcatagcaaattgtaaaaataatgctgacaatttaaccttgtgaaaaaacctaaaaagaagaaaaagtaaaagaaa

SEQ ID NO: 33190 - DNA, 201 bp, Homo sapiens; identical to SEQ ID NO: 6359

SEQ ID NO: 33191 - DNA, 201 bp, Homo sapiens
ttccttgtaaccttgtgttttgggaacctagcaactctactccccactaagtgacaacccatgcaggtttgcccagattattcccagtttaacactggaartctcacgtcctgggagactcttcattccccaaggagcagggacagcaggtcactgtcactggagcactggaagctggccacatcattagcagattcagaa

SEQ ID NO: 33192 - DNA, 201 bp, Homo sapiens; identical to SEQ ID NO: 6677

SEQ ID NO: 33193 - DNA, 201 bp, Homo sapiens
gtgggtgatcactgtcctggtctccctgaagcaaggacgcctctctggcctcagggtgcctgtcaggcaagtctctcctgtccctggaggttcacagagcmgcatccctgcaagagcaatgctaagtggggttggctttgagccccagccattctcttaacaattcttttagttaagtatcagttcccccatcccctcact

SEQ ID NO: 33194 - DNA, 201 bp, Homo sapiens
gtccagctgtgaaactcagagatgtaactgctgacatcctccctattttgcatctcaggtcacccgatgacccgtgcctttatcacccatgctggttcccrtggtgtttatgaaagcatatgcaatggcgttcccatggtgatgatgcccttgtttggtgatcagatggacaatgcaaagcgcatggagactaagggagct

SEQ ID NO: 33195 - DNA, 201 bp, Homo sapiens
ggtcaatggtagtgcagttcagggtttcaatggccactgagaggaaggagaggcagggacgaggatctgtcaaaggatgggcaagagtggtgtgactcacsgagactgttcgtttgtaaaagcaccatcttcatggctgtggatgtgcttcagctgggcaggagcagggacactacactgagaactgatccatccaatctt

SEQ ID NO: 33196 - DNA, 201 bp, Homo sapiens
ttttccatgaaactttttattttagaagaaatttagatttatgcaaggttgcaagaactagcacagagaattttcatatcctgtgcctagtttcctcctcttttttttttttttttttgagacaaagtgtcactctgtcacccaggctggagtgcagtggggcaatcttggctcactgcaacctctgcctcctgggttcaa

SEQ ID NO: 33197 - DNA, 201 bp, Homo sapiens
gagagtcctctttgagctttacaagaaatatcctggtgtgaaaaaagaccaaaaccagatagccagcctgaacactctctgtttagagaaagctggcttakcaatgttgtatgtcttttggatgtgctgtgttattcacatatgagaagaaagagtttcaagggttagcaaatagcgtcacattcagcagagaacatgtgg

SEQ ID NO: 33198 - DNA, 201 bp, Homo sapiens
tttccatgaaactttttattttagaagaaatttagatttatgcaaggttgcaagaactagcacagagaattttcatatcctgtgcctagtttcctcctcttttttttttttttttttgagacaaagtgtcactctgtcacccaggctggagtgcagtggggcaatcttggctcactgcaacctctgcctcctgggttcaaa

SEQ ID NO: 33199 - DNA, 201 bp, Homo sapiens
cagctgtgaaactcagagatgtaactgctgacatcctccctattttgcatctcaggtcacccgatgacccgtgcctttatcacccatgctggttcccatgktgtttatgaaagcatatgcaatggcgttcccatggtgatgatgcccttgtttggtgatcagatggacaatgcaaagcgcatggagactaagggagctgga

SEQ ID NO: 33200 - DNA, 201 bp, Homo sapiens
ctccgctcactgcaaccttcacctcccgggtttaagaaattctcccacctcagtctcctgagtaactgggactgcaggcatgtgccactgctcctggcaatttttttttttttttttttagtagagatgaggtttcgcaatgttagccaggctggtcttgaactcctgacctcatgtgatctgcccgcctcggcctcccaa

SEQ ID NO: 33201 - DNA, 201 bp, Homo sapiens
agctttgtaatgtcttgaaatgagtagtattagctctctaatttttttcaaagttgtttttgctattgtaggttttctacatttctgtatgaattttagartcagtttgccaatttgcacaaaaaaaagcctgttgggattttggttgaaatcatatttaagttacagttcaactggggagaaacagcatcctaacaattt

SEQ ID NO: 33202 - DNA, 201 bp, Homo sapiens
atagtttagagaattttcatctaccctgtgtccagtttccaccattgttaaatctcatgtttctatggcacatccatcacaactcattcaccaatattgaygcataatgatgagctaaaagctaaagtctgtttccttcagatttcattaatttttacttaatttccctgttcttttatgggatcccagtgataccacctg

SEQ ID NO: 33203 - DNA, 201 bp, Homo sapiens; identical to SEQ ID NO: 6367

SEQ ID NO: 33204 - DNA, 201 bp, Homo sapiens; identical to SEQ ID NO: 6366

SEQ ID NO: 33205 - DNA, 201 bp, Homo sapiens
agattttcatgatgttcgccccgctgacattctcttccatagtgttgacaatcctttccatagaaaaccatgtgtaatgagccttaaagtgccttgtaacyccttgttctaatggctgaattagagatgatgtttgaggacatggagaccactttggctccttttgtgttgaattcatggggttctggatggctagaggca

SEQ ID NO: 33206 - DNA, 201 bp, Homo sapiens
ggcactgcttcttctacatcttctttctcatcaagtactgattggaaagcactcatctctatcaggtcatctattgattccctgagtgtggcatctattgkctcttgaatttctccaagagtcatattttgaaataccttatccccaacattttgttgctgtatccataatcccttcatgacttccttgattggctctgtc

SEQ ID NO: 33207 - DNA, 201 bp, Homo sapiens; identical to SEQ ID NO: 6687

SEQ ID NO: 33208 - DNA, 201 bp, Homo sapiens
tgactaagcaaatgtctagtaccagttagggtgtcctggaaggaaccatcttgtgcttctacaagaattatgccctgaggttggctgttgaatccctcackaaatgctcctcagtgtgttgcctaacacacactgctgagctcacccattaaaatctgcatgatggaattcagcccaatgcaatgagaattcccatggact

SEQ ID NO: 33209 - DNA, 201 bp, Homo sapiens
ctaacacacactgctgagctcacccattaaaatctgcatgatggaattcagcccaatgcaatgagaattcccatggacttcctctgtgcaaggcaaagcaygggtgctgtggaaggaggatgaaaacaggtagaagatgtaatctcatcctcaaggggtgctcggtagaatggaggaaacaatacatagattcctgaagat

SEQ ID NO: 33210 - DNA, 201 bp, Homo sapiens
tgttcagaatgcagaagcagagtgggcagagagagacagctcatcagagtgcttgggcaagcatagggacggcgactcaccactgcagacaatgtatctgwggaaagccatttaaaataggtgacagtcacattccatcaaatttctggaagggtccatggaggcagggttgtcaatctcattacagcatttcagaggcct

SEQ ID NO: 33211 - DNA, 201 bp, Homo sapiens
gcaagcatagggacggcgactcaccactgcagacaatgtatctgaggaaagccatttaaaataggtgacagtcacattccatcaaatttctggaagggtcyatggaggcagggttgtcaatctcattacagcatttcagaggcctcagaagatttggaaatgaaaaaagacaagcagcacttgtggctcacctgtgtcaca

SEQ ID NO: 33212 - DNA, 201 bp, Homo sapiens; identical to SEQ ID NO: 6691

SEQ ID NO: 33213 - DNA, 201 bp, Homo sapiens; identical to SEQ ID NO: 6417

SEQ ID NO: 33214 - DNA, 201 bp, Homo sapiens
caccaaacatgatgaaaaatacagtagagccatgagagatcactttttactctgacatgcaatttattggagagatgaaatgctcaaacagagagtataartgttatatcacatgcacttaagccacacttcagctcactggaatagcaacaggaggtagctacaaaattattacagtagtgtagtatatactataggtaa

SEQ ID NO: 33215 - DNA, 201 bp, Homo sapiens; identical to SEQ ID NO: 6648

SEQ ID NO: 33216 - DNA, 201 bp, Homo sapiens; identical to SEQ ID NO: 6418

SEQ ID NO: 33217 - DNA, 201 bp, Homo sapiens; identical to SEQ ID NO: 6419

SEQ ID NO: 33218 - DNA, 201 bp, Homo sapiens
gcaaataatcattgtctgcctcaggcttaagtttaataaatagcaaattgcatacagatattttacaacgattgaaagacaaacagaggtcctatccgtgyagtcccaacgataagaacaggtgttggcatgaagtgtttataaattcttgggtacagctgttctgaaagtaaagttcactttcaatcctaaaaaaagtcc

SEQ ID NO: 33219 - DNA, 201 bp, Homo sapiens; identical to SEQ ID NO: 6420

SEQ ID NO: 33220 - DNA, 201 bp, Homo sapiens
attgtctgcctcaggcttaagtttaataaatagcaaattgcatacagatattttacaacgattgaaagacaaacagaggtcctatccgtgtagtcccaacrataagaacaggtgttggcatgaagtgtttataaattcttgggtacagctgttctgaaagtaaagttcactttcaatcctaaaaaaagtccgctattcctc

SEQ ID NO: 33221 - DNA, 201 bp, Homo sapiens; identical to SEQ ID NO: 6698

SEQ ID NO: 33222 - DNA, 201 bp, Homo sapiens
aaggcgaaggaaacaaatgtagcaggcacagcgtggggtggacagtcagctgtcggtggcttctgctgagatggccagaggactccaggttcccctgccgyggctggccacaggactgctgctcctcctcagtgtccagccctgggctgagagtggaaaggtgttggtggtgcccactgatggcagcccctggctcagcat

SEQ ID NO: 33223 - DNA, 201 bp, Homo sapiens
aaataaaaatttctttggcatatggaaatcttgtttaaaaagtttagaaaacattttttaaaactccaatatgaaaagctgggtgcagtggcatgcgcctrtggtcccaggtacttgggaggctcaggtgggaggatcattgagctcaggagtttcagcacctgtggttttttgatttatttatttaaaacacaacaaaaa

SEQ ID NO: 33224 - DNA, 201 bp, Homo sapiens
gcctagtgtatttcaagttttcagtggtcactgagaggaagaagaggcacggacgagggtctgtcagaggatggacaaggactgctgtgactcacggacastgtttgtaaaggcaccatcttcatggttgtgcatgtccttcagctcggcaggatcagggacactacattcagaactgatccatcctggggtttttgcttg

SEQ ID NO: 33225 - DNA, 201 bp, Homo sapiens
ttcatggggttctggatggctagaggcattgtccaatatcaaaagtaatttaaaagacagtcctttagtggcaaggtatttctgatttcagagacaaagcrttggttttcatggaaccagtttggaaaaagtgtttctgttgtactggccttcttgttctacaacaaaaagactgggagctggcgtttattttttccctta

SEQ ID NO: 33226 - DNA, 201 bp, Homo sapiens; identical to SEQ ID NO: 6575

SEQ ID NO: 33227 - DNA, 201 bp, Homo sapiens
ccattcatctgcagaactctcttcatcttcccaaactgaagcttgggacccattaaacaataattgcccattcccctctcctccaagccctggtgtaaccrcccgggggattcaccttgcctgctgcctagacagagtcaatataacaagacaggggaattgcaatagagaaagagtaattaatgcagaactagccgtgtg

SEQ ID NO: 33228 - DNA, 201 bp, Homo sapiens
tggacaaggactgctgtgactcacggacagtgtttgtaaaggcaccatcttcatggttgtgcatgtccttcagctcggcaggatcagggacactacattcrgaactgatccatcctggggtttttgcttgcctgattttcagctgaacggtgatgcaacagtaaattagaattgtggacatgataatttttagtggtccca

SEQ ID NO: 33229 - DNA, 201 bp, Homo sapiens
tttaaaattgaattttaaagattatttatattctggatatttatcctttaccagtctgtagatgttttttttaaagtaaactctttttgtttgtttgtttwtatttttttatttttattttttattattgtactttaagttttagagtacatgtgcacaatgtgcaggttagttacatatgtatacatgtgccatgttggt

SEQ ID NO: 33230 - DNA, 201 bp, Homo sapiens
tagcttgatgggtttggcattgaatctataaattaccttgggcagtatggccattttcacgatattgattcttcctatccatgagcatggaatgttcttcsatttgtttgtgtcttcttttatttcgttgagcagtggtttgtagttctccttgaagaggtccttcacatcccttttaagttggattcctaggtattttat

SEQ ID NO: 33231 - DNA, 201 bp, Homo sapiens
ttaaagattatttatattctggatatttatcctttaccagtctgtagatgttttttttaaagtaaactctttttgtttgtttgtttttatttttttatttwtattttttattattgtactttaagttttagagtacatgtgcacaatgtgcaggttagttacatatgtatacatgtgccatgttggtgtgctgcacccatt

SEQ ID NO: 33232 - DNA, 201 bp, Homo sapiens
tcctgggactttgctgaagttgcttatcagcttaaggagactttgggctgagacaatggggttttctaaatatacaatcatgtcatctgcaaacagggacwatttgacttcctcttttcctaattgaatgctctttatttctttctcttgcctgattgccctggccagaacttccaacagtatgttgagtaggagtggtga

SEQ ID NO: 33233 - DNA, 201 bp, Homo sapiens
ctgtagaggatgtggagaaataggaacacttttacactgttggtgggactgtaaactttttattttacaataaatttagatttaaagcaagggtgcaaaawattgcactaagaattcccatatatcttttgccagtttcccctattgctaaatgttagtttactgtgcacatttttttttattatactttaagttctaggg

SEQ ID NO: 33234 - DNA, 201 bp, Homo sapiens
ttgacttagggtggagagttctgtagatgtctattaggtctgcttggtgcagagctgagttcaggtcctggatatccttgttaacctttggtcttgttgawctgtctaatatcgacagtgggatgttaaagtctctcattattattgtgtgggagtctaagtctctgtgtaggtctctaagaacttgctttatgaatctag

SEQ ID NO: 33235 - DNA, 201 bp, Homo sapiens
tgcagctaattttttgcatttttagtagagatagggtttcaccatgttggccaggctggtctccaactcctggcctcccgtgatacgcccaccttgacctyccaaagtgctgggactacaggtgtgagccaccacgcccagcacacatagaatttttgactccctaaaaatttaactattaatagcctactgtgcactaga

SEQ ID NO: 33236 - DNA, 201 bp, Homo sapiens
ggagagttctgtagatgtctattaggtctgcttggtgcagagctgagttcaggtcctggatatccttgttaacctttggtcttgttgaactgtctaatatygacagtgggatgttaaagtctctcattattattgtgtgggagtctaagtctctgtgtaggtctctaagaacttgctttatgaatctaggtgctcctgtat

SEQ ID NO: 33237 - DNA, 201 bp, Homo sapiens
agtgctgggactacaggtgtgagccaccacgcccagcacacatagaatttttgactccctaaaaatttaactattaatagcctactgtgcactagaagccktaccaataacagaaacagttgcttaacacatatttggcatgttatatgtgttatatactgtattatcataatgaagtcagctagagaaaagaaaatgtta

SEQ ID NO: 33238 - DNA, 201 bp, Homo sapiens
actattaatagcctactgtgcactagaagccttaccaataacagaaacagttgcttaacacatatttggcatgttatatgtgttatatactgtattatcayaatgaagtcagctagagaaaagaaaatgttattaagaaaatcttaaggaagagaaaattaagtattcattaagtggaagtggatcatgataaaggtcttc

SEQ ID NO: 33239 - DNA, 201 bp, Homo sapiens
tgttgattcctctggtgtggtgtctattcattcttgaatttctcacagattcatatcttgaaagaccatatcccccaccttttgttgctgaattagagatrttgggtttgcaggcaagtagaccactttgacaccttcagtgttgaactcatgggttctgggtggctaggggcattgtccaaaaatcaaaagaactttgaa

SEQ ID NO: 33240 - DNA, 201 bp, Homo sapiens
acagatttgacaagttctattaataattgcataaaatactttactttggatgcaatgtagtttttaaccaattaatattgatatagatttaggcattttgyattttttgtctttatgaatagggccgtgtaaacactctttaatactttccttacatgaatatatttccatattcttgcttttatcttagttgactagagc

SEQ ID NO: 33241 - DNA, 201 bp, Homo sapiens; identical to SEQ ID NO: 6348

SEQ ID NO: 33242 - DNA, 201 bp, Homo sapiens
aaaaaggattctttactgaactgtgatttgacattttcatttgtttcatttcaaatttctttccagtttaacaaattattttgtgccaatgcgtgtactcrtcagtagcaaattttataaaactgcccttcttgaagatatgtatttataacttataaaattgtggatcatattcagcctacatttttaagtaccatgttt

SEQ ID NO: 33243 - DNA, 201 bp, Homo sapiens
taaacctccaaaacaagatgccggaagttgccagtcctcagaagccttcacagttactgatcctcccactctgttaaagactgttccttcagaggaccccygttttctagttagtatagcagatttgttttctaatcatattatgttctttctttacgttctgctctttttgcccctcccaggtcctgtggcggtacactg

SEQ ID NO: 33244 - DNA, 201 bp, Homo sapiens
ttaacaaattattttgtgccaatgcgtgtactcgtcagtagcaaattttataaaactgcccttcttgaagatatgtatttataacttataaaattgtggawcatattcagcctacatttttaagtaccatgtttagaaaagtaccaaaaaccacagtaagaaatgaaacttcccttttttgttaattctatatgcccgccc

SEQ ID NO: 33245 - DNA, 201 bp, Homo sapiens
tgtggatcatattcagcctacatttttaagtaccatgtttagaaaagtaccaaaaaccacagtaagaaatgaaacttcccttttttgttaattctatatgmccgccccagaggaaatggtcttagttttgtgaacattcttttaatgtttttaaaaaagtactttaggtatatacaatatctaatgtaaattctcacacct

SEQ ID NO: 33246 - DNA, 201 bp, Homo sapiens
ggcattcagaagaggaattcagactgtgcaagatctgaggccaggctccagctcccccagtcccttggtgagcaggagctccctgaacccaccatgggtcyttgctagggttgtcttgcccatgtgtgctttagatagcagcacctcttcttccatggtgtatatggagaatcctcaacaaagtcttcccaagaatctgat

SEQ ID NO: 33247 - DNA, 201 bp, Homo sapiens
atcctcaacaaagtcttcccaagaatctgatcatcacatcttgagctcagcctccctgcagctttttctatattgacagccacttcagagagagtcctctytgatccttacaagaaatatcctggtgcgaaaaacgaccaaaaccacatagccagcctccacgctgttcagagaaagctggcttagcaatgttgtatggtt

SEQ ID NO: 33248 - DNA, 201 bp, Homo sapiens
caccaccacagtcagcaaatttttgtatttttagtagacatggggttttgccatgttggccaggttggtcttgaactcctgacttcagatgatctgccctyctcagcctcccaaagtcctgggattacaggcatgggccaccacgcccggccaagaaatgttatctttcacagatgcagatgtacaaaagggacatctctt

SEQ ID NO: 33249 - DNA, 201 bp, Homo sapiens
ggtgtataaaatatatgcatttatatgcctttaaggaatatacatatgataggatttatagatgtggaaggttatgtattaatgtatatatttataaatakaaaataaatataattatcaaagaagaattcagatcataaagagtgccctttggcaaagagccctggatatggctcaaccacaaaagtaaattgtcataga

SEQ ID NO: 33250 - DNA, 201 bp, Homo sapiens
ctcctcacttcccagacggggtggcggccgggcagaggctgcaatctcggcactttgggaggccaaggcaggcggctgggaggtgtaggttgtagtgagcsgagatcacgccactgcactccagcctgggcaccattgagcactgagtgaacgagactccgtctgcaatcccggcacctcgggaggccgaggttggcggat

SEQ ID NO: 33251 - DNA, 201 bp, Homo sapiens
tagagcaccacaccctgtaattgcctagttgtgagtttgtctctgttcacctgacccctcctttcaggcaaggaccatttctaacttggctttctgtccckagttcctagcatagtaggtagggctcacacattccataaatatttggtggataagggaattagcaatggattctgctttggttccaaagcagagattaat

SEQ ID NO: 33252 - DNA, 201 bp, Homo sapiens
aggcttaagtttaataaatagcaaattgcatacagatattttacaacgattgaaagacaaacagaggtcctatccgtgtagtcccaacgataagaacaggygttggcatgaagtgtttataaattcttgggtacagctgttctgaaagtaaagttcactttcaatcctaaaaaaagtccgctattcctccagatgtgctta

SEQ ID NO: 33253 - DNA, 201 bp, Homo sapiens
ccagtatctttttagaaatgccctagaaatagcctctgaaattctccaaacccctgtcacggcatatgatctctacagtcacacatcaatttggttgttgygaacggactttgttttggactatcccaaacccgtgatgcccaacatgatcttcattggtggtatcaactgtcatcagggaaagccattgcctatggtaag

SEQ ID NO: 33254 - DNA, 201 bp, Homo sapiens
ggacagtcagctgtcggtggcttctgctgagatggccagaggactccaggttcccctgccgcggctggccacaggactgctgctcctcctcagtgtccagmcctgggctgagagtggaaaggtgttggtggtgcccactgatggcagcccctggctcagcatgcgggaggccttgcgggagctccatgccagaggccacca

SEQ ID NO: 33255 - DNA, 201 bp, Homo sapiens
tcctttaggagctcttgtaaggcaggcctggtggtgacaaaatctctcagcatttgcttgtctataaaggattttatttctccttcacttatgaagcttastttggctgcatatgaatttctgggttgaaaattcttttctttaagaatgttgaatattggcccccactctcttctgtcttgtagggtttctgcagagaga

SEQ ID NO: 33256 - DNA, 201 bp, Homo sapiens
tgcaataggttcgaacatgcacttttagcttggagaggtttgttactaccaaacttctgaagcctacttctgtcaactcgtcaaagtcattctctttccakctttgctccattgctagcaaggagctgtgatcctttggaggagatgtgcttatgcgctatggtttttagaattttcagcttttctgctctagtttccccc

SEQ ID NO: 33257 - DNA, 201 bp, Homo sapiens
cttggatgtccaggcagacgtttgctgcatggatagagtccttatagagaacctctgctagagaagggtggtaaagaaatgtgaggttggagcccccacasagagtctccactggggcactgcctagtggagttgtgagaagaaggccacagtccttcagaacccagaagggcagatccaatagcttgcactgtgtgcctg

SEQ ID NO: 33258 - DNA, 201 bp, Homo sapiens
cattttaaaaggagatttttcaattctaaaaattctttaaataaaatgctcttgcagggacaacatagtaggtcaacattgttcccatctccacaaaaagttttttttttaattagctaggtgtggtagcatttctgtagtcctagctactgggaatgctgaggaggaaggatcacttgagcccaggaattcgtggttaca

SEQ ID NO: 33259 - DNA, 201 bp, Homo sapiens
gagtgtgtccaatggtgacctattaacttatgtcttcagcttaaaaagaaagtaccttcaaaagggttccagaaacactttccatggacatgtcactcttyagtagcccccaaagcaagaccatcatattgctgccctgctgtgtgacttcttagcccctagagcaccacaccctgtaattgcctagttgtgagtttgtct

SEQ ID NO: 33260 - DNA, 201 bp, Homo sapiens
atatttccatattcttgcttttatcttagttgactagagccctacatgtagggttacaggatttccatgaattgagaaggattggcatttttttgctattrtgtcttcctgttcaggaatatgtatgtctcactatttattcagatcttgttttatatacataaataaaatttttcactatataagcattttctgtttctt

SEQ ID NO: 33261 - DNA, 201 bp, Homo sapiens
gtttgctgcatggatagagtccttatagagaacctctgctagagaagggtggtaaagaaatgtgaggttggagcccccacacagagtctccactggggcaytgcctagtggagttgtgagaagaaggccacagtccttcagaacccagaagggcagatccaatagcttgcactgtgtgcctggaagagccacagacatcaa

SEQ ID NO: 33262 - DNA, 201 bp, Homo sapiens
tgtccaaatccttcctcctatattcctaagttactaacgaccaattcagaccacatgacattcctgcaaagggtcaagaacatgctctaccctctggcccygtcctacctttgccatgctctttctgctccttatgcaagccttgcctctgagctttttcagagggaggtgtcagtggtggatcttctcagccatgcatct

SEQ ID NO: 33263 - DNA, 201 bp, Homo sapiens; identical to SEQ ID NO: 6361

SEQ ID NO: 33264 - DNA, 201 bp, Homo sapiens
gggggaagggacttgacttgtctcagatgagaccttggactatggacttttgagctagtgctgaaatgagttaagactttggaggacagttgggaaggcaygattggtttttaaatgtgaaaagacatgagatttgggatgggccagagggcagaatgatatgatttgactgtgtgtttccacccaaatctcatctcatat

SEQ ID NO: 33265 - DNA, 201 bp, Homo sapiens
aaacctatatatgattttatatcacctatgatagagggttatctataaaatatgaaacatcaaactatatatggtttcatttattttgattataaatatcttttatgagatatgaaataaatgtgtttatgtgtctattaaagaatatggatgtatgaaagtttttatacttgtggaagattacatatattaatgtatgta

SEQ ID NO: 33266 - DNA, 201 bp, Homo sapiens
ggcttaagtttaataaatagcaaattgcatacagatattttacaacgattgaaagacaaacagaggtcctatccgtgtagtcccaacgataagaacaggtrttggcatgaagtgtttataaattcttgggtacagctgttctgaaagtaaagttcactttcaatcctaaaaaaagtccgctattcctccagatgtgcttaa

SEQ ID NO: 33267 - DNA, 201 bp, Homo sapiens
aacctatatatgattttatatcacctatgatagagggttatctataaaatatgaaacatcaaactatatatggtttcatttattttgattataaatatcttttatgagatatgaaataaatgtgtttatgtgtctattaaagaatatggatgtatgaaagtttttatacttgtggaagattacatatattaatgtatgtat

SEQ ID NO: 33268 - DNA, 201 bp, Homo sapiens
tttaataaatagcaaattgcatacagatattttacaacgattgaaagacaaacagaggtcctatccgtgtagtcccaacgataagaacaggtgttggcatraagtgtttataaattcttgggtacagctgttctgaaagtaaagttcactttcaatcctaaaaaaagtccgctattcctccagatgtgcttaaagtcaaat

SEQ ID NO: 33269 - DNA, 201 bp, Homo sapiens
gatccaaattcaaagttagcttttggtggacaagactaaggcctcccactaaaattatttacttcaagtttttattttcaaagttttcaaacatacacaayggagagactcagtgtaatgagcacccacttatccattcttaggttaaataattttcactattttgctctactaattcatctatccctttattctatcttt

SEQ ID NO: 33270 - DNA, 201 bp, Homo sapiens
agaagaaaaaacacccccaaaagctggaaattcactgaaggcagagaaaaggggtgcagacgctctgcttctgcttccccagcagttcctctgaccccccmaaaatattctccagcgggtttcccaagaggtcaaaggagaatgggtcctggccgccgaagaactccctgaagacgtcggctgggtcgcggaagctgaaga

SEQ ID NO: 33271 - DNA, 201 bp, Homo sapiens
tgttctgaaagtaaagttcactttcaatcctaaaaaaagtccgctattcctccagatgtgcttaaagtcaaatgtggactggaattacttggtgtcaatgsggagtaactgctctttgctatttattatgaaggactttaactcaactctccatcttcctccacttccaccctttcttggccattctcaatgattctcttg

SEQ ID NO: 33272 - DNA, 201 bp, Homo sapiens
gcttttggtggacaagactaaggcctcccactaaaattatttacttcaagtttttattttcaaagttttcaaacatacacaatggagagactcagtgtaaygagcacccacttatccattcttaggttaaataattttcactattttgctctactaattcatctatccctttattctatctttttaaagaaaacttttaaa

SEQ ID NO: 33273 - DNA, 201 bp, Homo sapiens
tgaaagtaaagttcactttcaatcctaaaaaaagtccgctattcctccagatgtgcttaaagtcaaatgtggactggaattacttggtgtcaatgcggagyaactgctctttgctatttattatgaaggactttaactcaactctccatcttcctccacttccaccctttcttggccattctcaatgattctcttggtggt

SEQ ID NO: 33274 - DNA, 201 bp, Homo sapiens
gttcactttcaatcctaaaaaaagtccgctattcctccagatgtgcttaaagtcaaatgtggactggaattacttggtgtcaatgcggagtaactgctctwtgctatttattatgaaggactttaactcaactctccatcttcctccacttccaccctttcttggccattctcaatgattctcttggtggtgattttttta

SEQ ID NO: 33275 - DNA, 201 bp, Homo sapiens
gatgggagcaatcatgccccaaacatcagcatcacacaatatactcaggtaacctgcacatgtactcctgaatctaaaataaaagttgagtatgtataagwggaagtgaatcatcataaaggtctccatcctcatcatcttccattgagtgggctgtggaggaggaggagtagatgttgattttgctgtctcagggtggca

SEQ ID NO: 33276 - DNA, 201 bp, Homo sapiens
gcaatcatgccccaaacatcagcatcacacaatatactcaggtaacctgcacatgtactcctgaatctaaaataaaagttgagtatgtataagtggaagtsaatcatcataaaggtctccatcctcatcatcttccattgagtgggctgtggaggaggaggagtagatgttgattttgctgtctcagggtggcagaggcag

SEQ ID NO: 33277 - DNA, 201 bp, Homo sapiens
aatcatgccccaaacatcagcatcacacaatatactcaggtaacctgcacatgtactcctgaatctaaaataaaagttgagtatgtataagtggaagtgawtcatcataaaggtctccatcctcatcatcttccattgagtgggctgtggaggaggaggagtagatgttgattttgctgtctcagggtggcagaggcagaa

SEQ ID NO: 33278 - DNA, 201 bp, Homo sapiens; identical to SEQ ID NO: 6690

SEQ ID NO: 33279 - DNA, 201 bp, Homo sapiens
gcaggagaggcaggtgcacttggtgtaaccttatggaaatacatcataattactgtctgtttttttctctttgatgtatttaaaaatgcttttatacagtrctaatccttcttccccatttgctttagtttcagtgcccataagggttcatgtcttaatagaagtcaatagcagtcttaaataattggaagcatttctatg

SEQ ID NO: 33280 - DNA, 201 bp, Homo sapiens
agtatcccaaacccgtgatgcccaatatgatcttcattggtggtatcaactgtcatcagggaaagccagtgcctatggtaagttatctcccctttagcacwttaagaataatctggctttggaaattaaaagatttcttacagaatcataatttatcatttacatttgtcccatttggaatttctttctggtttaaggaat

SEQ ID NO: 33281 - DNA, 201 bp, Homo sapiens
agtggatgtagctctcagcagatgggggaagccagaaggggatggaatgggaagggtttcccctggagtcagaccgctcagtggcccgggctcggtggccygggctcggtggcctgggctctcctccgactgcctcagccaaactccgcgttgttctgctggtcagtggcctgccggtgcctgttggtgagttcttctcaa

SEQ ID NO: 33282 - DNA, 201 bp, Homo sapiens
gttaattctatatgcccgccccagaggaaatggtcttagttttgtgaacattcttttaatgtttttaaaaaagtactttaggtatatacaatatctaatgyaaattctcacacctattttgttaaaataaaatctagtattgggctggacatattcttcttttctttgcatttttcacttgccaataaattataaatacct

SEQ ID NO: 33283 - DNA, 201 bp, Homo sapiens
ttaaggttttgttttttgcatatgtatcttgtatccagccacattactaacttatcttattattttgtagtatacagtagatgtacaatatacaatgtcawctgcaaagaattcccttctctgatatttataccacttattttgctttgctggagcttatacttccaaagcactattgagtaatattgtgagagtagccag

SEQ ID NO: 33284 - DNA, 201 bp, Homo sapiens
taggctaggagatgcaaatggcagaaatctaagaggttagacttgtctaagcacttttctcccctttaccctccataaattatagtatcctccattaattrtagtaacaggcaccacttatgtgttgcctgcaccccacaacctttggctgagggtaaggccctgccacttcctgaacccacactgaatttattgtgcctc

SEQ ID NO: 33285 - DNA, 201 bp, Homo sapiens; identical to SEQ ID NO: 6373

SEQ ID NO: 33286 - DNA, 201 bp, Homo sapiens
tgagctttttcagagagaggtgtcagtggtggatattctcagtcatgcatctgtgtggctgttccgaggggactttgtgatggactaccccaggccaatcrtgcccaacatggtcttcattgggggcatcaactgtgccaacaggaagccactatctcaggtctgtattggtgccttcatccaatcaatgttccaggcaaa

SEQ ID NO: 33287 - DNA, 201 bp, Homo sapiens
gctctgtcctccctcactcatttggctccttgagccgactgtcccttggaggatttcctggagaaacggtggggggaagtgatacccggctcggagcagcrggaacacataggagacctgaggctgaagtgatacagaggcattcggatgaagacagggctcatgcttggcaagagtaggagatttgcttagttggataat

SEQ ID NO: 33288 - DNA, 201 bp, Homo sapiens
accttctttatctctgaaagtgaactccctgctacctttgtggactgacagctttttatagtcacgtgacacagtcaaacattaacttggtgtatcgattsgtttttgccatatatatatatataagtaggagagggcgaacctctggcaggagcaaaggcgccatggctgtggagtcccagggcggacgcccacttgtcc

SEQ ID NO: 33289 - DNA, 201 bp, Homo sapiens
atctggctttggaaattaaaaaaggattccttactgaactgtgatttgacattttcgtttgttgcatttcaaatttctttccagtttaacaaattattttstgcgaattcatgtactcatcaattatcaaattttataaaactgcccttcttgaaagtatatgtaataatttaaaaattatagatcatattcaggctacat

SEQ ID NO: 33290 - DNA, 201 bp, Homo sapiens
ttcagatgccaggatgtgtctgggaaaagcatgcagttggttacatcttgctgggaaacaggattcagagtctgagtctcatctgtctgatgagaaggaarcattacttgatgatagagtatgtgtttgcacatgtatgtgtttgtgtatgtgcaggtgtgtttgcgtgcagtgtcccagaccctgcacaggggatttctt

SEQ ID NO: 33291 - DNA, 201 bp, Homo sapiens; identical to SEQ ID NO: 6379

SEQ ID NO: 33292 - DNA, 201 bp, Homo sapiens; identical to SEQ ID NO: 6656

SEQ ID NO: 33293 - DNA, 201 bp, Homo sapiens
ctaccctctggccctgtcctacctttgccatgctctttctgctccttatgcaagccttgcctctgagctttttcagagggaggtgtcagtggtggatcttstcagccatgcatctgtgtggctgttccgaggggactttgtgatggattaccccaggccgatcatgcccaacatggtcttcattgggggcatcaactgtgc

SEQ ID NO: 33294 - DNA, 201 bp, Homo sapiens; identical to SEQ ID NO: 6383

SEQ ID NO: 33295 - DNA, 201 bp, Homo sapiens
actttcaatcctaaaaaaagtccgctattcctccagatgtgcttaaagtcaaatgtggactggaattacttggtgtcaatgcggagtaactgctctttgcyatttattatgaaggactttaactcaactctccatcttcctccacttccaccctttcttggccattctcaatgattctcttggtggtgatttttttaccat

SEQ ID NO: 33296 - DNA, 201 bp, Homo sapiens
ctttcaatcctaaaaaaagtccgctattcctccagatgtgcttaaagtcaaatgtggactggaattacttggtgtcaatgcggagtaactgctctttgctrtttattatgaaggactttaactcaactctccatcttcctccacttccaccctttcttggccattctcaatgattctcttggtggtgatttttttaccatc

SEQ ID NO: 33297 - DNA, 201 bp, Homo sapiens
tactgcattagagattaaaacagaattaaaaagacatattaattgggcaatttagtaagaataaacccatgacacaatagcaaatcttatttttatgtaamttttattaagacaaaatgtagtgagaagagtggcatcgttttacagtttttgcatctctctttagtacttggctctatagagaggtggattctcatgtca

SEQ ID NO: 33298 - DNA, 201 bp, Homo sapiens
tctgctccttatgcaagccttgcctctgagctttttcagagggaggtgtcagtggtggatcttctcagccatgcatctgtgtggctgttccgaggggactytgtgatggattaccccaggccgatcatgcccaacatggtcttcattgggggcatcaactgtgccaacaggaagccactatctcaggtcggtgttcgtgcc

SEQ ID NO: 33299 - DNA, 201 bp, Homo sapiens
aggaaataatcattgtctgcctcaggcttaagtttaataaatagcaaattgcatacagatatttacaatgatcgaaagacaaacagaggtcctatccgtgyagtcccaacaataaagacaggcattggcataaagtgtttataaattcttgggtacagctgttctgaaagtaaagttcactttcaatcctaaaaaaagtcc

SEQ ID NO: 33300 - DNA, 201 bp, Homo sapiens
ggcataaagtgtttataaattcttgggtacagctgttctgaaagtaaagttcactttcaatcctaaaaaaagtccgctattcctccagatgtgcttaaagkcaaatgtggactggaattacttggtgtcaatggggagcaactgctctatgccgtttattatgaaggactttaactcaactctccatcttcctccacttcc

SEQ ID NO: 33301 - DNA, 201 bp, Homo sapiens
agcatttctatgaggcttgtattgtgtaaggccaattttttttctggcactgcttcttctacatcttctttctcatcaagtactgattggaaagcactcatctctatcaggtcatctattgattccctgagtgtggcatctattgtctcttgaatttctccaagagtcatattttgaaataccttatccccaacattttgt

SEQ ID NO: 33302 - DNA, 201 bp, Homo sapiens
tgttctgaaagtaaagttcactttcaatcctaaaaaaagtccgctattcctccagatgtgcttaaaggcaaatgtggactggaattacttggtgtcaatgsggagcaactgctctatgccgtttattatgaaggactttaactcaactctccatcttcctccacttccaccctttcttggccattctcaatgattctcttg

SEQ ID NO: 33303 - DNA, 201 bp, Homo sapiens
aaatattctccagcgggtttcccaagaggtcaaaggagaatgggtcccggccgccaaagaactccctgaagacctcggcggggtcacggaagctgaagacstactcgaaggggtccttgaagggcctgccgcctgcgcagccgccctccgccctcgcctcgccatagcggtcatagatatcgcgtttctacgcgtccgaca

SEQ ID NO: 33304 - DNA, 201 bp, Homo sapiens
gcatttctatgaggcttgtattgtgtaaggccaattttttttctggcactgcttcttctacatcttctttctcatcaagtactgattggaaagcactcatctctatcaggtcatctattgattccctgagtgtggcatctattgtctcttgaatttctccaagagtcatattttgaaataccttatccccaacattttgtt

SEQ ID NO: 33305 - DNA, 201 bp, Homo sapiens
tgaaagtaaagttcactttcaatcctaaaaaaagtccgctattcctccagatgtgcttaaaggcaaatgtggactggaattacttggtgtcaatggggagyaactgctctatgccgtttattatgaaggactttaactcaactctccatcttcctccacttccaccctttcttggccattctcaatgattctcttggtggt

SEQ ID NO: 33306 - DNA, 201 bp, Homo sapiens
tttctatgaggcttgtattgtgtaaggccaattttttttctggcactgcttcttctacatcttctttctcatcaagtactgattggaaagcactcatctctatcaggtcatctattgattccctgagtgtggcatctattgtctcttgaatttctccaagagtcatattttgaaataccttatccccaacattttgttgct

SEQ ID NO: 33307 - DNA, 201 bp, Homo sapiens
gttcactttcaatcctaaaaaaagtccgctattcctccagatgtgcttaaaggcaaatgtggactggaattacttggtgtcaatggggagcaactgctctwtgccgtttattatgaaggactttaactcaactctccatcttcctccacttccaccctttcttggccattctcaatgattctcttggtggtgattttttta

SEQ ID NO: 33308 - DNA, 201 bp, Homo sapiens
ttctatgaggcttgtattgtgtaaggccaattttttttctggcactgcttcttctacatcttctttctcatcaagtactgattggaaagcactcatctctatcaggtcatctattgattccctgagtgtggcatctattgtctcttgaatttctccaagagtcatattttgaaataccttatccccaacattttgttgctg

SEQ ID NO: 33309 - DNA, 201 bp, Homo sapiens
actttcaatcctaaaaaaagtccgctattcctccagatgtgcttaaaggcaaatgtggactggaattacttggtgtcaatggggagcaactgctctatgcygtttattatgaaggactttaactcaactctccatcttcctccacttccaccctttcttggccattctcaatgattctcttggtggtgatttttttaccat

SEQ ID NO: 33310 - DNA, 201 bp, Homo sapiens
tatgaggcttgtattgtgtaaggccaattttttttctggcactgcttcttctacatcttctttctcatcaagtactgattggaaagcactcatctctatcaggtcatctattgattccctgagtgtggcatctattgtctcttgaatttctccaagagtcatattttgaaataccttatccccaacattttgttgctgtat

SEQ ID NO: 33311 - DNA, 201 bp, Homo sapiens
ctttcaatcctaaaaaaagtccgctattcctccagatgtgcttaaaggcaaatgtggactggaattacttggtgtcaatggggagcaactgctctatgccrtttattatgaaggactttaactcaactctccatcttcctccacttccaccctttcttggccattctcaatgattctcttggtggtgatttttttaccatc

SEQ ID NO: 33312 - DNA, 201 bp, Homo sapiens
tttttcttaaagtaggctttatatcagtctttttcctcggccacaggagggaagagggtggtgggagtgagtttagtctgaccggggctgaagacatcctrttgtttaggactgcggttctccaacgttccagccccggtgcccatttgcttttgttcatctggattatgcctatcatatgtactgcattagagattaaaa

SEQ ID NO: 33313 - DNA, 201 bp, Homo sapiens
atgaggcttgtattgtgtaaggccaattttttttctggcactgcttcttctacatcttctttctcatcaagtactgattggaaagcactcatctctatcaggtcatctattgattccctgagtgtggcatctattgtctcttgaatttctccaagagtcatattttgaaataccttatccccaacattttgttgctgtatc

SEQ ID NO: 33314 - DNA, 201 bp, Homo sapiens
atctcagcaaaagctactcatatattcttgttcttttgggtaaatcattgtcagtgactgatttttttttatgaaaggataaaaacacgccctctattggrgtcaggttttgtgctggtatttctcccacctactgtatcataggagcttagattcccagctgcttgctctcagctgcagttctctgatggcttgcacagg

SEQ ID NO: 33315 - DNA, 201 bp, Homo sapiens
ggcctgtgagcgcctcgcatcccaagatgcagtgctcctgggactggccctgctctctgtgaggctctgtgaggccctgtgatgctccaagaccaggcccsgcccactccggcctccaaccagccatggtctccaaaaaggatgggaaaaagaggttggggaaaagagagggccttgactttggctgcctgaagaactgtt

SEQ ID NO: 33316 - DNA, 201 bp, Homo sapiens
taagaagaataaacccatgacacactaacaaacctttttatgtaactttttttgagacaaaatgtagtgagaagagtggcatcgttttacagtttttgcayctctctttagtacttggctctatagagaggtggattctcatgtcagcttctgcattctatctattgtgatattacacatcccccatgtagcttctggaaa

SEQ ID NO: 33317 - DNA, 201 bp, Homo sapiens
agtttttgcatctctctttagtacttggctctatagagaggtggattctcatgtcagcttctgcattctatctattgtgatattacacatcccccatgtarcttctggaaaactccactgtacacttgtgggagaatgacaatgagaaaatcaagtaacattattacggaaatagttttgactttgtaaaattctcctgaa

SEQ ID NO: 33318 - DNA, 201 bp, Homo sapiens
tgaggcttgtattgtgtaaggccaattttttttctggcactgcttcttctacatcttctttctcatcaagtactgattggaaagcactcatctctatcaggtcatctattgattccctgagtgtggcatctattgtctcttgaatttctccaagagtcatattttgaaataccttatccccaacattttgttgctgtatcc

SEQ ID NO: 33319 - DNA, 201 bp, Homo sapiens
aggcttgtattgtgtaaggccaattttttttctggcactgcttcttctacatcttctttctcatcaagtactgattggaaagcactcatctctatcaggtcatctattgattccctgagtgtggcatctattgtctcttgaatttctccaagagtcatattttgaaataccttatccccaacattttgttgctgtatccat

SEQ ID NO: 33320 - DNA, 201 bp, Homo sapiens
tgtcataaatcctgtgaagtcatgtgcaacatctggtcacagttttctccagaagaaatgtactgtttggggcttggtggctttcaaagctctttctatartaacagtggcatcttcagtggtgtaatccttctggactttcatgacattctctatccagattctctttcctagtattgacaaccttttccatagaaaact

SEQ ID NO: 33321 - DNA, 201 bp, Homo sapiens
ttgatggaaccaatccagaaaacgcgttcttattgttgagtccttctttttgtacaacaataaaactgtcagtgagtgttgatcttttcctttcaaggctygaggtttggcagttctactgatgagggcagtcctgactgtaaacttgactgcatttacacaaaacagtagagttagcctatcccttcctgccttacattc

SEQ ID NO: 33322 - DNA, 201 bp, Homo sapiens; identical to SEQ ID NO: 6477

SEQ ID NO: 33323 - DNA, 201 bp, Homo sapiens; identical to SEQ ID NO: 6667

SEQ ID NO: 33324 - DNA, 201 bp, Homo sapiens
gtgttgcctgcaccccacaacctttggctgagggtaaggccctgccacttcctgaacccacactgaatttattgtgcctcacagcgtcacccagaggcctwtagagatataaaaacctatatatgattttatatcacctatgatagagggttatctataaaatatgaaacatcaaactatatatggtttcatttattttga

SEQ ID NO: 33325 - DNA, 201 bp, Homo sapiens; identical to SEQ ID NO: 6668

SEQ ID NO: 33326 - DNA, 201 bp, Homo sapiens; identical to SEQ ID NO: 6351

SEQ ID NO: 33327 - DNA, 201 bp, Homo sapiens
ttgtttcttccaggctctgtcctccctcactcatttggctccttgagccgactgtcccttggaggatttcctggagaaacggtggggggaagtgataccckgctcggagcagcgggaacacataggagacctgaggctgaagtgatacagaggcattcggatgaagacagggctcatgcttggcaagagtaggagatttgc

SEQ ID NO: 33328 - DNA, 201 bp, Homo sapiens; identical to SEQ ID NO: 6672

SEQ ID NO: 33329 - DNA, 201 bp, Homo sapiens
ttttggaaaactagcacattacctggattttgcatctcaaggataattctgtaagcaggaacccttcctcctttagaaggaagtaaaggagaggaaaatgmtgtaaaacttacatattaataattttttactctatctcaaacacgcatgcctttaatcatagtcttaagaggaagatatctaattcataacttactgtat

SEQ ID NO: 33330 - DNA, 201 bp, Homo sapiens
ttgatgttaagtggtattttcattcaatttgcaattgttcattgctagtacagttgacccttgaacaatgtggagattagggataccaacctcgcaggtaktctaaaatccacatatcattttgacccccataacttaactattaatagcctactgtatagcagaagccttaccaataacgtaaatagccaatgaacacat

SEQ ID NO: 33331 - DNA, 201 bp, Homo sapiens
atccctcagacagtaagaagattctataccatggcctcatatctattttcacaggagcgctaatcccagacttccagcttccagattaattctcttaattrgaaccttagatttggcttttccctgccacttcccaactattaatccaaaggttttttttgttgttgtggttgttgtcattgttttcaatttgactctcaa

SEQ ID NO: 33332 - DNA, 201 bp, Homo sapiens
cacatcttgagctcagcctccctgcagctttttttatattgacagccacttcagagagagtcctctttgagctttacaagaaatatcctggtgtgaaaaaygaccaaaaccagatagccagcctccccactccctgtttaaagaaagctggcttagcaatgttgtctgcattttggatgtgctgtgttacccatatgtggg

SEQ ID NO: 33333 - DNA, 201 bp, Homo sapiens; identical to SEQ ID NO: 6534

SEQ ID NO: 33334 - DNA, 201 bp, Homo sapiens
acatcccccatgtagcttctggaaaactccactgtacacttgtgggagaatgacaatgagaaaatcaagtaacattattacggaaatagttttgactttgyaaaattctcctgaaaaattactggggatccctaggatttcctggctcatactttgagaatcgctagtctagcagagtagtccctggtattctgaagggat

SEQ ID NO: 33335 - DNA, 201 bp, Homo sapiens
tcccaggttcccaatcaggtccatttatgcaaatgaaggatggaaacttgcttagttcttattggtcactgcagctgcattctgattggttgatgaagctragccctgagtggctgaggtgggtgagctttaattggttggttcaggtgagcgctgaaaatctcaactataaaaaggtacaggttttcaggatactcagag

SEQ ID NO: 33336 - DNA, 201 bp, Homo sapiens
gaaagagggagagaaagaggggagagatgtggtgcagaccctagggaggaaggagttcagaaaaaccatcctcagggtgttcttgctacaaaccaaaaaaygcagcatggtggtggggaggatgactctgtcctccctgacttttagatgagcccaagggaaaaggcaaagacaaagcccttaagagccagaggactcacg

SEQ ID NO: 33337 - DNA, 201 bp, Homo sapiens
aacctctaggggagcatacagacgggcaggttgtggggctctgacctcaccggcagtgtctagaggtggatgtttacagctcctgaagctccagtgggcgkgggttatggccttcttttagttttgccctctatagtcagcttgtgttaaccagctcaattacaccctctaccttgtcgcaaggacagagggctttctgta

SEQ ID NO: 33338 - DNA, 201 bp, Homo sapiens
gagttcagaaaaaccatcctcagggtgttcttgctacaaaccaaaaaatgcagcatggtggtggggaggatgactctgtcctccctgacttttagatgagsccaagggaaaaggcaaagacaaagcccttaagagccagaggactcacgagggcctggggctggtgagagtggcggggagagagggctcaccttgggagaa

SEQ ID NO: 33339 - DNA, 201 bp, Homo sapiens
aaatcacattggcatctataaataagcctttcttatagcaatcctacacccacattaaagttgcattttcaatatgagacaaaaatgtatttcacaaaaaratgcgaggtttggctcctgctggcatagctgcagcaatgtcttcatgaatcttttcttctcttttctttctttctctctctctcttttttctttttctct

SEQ ID NO: 33340 - DNA, 201 bp, Homo sapiens
ggatttattgagtggatgtagctctcagcagatgggggaagccagaaggggatggaatgggaagggtttcccctggagtcagaccgctcagtggcccgggctcggtggcccgggctcggtggcctgggctctcctccgactgcctcagccaaactccgcgttgttctgctggtcagtggcctgccggtgcctgttggtgag

SEQ ID NO: 33341 - DNA, 201 bp, Homo sapiens
agttcagaaaaaccatcctcagggtgttcttgctacaaaccaaaaaatgcagcatggtggtggggaggatgactctgtcctccctgacttttagatgagcscaagggaaaaggcaaagacaaagcccttaagagccagaggactcacgagggcctggggctggtgagagtggcggggagagagggctcaccttgggagaag

SEQ ID NO: 33342 - DNA, 201 bp, Homo sapiens
aggccgagatgggcagattgcctgagctcaggagttcgagaccagcctgggcaacatggtgaaaccccgtctccactaaaatacaaaaagttagctgggcrtggcagcgtgcgcctgtaatcccagctactgaggctgaggcaggagaatcgtttgaacccaggaagtggaggttgcagtgagcctagatcttaccactgc

SEQ ID NO: 33343 - DNA, 201 bp, Homo sapiens
gatttattgagtggatgtagctctcagcagatgggggaagccagaaggggatggaatgggaagggtttcccctggagtcagaccgctcagtggcccgggctcggtggcccgggctcggtggcctgggctctcctccgactgcctcagccaaactccgcgttgttctgctggtcagtggcctgccggtgcctgttggtgagt

SEQ ID NO: 33344 - DNA, 201 bp, Homo sapiens
tttattgagtggatgtagctctcagcagatgggggaagccagaaggggatggaatgggaagggtttcccctggagtcagaccgctcagtggcccgggctcggtggcccgggctcggtggcctgggctctcctccgactgcctcagccaaactccgcgttgttctgctggtcagtggcctgccggtgcctgttggtgagttc

SEQ ID NO: 33345 - DNA, 201 bp, Homo sapiens
gttcagaaaaaccatcctcagggtgttcttgctacaaaccaaaaaatgcagcatggtggtggggaggatgactctgtcctccctgacttttagatgagccmaagggaaaaggcaaagacaaagcccttaagagccagaggactcacgagggcctggggctggtgagagtggcggggagagagggctcaccttgggagaagg

SEQ ID NO: 33346 - DNA, 201 bp, Homo sapiens
caagaccaggcgaggagatgcaagttgtaggacgctaagaggatagacttgtcaaagtgtctctcccctgtttaccctccatcaattacagcaccagccaycactcaggtattgcctgcagcctcaccctctagccaagtgtgtggcctgccactttctgaacccatgctgagttttttgtggctcaaagggtcacccaaa

SEQ ID NO: 33347 - DNA, 201 bp, Homo sapiens
tctgtcctccctgacttttagatgagcccaagggaaaaggcaaagacaaagcccttaagagccagaggactcacgagggcctggggctggtgagagtggcsgggagagagggctcaccttgggagaaggatggtcagtgtctggggctttcctggtcatgttccaaatcaggcttggcaggagtcctgctgtgcaaattgc

SEQ ID NO: 33348 - DNA, 201 bp, Homo sapiens
ctccatcaattacagcaccagccaccactcaggtattgcctgcagcctcaccctctagccaagtgtgtggcctgccactttctgaacccatgctgagtttkttgtggctcaaagggtcacccaaagggatttagagatgtagaaattatatatgattctataccacctataatggtatatgatagagagatctataaaata

SEQ ID NO: 33349 - DNA, 201 bp, Homo sapiens
cctgggctctcctccgactgcctcagccaaactccgcgttgttctgctggtcagtggcctgccggtgcctgttggtgagttcttctcaatgtccagctgtycttgcgtccctccgctgatgtgctcctcccgatgtccagctacctgtgtgtctgcctgctagggtcttggggtttttataggcacatgatgggggcgtgg

SEQ ID NO: 33350 - DNA, 201 bp, Homo sapiens
cattaaaacggttttgttttgtatttttaatagagacggggtttcaccatgttggccaggctggtctctgactcctgacctcaagtgatccgcccgcctcsgcctttcaaagtgttgagattacaggtgtgaaccaccacacccggacttaaagtggttttaatgagaaaaaaagaaaatcacttccacttttcttgactt

SEQ ID NO: 33351 - DNA, 201 bp, Homo sapiens
cccattgctctcgcattctgtttttgatccaaattcaaatttacctgttactgggcaagcccaaggcctccctccaagattatttatttcaactttttatyatcaaagttttcgaacatataccaaggagaggctatggcataatgtgtacccatatagccattcttaagttaaataattttcaatatcttgctgtactgc

SEQ ID NO: 33352 - DNA, 201 bp, Homo sapiens
actagaggactttaggaggtggttcaatgtagtgtttgagcacgcggaccctggagtcctccaagcctgatttcataagtacttcagctgtgacacttgcrtaaacttgggtaaaaactcagcgttatctagattaaatatgataatacatgcagatgactggcatgtggctatgaatcagcaatacccgtaattgggtgg

SEQ ID NO: 33353 - DNA, 201 bp, Homo sapiens
tcagatgatgaaactgaggcacagaggggttgagtgacttgcccaaggttatgcctcaagtaagtgggggagccagaattcaagcccatacattctttgtaaaaaaaaaaaaaaaaaaaaggaaagaaaaaaaggctgagtgtggtggctcacacatgtaatcacagcactttaggaggccaaggcaggaagatcacttaa

SEQ ID NO: 33354 - DNA, 201 bp, Homo sapiens
atcttgttttggttggtgttacagaataacaccctcagcaaacatgagttcgtcttgtttttgttggtgttacagaataacatgcagctggctcttttttwaaaaatttaatattaaacgtccttcattgaacaaatatctgttgagagtctttgagtgactgggatatggccataatcaaatgaacatggctttgccatt

SEQ ID NO: 33355 - DNA, 201 bp, Homo sapiens
cctcaccagcaatggcagacatggccaggcatgtagacacagaggtagtgagatggaaagtgggcacagcccagagagcctgcccacctcatcctggggcraccaggacaaggaagcatcagcaatcttgcgagcacatgtaggagtgactttctggagcaggacgagcctcatgggcatgagaccattgtgagtgctcag

SEQ ID NO: 33356 - DNA, 201 bp, Homo sapiens; identical to SEQ ID NO: 6374

SEQ ID NO: 33357 - DNA, 201 bp, Homo sapiens
tgtgtccagctgtgaaactcagagatgtaactgctgacatcctccctattttgcatctcaggtcacccgatgacccgtgcctttatcacccatgctggttyccatggtgtttatgaaagcatatgcaatggcgttcccatggtgatgatgcccttgtttggtgatcagatggacaatgcaaagcgcatggagactaaggga

SEQ ID NO: 33358 - DNA, 201 bp, Homo sapiens; identical to SEQ ID NO: 6377

SEQ ID NO: 33359 - DNA, 201 bp, Homo sapiens
gcttattttctctattaatgagttcatccaaatgtttagaatttaatttttcacattgcaggagtttgtttaatgactgaaaattagtagaatacttaaargagagttcttttgatgcggtgtttctggatcctttagatatgtgtggcttaattgttgccaaatatttctccctcctctcggtggtcttcgccagaggaa

SEQ ID NO: 33360 - DNA, 201 bp, Homo sapiens
aaggggtgcagaccctctgcttctgcttcccagggagttcctctgaccccccaaaatattctccagcgggtttcccaagaggtcaaaggagaatgggtccyggccgccaaagaactccctgaagacctcggcggggtcacggaagctgaagacgtactcgaaggggtccttgaagggcctgccgcctgcgcagccgccctc

SEQ ID NO: 33361 - DNA, 201 bp, Homo sapiens; identical to SEQ ID NO: 6610

SEQ ID NO: 33362 - DNA, 201 bp, Homo sapiens
aatccatcttgagttaatttttctataaggtgtaagaagggatccagtttcagctttctacatatggctagccagttttcccagcaccatttattaaatarggaatattttccccatttcttgtttttgtcaggtttgtcaaagatcagaaggttgtagatatgtggtgttattcctgagacctctgttctgttccattgg

SEQ ID NO: 33363 - DNA, 201 bp, Homo sapiens
tacctgtagaatttatggtgatactactgctctcattcctgatattggtaatttatatcttctgtcttttttcctaatcagtctgggtagagatttatcargttaattgatttgccccaaaagctagctttggtgtcattggttttctccattgtttttctatttcctatttcattgatttctacactgaagttagcctcc

SEQ ID NO: 33364 - DNA, 201 bp, Homo sapiens
tcatggacctctcagttaacaaattttataattgtagatcatatccaagttgcatttaaagatactctttttgggaaaataccaaaaaccacagtgagaartgaaacttcccttttttgccaattctatagaaaatgctcttagtagttttgtgtgcatcattttcattttttgaaattattttatgcatatgcagatatc

SEQ ID NO: 33365 - DNA, 201 bp, Homo sapiens
tacaatatctaatgtaaattctcacacctattttgttaaaataaaatctagtattgggctggacatattcttcttttctttgcatttttcacttgccaatraattataaatacctttatagaccaatacagacagatttgacaagttctattaataattgcataaaatactttactttggatgcaatgtagtttttaacca

SEQ ID NO: 33366 - DNA, 201 bp, Homo sapiens; identical to SEQ ID NO: 6613

SEQ ID NO: 33367 - DNA, 201 bp, Homo sapiens
cgccgaagaactccctgaagacgtcggctgggtcgcggaagctgaagacgtactcgaaggggtcctcgaagggcctgccgcctgtgcagccgccctccgcscccgcctcgccatagcggtcatagatatcgcgtttcttggcgtccgacaacacctcgtaggcctcggccacctgcttgaatctcctctccgcttcctcct

SEQ ID NO: 33368 - DNA, 201 bp, Homo sapiens
agtggttttaatgagaaaaaaagaaaatcacttccacttttcttgacttgttggtgaattacagcagaattgatggttgaatccagttataaagaattcgrgctgaatctacaccatctagggccagtgcagctctggagaactgggactgggatgtggttacagcaagaaaagatctatgctttccccattgctctcgca

SEQ ID NO: 33369 - DNA, 201 bp, Homo sapiens
aagcaaggagtgttaggaggcttatacttgagacccaatctctctaatggcttgcaagtaaaggtttttaagagcaaggatacattttaggaaaacagaakttacaagaagaaatcgcaaatcaatacgcagaggttacacattggtttggtcatgagaagtgagggcttgcaggtcataggtgaattcagagattttctg

SEQ ID NO: 33370 - DNA, 201 bp, Homo sapiens
gttagcaccttagaagcaaacctctccatagggtccacgtttccagaccttcctattcccaacatgaaattaccttcatgcacatctttgggtctctcctstattcaaaatgccagctatcctccatttactttttgggaaatctgctcttgccaacagagatttgttttatcttaggatctacttctttcaccccactgg

SEQ ID NO: 33371 - DNA, 201 bp, Homo sapiens
cccctgtgtgactcccaccaggtgtgccactggtgaggcatggcaggagataatgcttgccagccttcccggaaatcggtgtgatcctgagtctgacttcrgccctggtgaagagtttacctgtggtagcaattttgccatcgcctatttcatcagcttcttcatgctctgtgccttcctggtgagaaccatttcctcaca

SEQ ID NO: 33372 - DNA, 201 bp, Homo sapiens
tgcccgtgggtgcccacccaccctctctgagccccagactgcttgagctatgggaataatatggcagcatggggctccatacagcccgagatgtttcctgsctatgatgtgaggagtctgttagagtattctagcctcagccattttctttctgactgtaagacgcctccccttctcaggtctcagtgcctcatctgtaag

SEQ ID NO: 33373 - DNA, 201 bp, Homo sapiens
ttcacatttgagagacaccacagtccttggcactttggagatggactgcatctcccagtaggcccaggccagggaaagcagtgcattctggggcttatagytctttgcctgagcctgtgcatctattctctgcccccctcccccatccctataggccttgccctatgtggctcttctcatcgcaatgatattcttcatcta

SEQ ID NO: 33374 - DNA, 201 bp, Homo sapiens
gcgcccatgtagctgggtagaggcagaagggtccaaatttgaaccctaatctttctgatggccaagccttttgagaagtcacctaggatccccctcagccrtgactcagtggctccccgctctttctcacaccccagattctgggttacttcgattatgccttcacctccattttcactgtggagattctactaaaggtga

SEQ ID NO: 33375 - DNA, 201 bp, Homo sapiens
atcatgtcttcaccaatcttatcctggtgttcatcatcctcagcagtgtgtccctggccgctgaggaccccatccgagcccactccttccgcaaccatgtragcctttggctgggagctaggagctgaggggacactcccaggggtgtcctagtgggcacaagctgggtcagggtggagataaggagaagagccctaggtg

SEQ ID NO: 33376 - DNA, 201 bp, Homo sapiens
gatcatgccactgcactccagcctgggcagagtctttttcaagactccgtctcaaaaaaaaagagagaatagaaaagaagagaagaaaaagaaaatctagytcagtgcctggcatatagttactgctaataaacgttggctattattcgttttactttttcctggtgggcgatgatgaggatgataatggtgatgatgaaa

SEQ ID NO: 33377 - DNA, 201 bp, Homo sapiens
aaataaactcaagcctgacttatacccattcaatttcactccagttgtatactgagggaaagaagtaggcacagcggtgagtcctagaccctcataccctrctcatccatccctgcccctctgatgtttattctggctcagggttcctgggcaacaccacctcagcggggtcggctcctgtatgccccgctgttgttggtg

SEQ ID NO: 33378 - DNA, 201 bp, Homo sapiens
agaggggcagtgccgacagcttggtggaggctgtgagtccagagggcatatagacaagacggatgggggagaaggggaggaggtgggtactggaggaggayggaaaggagtccccaggtcctgtgttgtgcatgtagatatccctttgccctacgacctctgctcacccctgtcccccactgacttccctacatgccctca

SEQ ID NO: 33379 - DNA, 201 bp, Homo sapiens
tgagggggctgggatatcccctcacctgcccccacctctaccccccctctggctcccacagactgctatacaaggccatcgatgcatatgcagaggaccayggccccatctataattaccgtgtggagatctcagtgttcttcattgtctacatcatcatcattgcgttcttcatgatgaacatcttcgtgggcttcgtca

SEQ ID NO: 33380 - DNA, 201 bp, Homo sapiens
aagctagtaatcaagaactaaactttccagtatccataatgggaggcagacagtgcaagaggtttgaccaatacacagtgcaatcaagtccccagactcgyctcagcccaggccagggaatatttggttgggtgtggcggcatctctgcctcaggctccatctcaacctgattttctcctgcagcactatgagcagactgc

SEQ ID NO: 33381 - DNA, 201 bp, Homo sapiens
tctccccagatgcaagatgccatggggtatgaactgccctgggtgtactttgtgagccttgtcatctttgggtccttcttcgtcctcaaccttgtgcttgrcgtcctgagtgggtgagggacctagacactccctgcttcccacccctcagccactgcccacttctttgtgcctggcaaactcctagacatccttcaaaac

SEQ ID NO: 33382 - DNA, 201 bp, Homo sapiens
tagacaccaccccagagcccagtccagccaatggggcaggccctggtcccgaatgggggctgtgccccgggcccccagctgtggaaggtgaaagcagtggrgcatcaggcctagggacccctaagcgaagaaaccagcacagcaagcacaagacagtggcagtggccagtgcccagcggtcacctcgggcactcttctgcc

SEQ ID NO: 33383 - DNA, 201 bp, Homo sapiens
tctcaacctgattttctcctgcagcactatgagcagactgctcccttcaactatgccatggacatcctcaacatggtcttcactggcctcttcactattgwgatggtgctcaaaatcatcgccttcaagcccaaggtggccccccttctctagccccacccaccagtggatgaattccttgggagtggagctcattgcaga

SEQ ID NO: 33384 - DNA, 201 bp, Homo sapiens
agcccacctctcctgtccccatccccacctcccccaacccccaccatccccaggtctgagtctagcctcttgtcctgtccccagatgacagtgtttggggmcttcctgcaccgcggctccttctgccgtagctggtttaatatgttggatctgctggtggtcagtgtgtccctcatctcctttggcatccagtaagtgaca

SEQ ID NO: 33385 - DNA, 201 bp, Homo sapiens
ggacagagatctggggaagcactgacattgctatttgcccctggtgccccacccacccccaggtcggaagccctccttcaccatccagtgtctgcagcgcmagggcagttgtgaggatttacccatcccaggcacctatcatcgtgggcgaaattcagggcccaatagggctcaggtgaggctgtggaggtggtgctgggg

SEQ ID NO: 33386 - DNA, 201 bp, Homo sapiens
gcccctctgatgtttattctggctcagggttcctgggcaacaccacctcagcggggtcggctcctgtatgccccgctgttgttggtggaagagggcgcagsgggggaggggtacctcggcagatccagtggcccactgcgcaccttcacctgtctgcacgtgcctggaacccactcggaccccagccatgggaagaggggc

SEQ ID NO: 33387 - DNA, 201 bp, Homo sapiens
ccatgatggccctgttcactgtctccacctttgaaggctggcctgcgtgagggacagggccctgggtttatcaggggatgaggcaggggtctctgcaggaytgggttgggatctcctgggaatgggtgggagtgtaccttggggatgtgacgaaggtctctcgagactggatagggttttctggagagtggtgggtgtatc

SEQ ID NO: 33388 - DNA, 201 bp, Homo sapiens
gccttgatgtgtccacagatgttcggcaaggtggctcttcaggatggcacacagataaaccgaaacaacaacttccagacctttccacaggctgtgctgcwtctgttcaggtgacatctactcactcccctgccaccttatgcccgtgggtgcccacccaccctctctgagccccagactgcttgagctatgggaataata

SEQ ID NO: 33389 - DNA, 201 bp, Homo sapiens
ggggtgggggtgggtaggcagaggtgaaagccaaagattggacctcggggtcttcaggtcctgaccactatccccaccttgcctacagccagcctcccagycagtgacaccggttccatgacagagacccaaggcgatgaggatgaggaggagggggctctggccagctgtacacgctgcctgtgagggcccccagcccct

SEQ ID NO: 33390 - DNA, 201 bp, Homo sapiens
tggggcatcaggcctagggacccctaagcgaagaaaccagcacagcaagcacaagacagtggcagtggccagtgcccagcggtcacctcgggcactcttcygcctcaccctggccaatcctctgcgacggtcctgcatcagcatcgtggagtggaagcatcctggaaggcaggggcagggcccaggggtaagggtcatcag

SEQ ID NO: 33391 - DNA, 201 bp, Homo sapiens
tcagctctatactgggaatgggtgagtgtttcatcagaatggctctttaccaggcacagtggtgcacgcctgtagtcccaactactcaggaggccaaggcrggaagattgcttgaggccaggagcttaagaccagcctgggcaacatctctacaaaagcgagaccccatctctacgaaaaatttaaaaattctcgggcagg

SEQ ID NO: 33392 - DNA, 201 bp, Homo sapiens
ccccgaggtcggaggtggagggtgggggtggggctgagctgaccccgcccttatttctgcctccccctccctccccgcaggcctgcacatagtgctcaatyccatcatgaaggctctggtgccgctgctgcacattgcactgctcgtgctcttcgtcatcatcatttatgccatcattgggctcgagctgttccttggacg

SEQ ID NO: 33393 - DNA, 201 bp, Homo sapiens
gcctgtagtcccaactactcaggaggccaaggcgggaagattgcttgaggccaggagcttaagaccagcctgggcaacatctctacaaaagcgagaccccrtctctacgaaaaatttaaaaattctcgggcagggtggcatgtgcctatagtcctagctactagtgaggcagaggcaggagaatctcttgaggccaggagt

SEQ ID NO: 33394 - DNA, 201 bp, Homo sapiens
ctgggtgacagagcaagaccctgtctctaaaaataataataattgataatatttgatcttttttccatagagatattgcacatatattaggtttttcctayatacttcgaattccatatactactggaaaatgacatcgtttttcttattttagtttgactgtttgctgcaggtatatatttggtaaatatttcatctgtt

SEQ ID NO: 33395 - DNA, 201 bp, Homo sapiens
ggctgaggcgggaggatcacttgagcccaggagttcaagaccagcctgggcaacaaagtgagacctcgtctctacaaaaatatttaaaaattagctgggcrtggtgtctcacgcctgtggtcccagctacataggaggctgaggcaggaggatcgcttgagcccaggaggtcgaggctgcagtgagccatattcatgccac

SEQ ID NO: 33396 - DNA, 201 bp, Homo sapiens
tcattctagctctatctcttctgagtccctgttgggttcagcaaaagtccccctctactggctttctcattccattttgtaacctatctactggctccacyatctcctgaaatgcctctcctgttatttctgttatctctttcattgcctctacatcccccatccattggctccgtcatgttcactggctcctgctttggc

SEQ ID NO: 33397 - DNA, 201 bp, Homo sapiens
agatcataaatctctttgtggctgtgatcatggacaactttgattatctcaccagagattggtccatcctgggcccccatcaccttgatgaattcaagagratctggtctgaatatgaccctggggccaagtatgccctctatacccttacctagaatccaggggacaatgtattgccctacacagtcccctagcccccaa

SEQ ID NO: 33398 - DNA, 201 bp, Homo sapiens
acggtctgggcccctctgcctatgtgtcttccttcttcaaccgctttgactgctttgtggtctgtgggggcatcctagagaccaccttggtggaggtgggygccatgcagcccttgggcatctcagtgctccgatgtgtgcgcctcctcaggatctttaaggtcaccaggtttgtattaggggagggggaagacaagggcc

SEQ ID NO: 33399 - DNA, 201 bp, Homo sapiens
ctactggccccctaccctggcttgcgagctttgagaagacagggcactgcttttctcctacttgcagcattacttcactgatgcctggaacacgtttgacrctcttattgtggtgggcagcatagtggatattgccgtcactgaagtcaatgtgagaactggcctttccactaatccactctcgccctatacaccttccct

SEQ ID NO: 33400 - DNA, 201 bp, Homo sapiens
aattaccgtgtggagatctcagtgttcttcattgtctacatcatcatcattgcgttcttcatgatgaacatcttcgtgggcttcgtcatcatcactttccrtgcccagggcgagcaggagtaccaaaactgtgagctggacaagaaccaggtgacctctgacccctgaccccctatggatggtcaccaacccttccctcct

SEQ ID NO: 33401 - DNA, 201 bp, Homo sapiens
cccatccccaccctaacccaaaacccaccactcaaatttaaccttaaattcgcccaccccatggcaatttaaactctacccccaacttaaacaccaaaccstacttcacttggaaatgtaatctcaccttcactcccctataaactctcactctaatcttaattcgaacactcttacttcccagtccttaacccagctact

SEQ ID NO: 33402 - DNA, 201 bp, Homo sapiens
cccccacctgagccccccagggcaggcttaggtaggtgatctcagcctgtgggctccccttcccccagccgccgcctccgccgagccaaccgggtccttcrggcacgctgccgtcgggcagtgaagtccaatgcctgctactgggctgtgctgttgctcgtcttcctcaacacgttgaccatcgcctctgagcaccacggg

SEQ ID NO: 33403 - DNA, 201 bp, Homo sapiens
ttaaattcgcccaccccatggcaatttaaactctacccccaacttaaacaccaaaccctacttcacttggaaatgtaatctcaccttcactcccctataarctctcactctaatcttaattcgaacactcttacttcccagtccttaacccagctactcccagttctccctaattttccatgctcttctctccttccttca

SEQ ID NO: 33404 - DNA, 201 bp, Homo sapiens
gccatggggtatgaactgccctgggtgtactttgtgagccttgtcatctttgggtccttcttcgtcctcaaccttgtgcttggcgtcctgagtgggtgagrgacctagacactccctgcttcccacccctcagccactgcccacttctttgtgcctggcaaactcctagacatccttcaaaacccatctgaaatactcctt

SEQ ID NO: 33405 - DNA, 201 bp, Homo sapiens
atctccctccagaatggtggccaccttggcgaggtagcccaccctaataacagggactctctgcttcttttcccatgtccctctgtccctccatccctccrgattaccctagggcctgagtgatttgggtactgggagggccaaagcatgagatagggagatagctggagtaaatgcaaactgagcatccctactgcaccc

SEQ ID NO: 33406 - DNA, 201 bp, Homo sapiens
ccacctgcctcagcctcccaaagtgctgggattacaggcatgagccactgcgcccagccatatgtgcatgtctttaaccttcatcctctgcctattctttyccctattattacatttcttccatgcctcccctgtgtccattccctgtgtctccctcaccattgatgactcccgtcttcctgtcctcaggtgcctggtgtg

SEQ ID NO: 33407 - DNA, 201 bp, Homo sapiens
ttcctcacccctcctcacccatctaacctgtttgcacatccacaggggctccttcctggtatacccagatggagacgtgtcacggcccctggtccgggagyggctctgggtcaacagtgatttcaactttgacaatgtcctttcagccatgatggccctgttcactgtctccacctttgaaggctggcctgcgtgagggac

SEQ ID NO: 33408 - DNA, 201 bp, Homo sapiens
cacccaaacccacaggacccaggccctgccctgcccctggggccaggatcactgatcaaactgaccatttgcacggatgcatgaccatacggcctggaccygacacataaatacacatctctgaccactagccatgtggcctgacccatgttccttccaagtgaccatatgtttctaccagtggccacatttctcagaccc

SEQ ID NO: 33409 - DNA, 201 bp, Homo sapiens
gacacatatgaatgaatgcacacaatgctcactgtacttgtgaggaaactgaggtcctgagaggtttaccccagatcatgcagctagtaagtggcagagcygacatttaaacccaggcctcctgcactcttacataaataaactcaagcctgacttatacccattcaatttcactccagttgtatactgagggaaagaagt

SEQ ID NO: 33410 - DNA, 201 bp, Homo sapiens
gatagctggagtaaatgcaaactgagcatccctactgcacccctcaccccagagctctgaggacagctcccgcatttccattaccttctttcgcctcttcygagttatgcggctggtcaagcttctcagtaagggtgaagggatccgcacattgctctggacattcatcaagtccttccaggtaatcccctaccccatccc

SEQ ID NO: 33411 - DNA, 201 bp, Homo sapiens
aagtgttgcagaggaaaggcaagtgttgcagaggaaaggcaagtgttgcaaaggaacttggttactttgtaaaagaggaagaaagaggatgtgtgcattargaggagggccactcaccatgcaggcctgagccaggctcatggccaggcggaaccgggcagacatggcaagaggcagcagagggctgaggccagagcccac

SEQ ID NO: 33412 - DNA, 201 bp, Homo sapiens
cacctgtgcccccaggtgcttatctcagagggtctgggcctctttgctcgagacccacgtttcgtggccctggccaagcaggagattgcagatgcgtgtcrcctgacgctggatgagatggacaatgctgccagtgacctgctggcacagggaaccagctctctctatagcgacgaggagtccatcctctcccgcttcgat

SEQ ID NO: 33413 - DNA, 201 bp, Homo sapiens; identical to SEQ ID NO: 6713

SEQ ID NO: 33414 - DNA, 201 bp, Homo sapiens
ctgcccttcacctaactgctcccttgctcactggcccacagatcataaatctctttgtggctgtgatcatggacaactttgattatctcaccagagattgrtccatcctgggcccccatcaccttgatgaattcaagaggatctggtctgaatatgaccctggggccaagtatgccctctatacccttacctagaatccag

SEQ ID NO: 33415 - DNA, 201 bp, Homo sapiens
cttctctcccttgcccctagaggaggaggtcaccgtgggcaaattctacgccacatttctgatccaggactatttccgcaaattccggcggaggaaagaawaagggctactaggcaacgacgccgcccctagcacctcttccgcccttcaggtcttcggggcagggcctagtgtggatgggcacgtgtggcagtgctgtgg

SEQ ID NO: 33416 - DNA, 201 bp, Homo sapiens
gaccagcctggccaatgtagtgaaaccccgtctctactaaaaatacaaaaaaattagccgggagtggtggcaagtgactgtagtcccagctactcgggagkctgaggcaggagaatcgcttgaacctggaaggtggaggttgcagtgagacgagattgtgccactgcactccagcttgggcaacacagtgagacttcatct

SEQ ID NO: 33417 - DNA, 201 bp, Homo sapiens
ggctgctttgagaacggactgttgggaggggcagtggggaagagcggaagcaagaaagttctatgggacccaagaaaggtctgttctgactgtagtgatcycccttagcccatctgcagcaatcacccctatttcctcgcacagggagaagagcaatgagaaggatctcccacaggagaatgaaggcctggtgagttagat

SEQ ID NO: 33418 - DNA, 201 bp, Homo sapiens
agccagtccaaaccctgactcaagtcctttctttagcctcaagcctcgatctcagtccttgacctctggccccagtcactgacaccccttctgccctttaygacacacacctcccatcccccttctttttcagaaacaagatcatgaaaaccagagtctggtgagttgggaaagttgtgcaaatccttgactccataactt

SEQ ID NO: 33419 - DNA, 201 bp, Homo sapiens
caccccagcgcctacatccgcaatggctggaacctactcgacttcatcatcgtcgtggtcgggtgcgcgtctgcgggaggcaccccaccctagtcgccttyctaccgtcaggcccgctgaattctgggctcaggaaagcgactctttcagaccgcccccattcggcagccagaatcaggaatattattaaaacccatttct

SEQ ID NO: 33420 - DNA, 201 bp, Homo sapiens
ttcaaacagagggacaggatcaggtaggaagcagccacaattgccccaataccctgtccctccctgacacagtttctccatatagacaccaccccagagcycagtccagccaatggggcaggccctggtcccgaatgggggctgtgccccgggcccccagctgtggaaggtgaaagcagtggggcatcaggcctagggacc

SEQ ID NO: 33421 - DNA, 201 bp, Homo sapiens
cagctataaagactccaaatgacacccctaccctagacatggccctaaccctgcccccagtatgtcctccctaattgtcctttctctccctgcagggccayagctggccgagctgaccaataggaggcgtggacgtctgcgctggttcagtcattctactcgctccacacactccaccagcagccatggtgggggtccagc

SEQ ID NO: 33422 - DNA, 201 bp, Homo sapiens
cccaccccatggcaatttaaactctacccccaacttaaacaccaaaccctacttcacttggaaatgtaatctcaccttcactcccctataaactctcactstaatcttaattcgaacactcttacttcccagtccttaacccagctactcccagttctccctaattttccatgctcttctctccttccttcaaacagaggg

SEQ ID NO: 33423 - DNA, 201 bp, Homo sapiens
gtggagtcggggtgggtaaggggaactgggtggtctataggcagggtgcttctccatcctttgcagcctaagctcatcccagacatcctgttgaacgtgtktcttgccattgctgtggacaacctggccagtggagatgcaggcactgccaaggacaagggcgggtgagatctggctccacccctaacacagtctctctct

SEQ ID NO: 33424 - DNA, 201 bp, Homo sapiens
agagtggtatggagtgaaggtcagtggaggaaatggagggccagattgagggcattctgggccagggtgaggactgtagtttttcctgaattaaggagacrtgggagggttgtgggcagagttgggatatcccagacagggtttaacaggctccctctggctgctttgagaacggactgttgggaggggcagtggggaaga

SEQ ID NO: 33425 - DNA, 201 bp, Homo sapiens
catatgtttctaccagtggccacatttctcagacccagctccctgacaggtggccacagatccccacccggcaaacacttattcctggtggatgcccacaygtctctagcccataacactgcctcttgaacacatgttgctaaccatacatccctgacccatcaccacatgtccccagcccaagtccctcagctgcatcta

SEQ ID NO: 33426 - DNA, 201 bp, Homo sapiens
ctgccctgggtgtactttgtgagccttgtcatctttgggtccttcttcgtcctcaaccttgtgcttggcgtcctgagtgggtgagggacctagacactccytgcttcccacccctcagccactgcccacttctttgtgcctggcaaactcctagacatccttcaaaacccatctgaaatactccttcattcaatcatgagc

SEQ ID NO: 33427 - DNA, 201 bp, Homo sapiens
ggcatgggtgttgtgtcagggccagaactgtatcccttggaatccctgaacaattctgtggtcctgagttctgaccatggcccactccctctccacaggcygaggaagggctgccacaccctcatccaccatcatgtcttcaccaatcttatcctggtgttcatcatcctcagcagtgtgtccctggccgctgaggacccc

SEQ ID NO: 33428 - DNA, 201 bp, Homo sapiens
gtgcccgcagcatgtggtgcagtgtgtatttgtggccatccggaccatcggaaacatcatgattgtcaccacacttctgcaatttatgttcgcctgcatcrgggtgcagctcttcaaggtggggcaaacactggagggaatgccaggcaggggtctgggcgggagtgtgatgaagggtgaacctacttgacagacatcctc

SEQ ID NO: 33429 - DNA, 201 bp, Homo sapiens
tggtacctccccaactcctccaggggccgcatcaaacacttggatgtggttgccctgctgagacgtatccagccccctctgggatttgggaagctgtgccsacaccgagtggcctgcaaggtctgtgcacctgcccacccccaggctcctgagagaactgtctatcacatggcaagggtgggaagggatctgccttgggtg

SEQ ID NO: 33430 - DNA, 201 bp, Homo sapiens
ctctgggatttttcctataagcagtggggagccatgggagggatttgagtagggtagtgacatagttaacattgcattttaaatagatgttctgacggctrtgctgaaaacagaagggagggggaagagactggagatgctaaaattggcaggaatgatggtcgccttagccagaggaggtggcagaggagatggtgagaa

SEQ ID NO: 33431 - DNA, 201 bp, Homo sapiens
gtttgatcgcatcctcagaggtttctgccccttgacattcgttcctgcatacccggcattttcccagagtgggtttcatgtctctcgtgtttgcagagacytgtggcaatgaacatgcccctcaactcagatgggacggtgacattcaacgccacactctttgccctggtccggacatccctgaagatcaaaacagaaggt

SEQ ID NO: 33432 - DNA, 201 bp, Homo sapiens
ccacccacccccaggtcggaagccctccttcaccatccagtgtctgcagcgccagggcagttgtgaggatttacccatcccaggcacctatcatcgtgggygaaattcagggcccaatagggctcaggtgaggctgtggaggtggtgctggggtctggggtctggagagatgggggcagcctaggctgaatttctcaaaca

SEQ ID NO: 33433 - DNA, 201 bp, Homo sapiens
tctctgagcaatctggtggcatccctgctcaattcaatgaaatccatcgcatccttgctgcttctcctcttcctcttcatcattatcttctccctgcttgrcatgcagctgtttgggggcaagttcaactttgaccagacccacaccaagcgaagcacctttgacacgttcccccaggccctcctcactgtctttcaggta

SEQ ID NO: 33434 - DNA, 201 bp, Homo sapiens
aaaattcccccacttaaggtgtgccattcaatgcttttagtaccttcacagagttgtgcagccatcaccactatctaattttagaacattttccccacccrcacccccttggcagtgtattcatttgctcgggctgccataacaaaatgccgcagactgtggttaaacaccagaaatcgatttgctcacagttctggaggc

SEQ ID NO: 33435 - DNA, 201 bp, Homo sapiens; identical to SEQ ID NO: 6920

SEQ ID NO: 33436 - DNA, 201 bp, Homo sapiens
tttaggaaagatggggatttaaaaaccagagacaacctggacgaactacttgacgctgtgtacggtaaatgtgatttttcacaggctgtggttctggggasccgtgtgggctcttgttgagctgggggagatacttcgaatactgatatcgccccaaagctgcaactctccggccccgccacggctccttatgtacaaaga

SEQ ID NO: 33437 - DNA, 201 bp, Homo sapiens
aggccataaaattcccccacttaaggtgtgccattcaatgcttttagtaccttcacagagttgtgcagccatcaccactatctaattttagaacattttcsccacccacacccccttggcagtgtattcatttgctcgggctgccataacaaaatgccgcagactgtggttaaacaccagaaatcgatttgctcacagttc

SEQ ID NO: 33438 - DNA, 201 bp, Homo sapiens; identical to SEQ ID NO: 6921

SEQ ID NO: 33439 - DNA, 201 bp, Homo sapiens; identical to SEQ ID NO: 6922

SEQ ID NO: 33440 - DNA, 201 bp, Homo sapiens; identical to SEQ ID NO: 6923

SEQ ID NO: 33441 - DNA, 201 bp, Homo sapiens; identical to SEQ ID NO: 6924

SEQ ID NO: 33442 - DNA, 201 bp, Homo sapiens; identical to SEQ ID NO: 6925

SEQ ID NO: 33443 - DNA, 201 bp, Homo sapiens; identical to SEQ ID NO: 6927

SEQ ID NO: 33444 - DNA, 201 bp, Homo sapiens; identical to SEQ ID NO: 6926

SEQ ID NO: 33445 - DNA, 201 bp, Homo sapiens; identical to SEQ ID NO: 6928

SEQ ID NO: 33446 - DNA, 201 bp, Homo sapiens; identical to SEQ ID NO: 6929

SEQ ID NO: 33447 - DNA, 201 bp, Homo sapiens; identical to SEQ ID NO: 6930

SEQ ID NO: 33448 - DNA, 201 bp, Homo sapiens; identical to SEQ ID NO: 6931

SEQ ID NO: 33449 - DNA, 201 bp, Homo sapiens; identical to SEQ ID NO: 6932

SEQ ID NO: 33450 - DNA, 201 bp, Homo sapiens; identical to SEQ ID NO: 6933

SEQ ID NO: 33451 - DNA, 201 bp, Homo sapiens
gcccctgcaccttgaactgtttactttcctgtaaccatttacccttttaactttttgactactttacttctgtaaaattgttttaactagaccccccccccttcctaaaccaaggtataaaagttaatcaagccccttcctcggggctgagagaattttgagcgttagccgtctctcggtcgccagctaataaaggactct

SEQ ID NO: 33452 - DNA, 201 bp, Homo sapiens
taacttttataccttggtttaggaaggggggggggtctagttaaaacaattttacagaagtaaagtagtcaaaaagttaaaagggtaaatggttacaggaragtaaacagttcaaggtgcaggggctttaagactattacaagatgatagacccggggctttgggcgttatcaatcggacaaattcctgggaactgcggat

SEQ ID NO: 33453 - DNA, 201 bp, Homo sapiens; identical to SEQ ID NO: 6934

SEQ ID NO: 33454 - DNA, 201 bp, Homo sapiens; identical to SEQ ID NO: 6935

SEQ ID NO: 33455 - DNA, 201 bp, Homo sapiens
cgagacgcagaagtcgctccacgccctgggcggcctcagctcccgcgacaccgcagcaactcagaacccaggcaggggccgggcagccagcatgctgcccscacgttcacctccaactcccacctctcggccctcgccccaacccgcaggaccctggcagcgcactggctgtctccgcggaagcccccgagggcctcggcg

SEQ ID NO: 33456 - DNA, 201 bp, Homo sapiens; identical to SEQ ID NO: 6936

SEQ ID NO: 33457 - DNA, 201 bp, Homo sapiens; identical to SEQ ID NO: 6937

SEQ ID NO: 33458 - DNA, 201 bp, Homo sapiens
aagaggtaggtgagcaggaagaggaggaagagcaggtactgcagccctggggccgtggggaggcccaccaggatgaaggtgctgaccttggtgacattctrcccactcatgcctctgtgcttgggagctgcaggcctacaaaacatcaaagagcaagaggaaagggctgcagggcagctgaggcagagagagagtggagct

SEQ ID NO: 33459 - DNA, 201 bp, Homo sapiens; identical to SEQ ID NO: 6939

SEQ ID NO: 33460 - DNA, 201 bp, Homo sapiens
catcttgggggtgatgtcagacacgtaccagatctccaggaaagacatggagctcagaaagtagtacatgggcctgtggagggaggtgctgctccagacgytgaggatgatggccaggttctccaccaggacaaagaggtaggtgagcaggaagaggaggaagagcaggtactgcagccctggggccgtggggaggcccac

SEQ ID NO: 33461 - DNA, 201 bp, Homo sapiens; identical to SEQ ID NO: 6941

SEQ ID NO: 33462 - DNA, 201 bp, Homo sapiens
ggtgtggtggtgcgcacctgtaatcccagctactaaggacgctgaggcaggagaattgctggaacccgggaggtggaggttgcagtgagctgagatcatgscactgaactccagcctaggagacagagagagacagtctcaaaaaatatacacacacacacacacacacacacacacacacacatatatataccataataa

SEQ ID NO: 33463 - DNA, 201 bp, Homo sapiens
ccctttggctttgcaaaggaaaacctccttgtttctcaccttttcttaccttctggtgaggtaaggtgagggagagaggccttacgtttcttctcactgcmtctcacaggttatccaagcccagaagtgttaccagaaaggggaccggatccagaccccaagagagggttcttggatctcatgcaaaaaaagaattcaggg

SEQ ID NO: 33464 - DNA, 201 bp, Homo sapiens
atagcattgggaggattctgcatttacatctgaagaacttagaaacacaactgaaaaatactatcgtttttttccttatccacactggatacattccaagrtccccagtggatgcctgaaaccacagatagtaccataccctatatatactatgttttttcctatagataggtacctatgataaagtttaatttataaatt

SEQ ID NO: 33465 - DNA, 201 bp, Homo sapiens
agcccggtggattgctgattgcccatttttatggttatttcttgattatatgctaaacaaggtgtaaataattctggcctgccttttttagatcatattgsgtaacttcctgtcgttgccatggcatttgtcaactgtcatggtactggtgggagtgtagtagtgaggacgaccagaggtcactgtcattgccatcctggt

SEQ ID NO: 33466 - DNA, 201 bp, Homo sapiens
atgctaaacaaggtgtaaataattctggcctgccttttttagatcatattgcgtaacttcctgtcgttgccatggcatttgtcaactgtcatggtactggygggagtgtagtagtgaggacgaccagaggtcactgtcattgccatcctggtgttggtgggttttagccagtttctttactgcaacctgttttatcagcaa

SEQ ID NO: 33467 - DNA, 201 bp, Homo sapiens
ttcaacacatgaattctatttaatttggccagcacagtcactgtccttctcactctcactctctcaaataggattggctgtcaacatttaaatatcaagayttcggagcggggcgcgatggctcacgcctgtgatcccagcactttggcaggccgaggtgggcagatcacgaggtcaggagatcgaaacacagtgaaaccc

SEQ ID NO: 33468 - DNA, 201 bp, Homo sapiens
ctctgttgcccaggctggaatgcagtggcacagtcatagctcactgcagcctagaactcctgggctcaagtgatcttccctcctcagctgcctgggcttcytaaagcactgggattacagatgtgagccactgcacctggccaagaaagcttcttttaatccttatttgctaaaagatttttttttttgtacatatgagat

SEQ ID NO: 33469 - DNA, 201 bp, Homo sapiens
ggaggctgaggctgcagtgagccatgattgtgccattgcactccaaactgggtgacagagggggactgtctcaaacaataattattattattactttacayacttgatatttatttgtcatttttgttgcctgtaaatgtctttgtttcacccttattagtgaaagatcattttgctggatcttgaactctaggctgacta

SEQ ID NO: 33470 - DNA, 201 bp, Homo sapiens
tatatggcagggaagaaatataacaatgtataagaaaacagaaaatgtacccctcccaaggaactagggaggggtaaggaagcaatagtgatgaatgaggkgtctggcatttcattgtctggatgctgtgacctggtgagtttcagctctttgatactttttttgagtggcctgagggtgttgctaagaaggaactcagat

SEQ ID NO: 33471 - DNA, 201 bp, Homo sapiens
tcaggtacctcaggtgtccaagcatcactaccagattgcccttgaccaccagattctttcagcagccttggggtgggggagtggacagtgaaggtgactgytgcaagcattaagtgttggagtgctatactgcttccatcctctccagcccctctgttccccaagatttgtttctcctggagtgaatacacgcggaggacc

SEQ ID NO: 33472 - DNA, 201 bp, Homo sapiens
agccttggggtgggggagtggacagtgaaggtgactgttgcaagcattaagtgttggagtgctatactgcttccatcctctccagcccctctgttccccawgatttgtttctcctggagtgaatacacgcggaggaccttaagagcaaggtcttaaaatatgtgcaacacatacaagcttttcaaagaacaattattcaga

SEQ ID NO: 33473 - DNA, 201 bp, Homo sapiens
cctgaccttgagtgagctgcctgccttggcctcccagagtgctgggattacaggcgtgagtcggcgcacccggcctctgattttcagtaaatacgttgtcrtttacttgatgtttccatgggagaacagggacctggagcttctgccatcttgctgacatcaccataacataactctttagacttccaagtcttgtctttt

SEQ ID NO: 33474 - DNA, 201 bp, Homo sapiens
aacacatgaattctatttaatttggccagcacagtcactgtccttctcactctcactctctcaaataggattggctgtcaacatttaaatatcaagatttyggagcggggcgcgatggctcacgcctgtgatcccagcactttggcaggccgaggtgggcagatcacgaggtcaggagatcgaaacacagtgaaaccccgt

SEQ ID NO: 33475 - DNA, 201 bp, Homo sapiens
attccctcttagctgagagtttttatcaggaatggttgttggattttgtcaatgcttctccttcatctattgagatcaatcacatggtttttagtttgttwatatggtgaaatacagtgattgattttgggatgtcaaatgaactttgtgttcctgcaataaatcctacttggtcatgatgtattattttaaaaatatatt

SEQ ID NO: 33476 - DNA, 201 bp, Homo sapiens
gcgatggctcacgcctgtgatcccagcactttggcaggccgaggtgggcagatcacgaggtcaggagatcgaaacacagtgaaaccccgtctctactaaamatacaaaaaaaaaaattaaattaaatatcaagatttctggcttctcttgaagaattaggtgatgggcccacatttccacactaaaacaactgtccagaac

SEQ ID NO: 33477 - DNA, 201 bp, Homo sapiens
gatgtcaaatgaactttgtgttcctgcaataaatcctacttggtcatgatgtattattttaaaaatatattgttagatttgatttgctgatttttaaagartttgtgcatctatgttcttaaggaacattggtctatagttttctcgtaacgtctgtttggttttgctatcagggtaatgctagccttgtagaatgagtag

SEQ ID NO: 33478 - DNA, 201 bp, Homo sapiens
gcacatcctcaaccttggaaaaataaacttttaaattgattgagacttgcctcagtgattttctttggtgtatactctgtatcacttgaatactttccaaktgaagacatgctttataatccagagtatggactgttttggccagatgttttctatatactggaaagaaatgtgtattctgctgttgttgaatggcatgtt

SEQ ID NO: 33479 - DNA, 201 bp, Homo sapiens
tataatccagagtatggactgttttggccagatgttttctatatactggaaagaaatgtgtattctgctgttgttgaatggcatgttctataaatctcaawtacatcaagttggttgatagtcttgatgtcttctatatctctgtggattttccatttgttctagtgattattgagagaaaggtattgatatatctgccta

SEQ ID NO: 33480 - DNA, 201 bp, Homo sapiens
ctctgggaccacctgcctaactccttgtacacttccaaccacccttactccgtgtctcccagacaaccagactggggcaagtgttgggaagatggagacayaggaatgatcaggatgggaaagaggctcctccccctcctccaacaggcactgcttccagcccagactggtgtgtgtggttgtagggcaggagggggtgta

SEQ ID NO: 33481 - DNA, 201 bp, Homo sapiens
tctgtgaccatactttgttatttattttcctgggacatggtatagttcatctccagtcaccttcctctggacttacaggttattcttgtccagaattttastgctattttaaaaattttaacacaaaatttggtcataactattattgttggctgggtgcagtggctcacacctgtaatcccaacactttggtaggctgag

SEQ ID NO: 33482 - DNA, 201 bp, Homo sapiens
aaaaattttaacacaaaatttggtcataactattattgttggctgggtgcagtggctcacacctgtaatcccaacactttggtaggctgagacaggaggaytgcttgagcccaggagttccagaccagcctgggcaacatagggagaccccatctctacaaaaaaatttaaaaattagctgggcatggtggtatgtgccta

SEQ ID NO: 33483 - DNA, 201 bp, Homo sapiens
atggaagagtgggatgaaatcagagttgttacctgatattcaacacatgaattctatttaatttggccagcacagtcactgtccttctcactctcactctytcaaataggattggctgtcaacatttaaatatcaagatttcggagcggggcgcgatggctcacgcctgtgatcccagcactttggcaggccgaggtgggc

SEQ ID NO: 33484 - DNA, 201 bp, Homo sapiens
tttgttcacaacgcttaaagatggggagaataattagaacaaatttcactgggaatacacttgacaggtgaagtacattaaccacatagtgaatgagttcyaattttgttacagtcgaattattaaagtctagttggtcaattaggatgacaacaggcttctgtggaaagaaaagtctaattgaagtttagggagtgcctt

SEQ ID NO: 33485 - DNA, 201 bp, Homo sapiens
attttcagactgcagttgatcatgggtaattaaaactataaaaagtgaaaccacagatgaggggatactgtagtacatttaataaatgttacttgccattratatttctgtagatttttgatcaacttttgctctggaagatcagaggggactgacctaattaggtctgataaaaggcttaactttatcacttagcattgc

SEQ ID NO: 33486 - DNA, 201 bp, Homo sapiens
ctaattaggtctgataaaaggcttaactttatcacttagcattgcttgagtattttactggcctggtgggtgtactgagaaaagcaggcttatgtttcaayagtggactctattgtgcgaaataaatatgagtctcctccctctttgctgttgccttatttgtactagcatgccagtttgaatacacagtgttcatgtcaa

SEQ ID NO: 33487 - DNA, 201 bp, Homo sapiens
agtcttttatcaaatatggatttattaaaaaataatattatatatagtattattttgttctcatattttaaatataaaataatgtatgttttactttttcygatttgtttttttcactcaacattcttgttaatgacttatctatgctgatacatggatcgttgtagtgggttcattgttaactgttgcatagaatttcat

SEQ ID NO: 33488 - DNA, 201 bp, Homo sapiens
gtgagctgagatcatgccactgaactccagcctaggagacagagagagacagtctcaaaaaatatacacacacacacacacacacacacacacacacacayatatataccataataaaaattatgtgaatgtagcccctttctgtctcaaaatatcttattgtgctgtacttacctattttcagactgcagttgatcatgg

SEQ ID NO: 33489 - DNA, 201 bp, Homo sapiens
ggttgaatctttgtttatcacaattatgagcaaatgtattatcttcacttagcttcaatttctacatttataaggtggacataaaacacccatctcacagrgttgccatgaagattaagtgaaatgctatttcagctgatatttgtgctacacatattttcccccagactacaccgtaacttttcaatttgtttgttgtac

SEQ ID NO: 33490 - DNA, 201 bp, Homo sapiens
ggttttagccagtttctttactgcaacctgttttatcagcaaggtctttatgacccatgccttgtgccaacctcctgtctcatcttgtgactaagaatgcyttaacctcctgggaatgcagcccagcaggtctcagccttattttacccatcccctagacaagatggagttgctctgattcaaacgtctctgacaaaagca

SEQ ID NO: 33491 - DNA, 201 bp, Homo sapiens
gtacctttagatacatagacacattttatttgtagtcaaatgtattatcctacataatttacattttatatgttctgtatccttccctaccccaagctcakaaacagatcattattataatttcttttaaaagtttaaagttttgctttcacatcaaactgattatctacctgaaatggatctgtatatatggtgtgatat

SEQ ID NO: 33492 - DNA, 201 bp, Homo sapiens
tggtggctcacgcctgtaatcccagcactttgggcagctgaggtggttggatcacgaggtcaggagatcgagaccatcctggctcacacggtgaaaccccrtctctactaaaaatacaaaaaaaaaattagctgggcgtggcggtgggtgcctgtagtcccagctactcgggaggctgaggcaggagaatggtgtgaaccc

SEQ ID NO: 33493 - DNA, 201 bp, Homo sapiens
tgggcctcagttccttcatcagtaagatgaggggcaaaatagcattgggaggattctgcatttacatctgaagaacttagaaacacaactgaaaaatactrtcgtttttttccttatccacactggatacattccaagatccccagtggatgcctgaaaccacagatagtaccataccctatatatactatgttttttcct

SEQ ID NO: 33494 - DNA, 201 bp, Homo sapiens
gactggaccttctttctgttccttgcacaggcatgctccttctagcacaggaacttggcatatgttgttgcctccccccaggaatgctctcatcctccccyacgaatttcctctggttaactcttattttaggatctcatacaacacttccacaaggaaaccctcccagacctctctaacgaggcgaagcatacctactat

SEQ ID NO: 33495 - DNA, 201 bp, Homo sapiens
tctgggctggagttttcttttaaagagaaggtctctttaaaaatttaatttatttaataaataaagaactattcaagttatctatttcttcttgagtgaasactggttctttgagaactattcattgatcttttttccttgtttactgtttactgctttattgatttgcactctaattttcattatttcatttcttctgct

SEQ ID NO: 33496 - DNA, 201 bp, Homo sapiens
tttaaaaatttaatttatttaataaataaagaactattcaagttatctatttcttcttgagtgaagactggttctttgagaactattcattgatctttttyccttgtttactgtttactgctttattgatttgcactctaattttcattatttcatttcttctgcttatttttcatttcatctgctcttctttttccagtt

SEQ ID NO: 33497 - DNA, 201 bp, Homo sapiens
gaactattcattgatcttttttccttgtttactgtttactgctttattgatttgcactctaattttcattatttcatttcttctgcttatttttcatttcrtctgctcttctttttccagtttcttaaagtggttaagaatgttacttaagtactgcttgagcaacattccacaaatttcgatatgttttcaatttttatt

SEQ ID NO: 33498 - DNA, 201 bp, Homo sapiens
gtgactgttgcaagcattaagtgttggagtgctatactgcttccatcctctccagcccctctgttccccaagatttgtttctcctggagtgaatacacgcrgaggaccttaagagcaaggtcttaaaatatgtgcaacacatacaagcttttcaaagaacaattattcagaatacatacagaactcttacaaatcagcaag

SEQ ID NO: 33499 - DNA, 201 bp, Homo sapiens
aaaagaattcagggtgagtccatagagtaaagtgaaagtaagtctataatgaaagtgaaggaatagaaggatggctgctcctccatagacagagcagcccrgtggattgctgattgcccatttttatggttatttcttgattatatgctaaacaaggtgtaaataattctggcctgccttttttagatcatattgcgtaac

SEQ ID NO: 33500 - DNA, 201 bp, Homo sapiens
tactttacacacttgatatttatttgtcatttttgttgcctgtaaatgtctttgtttcacccttattagtgaaagatcattttgctggatcttgaactctrggctgactattgttttctctcagcactttgcaggtattattccattgtattctgacctgtattgctgctatggagtagccagctatcaatttaactggca

SEQ ID NO: 33501 - DNA, 201 bp, Homo sapiens
gaatttcctctggttaactcttattttaggatctcatacaacacttccacaaggaaaccctcccagacctctctaacgaggcgaagcatacctactatacrctcgtgtagcaccatgcacctttctactttagtacttccgacaagtaggtttatgtttatttataggactctttgattactatctgcctcccactcagag

SEQ ID NO: 33502 - DNA, 201 bp, Homo sapiens
tactatacgctcgtgtagcaccatgcacctttctactttagtacttccgacaagtaggtttatgtttatttataggactctttgattactatctgcctccsactcagagtataacctccacaagggtagggaccaaggagccaagttaagtttccaagcagggcacacactgccagatcccgtattaaacacacacatcct

SEQ ID NO: 33503 - DNA, 201 bp, Homo sapiens
ttgattactatctgcctcccactcagagtataacctccacaagggtagggaccaaggagccaagttaagtttccaagcagggcacacactgccagatcccrtattaaacacacacatccttgcaacaccaaattgggaagttccactgctggctgtccgctgttgccctttctcctctttcttctttcacgggcctctcca

SEQ ID NO: 33504 - DNA, 201 bp, Homo sapiens
ttactctccccctacaataaagactacattttcctgtttaaagaacctccctttcacatttcaagtcttttcttgtagtctataggtatgtgataatggartgatggtcacaagattggtttgtgtctagcaacgtgttgaggctcttttaaaaagtaaagatgtaaagatctcaaagtcttttgagaaaacaggaaaagt

SEQ ID NO: 33505 - DNA, 201 bp, Homo sapiens
tttttcttttcagtgtattttcttccactgttttatcaagtactgcttttctccacttcatttcacatcacatgcattgctccaaattactccatgctgawtacatgtatcttaaatggatgcataatatgatgcatggtttcacaaaactttattttgtaatcaatactgaaatgaacttcttcgcagatgtaggatttt

SEQ ID NO: 33506 - DNA, 201 bp, Homo sapiens
ataattagaacaaatttcactgggaatacacttgacaggtgaagtacattaaccacatagtgaatgagttccaattttgttacagtcgaattattaaagtytagttggtcaattaggatgacaacaggcttctgtggaaagaaaagtctaattgaagtttagggagtgcctttatatggcttgagcaacacagtggaaatc

SEQ ID NO: 33507 - DNA, 201 bp, Homo sapiens
ttctcagagggaagagaagtacactccaagttcttaccacataaaacatatatcactcatgtagcaaattatgtaagtgtttgaaatcatttcaaagctaygtaacacacatcgaatacttccatcaaatgtccatatagactatcatgtaatcaaagaatagactccttttttccccaacagatgcctcttttttctttt

SEQ ID NO: 33508 - DNA, 201 bp, Homo sapiens
ttccatcaaatgtccatatagactatcatgtaatcaaagaatagactccttttttccccaacagatgcctcttttttctttttcttgccttatagaactgrctagattctccagcacaacattgaataaaaatgcagatattcttgtcttgttcttgagcttaggacaaaatcattcatgcctttcaccattaaatgtaat

SEQ ID NO: 33509 - DNA, 201 bp, Homo sapiens
ccagcttgagaatttgtcagacttctttaatctgttgttttgtctttcatcaatttgggggaatttcttcaagtattgtctttctcctatctactctttcstgctacatcaaatttatacaacatgttctcttctatcttatgtggatgtggcttttaagttctttttcatgttgttcatctctttgtcttgaagtaattt

SEQ ID NO: 33510 - DNA, 201 bp, Homo sapiens
aatggtgtgaacccaggaggtggagctttcagtgagctgagatcatgctactgcactctagcctgggcgatacagtgagactccgcctcaaaaaaaaaaaraaaaaagaaattgaccagaagggtccatttctatgtttatccaaaaacaaaaagacaacaaaaaaagtgtctatgggactattgggttgatttcatccag

SEQ ID NO: 33511 - DNA, 201 bp, Homo sapiens
tggcatttcattgtctggatgctgtgacctggtgagtttcagctctttgatactttttttgagtggcctgagggtgttgctaagaaggaactcagataaaacaaatgcaagtttcaagctttaagggccaggcttggtggctcacgcctgtaatcccagcactttgggcagctgaggtggttggatcacgaggtcaggaga

SEQ ID NO: 33512 - DNA, 201 bp, Homo sapiens
tttaaatatgggtaaccaattgtcctaagatcaaatattgaatagaccattttttctactttgatttgtagggcttacttttgtcatattactgtcccatrtatgaaggtctgtttctggtctctttattctgtttcagtggtcaaaaaccacacaattttaatcactataatttaaaaataaacactaatatctttaaaa

SEQ ID NO: 33513 - DNA, 201 bp, Homo sapiens
agtgagctgagatcatgccactgaactccagcctaggagacagagagagacagtctcaaaaaatatacacacacacacacacacacacacacacacacacatatatataccataataaaaattatgtgaatgtagcccctttctgtctcaaaatatcttattgtgctgtacttacctattttcagactgcagttgatcatg

SEQ ID NO: 33514 - DNA, 201 bp, Homo sapiens
tccacatttaaatattgaatacttcaaaatcctatttggaaaaaagtacaggtcacagatcctacaatcctactgtggcttgtgtctctttttccgaggcmcatcctcaaccttggaaaaataaacttttaaattgattgagacttgcctcagtgattttctttggtgtatactctgtatcacttgaatactttccaagtg

SEQ ID NO: 33515 - DNA, 201 bp, Homo sapiens
tatcgaggctctttacatctctcttcgtaaatgaaactggtctatgtattttctttcttcagctttttactggctttggtatcaaattagattgattaccktaaatgaatttgagagcatttcccgcccagtgtccccctttttggattatttggaacaacttgtgtaaaattagaatcatatgccacttgaatatttgac

SEQ ID NO: 33516 - DNA, 201 bp, Homo sapiens
cagtgagctgagatcatgccactgaactccagcctaggagacagagagagacagtctcaaaaaatatacacacacacacacacacacacacacacacacacatatatataccataataaaaattatgtgaatgtagcccctttctgtctcaaaatatcttattgtgctgtacttacctattttcagactgcagttgatcat

SEQ ID NO: 33517 - DNA, 201 bp, Homo sapiens
ggagaattgctggaacccgggaggtggaggttgcagtgagctgagatcatgccactgaactccagcctaggagacagagagagacagtctcaaaaaatatacacacacacacacacacacacacacacacacacatatatataccataataaaaattatgtgaatgtagcccctttctgtctcaaaatatcttattgtgct

SEQ ID NO: 33518 - DNA, 201 bp, Homo sapiens
aggagaattgctggaacccgggaggtggaggttgcagtgagctgagatcatgccactgaactccagcctaggagacagagagagacagtctcaaaaaatatacacacacacacacacacacacacacacacacacatatatataccataataaaaattatgtgaatgtagcccctttctgtctcaaaatatcttattgtgc

SEQ ID NO: 33519 - DNA, 201 bp, Homo sapiens
gaagagaaacagatgaacgcatctttgaattatctagttgttccccctggccttgtttcctatttttgctgttctttcttcattttagtatttgttaactyttgcctctctccctgaaaccaagacaatgagctagaatcatcaaagatattaaaacctagagctctctgtcttgctttagtccaaagcttggtgggaaat

SEQ ID NO: 33520 - DNA, 201 bp, Homo sapiens
acaattcatgttagctttttcagttttctttttttttcaaaatttgacacatttattttatttttgagtttcatttttacaagagaagacacaaggtaaaraaagacaaccactttggagagggatcatggtgagggcaatgtcactgtcatggccatagtacaagccttccaagaaaagggacctgcgttattccctctc

SEQ ID NO: 33521 - DNA, 201 bp, Homo sapiens
gcttagttttcccgagtctacttaccaaagctaggtcggatattggtgatctcagccatgtcgtaatcagaggctgttgctataacgtttttgcaatggtragacagctctgggaaccctcggtcagtaccgaggcagcagctgtagagctctaggtcagggaagggggaaggtatccagcggacgcctcctgcgacggtc

SEQ ID NO: 33522 - DNA, 201 bp, Homo sapiens
cgcctcttccgaaagattacggaagtcagccctcgcccccttcaggaagctctcccggaggggactcctcccaccgccgagttttcccgagaatgaggccscgcccactgacgcgctgtggttccaaaacgagaaagtactgaagggtaagaagcataggtagattattatatgaaatcctctgatttcagttttctgggc

SEQ ID NO: 33523 - DNA, 201 bp, Homo sapiens
ctaggtcagggaagggggaaggtatccagcggacgcctcctgcgacggtccggcccctagttgtcagctgcgctcagctcttaagatgctccggggatgckctgagctaaggatgcaggtgcagtcagactggtcctgatgagaggtaggctccgccttcttccgaatggtcctcggaagaagactccgcctcttccgaat

SEQ ID NO: 33524 - DNA, 201 bp, Homo sapiens
gtggatgaacataacctcaataaacccttcttggggccagatgtcctgagggccacctctaccctaaatcacaatcacaaatgtgtctaatattcttcaarattcttggacttccctggcccgtgacatggatctgagtgtgccaggtggcagtagcagttccttcaggcaatgaaaggcaggaccgggctggctgcaggg

SEQ ID NO: 33525 - DNA, 201 bp, Homo sapiens
ccccttttcctccctgcaatacacatacatgatctgttgcccagtctggagtgcagtttgtggtaatagctcactgcaacctcaaactcctgggcttcccrccttggccttccaaagtgctagtattacaggggtgagccactgtgcctggccatattttcttttatttttttattttttattttttattttttattttga

SEQ ID NO: 33526 - DNA, 201 bp, Homo sapiens
gcagtagctttttcctggtctatgtaatccagaccaggaaaaagccctttacagccagtgtggcatggtccagggcagctctagctgacgttcaccaaggrgagatcctactttgctatggtagggaggatttgggatagacatttgcagcctgcacttctagggaacctagtggatgagtgactagggagatgacagcca

SEQ ID NO: 33527 - DNA, 201 bp, Homo sapiens
gagcaagacttcgtctcaaaaaaaaaaaaggtattcctccaggatgaatatatccattgtaggcaaaaaaataggtgtgtgtatgtatgtatatatatatrtgtgtgtgtgtgtgtgtgtgtatgtgtatatatgtatatgtgtgtgtatatatgtatatatgtgtgtgtgtatatatatgtatttatgtatacatatatt

SEQ ID NO: 33528 - DNA, 201 bp, Homo sapiens
tggaagccatccgcccacctcagcctccttaagtgctggaattataggcgtgagccaccatgcctggccctcagccagttttgaattacagtctggttgcycttgccaaccagtatacttctgggctttttccttttgccagaaatcagaatgtaatcagtgaatataaactcatttttactattagccacatcaaatgaa

SEQ ID NO: 33529 - DNA, 201 bp, Homo sapiens
gtgttggatgaacaaataactaaacagaaataggccgggtgtggcggctcacgcctgttatcccagcactttgggaggctgaggcaggcagattacctgargtcaggagttcaaaaccagcctggccaacatggcgaaaccctgtctctgctaaaataaaatacaaaaattagccaggtgtggtgacacacacctgtaatc

SEQ ID NO: 33530 - DNA, 201 bp, Homo sapiens
aaattagccaggtgtggtgacacacacctgtaatcccagctactcaggaggctgaggcaggagaatcacttgaagccgggaggtggaggttatagtgagcwgagatcgtgccactgcactccagcctgggcaaaagaccgagaccccatctcaaaaaaaaaaaaaaagaaaaaaaaaagagaaagagaaatagattttttt

SEQ ID NO: 33531 - DNA, 201 bp, Homo sapiens
tgtctctccgcactttgatgattttcttcttgttgctgagggtctctgggtatatgctgatgcctttgagcatgtgaataaacttgtatggtgggttcttstgcttcttctctgcctgctggtggcagcatgaccagacaaagacggtcaccgagacacacaccaccagcacagaggccccgatgaggccggccaccaccg

SEQ ID NO: 33532 - DNA, 201 bp, Homo sapiens
ataaacccttcttggggccagatgtcctgagggccacctctaccctaaatcacaatcacaaatgtgtctaatattcttcaaaattcttggacttccctggcccgtgacatggatctgagtgtgccaggtggcagtagcagttccttcaggcaatgaaaggcaggaccgggctggctgcagggggacaggtgcctactacag

SEQ ID NO: 33533 - DNA, 201 bp, Homo sapiens
attagtataatgcctactgttttcccttctattagaggtatcctctcctatcctctccaaccaatccatggctttttcttccctccaaacctagatgaagsgtttatcttctctagaaagcctatgagcatcatgagcacaatactatgagcataatgtccagattacatgagaggcaggtataatttcatctgcactggt

SEQ ID NO: 33534 - DNA, 201 bp, Homo sapiens
atgaggttttataagagcaaaattttcttctgcagaggtggggagtgggagaaattctccagagaagcccaataaaaagaagccaatttcaggtaatcagmaaatacaattcagcacaaaacacaatttccatggattaaaatctgcaacttgatattggcagttaggctaatttcttcagtttgtattagacatgcaagt

SEQ ID NO: 33535 - DNA, 201 bp, Homo sapiens
gagtcctccagctttccagagaatcaggctgacatcactgtgcctatgtaatgtgaatcagtctttattttgcacttgtgtggtgcattaacaaattcaasatacaagatagcattacatattgtagattagcattacagcattatgcaatttcacacaattcatgttagctttttcagttttctttttttttcaaaattt

SEQ ID NO: 33536 - DNA, 201 bp, Homo sapiens
acacgggcagcatgcccatccccactcagcgccgctttgtgatgcccaagtctgtagccacaacaccacctgaatgccactccattctgcattgaaggcartttaatgtcattccctcaagctccctccctttctctttctacccaattcccattccaagtagctatgtcaatggctctttcttttgaaagagccattgaa

SEQ ID NO: 33537 - DNA, 201 bp, Homo sapiens
ggcatgaatattatttaggataccttgccaaatgtaaagaccccatttgttcaactgaagaatcttcctagccagggaaatctattggacgtagatactcrtcaggaagagaatgtctacagaaagaggagcagattaaaagtgaaagaggcaaggatcttgaagtgtggaggtctatctgggccacaggcaaggagtcgg

SEQ ID NO: 33538 - DNA, 201 bp, Homo sapiens
gcagcactctggtcttcacccgatgccgtttgtcaggaaggatggtcattttgatgtaggggtcagatccctgggtctggtcatccatcactggcagcccrtgggcctcctggattgtcaccaccagggcttttttcgggaagttatagtccactgagaaggtgagggatcctagcatgacatcctcctctggagatgatg

SEQ ID NO: 33539 - DNA, 201 bp, Homo sapiens
ttgggaaagggggggctctgttgttcgtatctttgatggccatcccatgtgttctttagtgattgcacaataaacacacactgactatatgtgagtctgcytgcctggatgaggggccaaggaaaccaagcaggaatagaacagaacaactttctcaggttaggtctgaagaaatcccatgataccaagaagtatattaaa

SEQ ID NO: 33540 - DNA, 201 bp, Homo sapiens
tatacacagagtctcactgtgtagcccaggctggtcttgaattcctggtctcaagtgatcctcccgcctcagcctcccaaaatgctgggattacaggcatragccaccatgcccagttgctatttcttatctgtgaccttggacaagttactcaacatctctgtacttcagtttcctcacctataaaatgtgggtgaaagg

SEQ ID NO: 33541 - DNA, 201 bp, Homo sapiens
ccttgcctcatccaccccacctttgtttcttggcttactgcagacctctagaccttgaggtcaaagagcagagatataagaggcaataaaaagaaaagatrggaatgatgaaaacatgaggttttataagagcaaaattttcttctgcagaggtggggagtgggagaaattctccagagaagcccaataaaaagaagccaa

SEQ ID NO: 33542 - DNA, 201 bp, Homo sapiens
aaacctgtgcgggacttgtcagagaaatgagaagcctgtctaagtgctctgggcacctagagctgggagattcaggggaggcttttttaattaattaattwatttatttatttatttattttttaattttattttttgagacagagtctctcgctctgtcacccaggctggagtgtagtggcgagacctcggctcactgca

SEQ ID NO: 33543 - DNA, 201 bp, Homo sapiens
ctgtgcgggacttgtcagagaaatgagaagcctgtctaagtgctctgggcacctagagctgggagattcaggggaggcttttttaattaattaattaattwatttatttatttattttttaattttattttttgagacagagtctctcgctctgtcacccaggctggagtgtagtggcgagacctcggctcactgcaacct

SEQ ID NO: 33544 - DNA, 201 bp, Homo sapiens
aggtggaaaatgagctaaagtcgaggaagaccaacatcagaaagctcagttaagaggccgctatagccgggagcagtggctcatgcctgtaatcctagcaytttgggaggccgaggcaggcggatcacgagttcaggagatcgagaccatcctggctaacacggtgaaacctggtatctactaaaaaaatacaaaaaaatt

SEQ ID NO: 33545 - DNA, 201 bp, Homo sapiens
ctgatataatgaaggatctacaaatggtaggccagcctgttccaagtaagctggacagcatcaggatgccaaccactaagtgaaatggtgaaagctattgraccttctctcaccaggaagttgcttcttagaggagacctcatctgccaggccctctgtcttactctgaccactgcttatccttgacatccaagagcttcc

SEQ ID NO: 33546 - DNA, 201 bp, Homo sapiens
tttgggaggccgaggcaggcggatcacgagttcaggagatcgagaccatcctggctaacacggtgaaacctggtatctactaaaaaaatacaaaaaaattmgccgggcgtggtgactggcgcctgtagtcccagcaactggggaggctgcggcaggagaatggcgtgaacccgggaggcggagcttgcagtgagccgagat

SEQ ID NO: 33547 - DNA, 201 bp, Homo sapiens
ataaagtgaaacctcttcaagggcaatcatatgccaggcatattatctcatttgattctctgtaaggaagacaatattatcagctccattttacaaatgasaaaatagaggcttagaggggtcgagtaactcacccgtgtcacacggctggcaagtggtaagctggagagtaaagtcgtgcagtccaattctggagcccaa

SEQ ID NO: 33548 - DNA, 201 bp, Homo sapiens
attacaaaaaatatttgtctttctccttcaataaagtgaaacctcttcaagggcaatcatatgccaggcatattatctcatttgattctctgtaaggaagrcaatattatcagctccattttacaaatgagaaaatagaggcttagaggggtcgagtaactcacccgtgtcacacggctggcaagtggtaagctggagagt

SEQ ID NO: 33549 - DNA, 201 bp, Homo sapiens
caagcatggtggcgggtgcctgtagtcccagctacttaggaggctgaggcaggagaatggcgtgaacccgggaggcagagcttgcagtgagccgagattgyagtcactgcactccagcttgggcaacagagcaagactccgtctcaggaaaaaaaaaaaaaaaagaaatagaaaaattagccgggtgtggtggcgggcgcc

SEQ ID NO: 33550 - DNA, 201 bp, Homo sapiens
atggaacatagtcctgcctacgggcactggttgggaaaatgggtttaggaagcctgggaggctggaaggctctagggtggggctgcacaggctctgggtawcctatctcgggccttctccagggcatgtgttgctcaggatcctagccctggcttatccctcctcaagggagttaataaagtggaaagaaatgtggctctt

SEQ ID NO: 33551 - DNA, 201 bp, Homo sapiens
atccgtctcagcctcccaaagtgctgggaatacaggtgtgagccaccatgcttggtccctcagccaatgtgtttttgtttgttttgtttgtttttcccctygagacagggtcttgctctgtcacccaggttggagtgcagtggcacgatctcagctcacggtaacccccacctcctgggttcaagcgattctggtgtctca

SEQ ID NO: 33552 - DNA, 201 bp, Homo sapiens
tggagtgcagtggcacgatctcagctcacggtaacccccacctcctgggttcaagcgattctggtgtctcagcctcctgagtagctgggattaccggcgtsaatcaccatgtctggggtttccgccacgttggccaggctggtcttgatctcctgagtggaagccatccgcccacctcagcctccttaagtgctggaatta

SEQ ID NO: 33553 - DNA, 201 bp, Homo sapiens
aagaattctgggtttatgtacttttaaaatatgttccaaaattttagctcccaggtatataaaatacaaggctgggtgcagtggctcacacctgtaatccyggcactttgggaggctgaggcaggtggatcatttgaggtcaggagttcaagaccagactgaccaacatggtgaaaccccgtctctactaaaaatataaaa

SEQ ID NO: 33554 - DNA, 201 bp, Homo sapiens
aaataaacctgtgcgggacttgtcagagaaatgagaagcctgtctaagtgctctgggcacctagagctgggagattcaggggaggcttttttaattaattwattaatttatttatttatttattttttaattttattttttgagacagagtctctcgctctgtcacccaggctggagtgtagtggcgagacctcggctcac

SEQ ID NO: 33555 - DNA, 201 bp, Homo sapiens
agtgttaacctcactgagagtcctccagctttccagagaatcaggctgacatcactgtgcctatgtaatgtgaatcagtctttattttgcacttgtgtggkgcattaacaaattcaacatacaagatagcattacatattgtagattagcattacagcattatgcaatttcacacaattcatgttagctttttcagttttc

SEQ ID NO: 33556 - DNA, 201 bp, Homo sapiens
atttcatgttgggaaagggggggctctgttgttcgtatctttgatggccatcccatgtgttctttagtgattgcacaataaacacacactgactatatgtsagtctgcttgcctggatgaggggccaaggaaaccaagcaggaatagaacagaacaactttctcaggttaggtctgaagaaatcccatgataccaagaagt

SEQ ID NO: 33557 - DNA, 201 bp, Homo sapiens
ctccagcctgggcgacagagtgagactccatctcaaaaaagcagacttcgttgttctgtagcaacgtgctacagaagaaatgattgggactggaactaggrctgtggcagaggagatggacatggaggtaaaatatgtctcaggaagaattgtcaggggtttttaggcttgggcagttaattggctgtgaagcgtagggaa

SEQ ID NO: 33558 - DNA, 201 bp, Homo sapiens
ggtcggatattggtgatctcagccatgtcgtaatcagaggctgttgctataacgtttttgcaatggtgagacagctctgggaaccctcggtcagtaccgasgcagcagctgtagagctctaggtcagggaagggggaaggtatccagcggacgcctcctgcgacggtccggcccctagttgtcagctgcgctcagctctta

SEQ ID NO: 33559 - DNA, 201 bp, Homo sapiens
ggcggagcccggtaacccctggattctactgtataaatcactgccctcgcccagatagacgctgatccctggctgtggagaggattctcccgagcccctgaaaaaaaaaaaaggtggagagactttgaaaacttttctctcgaaaagtctgaggaggcagaggacggcccggagtctcgtagcgcaccgccctggtcccac

SEQ ID NO: 33560 - DNA, 201 bp, Homo sapiens
gagccggcacccttctctcacattctgcttgggagtcgactcagaggcctcaaatctcattactagcactttgcccacccttttcttttgcttagatgctrcttaagaacgtgaggctgagaggcggacttggtcagatctgcctgcgtgacaagctcaggacaggacgcttctgcccttgcattactgttgtaaaagttt

SEQ ID NO: 33561 - DNA, 201 bp, Homo sapiens
cggcccggcgagtgtcggcggcgctctggggaggagaggctgggaaggggctgcgagaggtacggaggagacaagcagcccgggagggagaatgaaccggraggttcctgtactccccccgccaccccagatcctcgtgctactcgcaactgcggtctgaggggcagtggctttcccagagtgcacagagaaatgaaccag

SEQ ID NO: 33562 - DNA, 201 bp, Homo sapiens
aaccaagataacggtcctctaagactccagagtagatcctaattggatttgaagacttatttcacttaaaggggaagaggtatattgtgtctacccagcamaacaaaacgggggacttggcattcccccccttctcccgcctccacccacactaatttatgcattctttaaagccaaaggaatcaaagtgaaatttcacac

SEQ ID NO: 33563 - DNA, 201 bp, Homo sapiens
atttgaagacttatttcacttaaaggggaagaggtatattgtgtctacccagcacaacaaaacgggggacttggcattcccccccttctcccgcctccacmcacactaatttatgcattctttaaagccaaaggaatcaaagtgaaatttcacacctagtctgtatcaagcatgtgctaggttaatttaaccttactgctc

SEQ ID NO: 33564 - DNA, 201 bp, Homo sapiens
ggaggttcctgtactccccccgccaccccagatcctcgtgctactcgcaactgcggtctgaggggcagtggctttcccagagtgcacagagaaatgaaccmgcgccggttttggtgttgggcgaggggtttccctcagctgagcacaaagtcaggctgtgtgtcccagattctggccaatggagaggtcgttgagggggtg

SEQ ID NO: 33565 - DNA, 201 bp, Homo sapiens
ggggagattctcggccaggagctgcggagcaactgcagctgcccagcaggagccggcacccttctctcacattctgcttgggagtcgactcagaggcctcraatctcattactagcactttgcccacccttttcttttgcttagatgctacttaagaacgtgaggctgagaggcggacttggtcagatctgcctgcgtgac

SEQ ID NO: 33566 - DNA, 201 bp, Homo sapiens; identical to SEQ ID NO: 32365

SEQ ID NO: 33567 - DNA, 201 bp, Homo sapiens; identical to SEQ ID NO: 32366

SEQ ID NO: 33568 - DNA, 201 bp, Homo sapiens; identical to SEQ ID NO: 32367

SEQ ID NO: 33569 - DNA, 201 bp, Homo sapiens; identical to SEQ ID NO: 32368

SEQ ID NO: 33570 - DNA, 201 bp, Homo sapiens; identical to SEQ ID NO: 32369

SEQ ID NO: 33571 - DNA, 201 bp, Homo sapiens; identical to SEQ ID NO: 32370

SEQ ID NO: 33572 - DNA, 201 bp, Homo sapiens; identical to SEQ ID NO: 32371

SEQ ID NO: 33573 - DNA, 201 bp, Homo sapiens; identical to SEQ ID NO: 32372

SEQ ID NO: 33574 - DNA, 201 bp, Homo sapiens; identical to SEQ ID NO: 32373

SEQ ID NO: 33575 - DNA, 201 bp, Homo sapiens; identical to SEQ ID NO: 32374

SEQ ID NO: 33576 - DNA, 201 bp, Homo sapiens; identical to SEQ ID NO: 32375

SEQ ID NO: 33577 - DNA, 201 bp, Homo sapiens; identical to SEQ ID NO: 32376

SEQ ID NO: 33578 - DNA, 201 bp, Homo sapiens; identical to SEQ ID NO: 32377

SEQ ID NO: 33579 - DNA, 201 bp, Homo sapiens; identical to SEQ ID NO: 32378

SEQ ID NO: 33580 - DNA, 201 bp, Homo sapiens; identical to SEQ ID NO: 32379

SEQ ID NO: 33581 - DNA, 201 bp, Homo sapiens; identical to SEQ ID NO: 32380

SEQ ID NO: 33582 - DNA, 201 bp, Homo sapiens; identical to SEQ ID NO: 32381

SEQ ID NO: 33583 - DNA, 201 bp, Homo sapiens; identical to SEQ ID NO: 32382

SEQ ID NO: 33584 - DNA, 201 bp, Homo sapiens; identical to SEQ ID NO: 32383

SEQ ID NO: 33585 - DNA, 201 bp, Homo sapiens; identical to SEQ ID NO: 32384

SEQ ID NO: 33586 - DNA, 201 bp, Homo sapiens; identical to SEQ ID NO: 32385

SEQ ID NO: 33587 - DNA, 201 bp, Homo sapiens; identical to SEQ ID NO: 32386

SEQ ID NO: 33588 - DNA, 201 bp, Homo sapiens; identical to SEQ ID NO: 32387

SEQ ID NO: 33589 - DNA, 201 bp, Homo sapiens; identical to SEQ ID NO: 32388

SEQ ID NO: 33590 - DNA, 201 bp, Homo sapiens; identical to SEQ ID NO: 32389

SEQ ID NO: 33591 - DNA, 201 bp, Homo sapiens; identical to SEQ ID NO: 32390

SEQ ID NO: 33592 - DNA, 201 bp, Homo sapiens; identical to SEQ ID NO: 32391

SEQ ID NO: 33593 - DNA, 201 bp, Homo sapiens
cagagttcatgcagaaaagctctgtggcaggtaagctgaacagctctcctctttggacctcacccaaaagtctctcctccaaggcagggcagttcagatgytctgatctcgtgtgcttccatgggctcctccccctggcaacacacggacgtcaggggagatgtggttctcaagtttgcacttttcctgaccactggggcc

SEQ ID NO: 33594 - DNA, 201 bp, Homo sapiens; identical to SEQ ID NO: 32392

SEQ ID NO: 33595 - DNA, 201 bp, Homo sapiens; identical to SEQ ID NO: 32393

SEQ ID NO: 33596 - DNA, 201 bp, Homo sapiens; identical to SEQ ID NO: 32394

SEQ ID NO: 33597 - DNA, 201 bp, Homo sapiens; identical to SEQ ID NO: 32395

SEQ ID NO: 33598 - DNA, 201 bp, Homo sapiens; identical to SEQ ID NO: 32396

SEQ ID NO: 33599 - DNA, 201 bp, Homo sapiens
acaagtggtgcaactcaccctgatggtatctcaaaataaaatctcaggtactatgaaataccgaagtcaatgaagacatttgagtaagggttttgcgctgkgatcgtggcttatggcgcagagacttccccatgaccaatcattccctgtagctgtctaacagtggaatccatccaggaggtgatggacaggtgttcctag

SEQ ID NO: 33600 - DNA, 201 bp, Homo sapiens
ctgttggctgggtgcccaccttctgaacccttcccagattgccagggggcaattagaattgagtacaagtggtgcaactcaccctgatggtatctcaaaawaaaatctcaggtactatgaaataccgaagtcaatgaagacatttgagtaagggttttgcgctgggatcgtggcttatggcgcagagacttccccatgacc

SEQ ID NO: 33601 - DNA, 201 bp, Homo sapiens
ttttaacttgaaaaccacagaaaacaaaacagaatttctattatagtaggtactttccttgctgcagcaggaattattcagtctgaactgggcatttcaaygcgtggtatttttttcctttcatttttgcaagtaaaaaaatcatatttttatgctgttcttcagtaacacacagtctctttgaataaactatttcttttg

SEQ ID NO: 33602 - DNA, 201 bp, Homo sapiens
atgctctgatctcgtgtgcttccatgggctcctccccctggcaacacacggacgtcaggggagatgtggttctcaagtttgcacttttcctgaccactggrgccttttccagtcaatgcttctgtggagtaaatacagttctgccttaagaacttaggggaggtgggtaaaggggagctttcaaagtggtttttctccgat

SEQ ID NO: 33603 - DNA, 201 bp, Homo sapiens; identical to SEQ ID NO: 32397

SEQ ID NO: 33604 - DNA, 201 bp, Homo sapiens
ttttgcaagtaaaaaaatcatatttttatgctgttcttcagtaacacacagtctctttgaataaactatttcttttgcatatttgacacttgcatatcttktgagtctacactagtgatgtaaagaaagcgtgttcctcctccaaccctaaaacaatgctctgagttcatgctgttggctgggtgcccaccttctgaaccc

SEQ ID NO: 33605 - DNA, 201 bp, Homo sapiens; identical to SEQ ID NO: 32398

SEQ ID NO: 33606 - DNA, 201 bp, Homo sapiens; identical to SEQ ID NO: 32399

SEQ ID NO: 33607 - DNA, 201 bp, Homo sapiens; identical to SEQ ID NO: 32400

SEQ ID NO: 33608 - DNA, 201 bp, Homo sapiens; identical to SEQ ID NO: 32401

SEQ ID NO: 33609 - DNA, 201 bp, Homo sapiens; identical to SEQ ID NO: 32402

SEQ ID NO: 33610 - DNA, 201 bp, Homo sapiens; identical to SEQ ID NO: 32403

SEQ ID NO: 33611 - DNA, 201 bp, Homo sapiens; identical to SEQ ID NO: 32404

SEQ ID NO: 33612 - DNA, 201 bp, Homo sapiens; identical to SEQ ID NO: 32405

SEQ ID NO: 33613 - DNA, 201 bp, Homo sapiens; identical to SEQ ID NO: 32406

SEQ ID NO: 33614 - DNA, 201 bp, Homo sapiens; identical to SEQ ID NO: 32407

SEQ ID NO: 33615 - DNA, 201 bp, Homo sapiens; identical to SEQ ID NO: 32408

SEQ ID NO: 33616 - DNA, 201 bp, Homo sapiens; identical to SEQ ID NO: 32409

SEQ ID NO: 33617 - DNA, 201 bp, Homo sapiens; identical to SEQ ID NO: 32410

SEQ ID NO: 33618 - DNA, 201 bp, Homo sapiens; identical to SEQ ID NO: 32411

SEQ ID NO: 33619 - DNA, 201 bp, Homo sapiens; identical to SEQ ID NO: 32412

SEQ ID NO: 33620 - DNA, 201 bp, Homo sapiens; identical to SEQ ID NO: 32413

SEQ ID NO: 33621 - DNA, 201 bp, Homo sapiens; identical to SEQ ID NO: 32414

SEQ ID NO: 33622 - DNA, 201 bp, Homo sapiens; identical to SEQ ID NO: 32415

SEQ ID NO: 33623 - DNA, 201 bp, Homo sapiens; identical to SEQ ID NO: 32416

SEQ ID NO: 33624 - DNA, 201 bp, Homo sapiens; identical to SEQ ID NO: 32417

SEQ ID NO: 33625 - DNA, 201 bp, Homo sapiens; identical to SEQ ID NO: 32418

SEQ ID NO: 33626 - DNA, 201 bp, Homo sapiens
gtgctggctggcatcagggctggggttggcctccacaaacctaccaccactggcacccagagctccccgccagcccacttctggggctgtgctgcccccavtcttgctggggagtgatgtcaaagggctgtgggagaatctggtggcctcagggaagtctgtggcacagctaatgaaactatcaatgcttgacatacttcg

SEQ ID NO: 33627 - DNA, 201 bp, Homo sapiens; identical to SEQ ID NO: 32419

SEQ ID NO: 33628 - DNA, 201 bp, Homo sapiens; identical to SEQ ID NO: 32420

SEQ ID NO: 33629 - DNA, 201 bp, Homo sapiens; identical to SEQ ID NO: 32421

SEQ ID NO: 33630 - DNA, 201 bp, Homo sapiens; identical to SEQ ID NO: 32422

SEQ ID NO: 33631 - DNA, 201 bp, Homo sapiens; identical to SEQ ID NO: 32423

SEQ ID NO: 33632 - DNA, 201 bp, Homo sapiens; identical to SEQ ID NO: 32426

SEQ ID NO: 33633 - DNA, 201 bp, Homo sapiens; identical to SEQ ID NO: 32425

SEQ ID NO: 33634 - DNA, 201 bp, Homo sapiens; identical to SEQ ID NO: 32424

SEQ ID NO: 33635 - DNA, 201 bp, Homo sapiens; identical to SEQ ID NO: 32427

SEQ ID NO: 33636 - DNA, 201 bp, Homo sapiens; identical to SEQ ID NO: 32429

SEQ ID NO: 33637 - DNA, 201 bp, Homo sapiens; identical to SEQ ID NO: 32428

SEQ ID NO: 33638 - DNA, 201 bp, Homo sapiens; identical to SEQ ID NO: 32430

SEQ ID NO: 33639 - DNA, 201 bp, Homo sapiens; identical to SEQ ID NO: 32431

SEQ ID NO: 33640 - DNA, 201 bp, Homo sapiens; identical to SEQ ID NO: 32432

SEQ ID NO: 33641 - DNA, 201 bp, Homo sapiens; identical to SEQ ID NO: 32433

SEQ ID NO: 33642 - DNA, 201 bp, Homo sapiens; identical to SEQ ID NO: 32434

SEQ ID NO: 33643 - DNA, 201 bp, Homo sapiens; identical to SEQ ID NO: 32435

SEQ ID NO: 33644 - DNA, 201 bp, Homo sapiens; identical to SEQ ID NO: 32436

SEQ ID NO: 33645 - DNA, 201 bp, Homo sapiens; identical to SEQ ID NO: 32437

SEQ ID NO: 33646 - DNA, 201 bp, Homo sapiens; identical to SEQ ID NO: 32438

SEQ ID NO: 33647 - DNA, 201 bp, Homo sapiens; identical to SEQ ID NO: 32439

SEQ ID NO: 33648 - DNA, 201 bp, Homo sapiens; identical to SEQ ID NO: 32440

SEQ ID NO: 33649 - DNA, 201 bp, Homo sapiens; identical to SEQ ID NO: 32441

SEQ ID NO: 33650 - DNA, 201 bp, Homo sapiens; identical to SEQ ID NO: 32442

SEQ ID NO: 33651 - DNA, 201 bp, Homo sapiens; identical to SEQ ID NO: 32443

SEQ ID NO: 33652 - DNA, 201 bp, Homo sapiens; identical to SEQ ID NO: 32444

SEQ ID NO: 33653 - DNA, 201 bp, Homo sapiens; identical to SEQ ID NO: 32445

SEQ ID NO: 33654 - DNA, 201 bp, Homo sapiens; identical to SEQ ID NO: 32446

SEQ ID NO: 33655 - DNA, 201 bp, Homo sapiens; identical to SEQ ID NO: 32447

SEQ ID NO: 33656 - DNA, 201 bp, Homo sapiens; identical to SEQ ID NO: 32448

SEQ ID NO: 33657 - DNA, 201 bp, Homo sapiens; identical to SEQ ID NO: 32450

SEQ ID NO: 33658 - DNA, 201 bp, Homo sapiens; identical to SEQ ID NO: 32449

SEQ ID NO: 33659 - DNA, 201 bp, Homo sapiens; identical to SEQ ID NO: 32451

SEQ ID NO: 33660 - DNA, 201 bp, Homo sapiens; identical to SEQ ID NO: 32452

SEQ ID NO: 33661 - DNA, 201 bp, Homo sapiens
gggtgcccaccttctgaacccttcccagattgccagggggcaattagaattgagtacaagtggtgcaactcaccctgatggtatctcaaaataaaatctcrggtactatgaaataccgaagtcaatgaagacatttgagtaagggttttgcgctgggatcgtggcttatggcgcagagacttccccatgaccaatcattcc

SEQ ID NO: 33662 - DNA, 201 bp, Homo sapiens; identical to SEQ ID NO: 32453

SEQ ID NO: 33663 - DNA, 201 bp, Homo sapiens; identical to SEQ ID NO: 32454

SEQ ID NO: 33664 - DNA, 201 bp, Homo sapiens; identical to SEQ ID NO: 32455

SEQ ID NO: 33665 - DNA, 201 bp, Homo sapiens; identical to SEQ ID NO: 32456

SEQ ID NO: 33666 - DNA, 201 bp, Homo sapiens; identical to SEQ ID NO: 32457

SEQ ID NO: 33667 - DNA, 201 bp, Homo sapiens; identical to SEQ ID NO: 6953

SEQ ID NO: 33668 - DNA, 201 bp, Homo sapiens
ccaatttaattttttcgttttctttgacacagcaattctaaaagctatctaggcaaatctgtcttaatattaaccacaacttttgtaatttacaaaaaaarggaattacaatgagagatgaatactttggtaaattatggaacatctgctgaactgtaagagtatatatcaatttaaaagaatatgctacaattgttttat

SEQ ID NO: 33669 - DNA, 201 bp, Homo sapiens; identical to SEQ ID NO: 6954

SEQ ID NO: 33670 - DNA, 201 bp, Homo sapiens; identical to SEQ ID NO: 6955

SEQ ID NO: 33671 - DNA, 201 bp, Homo sapiens
atatacttccttaagttcaactgacttcttcaggccaccataaatctatcaaaaaatcaaagggaaaatatcacctgggtcttgatcattttcttctgtgmtcagaaaatagtggataacatggactatacgtctttgtctcttctgcatttgccatgaagtttttgaagttttcctagtcagaaatattagtgtccactt

SEQ ID NO: 33672 - DNA, 201 bp, Homo sapiens
caaaaaatcaaagggaaaatatcacctgggtcttgatcattttcttctgtgctcagaaaatagtggataacatggactatacgtctttgtctcttctgcayttgccatgaagtttttgaagttttcctagtcagaaatattagtgtccacttaaagttgtccccagaaattatgatatccaaggccagcaacctccttctt

SEQ ID NO: 33673 - DNA, 201 bp, Homo sapiens
gcctctgcctaggaaagccaggtattgtccaaggtttcttcccaagtgatagcctgagatatggcctcgtgggaagggaaagacctgaccgtcccccagcrtgacaccgggggatacccgtaaagggtctgtgctgaggaggattagaaaaagaggaaggcctttttgcagttgagataagaggaaggcatctgtctcctg

SEQ ID NO: 33674 - DNA, 201 bp, Homo sapiens
gaacccccacctctactcccaaaagcaatgtaagttaatttctccctagaacacaattatcccagtatatacttccttaagttcaactgacttcttcaggycaccataaatctatcaaaaaatcaaagggaaaatatcacctgggtcttgatcattttcttctgtgctcagaaaatagtggataacatggactatacgtct

SEQ ID NO: 33675 - DNA, 201 bp, Homo sapiens
aaaatatcacctgggtcttgatcattttcttctgtgctcagaaaatagtggataacatggactatacgtctttgtctcttctgcatttgccatgaagtttytgaagttttcctagtcagaaatattagtgtccacttaaagttgtccccagaaattatgatatccaaggccagcaacctccttcttcttccttcattgctt

SEQ ID NO: 33676 - DNA, 201 bp, Homo sapiens
agatgccttgctgtgggaggaaactacaaaaacaaactttattccatcaactcaaattgtttttttatatttcaaatctgagagcactggttcaatttctrtttgtcttctccatgatatgcaattgtcctttgctgtatgaccaaaatgagttaaatgaaaatagttctgtatatttagtagttaaatagccatttgctt

SEQ ID NO: 33677 - DNA, 201 bp, Homo sapiens
tctcagcaaggagtaatgctgcttttcacacagaaagggcttctactgtgcctgaccttaagacaggaaaagtaggggagctaaggaagctacctacaccrccctcacccccagtagccaggctcaggaaggaagaggcacagcggtgtgaatggatggagaagaggaggccggtaggctgagcccctggctcctggaacg

SEQ ID NO: 33678 - DNA, 201 bp, Homo sapiens
tcacacactggggcctgttgtggggtggggggagtggggagggatagcattaggagatatacctaatgttaaatgacgagataatgggtgcagcacaccarcatggcacatgtatacatatgtaacaaacctgcacgttgtgcacatgtaccctaaaacttaaagtataattaaaaaaaaagaaaatgtgcttaagaaggc

SEQ ID NO: 33679 - DNA, 201 bp, Homo sapiens
cgccctcacccccagtagccaggctcaggaaggaagaggcacagcggtgtgaatggatggagaagaggaggccggtaggctgagcccctggctcctggaaygaacacacagccatggcaggtaggaaatctgggctccaacagtggccctgggctggagcagtgaaaggatgaaggtgaggtgtggttggggatctgcaaa

SEQ ID NO: 33680 - DNA, 201 bp, Homo sapiens
gtaggggagctaaggaagctacctacaccgccctcacccccagtagccaggctcaggaaggaagaggcacagcggtgtgaatggatggagaagaggaggcyggtaggctgagcccctggctcctggaacgaacacacagccatggcaggtaggaaatctgggctccaacagtggccctgggctggagcagtgaaaggatga

SEQ ID NO: 33681 - DNA, 201 bp, Homo sapiens
ggtgaaatatcaatgggacacacataggataccactctatcactctgcccttgatacacctccctagctgatcattgccctccctgctgagtccagatgtrgcttcacaatgtgtctcaacagagctttctgggcagccaccaccaatcagttggagttggcccctgaaatgaaatctatcttattttttatcccgtcttt

SEQ ID NO: 33682 - DNA, 201 bp, Homo sapiens
ggttggggatctgcaaatctagcctctctcactactaaacaaggtttacagttcccagtggtagaaagaccacatctcaaggaggaatgaaaacacaggamctgagcatttgtgcttggaattaataagcaaatcccatcaaacccttgacatcatggattttggcctcagaaggcagaaaccttgaaagttccagtgaca

SEQ ID NO: 33683 - DNA, 201 bp, Homo sapiens
cccatcaaacccttgacatcatggattttggcctcagaaggcagaaaccttgaaagttccagtgacaacccctgtgcccctcatcttcaggctcgtctctstggtggattgccacctgcacagcgccctggcatttccatgcacaaaataattggctgcagaaagttgtcagatgccttgctgtgggaggaaactacaaaa

SEQ ID NO: 33684 - DNA, 201 bp, Homo sapiens; identical to SEQ ID NO: 6959

SEQ ID NO: 33685 - DNA, 201 bp, Homo sapiens; identical to SEQ ID NO: 6960

SEQ ID NO: 33686 - DNA, 201 bp, Homo sapiens
gacgaaatgaaggcgcatgcgcagcccccgtcccgcgacccgacgcacgtctcccgtccccaaaggagaggcggggccgcagttcgcgcgtgcgcaggcgyactaagctgtgaggcgctccggacgaatgaactccctcaagaaggtgcacagagtggtggcgagtcctttattttaatgccaaacttcaacttcctaagt

SEQ ID NO: 33687 - DNA, 201 bp, Homo sapiens; identical to SEQ ID NO: 6961

SEQ ID NO: 33688 - DNA, 201 bp, Homo sapiens
tgttaatattataatctttggtaactgtagcaaataatcgttgaattattttgtaatttttggtgtgcaacatcctttgcaaagtcctaaatttcatacaratgtgaaagctggttgcgctactttattgatcctcacaattaaaatttctaattcatccagaagaacatatgtgaatctgtatgaaatacatatctaaga

SEQ ID NO: 33689 - DNA, 201 bp, Homo sapiens; identical to SEQ ID NO: 6962

SEQ ID NO: 33690 - DNA, 201 bp, Homo sapiens
tttcctctctcagtctcccggcgcgctgcgtctaacaggctcggggaacactgcagcgaaaatctacccctacacagttcccgctggcagcacgcaacagygggctgacgaaatgaaggcgcatgcgcagcccccgtcccgcgacccgacgcacgtctcccgtccccaaaggagaggcggggccgcagttcgcgcgtgcgc

SEQ ID NO: 33691 - DNA, 201 bp, Homo sapiens
tttcataagatgacaaaataatagaataaaaacattaaaaatgattgcataaactttggctgattatataaaatttagtgtcatcaaataatttatttttwtttttagatacatgtttgcctactccaaactgaaagctgagaagaactggcattcttagattttttagggtgatagctgagggagcacctcatcacaccc

SEQ ID NO: 33692 - DNA, 201 bp, Homo sapiens
tcagtctcccggcgcgctgcgtctaacaggctcggggaacactgcagcgaaaatctacccctacacagttcccgctggcagcacgcaacagcgggctgackaaatgaaggcgcatgcgcagcccccgtcccgcgacccgacgcacgtctcccgtccccaaaggagaggcggggccgcagttcgcgcgtgcgcaggcgcact

SEQ ID NO: 33693 - DNA, 201 bp, Homo sapiens; identical to SEQ ID NO: 6964

SEQ ID NO: 33694 - DNA, 201 bp, Homo sapiens; identical to SEQ ID NO: 6963

SEQ ID NO: 33695 - DNA, 201 bp, Homo sapiens; identical to SEQ ID NO: 6966

SEQ ID NO: 33696 - DNA, 201 bp, Homo sapiens; identical to SEQ ID NO: 6965

SEQ ID NO: 33697 - DNA, 201 bp, Homo sapiens
ccattcttaattatccctgggtaagattgttttacctgaagaaatttggaccggttttccaggagcagtttgttgtcggtcttcactgcttgttgaaacakgtagtcgcagaactgctccctcacaaatcctgggctggccaccaggatgcactttacaacatcaaagtgtatgtggcgctggatagcctggaccacctgt

SEQ ID NO: 33698 - DNA, 201 bp, Homo sapiens; identical to SEQ ID NO: 6967

SEQ ID NO: 33699 - DNA, 201 bp, Homo sapiens
cgcccgcgacccccgccattcgccgccccctacctcgctcaagcagggcgaagttgcgttcggagagcccgggatctgtacggctcgcttcgcatcttgcygctgcccccgactgactgcgtagtgctctcgcaaacttactcgagtcggggtcccctccctccgcagcggagcactccaatggccagtcccgctcgccgc

SEQ ID NO: 33700 - DNA, 201 bp, Homo sapiens; identical to SEQ ID NO: 33560

SEQ ID NO: 33701 - DNA, 201 bp, Homo sapiens
ttaatgctgttctccttgtccgcgctgatattcagctttcccgtgtagttgtaatgccggacgatgatatcatagttgacgtagtcagagaccgagctgcsgtgggccttgaccagcgggacgctggtgggccccatggtgccaaccctgtgtccccaggaagccggggtggcgctactccggacgaacgctagagggcga

SEQ ID NO: 33702 - DNA, 201 bp, Homo sapiens
gctgttctccttgtccgcgctgatattcagctttcccgtgtagttgtaatgccggacgatgatatcatagttgacgtagtcagagaccgagctgcggtggkccttgaccagcgggacgctggtgggccccatggtgccaaccctgtgtccccaggaagccggggtggcgctactccggacgaacgctagagggcgaggcga

SEQ ID NO: 33703 - DNA, 201 bp, Homo sapiens
tagtcagagaccgagctgcggtgggccttgaccagcgggacgctggtgggccccatggtgccaaccctgtgtccccaggaagccggggtggcgctactccrgacgaacgctagagggcgaggcgagagagccttcactggcttcaggggtggttcgatgagtgatccaggctttttgtgtagcttttccttggctggagag

SEQ ID NO: 33704 - DNA, 201 bp, Homo sapiens; identical to SEQ ID NO: 33561

SEQ ID NO: 33705 - DNA, 201 bp, Homo sapiens
tagttgtaatgccggacgatgatatcatagttgacgtagtcagagaccgagctgcggtgggccttgaccagcgggacgctggtgggccccatggtgccaamcctgtgtccccaggaagccggggtggcgctactccggacgaacgctagagggcgaggcgagagagccttcactggcttcaggggtggttcgatgagtgat

SEQ ID NO: 33706 - DNA, 201 bp, Homo sapiens
taaaatgacttctgctgaaacaaatacattcaaaaatcaagaaaagtacttttaacacaacaaaatacaaccatgttgttgcttgaaatgaatcacacaasattctgaaataaacatcaacaaaagtgccaaagacagatgtcatatttgttagactcatttgctaagaaatctcccttggtttgcaaaagttaatccatt

SEQ ID NO: 33707 - DNA, 201 bp, Homo sapiens
tcaaaaatcaagaaaagtacttttaacacaacaaaatacaaccatgttgttgcttgaaatgaatcacacaacattctgaaataaacatcaacaaaagtgcsaaagacagatgtcatatttgttagactcatttgctaagaaatctcccttggtttgcaaaagttaatccattcggttttcactttgttttgcttgtctgtt

SEQ ID NO: 33708 - DNA, 201 bp, Homo sapiens
ttttctgccatgttgaaggagtattaattaacttgaagaaggatgcttatattataaactttctgaattcttgcatgtctgacattttaaatattctattmtttacttgaataatattttgactaggtatcaagttaaaagttgtaagtcatttcccctgagaattttgaaagcattactcttttgtcttttaatttctag

SEQ ID NO: 33709 - DNA, 201 bp, Homo sapiens
gcagggcgaagttgcgttcggagagcccgggatctgtacggctcgcttcgcatcttgctgctgcccccgactgactgcgtagtgctctcgcaaacttactsgagtcggggtcccctccctccgcagcggagcactccaatggccagtcccgctcgccgcggccagttccctgcctgctacgcgaagtcacccagcgccgcg

SEQ ID NO: 33710 - DNA, 201 bp, Homo sapiens; identical to SEQ ID NO: 33564

SEQ ID NO: 33711 - DNA, 201 bp, Homo sapiens; identical to SEQ ID NO: 33565

SEQ ID NO: 33712 - DNA, 201 bp, Homo sapiens
tgtctatgaacagccatggcactccagcttgggcaacatacagagaccccatctctacaacacacacacacacacacacacacacacacacacacacacactagctgggcgtggtggtagtgtgtgcctgtggtcccagctactcaggaggctgaggcaagaggatcacttgagctcaggaggtcaaggctgcagtgagcc

SEQ ID NO: 33713 - DNA, 201 bp, Homo sapiens
gcccggtctccataacccacactccagtcctcccacgggctggctggcaagcggccctggtgggtctgcgggggcaggggcagccttcctggtttatctcyaccggcgcgatctgctcgtccgcctcggctccagaagctggggctcagggtccggcgaggcaggaagcctgaggccacagcccagagcagcctgagtgca

SEQ ID NO: 33714 - DNA, 201 bp, Homo sapiens
atgtctatgaacagccatggcactccagcttgggcaacatacagagaccccatctctacaacacacacacacacacacacacacacacacacacacacacactagctgggcgtggtggtagtgtgtgcctgtggtcccagctactcaggaggctgaggcaagaggatcacttgagctcaggaggtcaaggctgcagtgagc

SEQ ID NO: 33715 - DNA, 201 bp, Homo sapiens
cagcgtctacgacgagagcgggagcaccggaggtggtgatggtgagtggtcctggctttggggtgcagagatggggttacatcagagatggagctgggggyccggagctggggagggggaggccgggaagttgcgggcttcagcccagcccactctgtatcccgtctctgaccccatagggctgggctattcccttgagtg

SEQ ID NO: 33716 - DNA, 201 bp, Homo sapiens; identical to SEQ ID NO: 6979

SEQ ID NO: 33717 - DNA, 201 bp, Homo sapiens
aggcgccacactggatatagccacgtggggcagcccggtctccataacccacactccagtcctcccacgggctggctggcaagcggccctggtgggtctgygggggcaggggcagccttcctggtttatctccaccggcgcgatctgctcgtccgcctcggctccagaagctggggctcagggtccggcgaggcaggaagc

SEQ ID NO: 33718 - DNA, 201 bp, Homo sapiens
caagagttcaagaccagcctggccaacatggtgaaaccccacctctactaaaaatacaaaaaaaattagccgggcatggtggcgggcccctgtaatcccarcttctggggaggctgagacaggagaatcgcttgaacccaggaggcggagattgcagtgagcccagattaaaaaaagaataaactatggatacacgaaaca

SEQ ID NO: 33719 - DNA, 201 bp, Homo sapiens
gggctattcccttgagtgtcatgtccagctgtttcccaccagggcagaccccaggctctgagcacctccctccctgctgcttctcgtcacctgccgaggcrggggctgactgaggtcccctctctctcccagacagcacgccctcaatcctgcctgccccccgcggctacccaggccaagtctgtgccaatgacagtgaca

SEQ ID NO: 33720 - DNA, 201 bp, Homo sapiens
ctgagtcactcccactgccagtggggggtcggggcggggcggaggagtcggggcaggtcgtcgggggaggttggtaggggagggaggtggggagatattgmgcctatgtctcttatctctggggtgggcccagctgttacctgtcctccgcctccccttcaggctcagggtctgagtcctccacctcaaggccggctccat

SEQ ID NO: 33721 - DNA, 201 bp, Homo sapiens
gacccgtatgcgcgcgcgcgcgcgcacgcacacacacacacacacacacacacgcgcgcgtgcgcccgcgcacagctgttcgctggtgggtgttgcgtggrccagggtggagggaggatgaatgtcccactttgtccccaggaactctgagcctctgaccctgagtcactcccactgccagtggggggtcggggcggggcg

SEQ ID NO: 33722 - DNA, 201 bp, Homo sapiens
tgtcaccagggataaggtgggacaatggggggtgggggtggacagtgtgtgctggggggttcgggtgctgcagacctggaactcccttctgccaggatgtyggcagccggttgtaagccttgcacgggacagaccacaaggggccatgccagtggctgtggaggacacagctggtgtgtggggaaggggagaagcctcagc

SEQ ID NO: 33723 - DNA, 201 bp, Homo sapiens; identical to SEQ ID NO: 6974

SEQ ID NO: 33724 - DNA, 201 bp, Homo sapiens
tggcccagagcagcagcgatggtgtccccgaggctaggcggggggtagggtcctcaccgagggcgcagcagctgggaggcgcgggctccaggggcgcggcytggcggcaggcggcctcccgcaggcggcaggcgctggcgtagaccaccccgtcggagccgcacaccgggttcccctgggcgccgcagtcgtggtcgcagc

SEQ ID NO: 33725 - DNA, 201 bp, Homo sapiens; identical to SEQ ID NO: 6976

SEQ ID NO: 33726 - DNA, 201 bp, Homo sapiens
gcacctgggtccctgggaggcgccacactggatatagccacgtggggcagcccggtctccataacccacactccagtcctcccacgggctggctggcaagyggccctggtgggtctgcgggggcaggggcagccttcctggtttatctccaccggcgcgatctgctcgtccgcctcggctccagaagctggggctcagggt

SEQ ID NO: 33727 - DNA, 201 bp, Homo sapiens
ggacttcgggatgggaccccacacccctttcctgaacccaactccacggggctcaggccagctgccacctcctcatttagatggcagaaccccaactggawgggggacacatggcccaggcctggcactgtacaactctgcctcctttccccttccagtggaccacagtgatgggctctgggtgtccatgtgcggtaagag

SEQ ID NO: 33728 - DNA, 201 bp, Homo sapiens
taaaccctcctccccaccactctgaaaggctgggctgtagacgaagacagggctcagaagccctggcctgtgggcccccaccacccggccactatgtctcygaggggccggagtctggccccatctgtggaacgggctggcgctctgggtgctgctttccaggttcccgctgctcacaggaggccgaggcccggctgtgac

SEQ ID NO: 33729 - DNA, 201 bp, Homo sapiens
catgtctatgaacagccatggcactccagcttgggcaacatacagagaccccatctctacaacacacacacacacacacacacacacacacacacacacacactagctgggcgtggtggtagtgtgtgcctgtggtcccagctactcaggaggctgaggcaagaggatcacttgagctcaggaggtcaaggctgcagtgag

SEQ ID NO: 33730 - DNA, 201 bp, Homo sapiens
tgtcaggtgcccgggacacacacatgcacacacacacacatgcacacacaaagttcatgtgcaccccagaacatgtgagtaagatcagtaacgtgtattcktgtcaatatcctggagtgatcatttaccagagttttctgagatgttaaccacaggcacaagctgggtgtgtgggtatgaatggtccccaggaccaaactg

SEQ ID NO: 33731 - DNA, 201 bp, Homo sapiens
atggggggtgggggtggacagtgtgtgctggggggttcgggtgctgcagacctggaactcccttctgccaggatgttggcagccggttgtaagccttgcaygggacagaccacaaggggccatgccagtggctgtggaggacacagctggtgtgtggggaaggggagaagcctcagcacctggtgcacaaacacacacaca

SEQ ID NO: 33732 - DNA, 201 bp, Homo sapiens
tcatgtctatgaacagccatggcactccagcttgggcaacatacagagaccccatctctacaacacacacacacacacacacacacacacacacacacacacactagctgggcgtggtggtagtgtgtgcctgtggtcccagctactcaggaggctgaggcaagaggatcacttgagctcaggaggtcaaggctgcagtga

SEQ ID NO: 33733 - DNA, 201 bp, Homo sapiens
caacctcatcccctcagcactaaccacatccactctcaaccccgtccccttcgcactgaccacacccaccccgttcggccccgccccccgcactgaacacwcccgccctcaaccccgcaccctccgcactcacctccccctcgccgctcgaccccgccctcaccacactgaccaccctcaacccattgcgcccagtcccca

SEQ ID NO: 33734 - DNA, 201 bp, Homo sapiens
gtgctggggttcagcctgtctggcggcacccagacccccagcgtctacgacgagagcgggagcaccggaggtggtgatggtgagtggtcctggctttgggrtgcagagatggggttacatcagagatggagctgggggcccggagctggggagggggaggccgggaagttgcgggcttcagcccagcccactctgtatccc

SEQ ID NO: 33735 - DNA, 201 bp, Homo sapiens
taactatataatgcaagcattctgaaatgtgaaaaaatctgaaatccgaaacactgctggtccccccagcatttcggataagggatccttgacccgtatgmgcgcgcgcgcgcgcacgcacacacacacacacacacacacacgcgcgcgtgcgcccgcgcacagctgttcgctggtgggtgttgcgtgggccagggtgga

SEQ ID NO: 33736 - DNA, 201 bp, Homo sapiens; identical to SEQ ID NO: 6970

SEQ ID NO: 33737 - DNA, 201 bp, Homo sapiens
gcggcagtggctccgcgcactcacccgggccccgggcaggggcgcgctccacttcgttgcacgcgggtccggcgcacagttcccgggcgagtgggctgtgsgtgctgacgttgtagaagcgagtggcctcgaaggctacgggacgagggtggcgggtgaccaagtgcaggcgcgacgggtcagggaccgggccgggccggg

SEQ ID NO: 33738 - DNA, 201 bp, Homo sapiens
gtgcagagatggggttacatcagagatggagctgggggcccggagctggggagggggaggccgggaagttgcgggcttcagcccagcccactctgtatccygtctctgaccccatagggctgggctattcccttgagtgtcatgtccagctgtttcccaccagggcagaccccaggctctgagcacctccctccctgctgc

SEQ ID NO: 33739 - DNA, 201 bp, Homo sapiens; identical to SEQ ID NO: 6977

SEQ ID NO: 33740 - DNA, 201 bp, Homo sapiens; identical to SEQ ID NO: 6981

SEQ ID NO: 33741 - DNA, 201 bp, Homo sapiens; identical to SEQ ID NO: 6983

SEQ ID NO: 33742 - DNA, 201 bp, Homo sapiens; identical to SEQ ID NO: 6982

SEQ ID NO: 33743 - DNA, 201 bp, Homo sapiens
gctttgggagactgagatgggaggatcacttgagcccaggaatttgaggctgcagtgcacaatgatcatgtctatgaacagccatggcactccagcttggrcaacatacagagaccccatctctacaacacacacacacacacacacacacacacacacacacacacactagctgggcgtggtggtagtgtgtgcctgtgg

SEQ ID NO: 33744 - DNA, 201 bp, Homo sapiens; identical to SEQ ID NO: 6969

SEQ ID NO: 33745 - DNA, 201 bp, Homo sapiens
atgggggacacatggcccaggcctggcactgtacaactctgcctcctttccccttccagtggaccacagtgatgggctctgggtgtccatgtgcggtaagrggggagtagcttgtgtcagaccaccaaccaaatcgaaaagctacccatagcacactacccagcaatacaaaagaacaaactccaggccgggcacagtggc

SEQ ID NO: 33746 - DNA, 201 bp, Homo sapiens; identical to SEQ ID NO: 6972

SEQ ID NO: 33747 - DNA, 201 bp, Homo sapiens
acatcagagatggagctgggggcccggagctggggagggggaggccgggaagttgcgggcttcagcccagcccactctgtatcccgtctctgaccccatarggctgggctattcccttgagtgtcatgtccagctgtttcccaccagggcagaccccaggctctgagcacctccctccctgctgcttctcgtcacctgccg

SEQ ID NO: 33748 - DNA, 201 bp, Homo sapiens
agctccaaggctggggggttggggtgcttggagctccagctgtagctaggaaggtgggggatctcccaagggacctccagctgtcccccctgcaccacacyggtgactgctgagcccacacctgggtcccaagagtctcatcctagggacgggcagatctctgtcattctgttccttgggttcatttagaggcaggtgtca

SEQ ID NO: 33749 - DNA, 201 bp, Homo sapiens
agccccgtcccctgccgcgcctcctccgcactgaccacacccaccccaaccccacccccaccgcactgaccgctcctatcctcaaccccgccccctccgcsgtgaccacacctaccctcaaccccgccccctccgtcctgaccactcttaaccccgccccctccgcactgaccacacccaccacaaatcccgcccctcagc

SEQ ID NO: 33750 - DNA, 201 bp, Homo sapiens
cgagagctgggacagtcttagggcaatttggggtcctgggtgccccaaagggaggccggggctttgtgtttcagagaaacgcagcctgttccgttttgaarttgcccaccggctggatgttttgctaatttagtccacatcgtgtttgctcagaaagaggcttttggccacacgagtgctttctgggaatgtttcttctcc

SEQ ID NO: 33751 - DNA, 201 bp, Homo sapiens
gaatttcacgcaggtatttgcctaatacttacaaaaacagaaacagacttttaaaaagcggttgtaggagagaaaggagacagggcgtcctgtctgggccrccctgcaacaacagccccgtcccctgccgcgcctcctccgcactgaccacacccaccccaaccccacccccaccgcactgaccgctcctatcctcaaccc

SEQ ID NO: 33752 - DNA, 201 bp, Homo sapiens
ggtgtgtggggaaggggagaagcctcagcacctggtgcacaaacacacacacagacacagacacacacacacacagagacaccgctgctcactccagggartggcacagggcagtttcaaagaccactggggcatgaactatgggggcaaggcagagggttggagggccactgttgggctcctcattgggtctatgtctct

SEQ ID NO: 33753 - DNA, 201 bp, Homo sapiens
cagatctctgtcattctgttccttgggttcatttagaggcaggtgtcacctgggctgaggtctgcccacccaccatacagagtcacaggctgatagggacrggatgcagccagatggtgtcgtcctgctctcagcagggcagccgttaggaagagaagccgctctgactggccaggagaggagaaagattcctatggggcc

SEQ ID NO: 33754 - DNA, 201 bp, Homo sapiens
aaggagccacagggcctgtcgcttgtagggtgccaggggtggggaacccaccggccagggcagcctcagaccttgatctcacaggcagcgaggggcctccrtgctggcagagatcagggctgagcggtgttggctgaaataaataccaccccggagaagatgggcaaatgcagacataagcaggtgccaggggtcacaaag

SEQ ID NO: 33755 - DNA, 201 bp, Homo sapiens
acacatatgtccaaacccatggaaggtacagtgccaaaagtgaacccccatggaaacgcggggttccagaagacagagccgtgtccatgcagctttgtccrttgcaacaaaggcaccgcttttggtaaaggacatagatagcgggggaggcttgcatgtgtggggtggggttacatggggactctgtaccttctgctgaat

SEQ ID NO: 33756 - DNA, 201 bp, Homo sapiens
aaatccgaaacactgctggtccccccagcatttcggataagggatccttgacccgtatgcgcgcgcgcgcgcgcacgcacacacacacacacacacacacrcgcgcgcgtgcgcccgcgcacagctgttcgctggtgggtgttgcgtgggccagggtggagggaggatgaatgtcccactttgtccccaggaactctgagc

SEQ ID NO: 33757 - DNA, 201 bp, Homo sapiens
ggcaaaagtatagaggcagtgaaaagatctgtggttgccagggggcagatgggaggaagtaatccataggtggaggtgggaggatttttagggcagtgacrcaactgtgcgacactatggtcaatggtggacatatcatgacacatatgtccaaacccatggaaggtacagtgccaaaagtgaacccccatggaaacgcgg

SEQ ID NO: 33758 - DNA, 201 bp, Homo sapiens
ctatataatgcaagcattctgaaatgtgaaaaaatctgaaatccgaaacactgctggtccccccagcatttcggataagggatccttgacccgtatgcgckcgcgcgcgcgcacgcacacacacacacacacacacacacgcgcgcgtgcgcccgcgcacagctgttcgctggtgggtgttgcgtgggccagggtggaggg

SEQ ID NO: 33759 - DNA, 201 bp, Homo sapiens
tggggaaggggagaagcctcagcacctggtgcacaaacacacacacagacacagacacacacacacacagagacaccgctgctcactccagggagtggcayagggcagtttcaaagaccactggggcatgaactatgggggcaaggcagagggttggagggccactgttgggctcctcattgggtctatgtctctgatcag

SEQ ID NO: 33760 - DNA, 201 bp, Homo sapiens
ggcccagagcagcagcgatggtgtccccgaggctaggcggggggtagggtcctcaccgagggcgcagcagctgggaggcgcgggctccaggggcgcggcckggcggcaggcggcctcccgcaggcggcaggcgctggcgtagaccaccccgtcggagccgcacaccgggttcccctgggcgccgcagtcgtggtcgcagcc

SEQ ID NO: 33761 - DNA, 201 bp, Homo sapiens
ttctgaaatgtgaaaaaatctgaaatccgaaacactgctggtccccccagcatttcggataagggatccttgacccgtatgcgcgcgcgcgcgcgcacgcrcacacacacacacacacacacacgcgcgcgtgcgcccgcgcacagctgttcgctggtgggtgttgcgtgggccagggtggagggaggatgaatgtcccac

SEQ ID NO: 33762 - DNA, 201 bp, Homo sapiens
agtctgtccccagctcttccaggtccctcctcctcactggggacaaggggccacccccgtgccgctggggatggggaatagcagttctgggctgactgatsggggcgtctggagggtcctgggctgagagctggaatctgctgggttgggtgggaaatgagttagaatccgactcctgatttccttccagggcacctcccc

SEQ ID NO: 33763 - DNA, 201 bp, Homo sapiens
ccaggggctcacaaagatcccagggaggggaggacctgcccaggcttcagggggcaaatccctcaccgggaactctcttccagggctgagtctgggccccmggacccacgtgcaggcaggtgagtctgtccccagctcttccaggtccctcctcctcactggggacaaggggccacccccgtgccgctggggatggggaat

SEQ ID NO: 33764 - DNA, 201 bp, Homo sapiens
gccctgtgagccgctcctacgggggccagtacagatgctacggtgcacacaacctctcctccgagtggtcggcccccagtgaccccctggacatcctgatsgcaggtgaggagcccagcgggttcagtcagggacccaggctccgcacaggccctgccgggggagctcaggtagtgatggccgggatgagggatgggggtc

SEQ ID NO: 33765 - DNA, 201 bp, Homo sapiens
aggaaggaaccagttttatttgctgctacatcctggctctcagtgggatgaaaacaaaccagacagacggtggctgggggtcaggaaagggcccattaccrtctgaaatgatgcagagggcctagtgactgcccccacctcagccctaatggaatgagagcaagggtcctggggagggcagttccacttcctgtgtggctg

SEQ ID NO: 33766 - DNA, 201 bp, Homo sapiens; identical to SEQ ID NO: 6990

SEQ ID NO: 33767 - DNA, 201 bp, Homo sapiens
ccagagtggacacatcaatcacctacgtagactgtggagtccaacgccaagatcctcttatgtcccaaacacctcaggtcttaccctggtctggaaatcargcacaaatgagcccctcctaatgttccagcaccactgaccgtacaaccactgtcacgagtgggatttgtgacaacagtcggcaaaggaagaatctgaggc

SEQ ID NO: 33768 - DNA, 201 bp, Homo sapiens
gaagatgctgctatgtggaagcacatccttgagatccacaaggagacactgggcaaggagacgagggtgccccactgtgcagaagtctccctaataaatgmtctatgaacaccctggtgtttagtgcttctttctttggaatcccagcagctctgtcactggacggtttggtgcactcccttgagggaattcccctgggct

SEQ ID NO: 33769 - DNA, 201 bp, Homo sapiens
tctgaagaagatgctgctatgtggaagcacatccttgagatccacaaggagacactgggcaaggagacgagggtgccccactgtgcagaagtctccctaayaaatgatctatgaacaccctggtgtttagtgcttctttctttggaatcccagcagctctgtcactggacggtttggtgcactcccttgagggaattcccc

SEQ ID NO: 33770 - DNA, 201 bp, Homo sapiens
caaataaactcaaaatccagacaaccctggagcaacgcagccttgaattcctggggtctcttatatgcacacttttttcaaccaaacgggggtcaaaactrtagcatttgtgggatgcaagacttgtgtatatgaacggcagacttttcctatatgcaggcccagcagagacaatgtcggggctggagtacgagcaggtgt

SEQ ID NO: 33771 - DNA, 201 bp, Homo sapiens
cacttccctctccggacacactgtggcttgccatgccatgcactccagattgtaatccttgcttctcactcccaaataaactcaaaatccagacaaccctsgagcaacgcagccttgaattcctggggtctcttatatgcacacttttttcaaccaaacgggggtcaaaactgtagcatttgtgggatgcaagacttgtgt

SEQ ID NO: 33772 - DNA, 201 bp, Homo sapiens
atcatggacaggagaggcgggtggagggaggggcctggggaggccacaggtcccatgtagagaaatttggtttgaggtggagacttcaggaaagccccagstcctcagcctcctctcattcttttacccaggaccgtctgggggccccagctccccgacaacaggccccacctccacatctggtgagtccctgaggcttct

SEQ ID NO: 33773 - DNA, 201 bp, Homo sapiens
gctgtgatggggagggatgggctggtccccagggcacaggcagaaccctcaggcggggcaggcagaaggctcaggtggtagagcctgcggcagatcacagrcctgtggggactgggctctcagaagggctgggggctgcagctgaaatgtccaggtgggggcagggtggctgtgctgtgggcctgtcactagggagggcag

SEQ ID NO: 33774 - DNA, 201 bp, Homo sapiens
ttctttggaatcccagcagctctgtcactggacggtttggtgcactcccttgagggaattcccctgggctgcttggggtccactccagcctcaggtgtagstggaggacgcagcctcccaccttggtctggagccctgagcccctcactgtcattgcagatcccgaggttcctctcctggctccactcagtggtggaaacc

SEQ ID NO: 33775 - DNA, 201 bp, Homo sapiens
tggggaggccacaggtcccatgtagagaaatttggtttgaggtggagacttcaggaaagccccagctcctcagcctcctctcattcttttacccaggaccstctgggggccccagctccccgacaacaggccccacctccacatctggtgagtccctgaggcttctgaactcaagggagtgcggcctcccccagggcagcc

SEQ ID NO: 33776 - DNA, 201 bp, Homo sapiens
taggcgctcatttcaatgacatcacccccatccctgacatcatcgtgctcaaggtctgggaaggcacctgggggttgtgatcggcatcttggtggccgtcrtcctactgctcctcctcctcctcctcctcttcctcatcctccgacatcgacgtcagggcaaacactggacatcgagtgagtagggaatggggggaccctg

SEQ ID NO: 33777 - DNA, 201 bp, Homo sapiens
caccctccctgggcctggggcagcaggggcagaggcagaggtggcagtgactgcaaagggcttgtcaggggcctctgagcattggactttcagagggcacygagccagggccacggtgttcgggtgggggcaggacgggtgactggggccctgcagctggcaagccccattagcaggaaggaagccccatttcgcaggaag

SEQ ID NO: 33778 - DNA, 201 bp, Homo sapiens
agcatcgtcacggtggacccctccttgtccagcacgctgcctcccgcctgctgcgacctcactctctcctgctgtcctgggacctcgtgggcctcctcccrggtccccttcctgctcctcatcctctgtttggccgtctggttgttagagctctccccaggcctcaggaggatgaggaataaatgaaccaccccggtcccc

SEQ ID NO: 33779 - DNA, 201 bp, Homo sapiens
cgtctaagatcaacgtaccaatctcaaaaataccaggctgaattccccatgggtcctgtgacctcagcccatgcggggacctacaggtgctacggctcacwgagctccaaaccctacctgctgactcaccccagtgaccccctggagctcgtggtctcaggtgggggccttgaccctgtcctctctgagctcaaagtctca

SEQ ID NO: 33780 - DNA, 201 bp, Homo sapiens
gtgacttccttcagctcgctggcgcacagccccaggctgggctctcccaggccaacttcaccctgggccctgtgagccgctcctacgggggccagtacagrtgctacggtgcacacaacctctcctccgagtggtcggcccccagtgaccccctggacatcctgatcgcaggtgaggagcccagcgggttcagtcagggac

SEQ ID NO: 33781 - DNA, 201 bp, Homo sapiens
attttgggtcctcttagtgagtaggcagactccagccctttccattcagccaacttgaacctcagcccacaatcattttcttgtcactttttactcttggraaatccggtcccaatgtgcttgtctttcatttgagaataattttcattttctccagtagttttaaaattactttgtatctattctaggtatcttttactc

SEQ ID NO: 33782 - DNA, 201 bp, Homo sapiens
ggagcctctcactcactcaccccttccccgtgttagagaatctctcactcactcaccccttccccgtgttagagaatctctcactcactcaccccttcccygtgttaggagcctctcctggctcccaccttttctcttctcttctttccatgtcctcatgtttctcaggtgaaccccagcatcctcttggaagatccactt

SEQ ID NO: 33783 - DNA, 201 bp, Homo sapiens
ccccttccccatgttaggagcctctcactcactcaccccttccccgtgttagagaatctctcactcactcaccccttccccgtgttagagaatctctcacwcactcaccccttccctgtgttaggagcctctcctggctcccaccttttctcttctcttctttccatgtcctcatgtttctcaggtgaaccccagcatcct

SEQ ID NO: 33784 - DNA, 201 bp, Homo sapiens
tcactcaccccttccccgtgttagggaccctctcactcactcaccccttccccgtgttagggactctctcattcactcaccccttccccatgttaggagcytctcactcactcaccccttccccgtgttagagaatctctcactcactcaccccttccccgtgttagagaatctctcactcactcaccccttccctgtgtt

SEQ ID NO: 33785 - DNA, 201 bp, Homo sapiens
ctctcactcaccccttccccgtgttagggagcctcgcactcactcaccccttccccgggttagggagcctcgcactcactcaccccttccccatgttaggraatctctcactcactcaccccttccccgtgttagggaccctctcactcactcaccccttccccgtgttagggactctctcattcactcaccccttcccca

SEQ ID NO: 33786 - DNA, 201 bp, Homo sapiens
gggctctcccaggccaacttcaccctgggccctgtgagccgctcctacgggggccagtacagatgctacggtgcacacaacctctcctccgagtggtcggyccccagtgaccccctggacatcctgatcgcaggtgaggagcccagcgggttcagtcagggacccaggctccgcacaggccctgccgggggagctcaggta

SEQ ID NO: 33787 - DNA, 201 bp, Homo sapiens
tcactcaccccttccccgtgttagggagcctcgcactcactcaccccttccccgtgttagggaccctctcactcaccccttccccgtgttagggagcctckcactcactcaccccttccccgggttagggagcctcgcactcactcaccccttccccatgttagggaatctctcactcactcaccccttccccgtgttagg

SEQ ID NO: 33788 - DNA, 201 bp, Homo sapiens
gactgggctctcagaagggctgggggctgcagctgaaatgtccaggtgggggcagggtggctgtgctgtgggcctgtcactagggagggcagggcccctckgctggggcactggagactggcagctgtgaggcacagggcccgctcacacttccctcctgaagtgtcactcggttttgctctggggacacgtgaaagtgcc

SEQ ID NO: 33789 - DNA, 201 bp, Homo sapiens
cctgtggggactgggctctcagaagggctgggggctgcagctgaaatgtccaggtgggggcagggtggctgtgctgtgggcctgtcactagggagggcagsgcccctctgctggggcactggagactggcagctgtgaggcacagggcccgctcacacttccctcctgaagtgtcactcggttttgctctggggacacgtg

SEQ ID NO: 33790 - DNA, 201 bp, Homo sapiens
cagaatccttacactgattccttctcttctggagaggcctccacttactctcttcgaatttattttcatttggatgggatttgttttgcacattttccccyggccccgcagggagggtgactgtagagcatgttgggaagggtcttttggcttttcccatggctttgggagcttctgcagcagggtttgtgttgggctgtg

SEQ ID NO: 33791 - DNA, 201 bp, Homo sapiens
tctcaggacctcctgagtgctgatcactcatatttggctcagaaaaatctcttctaatatattacagagtttgactctttttgtccacaataatttggtgyctgaacacgtgaggcctcagataagactcaggaccccaaaggagttgtctcaacctggagctaaggtaccagcaggggcccactgaaagcctccaggatt

SEQ ID NO: 33792 - DNA, 201 bp, Homo sapiens
ccattggttttatggcgcctctactttctggagtttgtgtaaaacaaaaatattatggtctttgtgcacatttacatcaaggtaagagagccctaatggcrgcttgcacgctatagagttcctaagttctctctttctctattttcttttctgcctgctttacatctgctgttacctttctactgagataaaaaccactgt

SEQ ID NO: 33793 - DNA, 201 bp, Homo sapiens
gtctaagatcaacgtaccaatctcaaaaataccaggctgaattccccatgggtcctgtgacctcagcccatgcggggacctacaggtgctacggctcacasagctccaaaccctacctgctgactcaccccagtgaccccctggagctcgtggtctcaggtgggggccttgaccctgtcctctctgagctcaaagtctcag

SEQ ID NO: 33794 - DNA, 201 bp, Homo sapiens
aaggagacgagggtgccccactgtgcagaagtctccctaataaatgatctatgaacaccctggtgtttagtgcttctttctttggaatcccagcagctctrtcactggacggtttggtgcactcccttgagggaattcccctgggctgcttggggtccactccagcctcaggtgtagctggaggacgcagcctcccacctt

SEQ ID NO: 33795 - DNA, 201 bp, Homo sapiens
tctgtccacaaacacagaagagggagaacaacagtctctctagggtcccacggtttcctccattttttgctttgttctgagagagagacaaagtgccatgrctgctctgtgggttggacagatgcatgctttcacctgcaggctggaacccaagctgaggtcttcagcatccccaagtactgataaagcactttaggttgt

SEQ ID NO: 33796 - DNA, 201 bp, Homo sapiens
cagctctgactcccagctgtgacctcctgggagaggaggcctcccagggaacctcccagacccgattccgcgggggcctgtcccgtcccacctgcagcagwgacggtgacctggggcaggggaggggagaagagtcatggttcaggacggtcaggctctttccctgcagctccggggctcggctctggtgcaggaacaagg

SEQ ID NO: 33797 - DNA, 201 bp, Homo sapiens
cttgaacggtactgatgtatagaaaagctactgatttttgtagcttgatttttttatccagagactttactgaagtcacttaccaagtctacgagtcttcyggaagaatcttcagggttttctgggtatatgatcgtgtcatcagcacacacagataatttcactttctcttttccaatgtggatgcactttctttctttc

SEQ ID NO: 33798 - DNA, 201 bp, Homo sapiens
atgtgtttgttggccacttatatttcttgttttgagaaatgtctgttgatggtctttactcagttttccataaagttgtctgtgttttttgttttttttttcatgttgaattctttgacttccttgcagattctggacattagtcttttgttggaggcataatttgcaaatattttcttccattgtgtaggttgtctgttc

SEQ ID NO: 33799 - DNA, 201 bp, Homo sapiens
catattattttccatagaagataaactcatttacattcctaccaaccatgtatcttgctaacatctgttggttctgacttcttaaaagtagccattttgaytggtgtaagttgatactcagtgtggttttaagttgaatttctctgatgattaatgatgttgagcattttttaatgtgtttgttggccacttatatttctt

SEQ ID NO: 33800 - DNA, 201 bp, Homo sapiens
ttttagttctttgagatagctccatattattttccatagaagataaactcatttacattcctaccaaccatgtatcttgctaacatctgttggttctgacktcttaaaagtagccattttgactggtgtaagttgatactcagtgtggttttaagttgaatttctctgatgattaatgatgttgagcattttttaatgtgt

SEQ ID NO: 33801 - DNA, 201 bp, Homo sapiens
cacctgacccaattgtctttttaatataatgacttttcctttggctggataccatgtaatgggattgctaagtgaaatggtagttctatttttagttctttgagatagctccatattattttccatagaagataaactcatttacattcctaccaaccatgtatcttgctaacatctgttggttctgacttcttaaaagta

SEQ ID NO: 33802 - DNA, 201 bp, Homo sapiens
acacctgacccaattgtctttttaatataatgacttttcctttggctggataccatgtaatgggattgctaagtgaaatggtagttctatttttagttctttgagatagctccatattattttccatagaagataaactcatttacattcctaccaaccatgtatcttgctaacatctgttggttctgacttcttaaaagt

SEQ ID NO: 33803 - DNA, 201 bp, Homo sapiens
cacacctgacccaattgtctttttaatataatgacttttcctttggctggataccatgtaatgggattgctaagtgaaatggtagttctatttttagttctttgagatagctccatattattttccatagaagataaactcatttacattcctaccaaccatgtatcttgctaacatctgttggttctgacttcttaaaag

SEQ ID NO: 33804 - DNA, 201 bp, Homo sapiens
ccacacctgacccaattgtctttttaatataatgacttttcctttggctggataccatgtaatgggattgctaagtgaaatggtagttctatttttagttctttgagatagctccatattattttccatagaagataaactcatttacattcctaccaaccatgtatcttgctaacatctgttggttctgacttcttaaaa

SEQ ID NO: 33805 - DNA, 201 bp, Homo sapiens
aacagaatgatctttgcttgtataatttttaataaataagccatgtaatattgttggttaaataaaaacagctaactactgagatattggttaaaaaaaataactttatatttaaccataagtttccttacttaggtaaacacctgaaattcatagtttataacattggttaacagggaattaactttaagtgatgactgt

SEQ ID NO: 33806 - DNA, 201 bp, Homo sapiens
agatgcttcttcaagttcacttaagtaaaatctttaataaataagctggctttaaaattattggtaaaataagattagaaatgtcttaagaattgttagcrtttttgtttgcacttattgcacaagtggttttgtgcttatccctgcagaatagtataagattttccataagggttataaaactataaacctggccgggca

SEQ ID NO: 33807 - DNA, 201 bp, Homo sapiens
ttgcacaagtggttttgtgcttatccctgcagaatagtataagattttccataagggttataaaactataaacctggccgggcacggtggctcacgcctgyaaccccagcactttgggaggccgaggctggtggatcacctgaggttgggagttcaagagcagcctgacacacacaaaacaaaattataaacccagcccaa

SEQ ID NO: 33808 - DNA, 201 bp, Homo sapiens
atttttaataaataagccatgtaatattgttggttaaataaaaacagctaactactgagatattggttaaaaaaaataactttatatttaaccataagttyccttacttaggtaaacacctgaaattcatagtttataacattggttaacagggaattaactttaagtgatgactgtcacagtgttcataaataatctagg

SEQ ID NO: 33809 - DNA, 201 bp, Homo sapiens
aggagggggcagctgatgacccatggcgtctaagatcaacgtaccaatctcaaaaataccaggctgaattccccatgggtcctgtgacctcagcccatgcrgggacctacaggtgctacggctcacagagctccaaaccctacctgctgactcaccccagtgaccccctggagctcgtggtctcaggtgggggccttgacc

SEQ ID NO: 33810 - DNA, 201 bp, Homo sapiens
aataagtttatcaagtaaatgcaatggaataaatgcctataaacaaacttgtcacataatttacaatctaaagttatattaaataatagatattaattgaytagctgggtaatttataatttaaaaattacaggaaaacatttttaaaaaacaattcttattaaaagataaatatctgtgtttaattcaaagcttttttaa

SEQ ID NO: 33811 - DNA, 201 bp, Homo sapiens
aggcccatgcttccagctctcagataagagctgcttctaaggactttttaaaaaccccacaagaaacccttccatgtccttcaccccctcctgctttgacraggtttatcactagatattctttaggatgtcaggaattcagataagatgctctcgagaaaaaacttgcccagcaacggcatctcctccaatggactgaca

SEQ ID NO: 33812 - DNA, 201 bp, Homo sapiens
gggagcagccgcgtctcagggcagttccaggtgggatgatgttggggcgagagggctcagggctcctggggccagagacacaggaagatcagcagtgatgwggccccgggggaaagggaagatttgtggggaagcctgagggtcggctcctggaaaccatgaccaccttttcccaggtgtttctaagaagccatcactctc

SEQ ID NO: 33813 - DNA, 201 bp, Homo sapiens
accaaaggcctcctggtgccagatctaatcctgcagaacttctctgtcctccttcccccggctctcagcatcgtcacggtggacccctccttgtccagcaygctgcctcccgcctgctgcgacctcactctctcctgctgtcctgggacctcgtgggcctcctcccgggtccccttcctgctcctcatcctctgtttggcc

SEQ ID NO: 33814 - DNA, 201 bp, Homo sapiens
cccaggccaacttcaccctgggccctgtgagccgctcctacgggggccagtacagatgctacggtgcacacaacctctcctccgagtggtcggcccccagygaccccctggacatcctgatcgcaggtgaggagcccagcgggttcagtcagggacccaggctccgcacaggccctgccgggggagctcaggtagtgatgg

SEQ ID NO: 33815 - DNA, 201 bp, Homo sapiens
ctcaaaaaaaaaaaaaaagaaaaaaagaaaaaaagaaaaaaaaagagtttgaaagtttgagatagaaaaaaagaggttttttgaatctataagatgtactwctatcagcatgcctaatgcgtccatgaatctgtgtgtggtgtacataatgtttcactactaaaaatatacaaaagagctctaattaattggcttaaagag

SEQ ID NO: 33816 - DNA, 201 bp, Homo sapiens
attaatatctcatggctagagttttgaagtaaaagctacaggatgtctgtgtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccagacttcttcctctgtacttt

SEQ ID NO: 33817 - DNA, 201 bp, Homo sapiens
tattaatatctcatggctagagttttgaagtaaaagctacaggatgtctgtgtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccagacttcttcctctgtactt

SEQ ID NO: 33818 - DNA, 201 bp, Homo sapiens
atattaatatctcatggctagagttttgaagtaaaagctacaggatgtctgtgtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccagacttcttcctctgtact

SEQ ID NO: 33819 - DNA, 201 bp, Homo sapiens
tatattaatatctcatggctagagttttgaagtaaaagctacaggatgtctgtgtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccagacttcttcctctgtac

SEQ ID NO: 33820 - DNA, 201 bp, Homo sapiens
ggtaaatttatattaatatctcatggctagagttttgaagtaaaagctacaggatgtctgtgtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccagacttcttc

SEQ ID NO: 33821 - DNA, 201 bp, Homo sapiens
tggtaaatttatattaatatctcatggctagagttttgaagtaaaagctacaggatgtctgtgtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccagacttctt

SEQ ID NO: 33822 - DNA, 201 bp, Homo sapiens
aagtgtccttcgggctcagtgccatctacaaatgtaaagtgtccttcgggctctgtccatcctatgaggcatttggaacatggaggcaggagtgtttttargtttccttccttaccttcgagctgtgtgtgcagggcagggggctccaatgttcccagggctgaggctctgtccttcttcccccagcccagagaaaggctg

SEQ ID NO: 33823 - DNA, 201 bp, Homo sapiens
ctggtaaatttatattaatatctcatggctagagttttgaagtaaaagctacaggatgtctgtgtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccagacttct

SEQ ID NO: 33824 - DNA, 201 bp, Homo sapiens
tttaggtttccttccttaccttcgagctgtgtgtgcagggcagggggctccaatgttcccagggctgaggctctgtccttcttcccccagcccagagaaargctgatttccaacatcctgcaggggctgtggggccagagcccacagacagaggcctgcagtggaggtaattctgcccgaagaccccagactcccacctgc

SEQ ID NO: 33825 - DNA, 201 bp, Homo sapiens
gttaagaggggactatttggttgaaagaaaacccacaatccagtgtcaagaaagaagtcaacttttcttccctatttccctgcatttctcttctgtgctcrctgccacacgcagctcagcctgggcggcacagccagatgcgagatgcgtctctgctgatctgagtctgcctgcagcatggacctgggtcttccctgaagc

SEQ ID NO: 33826 - DNA, 201 bp, Homo sapiens
caagctggtaaatttatattaatatctcatggctagagttttgaagtaaaagctacaggatgtctgtgtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccagac

SEQ ID NO: 33827 - DNA, 201 bp, Homo sapiens
tgcaagctggtaaatttatattaatatctcatggctagagttttgaagtaaaagctacaggatgtctgtgtgtgtgtgtgtgtgtgtgtgtgtgtgtgtgtgtgtgtggtgtgtgtgtgtttaaaagcctttatgatagatttctataattttatgtttaattggcagtgaacccattttaatttccctctaacacaccag

SEQ ID NO: 33828 - DNA, 201 bp, Homo sapiens
cacacacagcctgaggatggggtggagatggacactcgggtgagaccccacccctgtcccaggcaccaaaggcctcctggtgccagatctaatcctgcagracttctctgtcctccttcccccggctctcagcatcgtcacggtggacccctccttgtccagcacgctgcctcccgcctgctgcgacctcactctctcctg

SEQ ID NO: 33829 - DNA, 201 bp, Homo sapiens; identical to SEQ ID NO: 6998

SEQ ID NO: 33830 - DNA, 201 bp, Homo sapiens
aggactcagaggtcccagggaaccttcccaagagacaaaccccttgctctgccccagcagatgctgccgtgaagcacacacagcctgaggatggggtggaratggacactcgggtgagaccccacccctgtcccaggcaccaaaggcctcctggtgccagatctaatcctgcagaacttctctgtcctccttcccccggct

SEQ ID NO: 33831 - DNA, 201 bp, Homo sapiens
gtctatatagagaaaagaaaacagcactctggattacacggatcccacaggagcttgtgaagaagggccagttccccatcccatccatcacctgggaacaygcagggcggtatcgctgttactatggtagcgacactgcaggccgctcagagagcagtgaccccctggagctggtggtgacaggtgagctgacactcaggg

SEQ ID NO: 33832 - DNA, 201 bp, Homo sapiens
tctatatagagaaaagaaaacagcactctggattacacggatcccacaggagcttgtgaagaagggccagttccccatcccatccatcacctgggaacatrcagggcggtatcgctgttactatggtagcgacactgcaggccgctcagagagcagtgaccccctggagctggtggtgacaggtgagctgacactcagggg

SEQ ID NO: 33833 - DNA, 201 bp, Homo sapiens
tgaagcacacacagcctgaggatggggtggagatggacactcgggtgagaccccacccctgtcccaggcaccaaaggcctcctggtgccagatctaatccwgcagaacttctctgtcctccttcccccggctctcagcatcgtcacggtggacccctccttgtccagcacgctgcctcccgcctgctgcgacctcactctc

SEQ ID NO: 33834 - DNA, 201 bp, Homo sapiens; identical to SEQ ID NO: 7001

SEQ ID NO: 33835 - DNA, 201 bp, Homo sapiens
ctgtgtggtgctcagcttggctgctcctgtgccccagctgtcatacttattctggggcccacagaggtgcctggcctcctccctccctgctaaggcagtgkcagctggacccaggctgctcagggatcagaagcctgtgggattccacgtgggctccagaggcgcctctgcaccatctctgggaactccctgtgcctctgt

SEQ ID NO: 33836 - DNA, 201 bp, Homo sapiens
caacgtaccaatctcaaaaataccaggctgaattccccatgggtcctgtgacctcagcccatgcggggacctacaggtgctacggctcacagagctccaamccctacctgctgactcaccccagtgaccccctggagctcgtggtctcaggtgggggccttgaccctgtcctctctgagctcaaagtctcagctcagaccc

SEQ ID NO: 33837 - DNA, 201 bp, Homo sapiens
ggggctggcaggactcagaggtcccagggaaccttcccaagagacaaaccccttgctctgccccagcagatgctgccgtgaagcacacacagcctgaggayggggtggagatggacactcgggtgagaccccacccctgtcccaggcaccaaaggcctcctggtgccagatctaatcctgcagaacttctctgtcctcctt

SEQ ID NO: 33838 - DNA, 201 bp, Homo sapiens
ctggggcagcaggggcagaggcagaggtggcagtgactgcaaagggcttgtcaggggcctctgagcattggactttcagagggcactgagccagggccacsgtgttcgggtgggggcaggacgggtgactggggccctgcagctggcaagccccattagcaggaaggaagccccatttcgcaggaagcaacagaggtgggc

SEQ ID NO: 33839 - DNA, 201 bp, Homo sapiens
tgccaggcctccccacaccctccctgggcctggggcagcaggggcagaggcagaggtggcagtgactgcaaagggcttgtcaggggcctctgagcattggrctttcagagggcactgagccagggccacggtgttcgggtgggggcaggacgggtgactggggccctgcagctggcaagccccattagcaggaaggaagcc

SEQ ID NO: 33840 - DNA, 201 bp, Homo sapiens
gccacatttaacacggtgcctccttctctcctaggagcctacatcaaacccaccctctcagcccagcccagccccgtggtgaactcaggagggaatgtaaycctccagtgtgactcacaggtggcatttgatggcttcagtctgtgtaaggaaggagaagatgaacacccacaatgcctgaactcccagccccatgcccgt

SEQ ID NO: 33841 - DNA, 201 bp, Homo sapiens
gcgtctcagggcagttccaggtgggatgatgttggggcgagagggctcagggctcctggggccagagacacaggaagatcagcagtgatgtggccccgggkgaaagggaagatttgtggggaagcctgagggtcggctcctggaaaccatgaccaccttttcccaggtgtttctaagaagccatcactctcagtgcagcca

SEQ ID NO: 33842 - DNA, 201 bp, Homo sapiens
aaaattatataatataaaaataacatttaaaaacccacaattcaggccgggcacggtggctcatgcctgtaatcccagcactttgggaagccgagacgggyggatcacttgaggtcaggagtttgagaccagcctggtcaacatggcaaaaccccgtctttactaaaaatacaaaaattagccaggcatggtgtcaagcac

SEQ ID NO: 33843 - DNA, 201 bp, Homo sapiens
ataaggacggggaacgtgacttccttcagctcgctggcgcacagccccaggctgggctctcccaggccaacttcaccctgggccctgtgagccgctcctaygggggccagtacagatgctacggtgcacacaacctctcctccgagtggtcggcccccagtgaccccctggacatcctgatcgcaggtgaggagcccagcg

SEQ ID NO: 33844 - DNA, 201 bp, Homo sapiens
acatggtgaatccctgtctctactaaaaatgcaaaacttagccaggcagtagtggcacactcgtaatcccagctacttgggagactgagacaggagaatcrcttcagcatgggagatgtaggttgcagtgagctgggatcatgccactgcattccagtctgggtgacagagtgagcccctgcctcaaaaaaaaaaaaaaag

SEQ ID NO: 33845 - DNA, 201 bp, Homo sapiens
tttccaatgtggatgcactttctttctttctgttgcctgattgctctggctaggacttccagtactgtgttgaataggagtggtgagagtggacatccttrtcctgttccatttcttggggaaatgctttcacttctccccattcaattttaaggttggctgtgcgtttgtcatataaggctcttattttggggtatgttt

SEQ ID NO: 33846 - DNA, 201 bp, Homo sapiens
cggctcctggaaaccatgaccaccttttcccaggtgtttctaagaagccatcactctcagtgcagccaggtcctatcgtggcccctgaggagaccctgacyctgcagtgtggctctgatgctggctacaacagatttgttctgtataaggacggggaacgtgacttccttcagctcgctggcgcacagccccaggctgggc

SEQ ID NO: 33847 - DNA, 201 bp, Homo sapiens
ccgctcacacttccctcctgaagtgtcactcggttttgctctggggacacgtgaaagtgccaggcctccccacaccctccctgggcctggggcagcagggrcagaggcagaggtggcagtgactgcaaagggcttgtcaggggcctctgagcattggactttcagagggcactgagccagggccacggtgttcgggtgggg

SEQ ID NO: 33848 - DNA, 201 bp, Homo sapiens
agaacacccagtgtctccttgtccatctgaagaagatgctgctatgtggaagcacatccttgagatccacaaggagacactgggcaaggagacgagggtgmcccactgtgcagaagtctccctaataaatgatctatgaacaccctggtgtttagtgcttctttctttggaatcccagcagctctgtcactggacggtttg

SEQ ID NO: 33849 - DNA, 201 bp, Homo sapiens
gattacacggatcccacaggagcttgtgaagaagggccagttccccatcccatccatcacctgggaacatgcagggcggtatcgctgttactatggtagcsacactgcaggccgctcagagagcagtgaccccctggagctggtggtgacaggtgagctgacactcaggggtcccagccccagactctgccctcaggaagg

SEQ ID NO: 33850 - DNA, 201 bp, Homo sapiens
gatggggaatagcagttctgggctgactgatcggggcgtctggagggtcctgggctgagagctggaatctgctgggttgggtgggaaatgagttagaatcygactcctgatttccttccagggcacctccccaagcccaccctctgggctgaaccaggctctgtgatcacccaggggagtcctgtgaccctcaggtgtcag

SEQ ID NO: 33851 - DNA, 201 bp, Homo sapiens; identical to SEQ ID NO: 6987

SEQ ID NO: 33852 - DNA, 201 bp, Homo sapiens; identical to SEQ ID NO: 6992

SEQ ID NO: 33853 - DNA, 201 bp, Homo sapiens
cagtgcctgtaatcccagctatttgggaggctgaggcaggagaatcgcttgaaccagggagtcagaggtttcagtgagccaagatcgcaccactgctctcyagcctggcgacagagggagactccatctcaaattaaaaaaaaaaaaaaaaaagaaagaaaaagagaaaaaagaaatttagaagaataacaagttattcca

SEQ ID NO: 33854 - DNA, 201 bp, Homo sapiens
cacgttccttccctctcactctcccccgctgcaggctgctgcatctgaagccccccaggatgtgacctacgcccagctgcacagcttgaccctcagacggraggcaactgagcctcctccatcccaggaagggccctctccagctgtgcccagcatctacgccactctggccatccactagcccagggggggacgcagacc

SEQ ID NO: 33855 - DNA, 201 bp, Homo sapiens
cccccaccacgttccttccctctcactctcccccgctgcaggctgctgcatctgaagccccccaggatgtgacctacgcccagctgcacagcttgaccctyagacgggaggcaactgagcctcctccatcccaggaagggccctctccagctgtgcccagcatctacgccactctggccatccactagcccagggggggac

SEQ ID NO: 33856 - DNA, 201 bp, Homo sapiens
cccccacccccaccacgttccttccctctcactctcccccgctgcaggctgctgcatctgaagccccccaggatgtgacctacgcccagctgcacagcttkaccctcagacgggaggcaactgagcctcctccatcccaggaagggccctctccagctgtgcccagcatctacgccactctggccatccactagcccaggg

SEQ ID NO: 33857 - DNA, 201 bp, Homo sapiens
aataggagtggtgagagtggacatccttatcctgttccatttcttggggaaatgctttcacttctccccattcaattttaaggttggctgtgcgtttgtcwtataaggctcttattttggggtatgtttctttcatgcctagtctgttgagggattttatcatgaagggatattggactttctcgaacgctttatctgcat

SEQ ID NO: 33858 - DNA, 201 bp, Homo sapiens
acaaaggacagacaggcggaagaggacaggcagatggacactgaggtgagtcctttcctctccaggcccccaggcctcccccacccccaccacgttccttmcctctcactctcccccgctgcaggctgctgcatctgaagccccccaggatgtgacctacgcccagctgcacagcttgaccctcagacgggaggcaactga

SEQ ID NO: 33859 - DNA, 201 bp, Homo sapiens
ggagaggaggcctcccagggaacctcccagacccgattccgcgggggcctgtcccgtcccacctgcagcagagacggtgacctggggcaggggaggggagmagagtcatggttcaggacggtcaggctctttccctgcagctccggggctcggctctggtgcaggaacaagggctgcaggtcagactcctgggcttccttc

SEQ ID NO: 33860 - DNA, 201 bp, Homo sapiens
tcatgaagggatattggactttctcgaacgctttatctgcatctattgagatgaccatatgctttttgttcttagtttatgtcatgagtcacttttattgrcttgcatatattgaaccatcctttcatccctggaatcaagccaacttgatcatgatgaattatgtttttgatacactgttagattccgtttaatagcatt

SEQ ID NO: 33861 - DNA, 201 bp, Homo sapiens
agccgcccccgcctcctgagctcacctcgtggtgggagacaaaatgcaaataaatgtgccgcgtccaggagtgcaacgtgctgtaaggaacataaaccagrgaaagggcagagagtgtggggcagtggggccagtctgaatggaaggggagggctgtctgctcagctgtcatctgagaagcctggacagagtggggcacac

SEQ ID NO: 33862 - DNA, 201 bp, Homo sapiens
ctcaccccttccccatgttagggaatctctcactcactcaccccttccccgtgttagggaccctctcactcactcaccccttccccgtgttagggactctytcattcactcaccccttccccatgttaggagcctctcactcactcaccccttccccgtgttagagaatctctcactcactcaccccttccccgtgttaga

SEQ ID NO: 33863 - DNA, 201 bp, Homo sapiens
ttgttattggtctgtttagggtttctattttttgcctgtgcgatcttaggaagttgtatgtgtctaggaattcatccatttctctaggttttctagtttaygtgcataaaggtgttcatagtagtctctgatggtcatttgtatttctgtggcgttggttgtaatgtcaactttatcatttctgattgtgcttatttaaat

SEQ ID NO: 33864 - DNA, 201 bp, Homo sapiens
cggtcccccaggctccccttcattcattcaaccagcaagtgttcccagggagctcactgtggatggggctccccatgggagctgcagacacagcagggagsaaagccgcccccgcctcctgagctcacctcgtggtgggagacaaaatgcaaataaatgtgccgcgtccaggagtgcaacgtgctgtaaggaacataaacc

SEQ ID NO: 33865 - DNA, 201 bp, Homo sapiens
tgagaggaagaggtgaccagccaggagggagatgggggccccgaagtttccgtagcaatggggaaaggggcgctggctggaaagggtctggggctcagggygagatcatctcaccccacactgtggggcctcagggacatcgcagcccctccctgcatctcagtggccccatctgggagctgagcaggggctggcaggact

SEQ ID NO: 33866 - DNA, 201 bp, Homo sapiens
ccgatgcccaggaagaaaacctctgtgagtgagaggaagaggtgaccagccaggagggagatgggggccccgaagtttccgtagcaatggggaaaggggcrctggctggaaagggtctggggctcagggtgagatcatctcaccccacactgtggggcctcagggacatcgcagcccctccctgcatctcagtggccccat

SEQ ID NO: 33867 - DNA, 201 bp, Homo sapiens
cccccaggtccagcccagctgccgatgcccaggaagaaaacctctgtgagtgagaggaagaggtgaccagccaggagggagatgggggccccgaagtttcygtagcaatggggaaaggggcgctggctggaaagggtctggggctcagggtgagatcatctcaccccacactgtggggcctcagggacatcgcagcccctc

SEQ ID NO: 33868 - DNA, 201 bp, Homo sapiens
cgtctctgctgatctgagtctgcctgcagcatggacctgggtcttccctgaagcatctccagggctggagggacgactgccatggtaaggaccccacaacrctgagctgatggacggctgaaggagggagggtgaccatgtgggaggctgtgagaaggaaggagatgcctccgctaccctcgtcaggaagggcagacacag

SEQ ID NO: 33869 - DNA, 201 bp, Homo sapiens
ttattctgtatgcctgttatatctgtatcttcatatgtgttatctggaagtgatatttcactaccaaactacatgaaacagctcatcagttgtcttttttwaaaaaaagtaagtgcttatcagattggcagacactagctaagatgcctttgaattcacctgattttaatatttagtaaaattaatttagtaaatttaatc

SEQ ID NO: 33870 - DNA, 201 bp, Homo sapiens
atttcttgtgtgcattaattatgttttctactttattcatttctagtttttctctgatgactaatgaaaaatttaatagatattccacaccaatactatgytcatcatttcagctgtgtcttgttcttatgcaattatttctaaatgtgttgatatgatttactatttttcacctcacagtagcttcctaattcatttcta

SEQ ID NO: 33871 - DNA, 201 bp, Homo sapiens
ttctataattgcctgttttttctgtaatggactttttgatttttatttctcttgggtgggtttttctcccacacatgtgatcttccatacagtttctcccygggctgactcaggaaggaaagctgatgaggagcattgctgtggtcactcctgccctgcggtgtccatgctgccaagcttagaatcagctctgtgttctgt

SEQ ID NO: 33872 - DNA, 201 bp, Homo sapiens
tgccaagcttagaatcagctctgtgttctgtccggcatggtggggcccatgtgagcctcacactcacgtgctagagatgcctggtccagcagtgataaagygcatctgtgtcatgcacacccgggaaggtggctcaatgctgagtgtggcccgggtcactgaggggagctatcccagggtctgtccacaaacacagaagag

SEQ ID NO: 33873 - DNA, 201 bp, Homo sapiens
agcagggcagccccagccctcacctccccgtcctgacccagcaggccctgaggaccagcccctcacccccaccgggtcggatccccagagtggtgagtgasgggctctgagtgggaggtgggcagggtccaggggaggcaggggtgggttctgtcctaggttcagtctcctctggaggtggtgatatagacaggctcctcc

SEQ ID NO: 33874 - DNA, 201 bp, Homo sapiens
cccaagagacaaaccccttgctctgccccagcagatgctgccgtgaagcacacacagcctgaggatggggtggagatggacactcgggtgagaccccaccyctgtcccaggcaccaaaggcctcctggtgccagatctaatcctgcagaacttctctgtcctccttcccccggctctcagcatcgtcacggtggacccctc

SEQ ID NO: 33875 - DNA, 201 bp, Homo sapiens
gcagggcagccccagccctcacctccccgtcctgacccagcaggccctgaggaccagcccctcacccccaccgggtcggatccccagagtggtgagtgacrggctctgagtgggaggtgggcagggtccaggggaggcaggggtgggttctgtcctaggttcagtctcctctggaggtggtgatatagacaggctcctccc

SEQ ID NO: 33876 - DNA, 201 bp, Homo sapiens; identical to SEQ ID NO: 7050

SEQ ID NO: 33877 - DNA, 201 bp, Homo sapiens
cttcccaagagacaaaccccttgctctgccccagcagatgctgccgtgaagcacacacagcctgaggatggggtggagatggacactcgggtgagaccccrcccctgtcccaggcaccaaaggcctcctggtgccagatctaatcctgcagaacttctctgtcctccttcccccggctctcagcatcgtcacggtggaccc

SEQ ID NO: 33878 - DNA, 201 bp, Homo sapiens
cctgacccagcaggccctgaggaccagcccctcacccccaccgggtcggatccccagagtggtgagtgacgggctctgagtgggaggtgggcagggtccargggaggcaggggtgggttctgtcctaggttcagtctcctctggaggtggtgatatagacaggctcctcccctgcttgggcctcagtttctccaaatgtaa

SEQ ID NO: 33879 - DNA, 201 bp, Homo sapiens
gctgtggtcactcctgccctgcggtgtccatgctgccaagcttagaatcagctctgtgttctgtccggcatggtggggcccatgtgagcctcacactcacrtgctagagatgcctggtccagcagtgataaagcgcatctgtgtcatgcacacccgggaaggtggctcaatgctgagtgtggcccgggtcactgaggggag

SEQ ID NO: 33880 - DNA, 201 bp, Homo sapiens
tactccttatttccttcattctgaaagtgtgatccatagagagatacctgtttcctcttctcattccatttcttgtgtgcattaattatgttttctacttyattcatttctagtttttctctgatgactaatgaaaaatttaatagatattccacaccaatactatgctcatcatttcagctgtgtcttgttcttatgcaa

SEQ ID NO: 33881 - DNA, 201 bp, Homo sapiens
ttttactcttgggaaatccggtcccaatgtgcttgtctttcatttgagaataattttcattttctccagtagttttaaaattactttgtatctattctagrtatcttttactctatcatagttaagacattgatgttatttattaatttgttcacattaaactcatgttctttcttcatttctgtaaaaatgtcaaccatt

SEQ ID NO: 33882 - DNA, 201 bp, Homo sapiens
tactcactattttgggtcctcttagtgagtaggcagactccagccctttccattcagccaacttgaacctcagcccacaatcattttcttgtcactttttyctcttgggaaatccggtcccaatgtgcttgtctttcatttgagaataattttcattttctccagtagttttaaaattactttgtatctattctaggtatc

SEQ ID NO: 33883 - DNA, 201 bp, Homo sapiens
tgaccccctggagctcgtggtctcaggtgggggccttgaccctgtcctctctgagctcaaagtctcagctcagaccctgccccaggagagctctgggctgrgatggagtgagcgggggtctgagaggggctcagccagtgggagactcaccctcagagggaaggaggagaacagggccctcccaggcctgcccaccctcag

SEQ ID NO: 33884 - DNA, 201 bp, Homo sapiens
acgttgtctgtctccctatcacacccgtgctccagggctcatgagtctcagttcagacacacactcttgtctctccccaggccacagtgtggctgagggcmgtgggaaacacctgccttgccactctctgcaggcgtggttccaaggcagagcctcctccctcagcccagtgcagaccctgagcggctgtctgttgtctga

SEQ ID NO: 33885 - DNA, 201 bp, Homo sapiens
ccttcccagctctgccgcttcctggctgggggccccgggcaggcgattcccctctctgagcgtcagtttttcatctgtacagtgggtggggtggatgtttstgtgctgcacgactgttgtgggggttggaggtggtgaacagaaggtccagcagtcacctgcacacagtaggcgctcatttcaatgacatcacccccatcc

SEQ ID NO: 33886 - DNA, 201 bp, Homo sapiens
tccctgcagctccggggctcggctctggtgcaggaacaagggctgcaggtcagactcctgggcttccttcccagctctgccgcttcctggctgggggcccsgggcaggcgattcccctctctgagcgtcagtttttcatctgtacagtgggtggggtggatgtttctgtgctgcacgactgttgtgggggttggaggtggt

SEQ ID NO: 33887 - DNA, 201 bp, Homo sapiens
cctcccagacccgattccgcgggggcctgtcccgtcccacctgcagcagagacggtgacctggggcaggggaggggagaagagtcatggttcaggacggtmaggctctttccctgcagctccggggctcggctctggtgcaggaacaagggctgcaggtcagactcctgggcttccttcccagctctgccgcttcctggct

SEQ ID NO: 33888 - DNA, 201 bp, Homo sapiens
gcaggggctggcaggactcagaggtcccagggaaccttcccaagagacaaaccccttgctctgccccagcagatgctgccgtgaagcacacacagcctgargatggggtggagatggacactcgggtgagaccccacccctgtcccaggcaccaaaggcctcctggtgccagatctaatcctgcagaacttctctgtcctc

SEQ ID NO: 33889 - DNA, 201 bp, Homo sapiens
aggcctcccagggaacctcccagacccgattccgcgggggcctgtcccgtcccacctgcagcagagacggtgacctggggcaggggaggggagaagagtcrtggttcaggacggtcaggctctttccctgcagctccggggctcggctctggtgcaggaacaagggctgcaggtcagactcctgggcttccttcccagctc

SEQ ID NO: 33890 - DNA, 201 bp, Homo sapiens
ttgggcctcagtttctccaaatgtaaaggtgagaggcctgcgggtgggaaagttcctttcagctctgactcccagctgtgacctcctgggagaggaggccycccagggaacctcccagacccgattccgcgggggcctgtcccgtcccacctgcagcagagacggtgacctggggcaggggaggggagaagagtcatggtt

SEQ ID NO: 33891 - DNA, 201 bp, Homo sapiens
agatttgtggggaagcctgagggtcggctcctggaaaccatgaccaccttttcccaggtgtttctaagaagccatcactctcagtgcagccaggtcctatsgtggcccctgaggagaccctgactctgcagtgtggctctgatgctggctacaacagatttgttctgtataaggacggggaacgtgacttccttcagctcg

SEQ ID NO: 33892 - DNA, 201 bp, Homo sapiens
tgatctcctggagctcctggtcctaggtgagaaattcacagcattgcctggagttccctgagtctccaggcaggtggggagcagccgcgtctcagggcagytccaggtgggatgatgttggggcgagagggctcagggctcctggggccagagacacaggaagatcagcagtgatgtggccccgggggaaagggaagattt

SEQ ID NO: 33893 - DNA, 201 bp, Homo sapiens
tggtctctacccagtgatctcctggagctcctggtcctaggtgagaaattcacagcattgcctggagttccctgagtctccaggcaggtggggagcagccrcgtctcagggcagttccaggtgggatgatgttggggcgagagggctcagggctcctggggccagagacacaggaagatcagcagtgatgtggccccgggg

SEQ ID NO: 33894 - DNA, 201 bp, Homo sapiens; identical to SEQ ID NO: 7004

SEQ ID NO: 33895 - DNA, 201 bp, Homo sapiens; identical to SEQ ID NO: 7005

SEQ ID NO: 33896 - DNA, 201 bp, Homo sapiens
cccccaccgggtcggatccccagagtggtgagtgacgggctctgagtgggaggtgggcagggtccaggggaggcaggggtgggttctgtcctaggttcagkctcctctggaggtggtgatatagacaggctcctcccctgcttgggcctcagtttctccaaatgtaaaggtgagaggcctgcgggtgggaaagttcctttc

SEQ ID NO: 33897 - DNA, 201 bp, Homo sapiens
ttgcttctcactcccaaataaactcaaaatccagacaaccctggagcaacgcagccttgaattcctggggtctcttatatgcacacttttttcaaccaaargggggtcaaaactgtagcatttgtgggatgcaagacttgtgtatatgaacggcagacttttcctatatgcaggcccagcagagacaatgtcggggctgga

SEQ ID NO: 33898 - DNA, 201 bp, Homo sapiens
ctattctgttcccttgatgtctgtgtatatttttgtactagtaaatgctgtcttagttactatggccttatagtataacttgaaatcaggcaatgtgatgyctcctgttttgttctttttgcatagaagtgttttagctgttcaggctggtttttggttccaaatgaatttaaaaattgctttttctctaattctgttaaa

SEQ ID NO: 33899 - DNA, 201 bp, Homo sapiens
ctgtagcaaaatattttaaaaaggggaagttaagaggggactatttggttgaaagaaaacccacaatccagtgtcaagaaagaagtcaacttttcttcccwatttccctgcatttctcttctgtgctcgctgccacacgcagctcagcctgggcggcacagccagatgcgagatgcgtctctgctgatctgagtctgcctg

SEQ ID NO: 33900 - DNA, 201 bp, Homo sapiens; identical to SEQ ID NO: 6984

SEQ ID NO: 33901 - DNA, 201 bp, Homo sapiens
ccatgacccccatcctcacggtcctgatctgtctcggtgagatttgaagaaggaggggagcttctaacctaagagggacctcaccccacagccaaactctkgtccctaaggagaccccaggggctcacaaagatcccagggaggggaggacctgcccaggcttcagggggcaaatccctcaccgggaactctcttccaggg

SEQ ID NO: 33902 - DNA, 201 bp, Homo sapiens
gttggtatttactcactattttgggtcctcttagtgagtaggcagactccagccctttccattcagccaacttgaacctcagcccacaatcattttcttgrcactttttactcttgggaaatccggtcccaatgtgcttgtctttcatttgagaataattttcattttctccagtagttttaaaattactttgtatctatt

SEQ ID NO: 33903 - DNA, 201 bp, Homo sapiens
cttctctccaggacagttctatgacagagtctccctctcggtgcagccgggccccacggtggcctcaggagagaacgtgaccctgctgtgtcagtcacagrgatggatgcaaactttccttctgaccaaggagggggcagctgatgacccatggcgtctaagatcaacgtaccaatctcaaaaataccaggctgaattccc

SEQ ID NO: 33904 - DNA, 201 bp, Homo sapiens
tcctggtgccagatctaatcctgcagaacttctctgtcctccttcccccggctctcagcatcgtcacggtggacccctccttgtccagcacgctgcctccygcctgctgcgacctcactctctcctgctgtcctgggacctcgtgggcctcctcccgggtccccttcctgctcctcatcctctgtttggccgtctggttgt

SEQ ID NO: 33905 - DNA, 201 bp, Homo sapiens
ctgagtgggaggtgggcagggtccaggggaggcaggggtgggttctgtcctaggttcagtctcctctggaggtggtgatatagacaggctcctcccctgcytgggcctcagtttctccaaatgtaaaggtgagaggcctgcgggtgggaaagttcctttcagctctgactcccagctgtgacctcctgggagaggaggcct

SEQ ID NO: 33906 - DNA, 201 bp, Homo sapiens
tccccagctcttccaggtccctcctcctcactggggacaaggggccacccccgtgccgctggggatggggaatagcagttctgggctgactgatcggggcrtctggagggtcctgggctgagagctggaatctgctgggttgggtgggaaatgagttagaatccgactcctgatttccttccagggcacctccccaagccc

SEQ ID NO: 33907 - DNA, 201 bp, Homo sapiens; identical to SEQ ID NO: 7120

SEQ ID NO: 33908 - DNA, 201 bp, Homo sapiens; identical to SEQ ID NO: 7121

SEQ ID NO: 33909 - DNA, 201 bp, Homo sapiens
atagtgctgctatgaacatgagtgtgcaaatatctctttgacaccctactttatttgtatatatacccagaggtaggattcctggagcatatggtagttcyattttttattttttgaggaacatttatactgttttccatagtggttgcatcattttgcaatcccaacaaggcataagggttccaatttctccacatcctt

SEQ ID NO: 33910 - DNA, 201 bp, Homo sapiens
tataattctatacccactaaacaacaactcccctttaccccctccctccagcccctggcaacggccattctactttctgtttctatgaattagactactttaaatacctcatataagtggagctatacagtatttgtgttgttactggtttatttcacttatcatcatatcctcaaggttcattcatgctgtagcatgtga

SEQ ID NO: 33911 - DNA, 201 bp, Homo sapiens; identical to SEQ ID NO: 7118

SEQ ID NO: 33912 - DNA, 201 bp, Homo sapiens
cccattccatagattgccttttcactctgttgattatgttcgtcaataaattaaagtctgatgtggtcccgttttttctatttttgctttttgttgcctgygcttttggtgtcatttccaagaaatcactgctgagtccaacatcatgaaggtctctccctatgttttcttctaggagttttatggttttaagtctttaat

SEQ ID NO: 33913 - DNA, 201 bp, Homo sapiens; identical to SEQ ID NO: 7119

SEQ ID NO: 33914 - DNA, 201 bp, Homo sapiens
tgttacatgcatagattgcataatggtcaagtcagggctcttaggatgtccatcacctgaataacatacacggtacccattctgtaatttctcatttcacscccctcccaatccctcctttgcccatttttaaattgggttatttgattttttgctgttgttgagttgtaggatttatttatatgttctggatattaaccc

SEQ ID NO: 33915 - DNA, 201 bp, Homo sapiens
taacccagggacagcaggaatatggggaaactgtggcataacaccatagaaaagaccctgtcacccagcatcccattcccaaaaaaagtttggcaggaatygaagttaaactggggaagcagggacccctggaaggttggggtcccaatgggcctcagattggatttttattccttcctgaattcaaactccaaagctaga

SEQ ID NO: 33916 - DNA, 201 bp, Homo sapiens
gccgtgggaccaaaccgtgggtgcccttagccaggatagatgatcgtaaactatgtctatgagtgagccctcctcatcgaaggtgttcatttccatctctstcttcaggacagctacagaacagtacacattttagaatgaaaatgaggagtcactggtaactgcggtacctaaaacataatttgctctgtgcatttcatg

SEQ ID NO: 33917 - DNA, 201 bp, Homo sapiens
atcttaaaaagagacacacatgagaataaccaatctcacattccagtcctgtaatcccagtatgtttgggctactgattctctttttaaaagtggcatctytcatttttaaaagagaaaatcctagatagtgactcctattatcatcaagtaatatatatcaaggccccaaggctaccttgtcacattttactctggcata

SEQ ID NO: 33918 - DNA, 201 bp, Homo sapiens
aggaatcccctttgttccagcaggaaacttgatgcctatccagaagcaaagttcacttggccgccctcaccgtggaaacgtgttgccacaccaaatgaacwtccccctcctgctgtcaaagagcagtcagtggccaccgctattgacctgagctctaattaggctggttttataatgaggaaaagagtgcgattctaatta

SEQ ID NO: 33919 - DNA, 201 bp, Homo sapiens
gccctcaccgtggaaacgtgttgccacaccaaatgaacatccccctcctgctgtcaaagagcagtcagtggccaccgctattgacctgagctctaattagkctggttttataatgaggaaaagagtgcgattctaattagtaaatttccatctctttctcaataggtatcctccagtcaaagcaatcagctatcctcatca

SEQ ID NO: 33920 - DNA, 201 bp, Homo sapiens
atcacactggttccattgccaaaaaaataactgtatcataaaactctagtaaaagtgatgatggttaagacaacaagagagcagaacgaggttttatttgstgctaatgacctgcattctctctcttaggtccgtggcactcaggtagttggttctgacatgactgtgacaattcagtttaccaatcctttaaaagaaacc

SEQ ID NO: 33921 - DNA, 201 bp, Homo sapiens
actgggcacaacatatagaaggcaatggcagccatagcttgcgccatgcatagcctggagtagacaaacctaaatgaactttcttccttctcacttctcayggactcatttaggtgaatgccaaagatgacgaaggtgtcctcgttggatcctgggacaatatctatgcctatggcgtccccccatcggcctggactggaa

SEQ ID NO: 33922 - DNA, 201 bp, Homo sapiens
aggctattggtgtgtatcctttggccagaataaccagccaagcatgtttacagtgatgcagggaatcaatccgttctatgactatttccttaactctccarttagttgctatcctgcccagcaaacacagctgagagaagctgcttaataagaaccaaaatactgagctatttgcatacctgaagaactagtgcaattacc

SEQ ID NO: 33923 - DNA, 201 bp, Homo sapiens
attcaggaaaatctcttactacagtgaggtacagtataggtaaaatcttcctgtcttgctatttgatctttattcctttttaagaaaattctggtattgcytgtggctagcagttctttctaagaagactgaactggtaccagactcctcccttgatagtgtaatctactttctgcagccttctgccctctccttgatcct

SEQ ID NO: 33924 - DNA, 201 bp, Homo sapiens
gtggaggtatgaatatgcttctgtttgaattgatgagtgtgaattacttgagggactttcaggtaaacctgtccaatagataatatgagtctgaagcttcrggaggaggtttgggttggacaggagataatttggatatcatacacacgtgggcaagctcactcagaaaaaggtaaatcaagtcagcagtggactgaggct

SEQ ID NO: 33925 - DNA, 201 bp, Homo sapiens
tgggaggccaagatgggaggatcgcttgaggccaggagtttgagacctagtctctaaaaaataaaaattaaaaattagatgggtgtggtggtgcacacctrtactcccagctacttgggaggctgaagtgggagaattgcttgagttcgggagttggaggttacagtgagcaatgattgtgccactgtactccagcctggg

SEQ ID NO: 33926 - DNA, 201 bp, Homo sapiens
tatttgatctttattcctttttaagaaaattctggtattgcctgtggctagcagttctttctaagaagactgaactggtaccagactcctcccttgatagygtaatctactttctgcagccttctgccctctccttgatcctggggtccaccttgtctcagaagaggggaaaccttagagggacagtcactatatgaggtc

SEQ ID NO: 33927 - DNA, 201 bp, Homo sapiens
tctaaaaaataaaaattaaaaattagatgggtgtggtggtgcacacctgtactcccagctacttgggaggctgaagtgggagaattgcttgagttcgggarttggaggttacagtgagcaatgattgtgccactgtactccagcctgggcaacagagcaagactccgtctttgaaaaaagaaaaaaaacaagctcatgtat

SEQ ID NO: 33928 - DNA, 201 bp, Homo sapiens
aggggtgagactgtcgcccaagtgaaaaagatagcagaagataagaaggaaaactgtttccagaaattgtcaaaagacagccaggtgaacaagattgtggyccgaggtggcacaggatgctgggctgaaaattacagcagcatgcacagcacttattgataggagaatgctcagctgtgctcctgagggcccttcagcctg

SEQ ID NO: 33929 - DNA, 201 bp, Homo sapiens
cagaaaatggttaagattaaaactgttcaatgcactgattcaaatatctttgggtggccttgaagctgctcttagcagagggaaagagacatccagccatktgagtgtcctgagggatgccaatgagaatgaatctgcccagaaaacccaagtctagagccccaggatatctccaggagccctcagatttggcttaatcca

SEQ ID NO: 33930 - DNA, 201 bp, Homo sapiens
tgcactgattcaaatatctttgggtggccttgaagctgctcttagcagagggaaagagacatccagccatgtgagtgtcctgagggatgccaatgagaatsaatctgcccagaaaacccaagtctagagccccaggatatctccaggagccctcagatttggcttaatccattctaataatctgtagatagcatatgcaca

SEQ ID NO: 33931 - DNA, 201 bp, Homo sapiens
ttagagggacagtcactatatgaggtctcctactattttgggtgcaaactaagtagtgtgaagcaccttcctgtgatacacctgagagctctttattttckaaatgcacgaggattcacattactttcgaggtcctaagactctggcctgactttggtaaatgattcattccttcttcttgggtacaggagccaatatgtt

SEQ ID NO: 33932 - DNA, 201 bp, Homo sapiens
aaacctctttttttggagtgaacggtcgtagatacatctgaggacccaggtgctcaatgggcattgtccttggcatttctaaatcaccaaggaactttttygcatttacccatatggattttaatttttgaaaaagttcatctatcaaaacaaatcatgattatgtaataataccttgttaccccattcttgtgtcagatt

SEQ ID NO: 33933 - DNA, 201 bp, Homo sapiens
gagcttctgggtctccaaccctatcagcttttatttaaaagtgttattgtctctttctatgattcatatcaggaatgaaatttctcagtttggaacagcakaaaaaggcagaagcctccggtgttccttgcaacctttccaattgtaacgcatatcaattagtaggagctctcggggtgacaactttgggagaatccactg

SEQ ID NO: 33934 - DNA, 201 bp, Homo sapiens
gccctttgtggtatgcactggtaagatataaggcaggagagaaaatagagaactcgaaaaataattatagatcatcctttaaattgtttttccagaacctrgcctccttttatgtcatgtgatttcctccaaagcttcagtatgtgggtatttgtcttctaacttgccaactatgctaagcagctgcagctctgacctccc

SEQ ID NO: 33935 - DNA, 201 bp, Homo sapiens
atctcagcctcaaataatctttatttaaagtactactaaatcaactagattcgcctttagaatattttcaaaacctgtttggccctatgatacgaatccartgttgttgaagaaaggggcatgtcagctccagagatctctagacgactgctctatggacagttaaagactttggcaacagcagacatgtgatgatggcta

SEQ ID NO: 33936 - DNA, 201 bp, Homo sapiens
acagtgatttctgcatttccatctgaggtatggggttcatctcactagggagtgccgcacagtgggcacaagtcagtgggtgcgtgcactgtgcgcgagcygaagcagggcgaggcattgcctcactcaggaagtgcaaggggtcagggagttccctttccgagtcaaagaaaggggtgacggacggcacctggaaaatgg

SEQ ID NO: 33937 - DNA, 201 bp, Homo sapiens
tcatttacattacagctaagaaagatggcactcatgtggtggaaaatgtggatgccacccacattgggaaattaattgtgaccaaacaaattggaggagayggcatgatggatattactgatacttacaaattccaagaaggtaatttactaccactgaatgaagatttatttgcccaagtccattgagtacttattcatt

SEQ ID NO: 33938 - DNA, 201 bp, Homo sapiens
tgaaaattgcatgcccaacctctccacctccttatcctcctccatgtggctcaatttccaaagcagttcctacctcctcacccctaagtggatttacttayggctcttcttgggctccaccctaaccctatcagactataatctatcagagcaaacattctgttttgttctctgatgtatcccatgtacctagatcacagc

SEQ ID NO: 33939 - DNA, 201 bp, Homo sapiens
cgaccatttctgtagggcgtggagtaaaactagggttggtttgaccagcactttcatcatttaatccttaaagacaccctacgatgtagatactgctattrtctcccttctgtagctgaggaatttgaggctttgagaggttgactggttacacaggttcagttacacagtttatgaaaacagagccaagattcagactca

SEQ ID NO: 33940 - DNA, 201 bp, Homo sapiens
attcatataggactgtaattccaggaggaaactagtggcaaaaactgagctgaggctcagaagatcagtcacatagataaggctactatggagggcttggrgacaagctagagttcagttgattaatggttggatgggaatcagcccagctcctgatggccactgggaggctggcggatgcatcccagtggaaggaaccat

SEQ ID NO: 33941 - DNA, 201 bp, Homo sapiens
catatcaggaatgaaatttctcagtttggaacagcagaaaaaggcagaagcctccggtgttccttgcaacctttccaattgtaacgcatatcaattagtargagctctcggggtgacaactttgggagaatccactgatttatattaatgaagagtgttactgtagtccaacagagtaaagtactaaattaccaactctaa

SEQ ID NO: 33942 - DNA, 201 bp, Homo sapiens
attgtagtgggccaaatatgctcatagtttctctttgactgcagaatctttatagaaagaatgatagactatatcctgtgtaatccatcacttaacacccraagaaatagagggttacagtaaaaatatagagaaaaaagccattttcttttcagccaccacattttaaaaaaactaaaacagttaaaactaaaataataa

SEQ ID NO: 33943 - DNA, 201 bp, Homo sapiens
ttctctttgactgcagaatctttatagaaagaatgatagactatatcctgtgtaatccatcacttaacacccgaagaaatagagggttacagtaaaaatayagagaaaaaagccattttcttttcagccaccacattttaaaaaaactaaaacagttaaaactaaaataataaataacaaaagatatatattgcttattta

SEQ ID NO: 33944 - DNA, 201 bp, Homo sapiens
gtccattgagtacttattcattgtcactcagagatgagttccagagaatgcactggcatttgcagcatttggtagcaacagcagaagtataaactttcacrtgtgaaagacacgtcacatatgcaatttttcattgtagttttctttgctagcttgctttgggcagaattctcattcacgtggcttgtaaaatgatttggt

SEQ ID NO: 33945 - DNA, 201 bp, Homo sapiens
agcagaagtataaactttcacgtgtgaaagacacgtcacatatgcaatttttcattgtagttttctttgctagcttgctttgggcagaattctcattcacstggcttgtaaaatgatttggtttaaagtcatacctaatttaacagaatatagaatatgttcttgctcacaagaaccttaattttaaataatcctattaga

SEQ ID NO: 33946 - DNA, 201 bp, Homo sapiens
ctgtgtctgagcacttattaatggttttgactatcactcctactacacatacacctcatagtttaatggtggaagctacagcacctgtccaagtgcacccygccatctgcaaccccctccattgaggtctcttgtgctatatcagactgtatttacacgtgacttctcagtgagacttgcaaaaccccttgccttcacagg

SEQ ID NO: 33947 - DNA, 201 bp, Homo sapiens
tcagatgcaagaatcgttcaggcaaagtgaaacacgtttcctcttccatacagccccctgctgtatccaactttttccttcccagacagtaaacccacaarctttatctgagtgtaccggaaacttctctatctttacaccttggctatccccctagaattccaccttggtcaaggccaacacatgaaaaaagacactgtg

SEQ ID NO: 33948 - DNA, 201 bp, Homo sapiens
aatagaaattaaaataactacttcacatttgtttagtactttaccaattatttccacatacattgttctattacattatcatggaagactacaacgtagayaatacaatattaataggacaatgcaatctctctaactcaggacaattaggtcgaaggccagtttcaattccaaaataatgtcatggtgggtttttgttaa

SEQ ID NO: 33949 - DNA, 201 bp, Homo sapiens
ggcatctaagaaagtaggacagtgtttcccagagtgtgttctctatgaacacctgtcatgtgagattctccttgggggaaaaaagttccatcatcaaatayagttggatcatgctgtgttttgtgtctcttctcatagaggcccaaggcacattaatatataaaaggctatgagtagacacgtagtcaaaaaatgaatctt

SEQ ID NO: 33950 - DNA, 201 bp, Homo sapiens
ctaataatggcatctaagaaagtaggacagtgtttcccagagtgtgttctctatgaacacctgtcatgtgagattctccttgggggaaaaaagttccatcrtcaaatacagttggatcatgctgtgttttgtgtctcttctcatagaggcccaaggcacattaatatataaaaggctatgagtagacacgtagtcaaaaaa

SEQ ID NO: 33951 - DNA, 201 bp, Homo sapiens
ttcttgggtaactactgggctccagacgctgttcttaaagcactttacatggttgcattttcaaccaccaacaaccccacaaggtaaagagtactggcatyactttacagatgagaaaactgaagcacagagaggttctataactcctccaaggccatacagccagcaaatggcggagctgggcttccaaccccagcaggc

SEQ ID NO: 33952 - DNA, 201 bp, Homo sapiens
ggagtcactggtaactgcggtacctaaaacataatttgctctgtgcatttcatgtttgctatttttttgaatcttaaaaagagacacacatgagaataacsaatctcacattccagtcctgtaatcccagtatgtttgggctactgattctctttttaaaagtggcatctctcatttttaaaagagaaaatcctagatagt

SEQ ID NO: 33953 - DNA, 201 bp, Homo sapiens
ttccaggaggaaactagtggcaaaaactgagctgaggctcagaagatcagtcacatagataaggctactatggagggcttggagacaagctagagttcagytgattaatggttggatgggaatcagcccagctcctgatggccactgggaggctggcggatgcatcccagtggaaggaaccatgacccaataagactgtca

SEQ ID NO: 33954 - DNA, 201 bp, Homo sapiens; identical to SEQ ID NO: 7122

SEQ ID NO: 33955 - DNA, 201 bp, Homo sapiens
atagaaagaatgatagactatatcctgtgtaatccatcacttaacacccgaagaaatagagggttacagtaaaaatatagagaaaaaagccattttctttycagccaccacattttaaaaaaactaaaacagttaaaactaaaataataaataacaaaagatatatattgcttatttatcattgagaagttgtataaatat

SEQ ID NO: 33956 - DNA, 201 bp, Homo sapiens; identical to SEQ ID NO: 7123

SEQ ID NO: 33957 - DNA, 201 bp, Homo sapiens
ctgtgtaatccatcacttaacacccgaagaaatagagggttacagtaaaaatatagagaaaaaagccattttcttttcagccaccacattttaaaaaaackaaaacagttaaaactaaaataataaataacaaaagatatatattgcttatttatcattgagaagttgtataaatatgcgtatttatttattattgagaat

SEQ ID NO: 33958 - DNA, 201 bp, Homo sapiens
aaaataatgtcatggtgggtttttgttaacttttattgcatagaatgtttcaaatggcactactgagtttaattctatctcaatcaatgcttagtgtccgstctatgcctgcaattggtttggtgctggcgattccagcagtgagcaggactcagttcctgtcctggtccgagtgacaggattattgtgcagaggggtctt

SEQ ID NO: 33959 - DNA, 201 bp, Homo sapiens
aattctatctcaatcaatgcttagtgtccgctctatgcctgcaattggtttggtgctggcgattccagcagtgagcaggactcagttcctgtcctggtccragtgacaggattattgtgcagaggggtctttggaaacaataagtaggggcatttagtccaactgattcagaaaaagacttgagaagagaagtcgtggacc

SEQ ID NO: 33960 - DNA, 201 bp, Homo sapiens
tgactttgcagaatttataacataggaataatgacggcaccctcctcctggggaggtctgaagcttgtattatagaaacaccccaacaagtgcagtacacrgtgcatccattaatgtgactttctctctggtggattgtatttttgcctgtcattatctctggatctcccccaggtcaagaagaagagagattggccctag

SEQ ID NO: 33961 - DNA, 201 bp, Homo sapiens
gattatacaggaaagttttacttatcactgccttagtttttccccacttatagtaccactgtgattttatgtttttcctgaggcattggcttgttgaagtkatattgcaacagagaatcaaaagatcacttagaaaaagtaacatgttagaaaacatcatgcttagaattaaatgtctaaagtataccagtatagatgata

SEQ ID NO: 33962 - DNA, 201 bp, Homo sapiens
attaatcagcaccctttttctcaccctttgttatcaacatataagcaggctagaaagacagtattttattccaatgtgaaacaaaactgctgatctggagktcttatgttataaattcccacatcataccttcaactatatatatgtcctgaaactagcatattttgagaataaaatgggaaatgacatttaaaggacacc

SEQ ID NO: 33963 - DNA, 201 bp, Homo sapiens
ggagcctcacctcaggggggctacagttttgcacagagcggccccactgttgacgccaacagaggccatggtctgagctccttagctgttcaggagagggmtggggactcaggaacctcagaagggcagagcagggcagagtaattagatcccagggtagcaaatgaaaccccaagtgggcaaatgcaaagtagcagatcc

SEQ ID NO: 33964 - DNA, 201 bp, Homo sapiens
gccaccacattttaaaaaaactaaaacagttaaaactaaaataataaataacaaaagatatatattgcttatttatcattgagaagttgtataaatatgcrtatttatttattattgagaattttataaatatatccacttaatttttatcccagttatggaaggtattatagcaggtggtctcatattcatttttccaca

SEQ ID NO: 33965 - DNA, 201 bp, Homo sapiens
catataaagaattgtaggcctttataaggcctttggtttttattttgagtgagctgaggagcctttagagagttttgagcagaaatgtggcataatctaasttaggttttgaaaagaccactggctgctgtgttgagaagagactaaagaggaagtagggcggaaggttagagactggtaggatgcttctgcaatcactcc

SEQ ID NO: 33966 - DNA, 201 bp, Homo sapiens; identical to SEQ ID NO: 7134

SEQ ID NO: 33967 - DNA, 201 bp, Homo sapiens; identical to SEQ ID NO: 7137

SEQ ID NO: 33968 - DNA, 201 bp, Homo sapiens; identical to SEQ ID NO: 7139

SEQ ID NO: 33969 - DNA, 201 bp, Homo sapiens; identical to SEQ ID NO: 7142

SEQ ID NO: 33970 - DNA, 201 bp, Homo sapiens; identical to SEQ ID NO: 7143

SEQ ID NO: 33971 - DNA, 201 bp, Homo sapiens
tctgtaactgtaaatcccaaagatgcttaacttatatagagttttctcacccctgaatctgttatcacagagtctctgttcctgggttctttgtttgactyagcccctaattattttgatatcactttcaagtattaatagtttggttatgataggtaccatattccctgaagtacttcatgttcgacaatgtgtgtaaaa

SEQ ID NO: 33972 - DNA, 201 bp, Homo sapiens
ggccaacctcttcccatcttccccttcatgttctcctcctcagtctctggtaaccactgttctgctctttgcttctatggtataataatttttttttttttagtgtctacatgtgagtgaaatcatgtagtatttgtctttccatgtctggtttatttcacttaccatgatgcccttcctccaagtctaattcatgttgtt

SEQ ID NO: 33973 - DNA, 201 bp, Homo sapiens
tctcttttccatctgatggtttgcaaatgtttgcaaacagctgtctcatcttccttgaatcttttctacctggggacaaatatctgtcctgactttatttycctctcctctaacatggtttcagctctctctctctctctcccacacattccaatttgtcactactcctcttaaagtgtgacacccagaatggatcccaat

SEQ ID NO: 33974 - DNA, 201 bp, Homo sapiens
tccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttcaa

SEQ ID NO: 33975 - DNA, 201 bp, Homo sapiens
atccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttca

SEQ ID NO: 33976 - DNA, 201 bp, Homo sapiens
tatccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttc

SEQ ID NO: 33977 - DNA, 201 bp, Homo sapiens
caacagccacaaccgttacaccatcacagcttatctctcagccaacatcaccttctacaccggggtcccgaaggcagaattcaagaaggagacgttcgacrtgacgctggagcccttgtcctgtaagctaacaatggtgtggttctttgtgagactcgctgtctggcccctgtcttgctaggtgttaatgcccgttatagc

SEQ ID NO: 33978 - DNA, 201 bp, Homo sapiens
aatgtcatcatttacagactgaatttggtgctgattatgttcaccattactaaaaatattgggaaatgagctatgcttggtgaaacaaagggcattttttwaaaatttggctgattaaatgtagtttagaaacaaaataaacttgcataaacttgcaagtgtttggaaacagtctggtttggtaatagtcactatgtttaa

SEQ ID NO: 33979 - DNA, 201 bp, Homo sapiens
gaccgcctttggaggcagaagagcagttccacccaataactctaatgcagcggaagatgacctgcccacagtggagcttcagggcgtggtgccccggggcrtcaacctgcaaggtatgagcataccccccttccccaccactctgggtccaggcacagccgggccctggcccctcttccctgcaggtaaacatcctctgtc

SEQ ID NO: 33980 - DNA, 201 bp, Homo sapiens
gttgatgagagtggaagataaatgtgggagcctctgtgctcctacttctcaggcccacagctgtagcttctgggggcatctgtggttgcatccatgagacrccttcctgccctggaagcaggaacccaggcttctggcagtgaccctgaggagtgacatctcatgcagcccttatccaggtcttagagcccttccctagtc

SEQ ID NO: 33981 - DNA, 201 bp, Homo sapiens
ctggaatctgtgggataaatgcaaggcctcacttataccctctggggcaactttattgcccataaagggctctccgcatttctttcaaattacaatgctcrtagcttctgcatctcatcatttaagagatgccttattgcagatgcaataaacaacagagaaaataatcttagtgcttttgaaacaacgcaagcacaaaac

SEQ ID NO: 33982 - DNA, 201 bp, Homo sapiens
tacacataaaagtttcttcttgaactaaccttctctaaattgcctgaaggctccctttatttaaggttttatgagagcaagaaaatgaaaaatatgactgygaaaatgaaatgaaaatatgactatgcagatatggaattatgctttcagcaataaggaaaagggagctttgcagattcctaaaataatgtgatgcaaaca

SEQ ID NO: 33983 - DNA, 201 bp, Homo sapiens
cgtcctcaactgatggtttagcgataacttaaaaggtgatgctgcaaatgattctttgctggatttcagaaaataaagaagctattccagcaaaaaaaaaagtttctatttttacctgtattctgtcagggatcacagtatatgtagttttgaagatgaatgttttagagtcagaaagacctggatttatatccaacttcc

SEQ ID NO: 33984 - DNA, 201 bp, Homo sapiens
ttgagatataatgagtgccccaaacaaagtacatgacagtgactggctacactgtgagacttaactgtagtttcatttagtgctgtaaatatcacaaacttcattaaggtggaaaatgggaacagactatgtgttctaattattgctgaaccctgaccattttcccctccatgtccacaaccgagcacgttctctctccag

SEQ ID NO: 33985 - DNA, 201 bp, Homo sapiens
taaattgtagcaaatgcctagagctttcaaaaccattatcagagaggccgggtgcagtggctcacacctgtaatcccagcactttggaaggccaaggtggstggatcacttgaggtcaggagtttgggatgaacctgaccaacatggtgaaaccctgtttctactaaaaataaaaaattagccaggctgtagtggtgcgtg

SEQ ID NO: 33986 - DNA, 201 bp, Homo sapiens
cctgaactcaggaggtggaggttgcagtgagccaagatcgtgccactgcactccagcctgggggacagagcaagacttcatctcaaaaaaaaaaaacactrtagtgttttctttggaaactaaaagctttggcacttttcctattcctagggtagtaaaggtaattttcatggaaaagaatagtcagtgtaaaggactgaa

SEQ ID NO: 33987 - DNA, 201 bp, Homo sapiens
tgtggagcatggatctaaatgatccatctcagaaacaggccctctgctggtgcctctcgcccaagttaggaaagtcttttgggggctgtccagaatgaatrgtgtgctttgctttcccattcaaaaagatacacgcgctgacataggccgcttcttaaaacgctgtctcctgtaatctcagcactttgggaggctgaggtt

SEQ ID NO: 33988 - DNA, 201 bp, Homo sapiens
tgcgatgatcttggttcactgcaacctttgcctcctgggttcaagcaatcctcctgcctcagcctcccgagtagctgggattacaggcacatgccaccacrccaggcaaatttttgtatttttagtagagacgggatttcactatgttggccaggctgatctcaaactcctgacctcaggtgatccacccacctcggcctg

SEQ ID NO: 33989 - DNA, 201 bp, Homo sapiens
tggagtgcaatgcgatgatcttggttcactgcaacctttgcctcctgggttcaagcaatcctcctgcctcagcctcccgagtagctgggattacaggcacrtgccaccacgccaggcaaatttttgtatttttagtagagacgggatttcactatgttggccaggctgatctcaaactcctgacctcaggtgatccaccca

SEQ ID NO: 33990 - DNA, 201 bp, Homo sapiens
agaacccactcattctgcaaaagcctccactttctttttttttatttttattttttgagatggaatctcgctctgacacccaggctggagtgcaatgcgaygatcttggttcactgcaacctttgcctcctgggttcaagcaatcctcctgcctcagcctcccgagtagctgggattacaggcacatgccaccacgccagg

SEQ ID NO: 33991 - DNA, 201 bp, Homo sapiens
acttcatccattctatctagagacacgataaactgaccatttgtgctcatctgaggctgtaaccaatagagggccagaacctcactcatctaaacaattawttgcaaggggagccatggaggaagcagggtccaggcttaggtccaaagacagcaatacgagagcgggtcattccaaaaggcaggacctgggggccaaggt

SEQ ID NO: 33992 - DNA, 201 bp, Homo sapiens
caggagatatgtttggaagctgtagagatactccaggctagaagaggaatagaccagagggattttagcccctggaggtatggggctcatttctcttgttscagcttcctctgagcacctgagcaatccttcaacattataggttccaggatgtattaataacaacactttataaattaagccacttaagaaaatgctttt

SEQ ID NO: 33993 - DNA, 201 bp, Homo sapiens
tgagagtggaagataaatgtgggagcctctgtgctcctacttctcaggcccacagctgtagcttctgggggcatctgtggttgcatccatgagacgccttyctgccctggaagcaggaacccaggcttctggcagtgaccctgaggagtgacatctcatgcagcccttatccaggtcttagagcccttccctagtctctgg

SEQ ID NO: 33994 - DNA, 201 bp, Homo sapiens
gagcctccaccaaggagatggtggaggtatgaatatgcttctgtttgaattgatgagtgtgaattacttgagggactttcaggtaaacctgtccaatagayaatatgagtctgaagcttcgggaggaggtttgggttggacaggagataatttggatatcatacacacgtgggcaagctcactcagaaaaaggtaaatcaa

SEQ ID NO: 33995 - DNA, 201 bp, Homo sapiens
gtgagggtaggtagtccttgcttctcgtgaatcctttgctgtgagtcatttggaaagccaatgactgctgtgcagcattcagaatggcagtgtttcttggrtaactactgggctccagacgctgttcttaaagcactttacatggttgcattttcaaccaccaacaaccccacaaggtaaagagtactggcatcactttac

SEQ ID NO: 33996 - DNA, 201 bp, Homo sapiens
ctacctatgagtcctgagggactctgagcaaggaaagcctgcttaccccaggggaccctaggaggggacaccttcagccctgctcccatagctgactctcsatcccctcgtggctactttcacagaggattgtggccgtgggaccaaaccgtgggtgcccttagccaggatagatgatcgtaaactatgtctatgagtgag

SEQ ID NO: 33997 - DNA, 201 bp, Homo sapiens
gggagaacccactcattctgcaaaagcctccactttctttttttttatttttattttttgagatggaatctcgctctgacacccaggctggagtgcaatgmgatgatcttggttcactgcaacctttgcctcctgggttcaagcaatcctcctgcctcagcctcccgagtagctgggattacaggcacatgccaccacgcc

SEQ ID NO: 33998 - DNA, 201 bp, Homo sapiens
gggccaatattcaacattcttaaagaaaagaattttcaacccagaatttcatattcagccaaactaagcttcataagtgaaggagaaataaaatactttayagacaagcaaatgctgagagattttgtcaccaccaggcctgccctaaaagagctcctgaaggaagcgctaaacatggaaaggaacaaccggtaccagccg

SEQ ID NO: 33999 - DNA, 201 bp, Homo sapiens
aacagcggatctctcggcagaaactctacaagccagaagagagtgggggccaatattcaacattcttaaagaaaagaattttcaacccagaatttcatatycagccaaactaagcttcataagtgaaggagaaataaaatactttacagacaagcaaatgctgagagattttgtcaccaccaggcctgccctaaaagagct

SEQ ID NO: 34000 - DNA, 201 bp, Homo sapiens
aaaagcaaggctcaagacctacgtgaagaatgcagaagcctcaggagccgatgcgatcaactggaagaaagggtatcagcgatggaaaatgaaatgaaagmaatgaagcaagatgggaagtttagagaaaaaagaataaaaagaaaccagaaaagcctccaagaaatatgggactatgtgaaaagaccaaatctacgtctc

SEQ ID NO: 34001 - DNA, 201 bp, Homo sapiens
gtaggtctttaagggtccccaggtgattgtgatatagagccatgactgagaactcttcaatcagaagtcctggaagcaaggcacagcacttacgcatctgyaaagagacttccaaatagaagtgctgcccaagacagaggctttcccagcctcttggtcttcaaggtccagagcaagctgctgcagatccatcgcaggtgt

SEQ ID NO: 34002 - DNA, 201 bp, Homo sapiens
aaaactctttcaagaatgaacaaaacctggggtcgcctatggctctgcccccctacttaatgccaacatcaaatacctgttgcgtctacttcctgcttccrctggcacccctccacttaccttcccccgagagtcagtcaaagacaccatcatgcctcccttgagcacttcagcaccctctgactggtttccttgctccac

SEQ ID NO: 34003 - DNA, 201 bp, Homo sapiens
agtgaataagttttgctcttgaaggttctcctgcttacaatcaaagtaatttgcagacttgcctgatttgtatgtttcttcaagtcaagaataattctaakggattactcctgtcccttcagctataagataacagagtgagaacaaaaatggcttgtgaaatcaacctaacagagtatttcttctctcttctcataggtc

SEQ ID NO: 34004 - DNA, 201 bp, Homo sapiens
caagtgtttggaaacagtctggtttggtaatagtcactatgtttaaaccctgatgcagatgatgctgtgtatctggacaatgagaaagaaagagaagagtwtgtcctgaatgacatcggggtaattttttatggagaggtcaatgacatcaagaccagaagctggagctatggtcaggtgagccacttaaaatttgttatt

SEQ ID NO: 34005 - DNA, 201 bp, Homo sapiens
atggaatctggtggtcacagggtactttcttggctccggatgccttgctttgacttccatatgggatctccctgtgttccttacccactgctccagtaccygtgttatcctgcctacctggctttgtgaacagcttccctgactccggagaattacatgcccagtgctcaggcttccccgcctgcatttctaatgtcctgc

SEQ ID NO: 34006 - DNA, 201 bp, Homo sapiens
tgaaaagcaaggctcaagacctacgtgaagaatgcagaagcctcaggagccgatgcgatcaactggaagaaagggtatcagcgatggaaaatgaaatgaawgaaatgaagcaagatgggaagtttagagaaaaaagaataaaaagaaaccagaaaagcctccaagaaatatgggactatgtgaaaagaccaaatctacgtc

SEQ ID NO: 34007 - DNA, 201 bp, Homo sapiens
actctagaaagaagagcgcctctcctcctccaaaggaacgcagttcctcaccagcaaaggaacaaagctggacggagaacgactttgacgagctgagagamgaaggcttcagacgatcaaattactctgagctacgggaggacattcaaaccaaaggcaaagaagttgaaaactttgaaaaaaatttagaagaatgtataa

SEQ ID NO: 34008 - DNA, 201 bp, Homo sapiens
gggaaaaaacagagcagaaaaactggaaactctagaaagaagagcgcctctcctcctccaaaggaacgcagttcctcaccagcaaaggaacaaagctggayggagaacgactttgacgagctgagagaagaaggcttcagacgatcaaattactctgagctacgggaggacattcaaaccaaaggcaaagaagttgaaaac

SEQ ID NO: 34009 - DNA, 201 bp, Homo sapiens
actgcctcctcaagtgggtccctgacccctgacccccgagcagcctaactgggaggcaccccccagcaggggaacactgacaccttacacagcagggtatwccaacagacctgcagctgagggtcctgtctgttagaaggaaaactaacaaacagaaaggacatccacaccaaaaacccatctgtacatcaccatcatcaa

SEQ ID NO: 34010 - DNA, 201 bp, Homo sapiens
gaaggggcagactgcctcctcaagtgggtccctgacccctgacccccgagcagcctaactgggaggcaccccccagcaggggaacactgacaccttacacrgcagggtattccaacagacctgcagctgagggtcctgtctgttagaaggaaaactaacaaacagaaaggacatccacaccaaaaacccatctgtacatca

SEQ ID NO: 34011 - DNA, 201 bp, Homo sapiens
atgcagctggagatctgagaaggggcagactgcctcctcaagtgggtccctgacccctgacccccgagcagcctaactgggaggcaccccccagcaggggmacactgacaccttacacagcagggtattccaacagacctgcagctgagggtcctgtctgttagaaggaaaactaacaaacagaaaggacatccacaccaa

SEQ ID NO: 34012 - DNA, 201 bp, Homo sapiens
cattgcctcactcgggaagcacaaggggtcagggagttccctttcctagtcaaagaaaggggtgacggatggcacctggaaaatcgggtcactcacacccraatactgcgcttttccgacgggcttaaaaaacggcgcaccacgagattatatcccgcacctggctcggagggtcctacgcccacggagtctcgctgattg

SEQ ID NO: 34013 - DNA, 201 bp, Homo sapiens
atgagtgacgcagaagactggtgatttctgcatttccatctgaggtaccgggttcatctcactagggagtgccagacagtgggcacaggtcagtgggtgcrcgcaccgtgcgcgagccaaagcagggtgaggcattgcctcactcgggaagcacaaggggtcagggagttccctttcctagtcaaagaaaggggtgacgga

SEQ ID NO: 34014 - DNA, 201 bp, Homo sapiens
cagcaatccaggtaagacaaaatccacatacacacacccaaccatggtcttaccctggcctttgcaatctatgtcctgccatcccacaccatcacctgtggccagggagggagggttgagttgccaaaggaggaaggggagcctggaggctactctaagagaggaatacagcccacctacagggttgatgggaatgcctgg

SEQ ID NO: 34015 - DNA, 201 bp, Homo sapiens
ctgttggatttggaggctggcaagctgtggacagcaccccccaggaaaatagcgatggtaaaactgtgtcctccctctgggaacttgcttcattgctgatytttgttttgcttttatgcttgcatttgatgtgtgggaaccacgcccattgggaggcaacatctgaagtgtgcttcctgggcacatgtacagtattagcta

SEQ ID NO: 34016 - DNA, 201 bp, Homo sapiens
gtcaggaagaaagtcccctacaagaagggttttttcactctgtgtttattaaatgctggtgatgtgtttagctgtggtctgtcctttcctgtagttttacratgccttggaataccagcaagaattgttaccaattatttctctgcccatgataatgatgccaatttgcaaatggacatcttcctggaagaagatgggaac

SEQ ID NO: 34017 - DNA, 201 bp, Homo sapiens
gtgttttctaaggaactaccactgctggaatgaagcatggatgacaaggcctgaccttcctgttggatttggaggctggcaagctgtggacagcacccccyaggaaaatagcgatggtaaaactgtgtcctccctctgggaacttgcttcattgctgatctttgttttgcttttatgcttgcatttgatgtgtgggaacca

SEQ ID NO: 34018 - DNA, 201 bp, Homo sapiens
tacagagtcaccctcagtgccatgaatcttgcagtatctggacagaattggagatgacaaactcacaccgcccttcctctgtgcaatgcaggcatgtatcrgtgtggccccgcctcggttcaagccatcaagcacggccatgtctgcttccaatttgatgcaccttttgtttttgcagaggtaagcaggaagctggaggaa

SEQ ID NO: 34019 - DNA, 201 bp, Homo sapiens
cagccagaaacagaatgagagtggcaatcgttttattgataagaccctgggtgaacagggctgaaaatcaagaaaggaaaatgggaacgggaggcccgtgrcagctgccactgttgtttggggcattaagatcaagtcctttaaggagggggacccttgaatctctaccagactccagtttggacttccaaggttgttctg

SEQ ID NO: 34020 - DNA, 201 bp, Homo sapiens
tgataatgatgccaatttgcaaatggacatcttcctggaagaagatgggaacgtgaattccaaactcaccaaggattcagtgtggtgagtttgattgacartggcattggctgatgtcacattatagtaatgttacacatttaccacaagatagactcaatctgatgtttctgttctattttgaggaccattcaacagcac

SEQ ID NO: 34021 - DNA, 201 bp, Homo sapiens
cctcttcctcctggcagtaggtcacatagccacagttagcccaaaagaagtccagggaagcaagcgatgggcatggtggcatggcattgtcttctctcctrtgagaggtaggacttatcacaaggacagaggagggagaaaaatggttgcttcttagacagtttattatctcagcctcaaataatctttatttaaagtact

SEQ ID NO: 34022 - DNA, 201 bp, Homo sapiens
gtgtcactcaatccacgagagttgtgtgtttcaagaggaaagcatgaccaatgttattaaatataactaggagatgcagtgagataggaacttcccactggagtcaacagttgggggacactggttgaactcgggtagattccaaattttaatggtctaaaagtcaaggagatgtgaggaaatgggtgtagtcaatttgga

SEQ ID NO: 34023 - DNA, 201 bp, Homo sapiens
cggggtttcaccaagttcgccaggatggtctcgatctcctgacctcgtgatctgcctgccttggcctcccaaggtgctaggattacaggcgtgagccaccragcccggccgtcctccatacattttttatctttgagcttgtcatttactgagtcttcacaatgtgccaacagtgtgctctgtgtttgcattagttttatg

SEQ ID NO: 34024 - DNA, 201 bp, Homo sapiens
ctgtcaccaggctgaagtgcagtggcacaatctcagctcactgtaacctccatatcccagattcaagcgattctcctgcctcagcctcccaagtagctggractacaggcacccgccaccacacccagctaatttttgtatttttagtagagacagggtttcatcatgttggcaaggctggtcttgatgtcttgaccttgt

SEQ ID NO: 34025 - DNA, 201 bp, Homo sapiens
ctggtgtgtagtgggtacatagtgaaattaatatctcttgaaccaatcaaaaatgggctgcactcagagaaagatgggagcatgggcaaacagctgacatygaagggcgtctaggcacggaacccgtggtagttgaacctgaaattcatcagtgtcataaacaaagactgctgtaactacctcaccacattattaaatctt

SEQ ID NO: 34026 - DNA, 201 bp, Homo sapiens
aacagacttccctgcattgcattacatgctagcccctgccctatcttttcttctgtcttacaacctagatcacttttttttttttttttttagacagggtytcactctgtcttccaggatggagtgcagtggtgcaatcatggctcactgcagccttgatctcccgggctcaagtgatcctcccactcagcccctcaagta

SEQ ID NO: 34027 - DNA, 201 bp, Homo sapiens
cagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaaa

SEQ ID NO: 34028 - DNA, 201 bp, Homo sapiens
ccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaa

SEQ ID NO: 34029 - DNA, 201 bp, Homo sapiens
cccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaa

SEQ ID NO: 34030 - DNA, 201 bp, Homo sapiens
acccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaa

SEQ ID NO: 34031 - DNA, 201 bp, Homo sapiens
gaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaa

SEQ ID NO: 34032 - DNA, 201 bp, Homo sapiens
ggaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacacta

SEQ ID NO: 34033 - DNA, 201 bp, Homo sapiens
tgcttgacaggtctcagtttctgtgacttctactaacaaagagtgtgacccaacaagataacccattccatggtcaggtagctctaacagtaaggaaacakgtttttctaccatttgatcctgccaatgatcctaattctgccatctggactgacagaaagtaaggcccatctcttttccatctgatggtttgcaaatgtt

SEQ ID NO: 34034 - DNA, 201 bp, Homo sapiens
gatgaatggtctccaatgaacagataacgttcaaccagtagagatggatggagagaccccttcagatactaggaagaaaatgttagcaagggctagagggraggtggacggcagtatgtagagcagtgagaagcgtgccttggctggggtggaggctgggagcagggatgagtaagggtaacctgaaaaagatagcttgag

SEQ ID NO: 34035 - DNA, 201 bp, Homo sapiens
ctgtcacaaggatgtgtcactgtagggctttctcacttacgaagtgggtattgattctttgcaggatcctgtgtggtaagtagggcagccattactcatgsacttttacaagttaggacacagggtaaggacagctttcagtgacaaagccacagctagaactccggtctgctgacttcaaatctagacattttctacttt

SEQ ID NO: 34036 - DNA, 201 bp, Homo sapiens
agaggacaggtctgtgcggctgtccatccagtcttcccccaaatgtattgtggggaaattccgcatgtatgttgctgtctggactccctatggcgtacttygaaccagtcgaaacccagaaacagacacgtacattctcttcaatccttggtgtgaaggtaagaggcagacatttagttttctcatttaaaaattcaccta

SEQ ID NO: 34037 - DNA, 201 bp, Homo sapiens
catttgaccagtagttttcatgatgcctctccagtgatcaccagaaatctctgcccaaatggctcaagagacttggcagaggaaggccgagggttgatgakagtggaagataaatgtgggagcctctgtgctcctacttctcaggcccacagctgtagcttctgggggcatctgtggttgcatccatgagacgccttcctg

SEQ ID NO: 34038 - DNA, 201 bp, Homo sapiens
caaagcagctactccattctgtattcccactagcaatacacaaaagttccaacttcatattcttgcaaataacttttattttctgttttttttttttttttaattattattgtagccatcctaatgggtgtgaagtggtatttcatggtgggattaattttcatttctctaatgaccaatgacgttgaacatctttttgtg

SEQ ID NO: 34039 - DNA, 201 bp, Homo sapiens
actgtattcctctagcctgggtgacagagtgagacttggtctcaaaaataaataaataaaaataattaacatccttattaaaatatgcttcacggcctggygaggtggctcacacctgtaatcccagcaatttaggaggctgaggcaggtggatcacaaggtcaggagatcaagaccatcctggctaacacagtaaaaatc

SEQ ID NO: 34040 - DNA, 201 bp, Homo sapiens
atcaggagtttgagaacagcctgaccaacacggtgataacctgtctctactaaaaatacaaaaaaattagctgggcgtggtggtgcatgcctgtaatcccygctacttgggaggctgaggcaggagaatcacttgaacctgggagacagaggttgcagtaagccaagatcatgccactgtattcctctagcctgggtgaca

SEQ ID NO: 34041 - DNA, 201 bp, Homo sapiens
atcccagcactttgggaggccgatgcaggaggatcacttgagatcaggagtttgagaacagcctgaccaacacggtgataacctgtctctactaaaaatasaaaaaaattagctgggcgtggtggtgcatgcctgtaatccccgctacttgggaggctgaggcaggagaatcacttgaacctgggagacagaggttgcagt

SEQ ID NO: 34042 - DNA, 201 bp, Homo sapiens
agaacctgaattacaaacccaagggggctgaccccagagcccactctttttaaaatgacatccttattgactgggcgtggtggctcacacctataatcccwgcactttgggaggccgatgcaggaggatcacttgagatcaggagtttgagaacagcctgaccaacacggtgataacctgtctctactaaaaatacaaaaa

SEQ ID NO: 34043 - DNA, 201 bp, Homo sapiens
caatgccctgatttaagtgctgacatgtattaatttacttctacctcttaacagcatgttaaggtaattactgttagtggcacggtaacttaaccaaggtyccagccaataagtggcagaacctgaattacaaacccaagggggctgaccccagagcccactctttttaaaatgacatccttattgactgggcgtggtggc

SEQ ID NO: 34044 - DNA, 201 bp, Homo sapiens
aaattcagaatgtagaccaaattgcttaaagatgcttaagggtttgtaaaaatatcccatgatgcattgcagttgccaattctggacagttatcagagatkcttattttcaaacattttcttgttaaccatatttctggccaagttggttttaggaaaatcacctggagttagaccatgagccttagcattagaggactga

SEQ ID NO: 34045 - DNA, 201 bp, Homo sapiens
gatctttgttggtttaaagtctgttttatcagagactaggattgcaacccctgcctttttttgttttccatttgcttggtagatcttcctccatccttttrttttgagcctatgtgtgtctctgcacgtgagatgggtttcctgaatacagcacactgaagggtcttgactctttatccaatttgccagtctgtgtctttt

SEQ ID NO: 34046 - DNA, 201 bp, Homo sapiens
atatgcggtgtttggttttttgttcttgtgatagtttactgagaatgatgatttccaatttcatccatgtccctacaaaggacatgaactcatcattttttatggctgcatagtattccatggtgtatatgtgccacatattcttaatccagtctatcatttgtggacatttgggttggttccaagtctttgctattgtga

SEQ ID NO: 34047 - DNA, 201 bp, Homo sapiens
gagtgttatgttccccttcctgtgtccatatgttctcattgttcaattcccacctatgagtgagaatatgcggtgtttggttttttgttcttgtgatagtwtactgagaatgatgatttccaatttcatccatgtccctacaaaggacatgaactcatcattttttatggctgcatagtattccatggtgtatatgtgcca

SEQ ID NO: 34048 - DNA, 201 bp, Homo sapiens
tgtgctcctgagggcccttcagcctgctttgcattcataggcaatttatcctccttaatcactaaatcattaatggggatcaatagcaatgccacatcagwgaaggcaggggtgcatgcggggagaataattgcttgcttagtttttagtttagtggtgctaaccgggcttcgggtccattctgggaggaaacccttctcc

SEQ ID NO: 34049 - DNA, 201 bp, Homo sapiens
ccaaaaactcattgcaattgttaaaaatgacaaaaagatagttatttggcattctccatatctcttccttaaaaacacacagacacacacacacacacacmgacagacacacagacacacacacacagcctttgtagctaagtgcagttcaaagttatctttcccagctccttgattcaggtacctcccatcatcaaataa

SEQ ID NO: 34050 - DNA, 201 bp, Homo sapiens
ggttcctagtgataaaaatcaatcattccttataatagcaaccaccaaaaaaaggtcatagttttagctgctgcatatgcctatactagttcctctctacyttgatatattaatattacagttaatagcagaagtattggagccaagcgttctctgggtcagtgccctgggactaatagagctaacatttatttagtattt

SEQ ID NO: 34051 - DNA, 201 bp, Homo sapiens
tgtctggtgtcctgggaggcagggagggcatttggattaagtttaatcagtaggtacatatggcaagaaaggtattcagataatttgttatctattaaaaygaactaaaatgaatctgtggtgtcacccaccaatgcatgtcacaggagcaaattctggccaagacagcaaattccaccaaggacctactctgtaaattcc

SEQ ID NO: 34052 - DNA, 201 bp, Homo sapiens
ttctgaaggagaaaataaaaaggcaagccaagtcattaatcttaaaattgtcagctgaattattttcaatgagccctgatgtctggtgtcctgggaggcakggagggcatttggattaagtttaatcagtaggtacatatggcaagaaaggtattcagataatttgttatctattaaaatgaactaaaatgaatctgtggt

SEQ ID NO: 34053 - DNA, 201 bp, Homo sapiens
ggtgaacagggctgaaaatcaagaaaggaaaatgggaacgggaggcccgtggcagctgccactgttgtttggggcattaagatcaagtcctttaaggaggrggacccttgaatctctaccagactccagtttggacttccaaggttgttctgttgaaggaggtgggtagtctttggttaaaaatgctaaactattctgaag

SEQ ID NO: 34054 - DNA, 201 bp, Homo sapiens
attgataagaccctgggtgaacagggctgaaaatcaagaaaggaaaatgggaacgggaggcccgtggcagctgccactgttgtttggggcattaagatcargtcctttaaggagggggacccttgaatctctaccagactccagtttggacttccaaggttgttctgttgaaggaggtgggtagtctttggttaaaaatgc

SEQ ID NO: 34055 - DNA, 201 bp, Homo sapiens
gggataatgtgaattagtgttcagccagaaacagaatgagagtggcaatcgttttattgataagaccctgggtgaacagggctgaaaatcaagaaaggaaratgggaacgggaggcccgtggcagctgccactgttgtttggggcattaagatcaagtcctttaaggagggggacccttgaatctctaccagactccagtt

SEQ ID NO: 34056 - DNA, 201 bp, Homo sapiens
gaggaacaggtgccctaaagtcaagcctcactttcttgaaattatgagtaaggcagagtcttgaccaagtcgtgtctgggataatgtgaattagtgttcakccagaaacagaatgagagtggcaatcgttttattgataagaccctgggtgaacagggctgaaaatcaagaaaggaaaatgggaacgggaggcccgtggca

SEQ ID NO: 34057 - DNA, 201 bp, Homo sapiens
ctaaaataataaataacaaaagatatatattgcttatttatcattgagaagttgtataaatatgcgtatttatttattattgagaattttataaatatatmcacttaatttttatcccagttatggaaggtattatagcaggtggtctcatattcatttttccacatttctcaatgcccctgagcaattagagatcagaac

SEQ ID NO: 34058 - DNA, 201 bp, Homo sapiens
attcccctaatttgccttcacccttgctcctatgtctgtttctctctgtcttcacacttgtatcttatgatgacctctttcacttacaagaattcataaaygtggctcatttgcacccacataattgaaactgtactccaccagaaagcgctggtctgaactcagggaggacggactgtgggcattccctggcttttccac

SEQ ID NO: 34059 - DNA, 201 bp, Homo sapiens
tggtccctagggtaatagagtcgctgatgtctttgtcacattaagggtgccacacagagcacttatgaagggccatgggtatcggaatgagaacactcagmacatccacaaacgcttcctccctgactgcctcctgtgctttctcccctctttcctattcccctaatttgccttcacccttgctcctatgtctgtttctct

SEQ ID NO: 34060 - DNA, 201 bp, Homo sapiens
ggcatgtgccactatgcccagctagtttttgtatttttagtagagatggggtttcaccatgttggccaggctggtcttgaattcctgacctcaagcaatcyatctgcctcatcctctcaaagggctgggattacatgcctggccaaaaagatcagcattttgattatatttattactttctagaatttaaaatataaatta

SEQ ID NO: 34061 - DNA, 201 bp, Homo sapiens
gtctacccagctctggagtgacactgggcattgtctgcacagaatcctgtgatgtgagccatctctgggtccctctcagccaccggaatagcgcctattcyggtggaggtggcagggggtacaatggacactgttagggttcttagctttggtgtttaatgctctatttttgtgctggttggctccctgccaggaggtggt

SEQ ID NO: 34062 - DNA, 201 bp, Homo sapiens
acacaggccacttcaaattgtgcttgacaggtctcagtttctgtgacttctactaacaaagagtgtgacccaacaagataacccattccatggtcaggtarctctaacagtaaggaaacaggtttttctaccatttgatcctgccaatgatcctaattctgccatctggactgacagaaagtaaggcccatctcttttcca

SEQ ID NO: 34063 - DNA, 201 bp, Homo sapiens
aagaggctgaagatagggttccaatcccttctagattgtagggtttctgctgagaaatttgctgttcatctgataggttttcttttataggttacctgatscttctgtctcacagctcttaagattcttttctttgtcttaactttggataacctaatgacaatgtgcctaggcaaagatctttctgcaatgaatttcctg

SEQ ID NO: 34064 - DNA, 201 bp, Homo sapiens
ttagcagttcttgtagtggtggcttggtaatggtgaattatctcagcatttgtttgtctgaaaaaggctgtatctttctttcatatatgatgcttagtttygctggatacaaaattcttggctgataattgttttgtttgaagaggctgaagatagggttccaatcccttctagattgtagggtttctgctgagaaatttg

SEQ ID NO: 34065 - DNA, 201 bp, Homo sapiens
gttgaaatgtgaggtaccattacattcatcatgctctttgttgcctgtgtactttggtttttttgttttttgtttttgctttttaacttgtatttttgttycataggtcctgtgtgatttatgctttaaagaagttctgttttgatgtgtttccaggatttgcttcaagatttagagctccttttagcagttcttgtagtg

SEQ ID NO: 34066 - DNA, 201 bp, Homo sapiens
ttcagttctgtatcttttaaatatagcatttaggccatttacattcaatgttagtgttgaaatgtgaggtaccattacattcatcatgctctttgttgccygtgtactttggtttttttgttttttgtttttgctttttaacttgtatttttgtttcataggtcctgtgtgatttatgctttaaagaagttctgttttgat

SEQ ID NO: 34067 - DNA, 201 bp, Homo sapiens
aggttatttggattttctctctttttggttaattttgctaatgatctatcaattttatttatctttttaaataaccagctttttgtttcatttatcttttrtatttttgtttgtttcaattttgtttagttctgctctgatcttggttatttcttttctcctgctgggttagggttttgtttgttcttgtttctccagttc

SEQ ID NO: 34068 - DNA, 201 bp, Homo sapiens
agtccttggggttttcaaggtaaacaatcatatcgtcagcaaacagtgacagtttgacttcctctttacctatttggatgtcctttatttctttctcttawcttattgctctggctaggacttccagtactatgttgaagaggagtggtgacagtgggactccttgtcttattccagttctcagaggaaatggctttcaac

SEQ ID NO: 34069 - DNA, 201 bp, Homo sapiens
cccgggttcataccattttcctgcctcagcctcctgggtagctggggactacaggcgcccgccaccaggcctggctaatttattgtatttttagtagaggyggggtttcaccaagttcgccaggatggtctcgatctcctgacctcgtgatctgcctgccttggcctcccaaggtgctaggattacaggcgtgagccaccg

SEQ ID NO: 34070 - DNA, 201 bp, Homo sapiens
gtaacagttttattaagaaaaattttaattacaaagcaatatctaacccatcctttggtttataaagcagcttaaacctctttttttggagtgaacggtcrtagatacatctgaggacccaggtgctcaatgggcattgtccttggcatttctaaatcaccaaggaactttttcgcatttacccatatggattttaatttt

SEQ ID NO: 34071 - DNA, 201 bp, Homo sapiens
gttcaacctggcttataaagaaaggtattttcaaagtgatgcaaagaatactgcaaggggtgtgcccaattcaaagaaatagcttctttttttttttttttaagtgttagcctagggtactgctaattagaaaagagtgttatcatttcatcaaaggaagggccactgagcttttacatagaaagattttatcagctgcaa

SEQ ID NO: 34072 - DNA, 201 bp, Homo sapiens
atctcattagttcaacctggcttataaagaaaggtattttcaaagtgatgcaaagaatactgcaaggggtgtgcccaattcaaagaaatagcttctttttktttttttttaagtgttagcctagggtactgctaattagaaaagagtgttatcatttcatcaaaggaagggccactgagcttttacatagaaagattttat

SEQ ID NO: 34073 - DNA, 201 bp, Homo sapiens
gtgagccacttaaaatttgttattgtcaaggacatttttacttcatattttttgtcacatgtatccctacaggatcccatatatcgatattagacaagcayaatttcctgctttttaggatctgagactccaaggcagagagcataggagtagggactcataaagacaactgcgtaatttatcagctgaaaccacatatct

SEQ ID NO: 34074 - DNA, 201 bp, Homo sapiens
aaatgtcatcatttacagactgaatttggtgctgattatgttcaccattactaaaaatattgggaaatgagctatgcttggtgaaacaaagggcattttttaaaaatttggctgattaaatgtagtttagaaacaaaataaacttgcataaacttgcaagtgtttggaaacagtctggtttggtaatagtcactatgttta

SEQ ID NO: 34075 - DNA, 201 bp, Homo sapiens
gactcatttaggtgaatgccaaagatgacgaaggtgtcctcgttggatcctgggacaatatctatgcctatggcgtccccccatcggcctggactggaagsgttgacattctattggaataccggagctctgagaatccagtccggtatggccaatgctgggtttttgctggtgtctttaacacatgtaagtatccaactg

SEQ ID NO: 34076 - DNA, 201 bp, Homo sapiens
tttttttggaggaaggggcaaaaatatttcataagtcacgccattgcttcctaggacattcatcctggcagaagatacatatatttaggtttgtcaatagyatctggttcacgttttatcagtctcatccacccgttacgaagttctcttcttaacgaattatttctgcctcaattcgttacttcattagggattgcaaga

SEQ ID NO: 34077 - DNA, 201 bp, Homo sapiens
ttggctattttctctctctctctctctctttttttttttttttttttttgggacagattctagctctgttgcccagcctggagtgcagtagtgctatctcrgcctcctgggctcaagcgattctcctgcctcagcctcccgagtagctaggattacaggcacacaccaccatgcctggcttatatttttatttttagtaga

SEQ ID NO: 34078 - DNA, 201 bp, Homo sapiens
atttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcctgcctcagcctcccgagtagct

SEQ ID NO: 34079 - DNA, 201 bp, Homo sapiens
tgttcttcacagctggctcttcctatagacatgtgggaccccctgctgcaggcctgtcccagctgcttggtggaagcagcttttgctacccttctgggctrttgcgcaggtttcatttatgagctcaaccctgaaccttccctgacagcagcaaggcctgtgtgcgtacctaattatgaagtgacggcctgtccctgtgaa

SEQ ID NO: 34080 - DNA, 201 bp, Homo sapiens
aatttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcctgcctcagcctcccgagtagc

SEQ ID NO: 34081 - DNA, 201 bp, Homo sapiens
gtcctaacttttggagcaaactcctcataaagcagcatgttctcccatgcttgaagcttagtctggaatctttgggttagagggaatgactgtttggttcrtggctgtatctcacttaaaacagtgcctagggccaggcacagtggctcacgcctgtaatcccagcacattgggaggccaaggcgggtggatctcttgagg

SEQ ID NO: 34082 - DNA, 201 bp, Homo sapiens
aaattggggtccaaagtttaatttacctttgggcaagtccttcaatctttcttctttttcaacatattagtttttggctattttctctctctctctctctytttttttttttttttttttttgggacagattctagctctgttgcccagcctggagtgcagtagtgctatctcggcctcctgggctcaagcgattctcctg

SEQ ID NO: 34083 - DNA, 201 bp, Homo sapiens
gacagagagagcacaggagacacaccctgacatctcccctcctcctgcttccaatcctctctttggccgaacctacctcgaagtcagagagcagaggagcrtgggaacatggcttcctgtggaacctgacagaagattctaggggtgcaggcaataggtctgagaacagccagtctgtcaataggtggagttgctgagaca

SEQ ID NO: 34084 - DNA, 201 bp, Homo sapiens
taaggattgttattaagaagttatttatcattattgttgctacgatttgaaagtagagggggtcgctgtttgtacttacatggcttcctccagagggaatkcccgaattctcagacagctcatttaaagcttccaaaatgacaaatattccacaggtatctgctgcgtcctctcctgtcctgattcctgacttcacatttc

SEQ ID NO: 34085 - DNA, 201 bp, Homo sapiens
acatcccaccccaacacacatatacaaaagccaccccatacaggtgtttctcgtctcctctctccgcaaaggacagtgctgttggtctgtcctgagatttyagcctacaggaatttctgaagccatattcaaggtgggggggcaggaatcagccactttcatattttgcttgtttccctggaaaaccacaagctgttataa

SEQ ID NO: 34086 - DNA, 201 bp, Homo sapiens
tcactctgtgtaggaagaatgctttgcatgctttgttccctctctgcattcaagtctctgctctggtcacctcttcaaagaggccttcgctcacccaactscacctaaaatatcaccatctgccctgttgttttcatcctccaaccttagtgtgtactccatttctcccttctagaatatgagctccatgaaggtagaagc

SEQ ID NO: 34087 - DNA, 201 bp, Homo sapiens
tacaataaaactgaacataaattcctacaagattccatggcttcccttccacttcatcccttgtttatttccctccagccatactgagatttttctcttcrgaaagcatccacacatcctcttgtgtcagcacttttagacatactgctccttttgctaggaaagctcccctcactatctttcactctgtgtaggaagaat

SEQ ID NO: 34088 - DNA, 201 bp, Homo sapiens
attataattactcctttctcacccactgcagaggcgtgtctgacagagggtacaatttgttgctttggcatgggctgcgctccaggggctgagccattttkaagagatgtttgagttgatgaaaagtgtatgaggaatcttttctcaagggtgcctgcagtgggaccccatggggagtgtcatatgagtcgatatgactca

SEQ ID NO: 34089 - DNA, 201 bp, Homo sapiens
aatgttaatatttagaaagcaaaacgaacatcaaaattcagacagcaagatcaggaatttgaaacacacaaaagaccagtgttcatctcatcgtacctgcygtggcagtttacagaagcctttggagaccaagcttactggacttggaattttatcccctcgttttcactttgggatttgaagatttccacaaacctccca

SEQ ID NO: 34090 - DNA, 201 bp, Homo sapiens
gaatgcatactggtaaccattgcactctagtactccaggaggaacaaatagttattattaatgtacaccaggcattgtactggggggaattctaaggttcragtctttaagaaacgtatttctagatgccaggtgacagggcacaaacacactgaacatgaaataacaacaatacttgtcaggtgggccatgtagagagca

SEQ ID NO: 34091 - DNA, 201 bp, Homo sapiens
aataaaatcgaggcaaagagtgattaagtgactttctcacaaccatctagctaataaatagcagtgctaagatttgaagccaggcagatacctgaatgcayactggtaaccattgcactctagtactccaggaggaacaaatagttattattaatgtacaccaggcattgtactggggggaattctaaggttcaagtcttt

SEQ ID NO: 34092 - DNA, 201 bp, Homo sapiens
ataaattggggtccaaagtttaatttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcc

SEQ ID NO: 34093 - DNA, 201 bp, Homo sapiens
tttatctgatggaaaagtctcattatagaaataaaaaataataaaagcataaaaagagctcaaagatctacaaattagagacactaacaattaacattttsttgtaatgtcatccatttaaagtattttcagtgcttttcatttttaattggcaattaattgaatatattgttcttttcaaataaacacacatgtacattt

SEQ ID NO: 34094 - DNA, 201 bp, Homo sapiens
tatgatgaaccgctccccccaacacacacacaagcacatacactgtagcccagcagtcccctgcagttttatgcttgtgtgtgtgttaatgcataacaaargattcagcgctatggcctggtaactggaaagtaggtcaaaagagaggggtgagactgtcgcccaagtgaaaaagatagcagaagataagaaggaaaactg

SEQ ID NO: 34095 - DNA, 201 bp, Homo sapiens
atatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcctca

SEQ ID NO: 34096 - DNA, 201 bp, Homo sapiens
tcacctggagggtcaccacgcttggagcacatcagaatcacctggagggtcaccacgcttggagcacatcagaatcacctggagggtcaccacgcttggarcacatcagaatcacctggagggcttgttcagccacttctgtgcagcaccctcaggttgagtaggtctgaggcctggcctgagaatttgcatttctaacca

SEQ ID NO: 34097 - DNA, 201 bp, Homo sapiens
tatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcctc

SEQ ID NO: 34098 - DNA, 201 bp, Homo sapiens
cagtgatggaagcagcgagaaccagtccgatctgggcatgtgctgaaggtggagcccgcctgattggctgagagactggatatgtggtgtgagagaaggarggtatggaggaagccaaatgagtgatgaatgtgaaatgtgtgccacatggtagaatcttagtaaatggtaacttccaacatgtttacatttggggaaact

SEQ ID NO: 34099 - DNA, 201 bp, Homo sapiens
gtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcct

SEQ ID NO: 34100 - DNA, 201 bp, Homo sapiens
cacacacaccccggggttcttgattcattcccctaacctttatttagtgcttgcaagtccaggttctgttttatgctggagacacagcaatgcctattctkactgaatttctgatctcatgggggaaccaaacaaacaagtgaatctatagtatagttatatgggtaatagaaaaatacaaagcaggttaaggaaaacggg

SEQ ID NO: 34101 - DNA, 201 bp, Homo sapiens
ttgcaaatagacaattctggatgtaagcgatgactgtgtcacctaccagctgtgtttcctgagcaaggtacttaagcactctgagctgtctctcctcatcygcaaaggggaaaaacagcacacacaccccggggttcttgattcattcccctaacctttatttagtgcttgcaagtccaggttctgttttatgctggagac

SEQ ID NO: 34102 - DNA, 201 bp, Homo sapiens
agctctccatcaccttccggaacaacagccacaaccgttacaccatcacagcttatctctcagccaacatcaccttctacaccggggtcccgaaggcagarttcaagaaggagacgttcgacgtgacgctggagcccttgtcctgtaagctaacaatggtgtggttctttgtgagactcgctgtctggcccctgtcttgct

SEQ ID NO: 34103 - DNA, 201 bp, Homo sapiens
ggcatgggtgttgggggcaatggcaattgagtgagatagggaagaacggggcaggagccctcaagggtcagctcagcaaacagcaagtgggacaggcccargtggaaggagagatgaggaagacaggtcttattggggggcaggtattcacaaatcagagagaaaagttacattgcaggaggtggaatggcaagaggcaat

SEQ ID NO: 34104 - DNA, 201 bp, Homo sapiens
ggaagcattccctttgaaaactggcacaagacagggatgccctctctcaccactcctattcaacatagtgttggaagttctggccagggcaattaggcagragaaggaaataaagggtattcaattaggagaagaggaagtcaaattgtccctgtttgcagacgacatgattgtatatctagaaaaccccattgtctcagc

SEQ ID NO: 34105 - DNA, 201 bp, Homo sapiens
aaatcaataaatgtaatccagcatataaacagaaccaaagacaaaaaccacatgattatctcaatagatgcagaaaaggcctttgacaaaattcaacaacscttcatgctaaaaactctcaataaattaggtattgatgggatgtatttcaaaataataagagctatctatgacaaacccacagccaatatcatactgaat

SEQ ID NO: 34106 - DNA, 201 bp, Homo sapiens
agcaggaagctggaggaaagtgctgtttttctccccaacctcttaacacatgaaagagtaagctaaaagttgttgtttctaagttttccaggtacatagcrtatgcttcgtgttgacaaaggtaactaggcattattccaacttccaggctattaatgctaaatgcagttcttgtttaacatttttctttccttgatgttt

SEQ ID NO: 34107 - DNA, 201 bp, Homo sapiens
aaatcagcaatgaagttgggaacactggtctttacagagtcaccctcagtgccatgaatcttgcagtatctggacagaattggagatgacaaactcacacygcccttcctctgtgcaatgcaggcatgtatcggtgtggccccgcctcggttcaagccatcaagcacggccatgtctgcttccaatttgatgcaccttttg

SEQ ID NO: 34108 - DNA, 201 bp, Homo sapiens
taaatcagcaatgaagttgggaacactggtctttacagagtcaccctcagtgccatgaatcttgcagtatctggacagaattggagatgacaaactcacaycgcccttcctctgtgcaatgcaggcatgtatcggtgtggccccgcctcggttcaagccatcaagcacggccatgtctgcttccaatttgatgcacctttt

SEQ ID NO: 34109 - DNA, 201 bp, Homo sapiens
catggggacattttacaggtgactaatagcagctaatctcttattaactatatagataggtggttaaaatttaaagcattttagaagagtaacataggccytctgacttcctaaatgcatggtgggcatggccaaaatgcacaggcaatgtccaaattctccagttaaacttgacatatgttcataatgtccaaaaacaaa

SEQ ID NO: 34110 - DNA, 201 bp, Homo sapiens
cattgaagggcgtctaggcacggaacccgtggtagttgaacctgaaattcatcagtgtcataaacaaagactgctgtaactacctcaccacattattaaayctttctttattactatatgaacattttctatagtgctgaggggttaatgtgctctcatttgattctgtactgtcatataatttcaggtcttttcaaggac

SEQ ID NO: 34111 - DNA, 201 bp, Homo sapiens
atttagatcttcttcttaaattattccaatggctttttatagcctaagaataaagcatgaatgtttaatttgatatcaaaggatttcacaatcttatcctyacctatatcataggtcagtgttgaagagtgtggatttcagagctctatcactaactagctgtgacctcagcaaggttcttaaccttcctgggtttcagct

SEQ ID NO: 34112 - DNA, 201 bp, Homo sapiens
ggtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcc

SEQ ID NO: 34113 - DNA, 201 bp, Homo sapiens
gcagggtcgcctttttaatgtcttgccagagcccagcatccttggggactgggggatgcaagttttggtagaaccttctgccatggcatgggtgttggggrcaatggcaattgagtgagatagggaagaacggggcaggagccctcaagggtcagctcagcaaacagcaagtgggacaggcccaagtggaaggagagatga

SEQ ID NO: 34114 - DNA, 201 bp, Homo sapiens
cccttcatctccaccacaaccactttgcaaaccctgcacaaaacattttcctaaaagcagcacacacacctcgaactgcattagaacttaggtgcaccacygcctgtcaacagatgtccctcaaaaaactgccctccgtgtcagatgagtttgggaaaccttgtgtaaagaaaggcaaagaggtgtccttgctgctgggct

SEQ ID NO: 34115 - DNA, 201 bp, Homo sapiens
gctgtgaagttgcttgtggctggcttcaaggcttcttctcccattcacctcaccttggccagctcagctcctctctgatgtgttcctgatgctcgaatttscctcctgcattttgcctcaatgcatctctggcccgcatccaaagtgatcatcattaatgttctcttctcatggatctattggccagatgatttctgctaa

SEQ ID NO: 34116 - DNA, 201 bp, Homo sapiens
cctgcacccatggcaggctgtgaagttgcttgtggctggcttcaaggcttcttctcccattcacctcaccttggccagctcagctcctctctgatgtgttmctgatgctcgaatttccctcctgcattttgcctcaatgcatctctggcccgcatccaaagtgatcatcattaatgttctcttctcatggatctattggcc

SEQ ID NO: 34117 - DNA, 201 bp, Homo sapiens
atatagtgcctgacacataataagtgtccaataaaagtttcccctattactagtaattctgttattcctgccatactactgctattagtttgggctatgawtagttttctcctggaaaaatacttgctctagcttcccaattccacctcacctcctcaggccctccttccctcagtctagcccctgccttgctgccaaagt

SEQ ID NO: 34118 - DNA, 201 bp, Homo sapiens
tttcctgtagttttacgatgccttggaataccagcaagaattgttaccaattatttctctgcccatgataatgatgccaatttgcaaatggacatcttccyggaagaagatgggaacgtgaattccaaactcaccaaggattcagtgtggtgagtttgattgacaatggcattggctgatgtcacattatagtaatgttac

SEQ ID NO: 34119 - DNA, 201 bp, Homo sapiens
atccacatagatggttgtaagcgacgactcatcctgcttcggggctggagtttgaccccaagtggatagtttcttaatcaagggtggcatacacatttcaractggaactttggaagtgaccaagtagaatgttgttttgagaagaacaccaagactgcatctgaatgtggcgggtagaaggattgatggccgccattggc

SEQ ID NO: 34120 - DNA, 201 bp, Homo sapiens
tggaatccatgaagtgctaaggagtgcagaatttattttaaatagtttagacagtctccctgctcttatttacaaaagtaatttgcactacaaagaagaarcttgctgaattgagaacacttgtgcatagtctcagaaagtcagaatttttgttatctgaactagtgaattttcactgtattttttaaatgcttcattttc

SEQ ID NO: 34121 - DNA, 201 bp, Homo sapiens
ataatgtcatggtgggtttttgttaacttttattgcatagaatgtttcaaatggcactactgagtttaattctatctcaatcaatgcttagtgtccgctcyatgcctgcaattggtttggtgctggcgattccagcagtgagcaggactcagttcctgtcctggtccgagtgacaggattattgtgcagaggggtctttgg

SEQ ID NO: 34122 - DNA, 201 bp, Homo sapiens
caagcgatgggcatggtggcatggcattgtcttctctcctgtgagaggtaggacttatcacaaggacagaggagggagaaaaatggttgcttcttagacartttattatctcagcctcaaataatctttatttaaagtactactaaatcaactagattcgcctttagaatattttcaaaacctgtttggccctatgatacg

SEQ ID NO: 34123 - DNA, 201 bp, Homo sapiens
tgggtttctgcattgatgatcaacgtgtttatttttaagcatctctgtgaagtgactaataatggcatctaagaaagtaggacagtgtttcccagagtgtrttctctatgaacacctgtcatgtgagattctccttgggggaaaaaagttccatcatcaaatacagttggatcatgctgtgttttgtgtctcttctcatag

SEQ ID NO: 34124 - DNA, 201 bp, Homo sapiens
ataatctcataaatctgtatgaaatgaacatagatacagcacatgcatataacaggaaacatttcttgcgaagatgctgctgtaggattatggagggtggsggaatctgggtctccaaaaatcttttaatttttaaatttctttgaataagccccttttcttctgctttccatatgttttgacacatacaaaaatctcccc

SEQ ID NO: 34125 - DNA, 201 bp, Homo sapiens
acatgttggctatagttaattatactatactatatatttcaaaattgccaggagagtaaatttcaaatgtttgcaccacaaaaataaatatgggaggtaakcgatatgttattaacttaattatcctgcaatgtgatttgattttatatatatatgtaaaatcatcactttgtaccctataatatatacaattatacaatt

SEQ ID NO: 34126 - DNA, 201 bp, Homo sapiens
caagattgagtatgcacgaagagggagcagaaacaggagatgggtgcctctggaacaaacatgcttatgcaggtgggtttatggaggggctcctgagaggstgagtcccatgagtcttcaagagcattacttagatgccatggcacctaggcagaaaacaatgtttaaatttgtgctggatttacaagtatatgtgatatt

SEQ ID NO: 34127 - DNA, 201 bp, Homo sapiens
gaatcagttggtattttccaacctggagaatcagtagatgaaattaggaaaagtctgtacggaaggaataagtgtttgagatcaaatatacaacatgttgkctatagttaattatactatactatatatttcaaaattgccaggagagtaaatttcaaatgtttgcaccacaaaaataaatatgggaggtaatcgatatgt

SEQ ID NO: 34128 - DNA, 201 bp, Homo sapiens
gggagaaaattatacaaaattatgcaaaaggtagtgggagtcatttaaaattctgctctgcatgtgattttgaaacactaatatgccatggatgtctttcytgcctagtcaatatagatctgcatttttatggctgaatagcattctattctgtttcaaaatacttgatcacatgttggacagttaggctgcttccatgct

SEQ ID NO: 34129 - DNA, 201 bp, Homo sapiens
aaataaataaatagtcctcagtgtttcggagggaacctaatacatgtttattatgcagtattttaaatgttgcagaaaaaataccaaagtaagaagtatcyattttctaactactcagaacatctgtaacatttccttaacccttctgtaatatgtctctttgtgtgtcgtatgcatgtttttaatgctgcataccaaagt

SEQ ID NO: 34130 - DNA, 201 bp, Homo sapiens
acacgtaatcacaccatggggaaaaatgaaaggagaagaaaaaaagaaagctggataatcagcccctaattttctaaaaattgctattaacaaagctgctktacaattctcttgataaatatccaagaaatctgttcttggaagcttaagaagagagtggaaaggctgtactctcaggactaaggaaggactcactcccta

SEQ ID NO: 34131 - DNA, 201 bp, Homo sapiens
gaatgatatttcattgtgtggataaaccaggttttatttatccattcatcagttgtacatttgggttgtttccatttttggctttcatgaataatgttgtwatgaacattcaggtaaaagtttttatgtgaacatatgttttttatttctcatgggcatatatttagagtggaatttctgggttgtatggtaactctatgt

SEQ ID NO: 34132 - DNA, 201 bp, Homo sapiens
gctgaccccagagcccactctttttaaaatgacatccttattgactgggcgtggtggctcacacctataatcccagcactttgggaggccgatgcaggagkatcacttgagatcaggagtttgagaacagcctgaccaacacggtgataacctgtctctactaaaaatacaaaaaaattagctgggcgtggtggtgcatgc

SEQ ID NO: 34133 - DNA, 201 bp, Homo sapiens
gttggaaaaaacattatttgccaccttcaaagaataagagtagctcatgttcacaaaaatacttttttttgcaatgccctgatttaagtgctgacatgtaytaatttacttctacctcttaacagcatgttaaggtaattactgttagtggcacggtaacttaaccaaggtcccagccaataagtggcagaacctgaatta

SEQ ID NO: 34134 - DNA, 201 bp, Homo sapiens
ttcttgttaaccatatttctggccaagttggttttaggaaaatcacctggagttagaccatgagccttagcattagaggactgagaatatacactgaaggyacacaatagtgttggaaaaaacattatttgccaccttcaaagaataagagtagctcatgttcacaaaaatacttttttttgcaatgccctgatttaagtg

SEQ ID NO: 34135 - DNA, 201 bp, Homo sapiens; identical to SEQ ID NO: 7129

SEQ ID NO: 34136 - DNA, 201 bp, Homo sapiens
atattccagatgctgagcctgggaacaaggtctatcccaagggagttggcaaaagctaattcgagtgtcagggcctcagcaaaggcagctgggggattcayataggactgtaattccaggaggaaactagtggcaaaaactgagctgaggctcagaagatcagtcacatagataaggctactatggagggcttggagacaa

SEQ ID NO: 34137 - DNA, 201 bp, Homo sapiens
ccaatttggtggttgaaataggaatttgaattacagaacatgaagattctcaaagtcaaatggcagcaggcagggctatattccagatgctgagcctgggmacaaggtctatcccaagggagttggcaaaagctaattcgagtgtcagggcctcagcaaaggcagctgggggattcatataggactgtaattccaggagga

SEQ ID NO: 34138 - DNA, 201 bp, Homo sapiens
ttgggcttaaactttaagtttctcaaataggacagaagctaaggtctagacgcacagaggacaaaccatgggcagttgcagtttattgtaataataatctyatttgcctgcgtgcattcaagatgataaatggccggtatctcctgatggctcagcacgttactgagaatcgtttatcacaacatccatccccagaaaata

SEQ ID NO: 34139 - DNA, 201 bp, Homo sapiens
tttgggtttcaacaaatgaatgtgtgaggaccacaaacatttagtccgtaacagtcctcaatctctctttttaagttttttttactgacacattgtaattstacatatttatgtggggcaatttgatgtttcgatacatatatatgttgtataatgatcaaatcggagtatttagtgtatccatcaccccatgcatttatc

SEQ ID NO: 34140 - DNA, 201 bp, Homo sapiens
ggctagatttctctttcctatcttgtgaagaatactaatatcaagaaactgtgcacaaagctcaatcaagcctaggtagctaaggttggaaaagagtaacrtcacaaatggaattaaagattttcatcttcttcctcctacatcccagctggggggattaaggtaggtctgtgtaaggagagtgaggccctcagtaaaggg

SEQ ID NO: 34141 - DNA, 201 bp, Homo sapiens
tattgagcacctactacgttccaaacatcatgcaagctgctgggtatacaaagttaaacaaaactccatctctgtcttcacaaagtttccccccaaccctwcctaagtttgcctgagctagaataaacatggccaggaaggtctcttttctttaggaaacatctggaaatatgtatgtaatctgccaatggcaacttagca

SEQ ID NO: 34142 - DNA, 201 bp, Homo sapiens
aaagacttcaagctctccatcaccttccggaacaacagccacaaccgttacaccatcacagcttatctctcagccaacatcaccttctacaccggggtccygaaggcagaattcaagaaggagacgttcgacgtgacgctggagcccttgtcctgtaagctaacaatggtgtggttctttgtgagactcgctgtctggccc

SEQ ID NO: 34143 - DNA, 201 bp, Homo sapiens
tagtcagcatcaggtgacagccttatgatttctttctgattcactcaaaaaacctagcacgatgctggtttcatgtatatcccacaaaattacgccttacrtttactccaaaagaggctttaagtgatgtaggaagcactgaaagaaaagtaaaataaaatcaaggtagaaaagacaccttaacaagtacctagcttccat

SEQ ID NO: 34144 - DNA, 201 bp, Homo sapiens
gcatttaagcaggctcaaatatctgctgtgttaaaaacaaaaattacaaaaatctttttcaccactgtctcttcctcctcgcctccttgccgtcctggagygctgcctggacttgcgtcctgctgtgttccttctccactccttccgcgcacactctgtcctgatttctgctaccagcacttccttgaagttgttctcaag

SEQ ID NO: 34145 - DNA, 201 bp, Homo sapiens
gtcctcatgttcacattcctgccttggttagccatctaagtggtgcacttcttaaagccagggaccaggtagtcagcatcaggtgacagccttatgatttmtttctgattcactcaaaaaacctagcacgatgctggtttcatgtatatcccacaaaattacgccttacatttactccaaaagaggctttaagtgatgtag

SEQ ID NO: 34146 - DNA, 201 bp, Homo sapiens
tttattgagtatgtattgtaaatatccacttgtaggttaatactagatggactgtaccatactccttagaatgttttctatgttgatttttgtttctccartaattgctttaatctctggcaatgcaaactcatttaacacttgcttttatatattgcattcatatatactccaaagacaaacaaatgctttatcagaatt

SEQ ID NO: 34147 - DNA, 201 bp, Homo sapiens; identical to SEQ ID NO: 7151

SEQ ID NO: 34148 - DNA, 201 bp, Homo sapiens
agaacaattgtgttcccccacaaggcatcattaggcaaggatggtccaacctcaatacggtttctttacatccctgtgtttcagctacatccgtggtctcytgtattgtttatctatgtcacttgcaaaaaactaggcttgaatacagttttttaaaagtgatgcttttaaatataagcggtaatcaacttatgaaggaac

SEQ ID NO: 34149 - DNA, 201 bp, Homo sapiens; identical to SEQ ID NO: 7152

SEQ ID NO: 34150 - DNA, 201 bp, Homo sapiens
cagtggggaacacatgaccagaggaaatgagagaagattggaatatattctaaggccttaaaaagatgtcaagaacaattgtgttcccccacaaggcatcmttaggcaaggatggtccaacctcaatacggtttctttacatccctgtgtttcagctacatccgtggtctcctgtattgtttatctatgtcacttgcaaaa

SEQ ID NO: 34151 - DNA, 201 bp, Homo sapiens
ctcttgtcctccatacatttttttttttttttttttttttgagacggagtctcactctgtcgcccaggctggagtgcagtggcatgatctcggctcactgmaagctctgcctcccgggttcataccattttcctgcctcagcctcctgggtagctggggactacaggcgcccgccaccaggcctggctaatttattgtatt

SEQ ID NO: 34152 - DNA, 201 bp, Homo sapiens
attttagagcagaaattaaccagctttcacacctgggacactgccctaatcagtgtataatcctaattctcattatgtcctcagtactcatatggtgtttyacacattgtaggtgcatttttgaaattgagattgttcttctatacattattttatttttatttttatttatttttattattatactttaagttttagggt

SEQ ID NO: 34153 - DNA, 201 bp, Homo sapiens
atgaggacaaagggatggggctttgttcctccatagtgatcagtcactggatgtgagccacccctggaatgaggtgtgaccctggatgaggcagttttctyctgctaaggcaactcccaaggaggcctgaaccaccaaggactattttctgtcatcactcccagcagctgaggataagcctgtcggtcatttccgaaggtg

SEQ ID NO: 34154 - DNA, 201 bp, Homo sapiens
gtgtcctcctctcagcttttccccaccggaatgcacccacccacagggggagcagtgtctgatctattttatttttgttgttttgtcagcatgtaacagtrtgcagggcatagagcaagcactgaataaacagaattgcttggaaaaaatttttaatgcataaaaactccatgctgcaatgggtggtcttaatctataaac

SEQ ID NO: 34155 - DNA, 201 bp, Homo sapiens
gggcagagtaattagatcccagggtagcaaatgaaaccccaagtgggcaaatgcaaagtagcagatcccagaaggagcaatttcggccgcctgtccccagygtgctgatgagttctgaattatgtgtaacctctggggggaaggcagctatgaatcactggacagtttaatgaagacgcttgctcaatgtttagctgcagt

SEQ ID NO: 34156 - DNA, 201 bp, Homo sapiens
agaggtaggcctgatgctgatttaattattattggtcactggtaagaagcaggggctgcctgagcatagggctggtgaggaagggtgagggtgagggtgarggtggaggctaaacaggggctgaggtgggggtgggaatgatttgctgggcatcagctgacctctgtgaggtcagtgcggtgtagactggcgacacatggc

SEQ ID NO: 34157 - DNA, 201 bp, Homo sapiens
gctgtgtggctttgagaaaatgacttcacctctctgagcttcattttcttcatcagtagaatgaaagtaatcttagtagttaccatttcccgatggagtgrctataatgattaaatcaggtcatccaggtagagtgcttaccatagaggtaggcctgatgctgatttaattattattggtcactggtaagaagcaggggct

SEQ ID NO: 34158 - DNA, 201 bp, Homo sapiens; identical to SEQ ID NO: 7162

SEQ ID NO: 34159 - DNA, 201 bp, Homo sapiens
gcacatcagaatcacctggagggtcaccacgcttggagcacatcagaatcacctggagggtcaccacgcttggagcacatcagaatcacctggagggtcasccacgcttggagcacatcagaatcacctggagggtcaccacgcttggagcacatcagaatcacctggagggtcaccacgcttggagcacatcagaatcac

SEQ ID NO: 34160 - DNA, 201 bp, Homo sapiens
aatccatctgaaagtgctgagatgacaggcatgagccaccgcacctgactgacttcaggttttacctgttggcatacttctggggtcttgcgtccctactyctgtgattcttcccttaagtggtgtgtctgcgtgtgcagtggcctgctagcgcttagaagcggagcatgcacagtgcgtttactagtgttgtactcgtga

SEQ ID NO: 34161 - DNA, 201 bp, Homo sapiens
cttgcgtccctactcctgtgattcttcccttaagtggtgtgtctgcgtgtgcagtggcctgctagcgcttagaagcggagcatgcacagtgcgtttactastgttgtactcgtgaccacttgatgcattttttccttaccagttgagtgtccctggaggaaggccacatactggttaaattccgccattttggctcttagt

SEQ ID NO: 34162 - DNA, 201 bp, Homo sapiens
attggagtggagcaaagtggagtgaatcgggagaaaggatggataaggccagtcccttcttggacacagatgtcctgcccacacactggcttaaggtactrttagtagttactgcaacacgtaagtctaggcagacaagtagatagacagagagctagctgctcttagtcagtttgagctgctgtaacagaaatgccatag

SEQ ID NO: 34163 - DNA, 201 bp, Homo sapiens
tatttgggaggcctcaggctcaaaataggttaaatctccagatggtttgtttattgttaatgtctgacattggagtggagcaaagtggagtgaatcgggaraaaggatggataaggccagtcccttcttggacacagatgtcctgcccacacactggcttaaggtactgttagtagttactgcaacacgtaagtctaggca

SEQ ID NO: 34164 - DNA, 201 bp, Homo sapiens
tcaggcaaagtgaaacacgtttcctcttccatacagccccctgctgtatccaactttttccttcccagacagtaaacccacaagctttatctgagtgtacyggaaacttctctatctttacaccttggctatccccctagaattccaccttggtcaaggccaacacatgaaaaaagacactgtgtgtcttagacaaaagat

SEQ ID NO: 34165 - DNA, 201 bp, Homo sapiens
attcatttggtatacatagctcctaaacaaacaaacaagtcttatagccacctggcattttgcggcacattgcgtttatgttggaaaagcatatggttctraagtgtgtggcatacagtaaacacagcttaaggtatagtaataataagagcattctacatagatcgccccataaaagtgtcagcccattttaaagacaag

SEQ ID NO: 34166 - DNA, 201 bp, Homo sapiens
tgccgttttatgagcatttttcattccaaacctttcttgcaagggaagaactattattcttatcttattcccaagttacttagagcttatacagatccatycatttggtatacatagctcctaaacaaacaaacaagtcttatagccacctggcattttgcggcacattgcgtttatgttggaaaagcatatggttctaaa

SEQ ID NO: 34167 - DNA, 201 bp, Homo sapiens
ccatatattttctcccatattatatagtggctaaaggaacatggaatagtaatggctgtgttgtcatctggaagatccagacatccagtaaattccatttytgagccattgacttaatttaataaatatttactggacattggtattgaagtactaagtattggagttaaaagtgggctgaaatataaggtgaataagaca

SEQ ID NO: 34168 - DNA, 201 bp, Homo sapiens
caagggtcctcttctctgggcaatgtccttcctctttacgtccattcttaaaaacgcctcatttccatatattttctcccatattatatagtggctaaagraacatggaatagtaatggctgtgttgtcatctggaagatccagacatccagtaaattccatttttgagccattgacttaatttaataaatatttactgga

SEQ ID NO: 34169 - DNA, 201 bp, Homo sapiens
gatcagatcaggaagattttattcttgactgtagcataagtaagcaagggtcctcttctctgggcaatgtccttcctctttacgtccattcttaaaaacgsctcatttccatatattttctcccatattatatagtggctaaaggaacatggaatagtaatggctgtgttgtcatctggaagatccagacatccagtaaat

SEQ ID NO: 34170 - DNA, 201 bp, Homo sapiens
gtgctggactccctgcctggcacacgatccatgctgtctaggtgcacctgctgttgttgctaccatgaccatcgtctgcccctctcctagttcccctgaayccagctctccaccactgccctccaggagatgcggatttaaatgtaacaaagtttagggagttggctgaaagtttcgtttttcttatagacttaagaaatc

SEQ ID NO: 34171 - DNA, 201 bp, Homo sapiens
tttaagtgtgtttgtgtataattattgcagctaatacaaatcaacaagagctccttggtattatctaatgaaccatctttaatctaattttcccaatgtcyaaaaattatctttttagttagtttatttggattaaggtctgtagattaaatttggttggtatgtcacttaaatcttttcctctagagtaatcctcttcat

SEQ ID NO: 34172 - DNA, 201 bp, Homo sapiens
actgaggattgctggttaaagtgctggactccctgcctggcacacgatccatgctgtctaggtgcacctgctgttgttgctaccatgaccatcgtctgccyctctcctagttcccctgaatccagctctccaccactgccctccaggagatgcggatttaaatgtaacaaagtttagggagttggctgaaagtttcgtttt

SEQ ID NO: 34173 - DNA, 201 bp, Homo sapiens
tattttacctgtacatattttagcgtgtagctttttaaaaatagacatatatacagtatacatagatacatatgtacatatgtgtgtatgtatgtgtttawgtgtgtttgtgtataattattgcagctaatacaaatcaacaagagctccttggtattatctaatgaaccatctttaatctaattttcccaatgtccaaaa

SEQ ID NO: 34174 - DNA, 201 bp, Homo sapiens
tgccccagtggctggccctctgccatttgtaggccatctcagggatgacagctcacgtgattaaagggctaaatgaagccctttttggtggggaaagaggsggcttggactcaaggcagtgcccagtcagaacccgagctccaccatggatagcagtgacagaatcactttaccccaccccccatcacattactgtttcct

SEQ ID NO: 34175 - DNA, 201 bp, Homo sapiens
tgagactgtcgcccaagtgaaaaagatagcagaagataagaaggaaaactgtttccagaaattgtcaaaagacagccaggtgaacaagattgtggcccgakgtggcacaggatgctgggctgaaaattacagcagcatgcacagcacttattgataggagaatgctcagctgtgctcctgagggcccttcagcctgctttg

SEQ ID NO: 34176 - DNA, 201 bp, Homo sapiens
cagaagcctctgtagtagcattttaggtagagtattaagatctgatttttttctactttttagattactatagcagaagtgtggaagataaattggaggamcgagattttgttagggacattagtaagagactcaagggggaaaaaaatctcactaataaatgataggataaatggatgctgcatgagtttgtatgatttt

SEQ ID NO: 34177 - DNA, 201 bp, Homo sapiens
ctttggagggagtgactgatggcaagaatagttgaaagaatcctccagaaagtgctatttgaggcgggtctcaaaaaacgaatagaaattgacccaggggratggaaattgtatacattctagaaaaaaaaaaatagaaaagttcagtggagcatgacattttggaagcacactgatgtctttgtatgacttgataagaag

SEQ ID NO: 34178 - DNA, 201 bp, Homo sapiens
gtcacacagctggaatttcttagaggcaatatgtttccatcaacccaagtacatcaaagcggtcagaaaaagagggatgcccagtgtcctaagatgactgygctatttctgttactttggggtatttttaaagaaaaagcagacacttggcctcaccagtgcaaacacccatgcaccttagaagttataggtggtccagga

SEQ ID NO: 34179 - DNA, 201 bp, Homo sapiens
gggccttctctctctctcacctctgagcctgcagcctcgacaaatcatgaaaggcaaggaggggagtggtaatcacaggttttactaacctgtggctgagrctgtgaaagcttgggagcagcttctggtgttaatttgctgttactttgacatgggcccctgcttttttgatacccagttgagggtgaaatcccaagctgt

SEQ ID NO: 34180 - DNA, 201 bp, Homo sapiens
tgtcacaggagcaaattctggccaagacagcaaattccaccaaggacctactctgtaaattcctaacttcctattagtgggtttttaaaattgtattttcrggaacatagtcccattcatgggactaaaataatactacgttgatgatcaaacgcttagaaacgaaacaattagaaccctgttgggattctactctagttg

SEQ ID NO: 34181 - DNA, 201 bp, Homo sapiens
tttaaatccaaagatgtttttgaaatgtttcttaatgcaggaaaaaatatattggacacacttgagaatgaaatcagggacaccatgtaaagtattctgawgtattgctacaccttcaatatctaaattgattgaggcagggcctctgggaagaaagtgaaaaattcagtctgtcttccacatgttttgtctataccagtg

SEQ ID NO: 34182 - DNA, 201 bp, Homo sapiens
tcattaataaagaatttttacctagctaacattttttaaatcaaaaacaaagggaggggttggaggctggagggaggtcatttaaaaaaatgattacaaawcctatttgttttagctcaaagtctcaacagtctaagacttggtgatctaaatttaaaaaaaaaaagtcatgagttttgttttgttttattttcccatagt

SEQ ID NO: 34183 - DNA, 201 bp, Homo sapiens
ctgcagttttatgcttgtgtgtgtgttaatgcataacaaaggattcagcgctatggcctggtaactggaaagtaggtcaaaagagaggggtgagactgtcrcccaagtgaaaaagatagcagaagataagaaggaaaactgtttccagaaattgtcaaaagacagccaggtgaacaagattgtggcccgaggtggcacagg

SEQ ID NO: 34184 - DNA, 201 bp, Homo sapiens
atatgagattttatctgtttgcttgtttgtttttacataaatgatgcagaaataactgactctccaactggaagaaagtttaaaaattgaccctcatcttrtcccatatacagtagtaaatctcagatggaatgagtattaatgtaaaaaagacaattttttgaggaaatttaacagacttaactaaaaactggaaactct

SEQ ID NO: 34185 - DNA, 201 bp, Homo sapiens
atatttagtaggacataatagagaatccagaaatggatttcagtatatgagttaatatgattgttggtttcatgaagtaagaagaccatatgagattttawctgtttgcttgtttgtttttacataaatgatgcagaaataactgactctccaactggaagaaagtttaaaaattgaccctcatcttgtcccatatacagt

SEQ ID NO: 34186 - DNA, 201 bp, Homo sapiens
ctaaatttcaatttcacgtaaacagaatgggattaataatcatgtctacccccaagaccatagggctgtagagaagattaaataaggtagtgtaagtaaaytgatgaacagaatgcctgcattactaagtaaacactaactaaataaatgtaagttacttgttattattgttgtcattaaccagagtcaggatcacgtgtt

SEQ ID NO: 34187 - DNA, 201 bp, Homo sapiens
tacaaagggaaaaagaagctctgggccaggcatggtgacttatgcctgtaattccaactctttggaaggctgaggcaggagaatcacttgagcccaggagktcaagactagcctgggcaacatagggagaccctggctctacaaaaaaaataaatttaattagccgagcatacacctgtagtcctagctactcgggagcct

SEQ ID NO: 34188 - DNA, 201 bp, Homo sapiens
tatctaagtggaaaaaagttaacaaatttcactgtaatcagaaattagaaagaaatgcctgctatcatcattccctttttaaaaagaagtactttaaaggytttagtaaatgaacaatgtaagagatacatctgctataaatgctggaaactaagaagtaaaactatatatttgctaatactatgattgtgtatgtagaaa

SEQ ID NO: 34189 - DNA, 201 bp, Homo sapiens
tgtaatgtcaatgtaaacattgttgaaatggcaccagtttttggaaaagctcctggactccccacctaaactcttctgactgtaattaaacatgatcaacrttacaccaagagaggtagattcagcagtgcccagaaaaaaactggcaagatgccttgaaactgttacctcttggcctttgttttactatgtaaacacaaa

SEQ ID NO: 34190 - DNA, 201 bp, Homo sapiens
tgcttctaaacgaatgtgcacacaaatcacccagtgatcttgttaaaatgcaaattcttattcaagagttctgggaggggcctgagattctgaattcctamcaagctcccagggaatgccaatattgctgatccatgaatgcctcaagtagcaaggctccacaccattgtaatgtcaatgtaaacattgttgaaatggcac

SEQ ID NO: 34191 - DNA, 201 bp, Homo sapiens
gtcttattcttactcaaatatacatttcctatatgtttgttgactatataagtgattattgaacaactacagagcatccagtctttgctaacacttggtaraactcagaaagacggagattttttttctttgttcccaatgaattgataaaccagcggggaagacagacttctctacaactagacacagcaagtcaaaaag

SEQ ID NO: 34192 - DNA, 201 bp, Homo sapiens
tttcttgaccatctctctccaggcataaggtcttattcttactcaaatatacatttcctatatgtttgttgactatataagtgattattgaacaactacakagcatccagtctttgctaacacttggtaaaactcagaaagacggagattttttttctttgttcccaatgaattgataaaccagcggggaagacagacttc

SEQ ID NO: 34193 - DNA, 201 bp, Homo sapiens
tctgtcttttttctttttgagttggagtctcgctctggtgcccatgccggagtgcagtggcgtgatctcagctcactgcaacctctgcctcccaggttcawgtgattctcttgcctcagcctcctgagtagctgggattacaggtgcccgccaccaggcctagctaatttattttttgtatttttagtagaaacgggattt

SEQ ID NO: 34194 - DNA, 201 bp, Homo sapiens
ctgacctcaagcaatctatctgcctcatcctctcaaagggctgggattacatgcctggccaaaaagatcagcattttgattatatttattactttctagawtttaaaatataaattagaaatctcaggtttttgttgactagctggtaagatggttaaggttaggagctgagccatgttgcctctctgctttactccatag

SEQ ID NO: 34195 - DNA, 201 bp, Homo sapiens
gtatcccatgtacctagatcacagcctggcatgtcataggccctcaataaatattggttgaattaaattgcaaatgtaaacgctttagaagacaacatttrtctggacatggttgtgtgcgtttattcttaaaagtgacttataatctcataaatctgtatgaaatgaacatagatacagcacatgcatataacaggaaac

SEQ ID NO: 34196 - DNA, 201 bp, Homo sapiens
actttctctctggtggattgtatttttgcctgtcattatctctggatctcccccaggtcaagaagaagagagattggccctagaaactgccctgatgtacrgagctaaaaagcccctcaacacagaaggtgtcatgaaatcaaggtccaacgttgacatggactttgaagtggaaaatgctgtgctgggaaaagacttcaa

SEQ ID NO: 34197 - DNA, 201 bp, Homo sapiens
acctagatcacagcctggcatgtcataggccctcaataaatattggttgaattaaattgcaaatgtaaacgctttagaagacaacatttgtctggacatgsttgtgtgcgtttattcttaaaagtgacttataatctcataaatctgtatgaaatgaacatagatacagcacatgcatataacaggaaacatttcttgcga

SEQ ID NO: 34198 - DNA, 201 bp, Homo sapiens
atttcaagatcccatctgtgacaggtataatcattctctgaagaatattttacaacctagggagacaataatttacattttgttcatattagacaaaaagyaggaggacagggaggcagttgctcctccggagatttttttcttttctttaacagtccattttccgatatgtttggaattaggctaaattgtgttaggtag

SEQ ID NO: 34199 - DNA, 201 bp, Homo sapiens
cctggcaccagtgatcctgccctagaaaacctccttcttcttaagggaataactattattatagtctgatcgagctgatacaaatatagcccttgtgttgygaggcttatgtgagaatatatgtgaattatggttgtcagctggggctggttctttgtaatcaacaggggtgcctcaaataaatgaattacaggatccacc

SEQ ID NO: 34200 - DNA, 201 bp, Homo sapiens
aacatcgtacctggcacaggacagctctgcaacaaagatgcatccagcccgatatgtcagtagtgttgatgctgagaagccctgatctagatcatgattastgtttttgccacagccttcaaaccaggcttctctctccacaccccatgtgccagccagcctaaaagtaacttctggttcatgttctagtttgcctgtcat

SEQ ID NO: 34201 - DNA, 201 bp, Homo sapiens
gctactatcagatatacttttgaaggggcttatgcccatccttatatagcataccatggagaagacagatggctccaaaatattttttccagaaagaatawagtgatcatagcaaacacttttgccaataatgtctctgtggcagctccatcttcttcagtttagagagcttttgtaaatgctatctttattttgtatttt

SEQ ID NO: 34202 - DNA, 201 bp, Homo sapiens
tactggtatgggaagggttcttaatctagggttcatgggcccctagaaaaccatgtatggacttcataggtctatagtgcatcccctaaaaatacatgccyatattgtatatatcttgtatttgtcactgtgtatgtctgtgtagaggaaaggtcagtagctactatcagatatacttttgaaggggcttatgcccatcct

SEQ ID NO: 34203 - DNA, 201 bp, Homo sapiens
gaggcttcatgtagagccagtctactggtatgggaagggttcttaatctagggttcatgggcccctagaaaaccatgtatggacttcataggtctatagtrcatcccctaaaaatacatgcccatattgtatatatcttgtatttgtcactgtgtatgtctgtgtagaggaaaggtcagtagctactatcagatatacttt

SEQ ID NO: 34204 - DNA, 201 bp, Homo sapiens
catcagtgacctggaagggtgtatttcactttccacagcgtaggaggcttcatgtagagccagtctactggtatgggaagggttcttaatctagggttcaygggcccctagaaaaccatgtatggacttcataggtctatagtgcatcccctaaaaatacatgcccatattgtatatatcttgtatttgtcactgtgtatg

SEQ ID NO: 34205 - DNA, 201 bp, Homo sapiens
atactaagcattccttctcactgtcatcagtgacctggaagggtgtatttcactttccacagcgtaggaggcttcatgtagagccagtctactggtatggraagggttcttaatctagggttcatgggcccctagaaaaccatgtatggacttcataggtctatagtgcatcccctaaaaatacatgcccatattgtatat

SEQ ID NO: 34206 - DNA, 201 bp, Homo sapiens
aatactggaagcaaactgattaggcatgacatatgaaattacctgagaaggtttaatgtcctgaacatattcagatctgaagcctatctatgatggcccarttgcatgggccagtttctcaaatactaagcattccttctcactgtcatcagtgacctggaagggtgtatttcactttccacagcgtaggaggcttcatgt

SEQ ID NO: 34207 - DNA, 201 bp, Homo sapiens
atcaacacataacgtgaaaacactatgtgttggcagcattttcctcaaaagaagcaaggagagggagacacctccagttacatttcccaagcagaacacastgatgtcgagcattgggtaggtttttacatttagtttggtttgagtgtctaaggctcattatcatcagtagtcagggacaggaagtttacattctcggtg

SEQ ID NO: 34208 - DNA, 201 bp, Homo sapiens
ggtaccatagcatggtgcatcactgaaatcaacacataacgtgaaaacactatgtgttggcagcattttcctcaaaagaagcaaggagagggagacacctycagttacatttcccaagcagaacacagtgatgtcgagcattgggtaggtttttacatttagtttggtttgagtgtctaaggctcattatcatcagtagtc

SEQ ID NO: 34209 - DNA, 201 bp, Homo sapiens
cttgacaccatgggttgcattgtagagagaggtgggtacaggcacagttgtgtgatttcctagtgtcatatgtcaacagtggcaggagctggaatgacatscagcccctgaattaccctgtgctctaagactggtctgtatagtgccaaatattgataacttgggcccacccaaggagaaaatctcatataaataaaagta

SEQ ID NO: 34210 - DNA, 201 bp, Homo sapiens
tagcaatggaaagggcggatttctacagtcctcaaagagatgatttgcttttgaatacttgtgtttctctcctcttagttgctatcatccatgatttctgygcctttttgattgtttcttttttggtggtggcattttgtttttgtagctggtaacctggtatttctaagagttatttggtgacttattcccacttggtct

SEQ ID NO: 34211 - DNA, 201 bp, Homo sapiens
gccatgtgcaagctccagtcttgacaccatgggttgcattgtagagagaggtgggtacaggcacagttgtgtgatttcctagtgtcatatgtcaacagtgkcaggagctggaatgacatccagcccctgaattaccctgtgctctaagactggtctgtatagtgccaaatattgataacttgggcccacccaaggagaaaa

SEQ ID NO: 34212 - DNA, 201 bp, Homo sapiens
gttggcatcagacagtccaggttttgacttttgaactggcccattagtagctaaggaaagctgaggatagtttctgtgtcactgaaaacaatcacacttayctcatggaaatcttagtgtcctttctccagacctgctccctctctttcctgcatttgagggatgagatctacttttagaattacagagggaggaggcatt

SEQ ID NO: 34213 - DNA, 201 bp, Homo sapiens
tgatttgacacttttgaacattacaaggcagtaatttttagaatgcccctccatttgggtttgactgatgtttcctcacttgatgttaaaatcaagtcacrtatctttcacaggaagattgcagaaatgatgctgtgttcttcttggtgcctcctacctggttgcacataacttttacagatcccattactgatgatgtta

SEQ ID NO: 34214 - DNA, 201 bp, Homo sapiens
acggggattgtggtcttaataagaccagaggacttaggagaaaggcagcttggaatagagaggtctagagaattaaacatctttagctcacagcataatgsaaagaaagtgcccttcaggggaacatgtatacaacagggttctgagaagaggtaaaaataaaactgcatcctgcactttctgcttgccgtaatgctgcag

SEQ ID NO: 34215 - DNA, 201 bp, Homo sapiens
cttcctctgcatgcagtttcttttccctatatttatgctcaaacttgcatcattcttgtctctagacgttctatttgctgtaataaatgaaattcttctcmatctaaggttagtttgatctcacttctgaactacaatttgaggccaatgtaccacattctatctactcttcagtactctgcaagagattggagtgaggac

SEQ ID NO: 34216 - DNA, 201 bp, Homo sapiens
cctgtgctaagaaagaggaccagaggagttgattgctaagctccttttcaacaggaacatttgtgctcctccagctcattcttgggctggtttatcacggrgattgtggtcttaataagaccagaggacttaggagaaaggcagcttggaatagagaggtctagagaattaaacatctttagctcacagcataatggaaag

SEQ ID NO: 34217 - DNA, 201 bp, Homo sapiens
ctgctgtgggggatgggggtgagatttctaggtcactggagctgtgtacctaagaggattatggctgcctctgctgagtcatgcaggttgtcagggaagtkgggggaagctggcagtcacaggagtcacccagctgccatgcaaaccaaagggccagtctcactcccaccgtgcccccctcaacagccctaagtccatttc

SEQ ID NO: 34218 - DNA, 201 bp, Homo sapiens
aaaaaaaaaaagaatgtgttttaagggttttgctttatcagatgcataatataaatcaacagtgagttaagagtatccaagacactgacaatatcttgatktgaaataatagactgtttattttaaaagatgtaatggtctcttttttttttttttacagaaaaaccacaactagagtaatgtacttaattccagaaaata

SEQ ID NO: 34219 - DNA, 201 bp, Homo sapiens
cttggtaatggtgaattatctcagcatttgtttgtctgaaaaaggctgtatctttctttcatatatgatgcttagtttcgctggatacaaaattcttggcygataattgttttgtttgaagaggctgaagatagggttccaatcccttctagattgtagggtttctgctgagaaatttgctgttcatctgataggttttct

SEQ ID NO: 34220 - DNA, 201 bp, Homo sapiens
accgtggctcccactagtacatttcagccaaccatcatctttcaatttcttaagcaactatgcactctcttgcctcagtcttcacctatccttctttctcygcctgaagcattcctctccacccccctttccacatggacaactgactcctcttttgctcactgcttatgtctcacttccttcagagaaattccttatttt

SEQ ID NO: 34221 - DNA, 201 bp, Homo sapiens
tccctgtgaaggtctcaggagagaggcttcccaagctgtgaagtgctcaaaccacagcagaaaatagaatttaattgcaccactgataataaaccggatgkatgaaggaaactgataactttcatcttttaggcactattaatttgcaggattatttgttagttatcttctgggtttacttaaagagcagtttaattcccc

SEQ ID NO: 34222 - DNA, 201 bp, Homo sapiens
tgatgtgtgattttcacatacataacatactttctctattgagaaatgtcttgccccaaactgtgcagcttgtaacgtgtagataactatttcttagcctrtactctttcaactattttgtgctgcattttggtgaaaatagacagcctatttcatcattttgaagcaacatttatatagaatgtcatttcagatttttgc

SEQ ID NO: 34223 - DNA, 201 bp, Homo sapiens
tatgatgctacgagagcccctaatgaggagatcactctgaaatccacaaagccttgttttcagctttttattacactttattgctgcaaagaaggagaagraggacctccctccacaagcaagctgcctaatagctgtaaatgcaaacactttttgctattattaaatatagatcggggtgttatgaatgtcatcaggatt

SEQ ID NO: 34224 - DNA, 201 bp, Homo sapiens
tttcacatgaatcactatttgcccatgtttgccactatttctcctatgttttatttttgaagctttataatttgaacttttacattgtggtctatgatccrtcttgagttaccttttggtgttgtgtgaggtagggatcaaatcttattttttccaaatttatccatttgttccaccagcatttgttgaaaagactgttgg

SEQ ID NO: 34225 - DNA, 201 bp, Homo sapiens
tgctggtagcactgggggtgggtcatgagttgcctggccccactaattcacacacaatgttctatttcccctggatttgtcctctgtctgtcctctctccmggtcacatgagctccttggatacagatataatgccttttacatgtcctgtctgattcaatccttctctttcaggtgggggcagtggggggacgatgaact

SEQ ID NO: 34226 - DNA, 201 bp, Homo sapiens
tgatcctacagataaacagaaaataaagttattttccctttgtccatcttttcctccccctctttttgtcccagtatttagaaagatttttttctttccaygcatgaaaaagacagtaatgacataactacttttatatcttgccaagcagctcctcaaggggttaactataaaaccatgttttgttcattttctttcaat

SEQ ID NO: 34227 - DNA, 201 bp, Homo sapiens
ttctttgctttttggaaaagagatgaggcagctccagtctgtgtctcccttggctttccccagacaccgtaaatgatattggcagcatcccagccctaccrctcatagagcgaaaacctattcctccttctcctgccacgtttaataaactttatctagaacaatttcttgtgcagtggcaaaacacagcacttacataac

SEQ ID NO: 34228 - DNA, 201 bp, Homo sapiens
actgaagaacttggagtctgatgttcaaaggcaggaagcatccagcatgggagaaagatgtaggctgggaggctaggcccatctctccttttcaagttttkctgcctgctttatattcactggaagctgattagcttgtgcccaccagattaagggtggatctgccttccccagcccactgactcaaatgttaatctcttt

SEQ ID NO: 34229 - DNA, 201 bp, Homo sapiens
ataaggaaaagggagctttgcagattcctaaaataatgtgatgcaaacagatattttctccccaaatagtcattgttctcagcattttgtaggtaccatarcatggtgcatcactgaaatcaacacataacgtgaaaacactatgtgttggcagcattttcctcaaaagaagcaaggagagggagacacctccagttacat

SEQ ID NO: 34230 - DNA, 201 bp, Homo sapiens
catatgcttagtggaagatatcttgtgatttctaaaaaagtaatttctttccaaaaagtttatataagagaaagagagtatgtgtgtgttagtaactttcytgtttaccaaagaatcagagtagcagctcattatcatgaattagtataaaggacaggaatgtcaatatcagtaagtgatatgtaacttgaaaaagcatac

SEQ ID NO: 34231 - DNA, 201 bp, Homo sapiens
ggatttcagaaaataaagaagctattccagcaaaaaaaaaagtttctatttttacctgtattctgtcagggatcacagtatatgtagttttgaagatgaawgttttagagtcagaaagacctggatttatatccaacttccgccagattcctaactctgtaggctttttatttatcttctaaatttcaatttcacgtaaac

SEQ ID NO: 34232 - DNA, 201 bp, Homo sapiens
cttagccaggatagatgatcgtaaactatgtctatgagtgagccctcctcatcgaaggtgttcatttccatctctctcttcaggacagctacagaacagtrcacattttagaatgaaaatgaggagtcactggtaactgcggtacctaaaacataatttgctctgtgcatttcatgtttgctatttttttgaatcttaaaa

SEQ ID NO: 34233 - DNA, 201 bp, Homo sapiens
aggagtgcagttgctctgttttaacctgagctaaccagcacttacacagagcctggggtgctcctcttgcaaagacagtgtacatggggcctgtgaaagakgcttaacccacagaaatcgacttcaacaagcagaatatctgcatgaccagcactgattggtggggaattgtatagataacacaagatccatgggaagtat

SEQ ID NO: 34234 - DNA, 201 bp, Homo sapiens
gagtagtgaagaaaagttgcacctacaggcagctaggggcagcaggaagcgagctgtccacatgacagatgtctcttggaaaccatggagccgagcacagytgccattagctgtcagcatggaggtgacagtgaaggccaactcaggaatgggacagaatcagatgccacgagaggaaagactaaaacccagtccacgaaa

SEQ ID NO: 34235 - DNA, 201 bp, Homo sapiens
aagatagactcaatctgatgtttctgttctattttgaggaccattcaacagcacaggcagaaaactctgattgtcaaagaatgttctagcaaatgattagwaatgttactgaagagacagtttgggttcctagtgataaaaatcaatcattccttataatagcaaccaccaaaaaaaggtcatagttttagctgctgcata

SEQ ID NO: 34236 - DNA, 201 bp, Homo sapiens
agggcatagagcaagcactgaataaacagaattgcttggaaaaaatttttaatgcataaaaactccatgctgcaatgggtggtcttaatctataaacaaasctttttcaaagcacattttagagcagaaattaaccagctttcacacctgggacactgccctaatcagtgtataatcctaattctcattatgtcctcagta

SEQ ID NO: 34237 - DNA, 201 bp, Homo sapiens
ttcccttgagatgtatgcatttatttttaaccctggccttttgctaatatcgaaccacaatgccatcattaatccccattaatactttgctctgactatgmcttttgggaactaactcatgactaaacttttttaaccaatcgatgttcgatgtactctttagcattgtaaaaaaatcttgaacttcagctagtaaatcaa

SEQ ID NO: 34238 - DNA, 201 bp, Homo sapiens
gaggtttttaaaaaaatactgaagagacctgaaattgcatgaatgctgagaagacccactattagcaagcaggagcttgaagctgcaagaggaagagtacrtaagagtcacagcaaagccccggagaacaaggcaacgcagaagcctggtttggagatgcagagggaggagggacctttccaacttcagtaacaagaagaa

SEQ ID NO: 34239 - DNA, 201 bp, Homo sapiens
attataactcagacctgtgcttctaaacgaatgtgcacacaaatcacccagtgatcttgttaaaatgcaaattcttattcaagagttctgggaggggcctsagattctgaattcctaacaagctcccagggaatgccaatattgctgatccatgaatgcctcaagtagcaaggctccacaccattgtaatgtcaatgtaaa

SEQ ID NO: 34240 - DNA, 201 bp, Homo sapiens
gagaaaagaaaaaaaagagaagcaattagaaaaaatgaagaaacttgcccacagttatacttctccctttaaattgcattgcttgattgctgctttctttycaatgcatttctgatgtgacagttcccaccaggaaaattgccagagaaagctaaggagaatgcttaactttgtgccatccgaacacttacttccctcaca

SEQ ID NO: 34241 - DNA, 201 bp, Homo sapiens
gccaggaactaggcttggacaggggaagcaaattcatttcctgtttgtggcaaacggagtctggatgatgataagactttttccatctaaactgccttgtkaacccagtaaacaaagcaaaaatcaatatgctagattcatcaatgcttgctggaacacactccatggcaagggacatttcctaggcaaaatggacaatgg

SEQ ID NO: 34242 - DNA, 201 bp, Homo sapiens
tgcatctcacatcattcaggaagttacatgagagcctcaacttcatggctgccatagttgtaagacaggaagaaaaaagaacattgctggggaaataattmtcttaaaattcagtgcctgtttcaataggactgaataaagccaaggaaattagattttaaggctaattgctataatgagaagagacaagtatagaacgtg

SEQ ID NO: 34243 - DNA, 201 bp, Homo sapiens
ggagggggagaatttgggtgttaaggggtagaggtcctgacctgagacattttgagcaatatttccatttccgtcatacccttgtttatatacacaaaatrttcaatggttttcaaaaacactttcacctctattagctcctttaaaccttagaatacctctgtgaatctttccaaaatctgttccgttttaataatttta

SEQ ID NO: 34244 - DNA, 201 bp, Homo sapiens
aaatacgttacagacaagcaaatgctaagagattttgtcaccaccaggcctgccctaaaagagctcctgaaggaagcgctaaacatggaaaggaacaaccrgtaccagccactgcaaaatcatgccaaaatgtaaagaccatcaagactaggaagaaactccatcaactaatgagcaaaatcaccagctaacatcataatg

SEQ ID NO: 34245 - DNA, 201 bp, Homo sapiens
aacagacttaactaaaaactggaaactctgacactgtagaagaaagcaagaaccatgtacagttatgtgccacatagcaacatttcagtcaatgacagatyatgcataggtgatcttatgagattctgatggagctgaaaaattcctgttacatagtgatgtcatagctatcataatagaatagtgagattacttattttt

SEQ ID NO: 34246 - DNA, 201 bp, Homo sapiens
tctactatttagtgtagaaattaagcacacttcgaggggcgtggaaggacccatggtagaggatttatcttgatcagagtcatttctgcatctcacatcaytcaggaagttacatgagagcctcaacttcatggctgccatagttgtaagacaggaagaaaaaagaacattgctggggaaataattctcttaaaattcagt

SEQ ID NO: 34247 - DNA, 201 bp, Homo sapiens
catttttttcagtggccactcttccagttagcaagctgctcttgtaatactgactgagaaatgcagagaggcaagaagaggaaaaggggggaaatggcggstttttcatttctaatagttctgtagcagtgagtcctgcccatcactgtgtgtgatatatacagtgttctaaggtatactgagtgtatataacgcccttaa

SEQ ID NO: 34248 - DNA, 201 bp, Homo sapiens
ggacgtggattaaatgggatgtccaggacccatgcagtcctggattatatcaatgtacccaacatggagagccagatgttggtacagagaagtagacccartctggctgaagagtagattatttctgaagaaatgttaaactgggtggtatttcaaacaatcaaagactgaaaaaaagaaatacttatattaccaatttcc

SEQ ID NO: 34249 - DNA, 201 bp, Homo sapiens
gattgtcgtgagcatctagtgagcagtgtctgtgatcaagtctgacccacagcacgtgaccaataagtgttcattgactgggaatgtgcaacttatcataycccagcaaggtcaggaaagcactccagggaatacttgttcctatgaggaatatgtacgacctgtagcccccataaatctgacatctgaacaaaatgctgc

SEQ ID NO: 34250 - DNA, 201 bp, Homo sapiens
gtcagaaacttccaggaccgcctttggaggcagaagagcagttccacccaataactctaatgcagcggaagatgacctgcccacagtggagcttcagggcktggtgccccggggcgtcaacctgcaaggtatgagcataccccccttccccaccactctgggtccaggcacagccgggccctggcccctcttccctgcagg

SEQ ID NO: 34251 - DNA, 201 bp, Homo sapiens
tgaggtacagtataggtaaaatcttcctgtcttgctatttgatctttattcctttttaagaaaattctggtattgcctgtggctagcagttctttctaagragactgaactggtaccagactcctcccttgatagtgtaatctactttctgcagccttctgccctctccttgatcctggggtccaccttgtctcagaagag

SEQ ID NO: 34252 - DNA, 201 bp, Homo sapiens
taatgacctgcattctctctcttaggtccgtggcactcaggtagttggttctgacatgactgtgacaattcagtttaccaatcctttaaaagaaaccctgygaaatgtctgggtacacctggatggtcctggagtaacaagaccaatgaagaagatgttccggtaaaccttgggttggggagaccgggcaggcagtgcagg

SEQ ID NO: 34253 - DNA, 201 bp, Homo sapiens
cagaataaccagccaagcatgtttacagtgatgcagggaatcaatccgttctatgactatttccttaactctccagttagttgctatcctgcccagcaaayacagctgagagaagctgcttaataagaaccaaaatactgagctatttgcatacctgaagaactagtgcaattacccattactgcatccatcctgtcagtt

SEQ ID NO: 34254 - DNA, 201 bp, Homo sapiens
cctttgggtaggcaccctggagcacagtcacttgattgtatcttctgccactcaaagaggctattggtgtgtatcctttggccagaataaccagccaagcrtgtttacagtgatgcagggaatcaatccgttctatgactatttccttaactctccagttagttgctatcctgcccagcaaacacagctgagagaagctgc

SEQ ID NO: 34255 - DNA, 201 bp, Homo sapiens
tcctcagtgacatgcaacctttgactatactgcctactgcctgatgcccttgtcttgggtccccaatttctagcctttagcctggtgattctatttatggyccaaatatgacaatctatagatagctaacaaggggaaaagtcatcaaggtgggcagcaaggaggtctggaaaagtgtcccaagcccagtcagggcactct

SEQ ID NO: 34256 - DNA, 201 bp, Homo sapiens
ctaataaatgagggttgtgatttatctagcaacaggggaacagctcagcattaacaattaaaaggtctgtagaggacagagctttttttccttactcttcyccttagctgattgagttcagccctatgctataaatagcccttgtaattaatggctatctgtttgaaaatcagttatcaggaccacagtttaggagccttt

SEQ ID NO: 34257 - DNA, 201 bp, Homo sapiens
gtgggggccaatattcaacattcttaaagaaaagaattttcaaccccgaatttcatatccagccaaactaagcttcataagtgaaggagaaataaaatackttacagacaagcaaatgctaagagattttgtcaccaccaggcctgccctaaaagagctcctgaaggaagcgctaaacatggaaaggaacaaccagtacca

SEQ ID NO: 34258 - DNA, 201 bp, Homo sapiens
gttgctatcatccatgatttctgtgcctttttgattgtttcttttttggtggtggcattttgtttttgtagctggtaacctggtatttctaagagttattyggtgacttattcccacttggtctcagcacactccctttccatcctaagactgttagcacaagttttgcttccttttccaaagcaactgtattcacacttc

SEQ ID NO: 34259 - DNA, 201 bp, Homo sapiens
tactccagaagcatgttgtaaggattaatgagggaataactggaagctctttgaactgcttcgtgatagttccttcctaataagatgacccaattaccagscttattttcaatattgcaactatgtaggaaagctaaattcttatggtattccttaaggaaggataaccttcataaaatgctactataacagcagccagag

SEQ ID NO: 34260 - DNA, 201 bp, Homo sapiens
gctgggaaaagacttcaagctctccatcaccttccggaacaacagccacaaccgttacaccatcacagcttatctctcagccaacatcaccttctacaccrgggtcccgaaggcagaattcaagaaggagacgttcgacgtgacgctggagcccttgtcctgtaagctaacaatggtgtggttctttgtgagactcgctgt

SEQ ID NO: 34261 - DNA, 201 bp, Homo sapiens
tgatttatttagccaacacttactgagcacctcctaatgactgggccctgctctagtgctggagatgtgtagaagaataagaccaacagagctcccaaagkagatttatgcactctacaaatgcatgatggaattgcaagatgaaaacagaaaaactcttatggatctagataaagaagctttagaataaaaagtagcatt

SEQ ID NO: 34262 - DNA, 201 bp, Homo sapiens
gacacggtaccttttgactgtatagtgagaacttaagtttcaaatgaaggctccgagaacataaaaaaccatgaatcttaaagagaaacaaacaagcaaargtttaataagaacttccttgctagatgtcctcatgatttatttagccaacacttactgagcacctcctaatgactgggccctgctctagtgctggagatg

SEQ ID NO: 34263 - DNA, 201 bp, Homo sapiens
aaacctaaatgaactttcttccttctcacttctcacggactcatttaggtgaatgccaaagatgacgaaggtgtcctcgttggatcctgggacaatatctrtgcctatggcgtccccccatcggcctggactggaagcgttgacattctattggaataccggagctctgagaatccagtccggtatggccaatgctgggtt

SEQ ID NO: 34264 - DNA, 201 bp, Homo sapiens
gatccagttcaatatgttatttcaagagaaaaactcccccactttgtgatttgggcttaaactttaagtttctcaaataggacagaagctaaggtctagamgcacagaggacaaaccatgggcagttgcagtttattgtaataataatcttatttgcctgcgtgcattcaagatgataaatggccggtatctcctgatggc

SEQ ID NO: 34265 - DNA, 201 bp, Homo sapiens
ggggtagggaaacttggagaaaagtaaagcagaccctgtctcaagtcttgatgccaggcctgtgtgtgttttctcctactagtcaagaaagaggcggtgcwgatccaagccggcgagtacatgggtcagctgctggaacaagcgtccctgcacttctttgtcacagctcgcatcaatgagaccagggatgttctggccaag

SEQ ID NO: 34266 - DNA, 201 bp, Homo sapiens
attctgttttgttctctgatgtatcccatgtacctagatcacagcctggcatgtcataggccctcaataaatattggttgaattaaattgcaaatgtaaaygctttagaagacaacatttgtctggacatggttgtgtgcgtttattcttaaaagtgacttataatctcataaatctgtatgaaatgaacatagatacagc

SEQ ID NO: 34267 - DNA, 201 bp, Homo sapiens
actcacccagccaggcgtgcacctggggctccccccttctcccccttagcactgtgtctcccgacagcgcgccacactgttctgcacccctggcaatgccrcagcctaccttcggtatttctcactagaggatggctctcgcagccttctccctatcattaaccctttttcgctcttctccctcccttcccccgtcagctc

SEQ ID NO: 34268 - DNA, 201 bp, Homo sapiens
tacatacacgggtagattcaagggctgtttaagaggtaggatagaaaatatttgctcaaggatcggatttgatgattgagggagagaaacaaggaagcctsaagaatgatgcccatgtgtctggtgtaccacctgcgtgcaaagtgatggtattcattgaggtagggaactcctgagatgcaccaggttttccaggaaagt

SEQ ID NO: 34269 - DNA, 201 bp, Homo sapiens
aatgacttttaggggtttttgaaatttttttctaattttgtaggtattatgggagggcaatttagtgtagccttaatgaagttgaataatgcctcctgtaygtagtcctggacttgtattgtctacttgaccaccagtgactcaagaccaagacactttattctgccactggtcaaaccctgagatcatgagagggtgtta

SEQ ID NO: 34270 - DNA, 201 bp, Homo sapiens
gtgtgtggctgactcatgggcaatgaaataaattttgttgaatcagtggtattggggacctcacctctatccccaatactttggacaacccattaagcttsctcatgtcttttccatttgactacagtctggaacattatttctttaaactctcaacctctctgtgtagcttttaatcttccccttcttagccaagtttta

SEQ ID NO: 34271 - DNA, 201 bp, Homo sapiens
cattttgattatatttattactttctagaatttaaaatataaattagaaatctcaggtttttgttgactagctggtaagatggttaaggttaggagctgakccatgttgcctctctgctttactccatagtcctcatgttttgttgggaccatgttttgaagtttattgcattatgctgataatgacttttaggggttttt

SEQ ID NO: 34272 - DNA, 201 bp, Homo sapiens
ggtagacagtttgaaagctgtcactttgaaagagcgagctgccaagtttctagctaccgtatttaaaaaaaaaaaaaaaaaaaaggcggcttagcaatgarctgttccattttgccaggaactaggcttggacaggggaagcaaattcatttcctgtttgtggcaaacggagtctggatgatgataagactttttccatct

SEQ ID NO: 34273 - DNA, 201 bp, Homo sapiens
gggtccagcttgtataggccttgtcagtttcagcttgcaatttatccaaaaagcaaagagaagtagccatataagggctttgtgcaaataatttgatttcrgattttagccctgaaatgctcattctgactgcactgtagagaatggactggaaaggggtacatacacgggtagattcaagggctgtttaagaggtaggat

SEQ ID NO: 34274 - DNA, 201 bp, Homo sapiens
catccagcagggagttttcatggaatctggtggtcacagggtactttcttggctccggatgccttgctttgacttccatatgggatctccctgtgttcctyacccactgctccagtacccgtgttatcctgcctacctggctttgtgaacagcttccctgactccggagaattacatgcccagtgctcaggcttccccgcc

SEQ ID NO: 34275 - DNA, 201 bp, Homo sapiens
atatcatatataaatatattgtttataatatgtaaacaatatatacataaataatatataaaaactatatattatatatgtaaacaatatatttttaaaamccaaactcatgggtttatagttttttcatagtgaaaacaaacaaatatatagtttgcttatatctattatatataaacagtatataatatataaagatat

SEQ ID NO: 34276 - DNA, 201 bp, Homo sapiens
agtccattttccgatatgtttggaattaggctaaattgtgttaggtagacagtttgaaagctgtcactttgaaagagcgagctgccaagtttctagctacmgtatttaaaaaaaaaaaaaaaaaaaaggcggcttagcaatgagctgttccattttgccaggaactaggcttggacaggggaagcaaattcatttcctgtt

SEQ ID NO: 34277 - DNA, 201 bp, Homo sapiens
aacatggtaaagccccatctctactaaaaatacaaaaattaggcgggcatggtggcatgcacctgtagttccagctacttgggaggctgaggcagaagaaycacttgaacccgggaggtggaggttgcactccagcctttgcaacagagcaagacttcatctgaaagatagaaagatgaaagaaagaaagaaagaaagaaa

SEQ ID NO: 34278 - DNA, 201 bp, Homo sapiens
caaaatccaggtcttgttcagctggaaaaaaccagcagcgtccagacatgactgggttttttgtttgtttgtttgagatgtgaagttttgcatgtaaatcraatagagtttgccagaaaattcattgcctgaacaaatatggtctgctccttgggtattgccaagtaggagaaagatggtttgtctggagagactgcagag

SEQ ID NO: 34279 - DNA, 201 bp, Homo sapiens
gagttttggctgggatggctggaactgtgcatcattgcgctgggcatccagcagggagttttcatggaatctggtggtcacagggtactttcttggctccrgatgccttgctttgacttccatatgggatctccctgtgttccttacccactgctccagtacccgtgttatcctgcctacctggctttgtgaacagcttcc

SEQ ID NO: 34280 - DNA, 201 bp, Homo sapiens
ttagcgacacaagcgggggcgaatgtcatttctcaggagttttggctgggatggctggaactgtgcatcattgcgctgggcatccagcagggagttttcayggaatctggtggtcacagggtactttcttggctccggatgccttgctttgacttccatatgggatctccctgtgttccttacccactgctccagtacccg

SEQ ID NO: 34281 - DNA, 201 bp, Homo sapiens
accaaatacttggttgacctgtgggtggctgactcatgggcaatgaaataaattttgttttatacgtataactttatatatatgtaactttatatatatawaaaaagtttgcttatatataatatatatacacatatcatatataaatatattgtttataatatgtaaacaatatatacataaataatatataaaaactat

SEQ ID NO: 34282 - DNA, 201 bp, Homo sapiens
ttgtgttccagaatctctacctcttttaaggtgcagatactttttcactcgtttctccacagcaggtgtttccaccattctgttcagaacaataaaaagakcagcttttttttttttttttttttttgagacaggatctcactctgttgcccaggctggagtgcagtggtacaatcagctcactgcaacctctgcctcccc

SEQ ID NO: 34283 - DNA, 201 bp, Homo sapiens
atgtacatcagcatcatagaattctgaaactactgatgcaacagaatcataaaatgtttaatgagacatatcaatttaattctgctgcttggaacttaaaragccagagttcgtcagcattttgctaacaaatgtcatcatttacagactgaatttggtgctgattatgttcaccattactaaaaatattgggaaatgagc

SEQ ID NO: 34284 - DNA, 201 bp, Homo sapiens
tctcacgtgtcccagatttgttttaaaaatcattttcaattcatctagttttctattaatgttaaaaggttggaaattatattttaattagtgttagagaygtacatcagcatcatagaattctgaaactactgatgcaacagaatcataaaatgtttaatgagacatatcaatttaattctgctgcttggaacttaaaga

SEQ ID NO: 34285 - DNA, 201 bp, Homo sapiens
attaaaaggagatgacctactgcttccctcctgccagtgatgggccacaaaacagacatgacacgtgggccttctcacgtgtcccagatttgttttaaaartcattttcaattcatctagttttctattaatgttaaaaggttggaaattatattttaattagtgttagagatgtacatcagcatcatagaattctgaaac

SEQ ID NO: 34286 - DNA, 201 bp, Homo sapiens
actcccggctaattttttgtatttttagtagagacagggtttcaccgtgttagccaggatggtctcgatctcctgatctcgtgatctgcccctctcgcctyccaaagtactggaattacaggcatgagccaccgcgcccggcccccaagacgcacttttaagagattatacaggaaagttttacttatcactgccttagtt

SEQ ID NO: 34287 - DNA, 201 bp, Homo sapiens
ccaatgtccaaaaattatctttttagttagtttatttggattaaggtctgtagattaaatttggttggtatgtcacttaaatcttttcctctagagtaatyctcttcatctgtttcttcatgccacaaacttatggctgaaactgagtcattttttatgtagaactttccatattctgaattttgctgattccatcccccg

SEQ ID NO: 34288 - DNA, 201 bp, Homo sapiens
cccgggttcaagcggttctcctgcctcagcctcccgagtagctgggactacaggcgcccaccaccactcccggctaattttttgtatttttagtagagacwgggtttcaccgtgttagccaggatggtctcgatctcctgatctcgtgatctgcccctctcgcctcccaaagtactggaattacaggcatgagccaccgcg

SEQ ID NO: 34289 - DNA, 201 bp, Homo sapiens
tccttattttttgccttagcattttcaagtaaattctagtaatcatattattttacctgtacatattttagcgtgtagctttttaaaaatagacatatatrcagtatacatagatacatatgtacatatgtgtgtatgtatgtgtttaagtgtgtttgtgtataattattgcagctaatacaaatcaacaagagctccttg

SEQ ID NO: 34290 - DNA, 201 bp, Homo sapiens
ctgcaagctccacctcccgggttcaagcggttctcctgcctcagcctcccgagtagctgggactacaggcgcccaccaccactcccggctaattttttgtwtttttagtagagacagggtttcaccgtgttagccaggatggtctcgatctcctgatctcgtgatctgcccctctcgcctcccaaagtactggaattacag

SEQ ID NO: 34291 - DNA, 201 bp, Homo sapiens; identical to SEQ ID NO: 7125

SEQ ID NO: 34292 - DNA, 201 bp, Homo sapiens
ggcacaatcagaataccttatcccacaagttagcagacctgggcatgtagagagtactttaaatggagagttatattgttttgtgtttccttccacaaagsaaccagagatgctgttcctggaggaaacttatttagaggtagggacatttgatagggaagagagcatgagagagatggagattctggcttctgtccatgc

SEQ ID NO: 34293 - DNA, 201 bp, Homo sapiens
ttacttaaagagcagtttaattccccagggcacaatcagaataccttatcccacaagttagcagacctgggcatgtagagagtactttaaatggagagttrtattgttttgtgtttccttccacaaaggaaccagagatgctgttcctggaggaaacttatttagaggtagggacatttgatagggaagagagcatgagag

SEQ ID NO: 34294 - DNA, 201 bp, Homo sapiens
cctgtcccagctgcttggtggaagcagcttttgctacccttctgggctattgcgcaggtttcatttatgagctcaaccctgaaccttccctgacagcagcraggcctgtgtgcgtacctaattatgaagtgacggcctgtccctgtgaaggtctcaggagagaggcttcccaagctgtgaagtgctcaaaccacagcagaa

SEQ ID NO: 34295 - DNA, 201 bp, Homo sapiens
aaaatatacagcttgatgatgattttgtatgtgcgtgtgccttgcaaccacaagccagatgaagaaatggaggatttccaacacccctagaaggttccctsttgccttttacagccaataaccccctagactatcaccaagatagtaacttttctgacttttatcaccataggtttgttttgcccatttgaccagtagttt

SEQ ID NO: 34296 - DNA, 201 bp, Homo sapiens
cgtgctaaccatccctgagatcatcatcaaggtcagtcttagcgtctcatcctggaacagagacaaaggcacgcagacttagtgttcatgtgtgcatatgygtgcttgtatgtgtgtgtgtgtgtgaatgaatgtcctgctcaaaaaaaaaaaaaaaaaaaataccagtgctaggatcctcttgttctttgaaagaagtaa

SEQ ID NO: 34297 - DNA, 201 bp, Homo sapiens
ttaacttatttcaagatcccatctgtgacaggtataatcattctctgaagaatattttacaacctagggagacaataatttacattttgttcatattagasaaaaagtaggaggacagggaggcagttgctcctccggagatttttttcttttctttaacagtccattttccgatatgtttggaattaggctaaattgtgt

SEQ ID NO: 34298 - DNA, 201 bp, Homo sapiens
tgctgaaggtggagcccgcctgattggctgagagactggatatgtggtgtgagagaaggaaggtatggaggaagccaaatgagtgatgaatgtgaaatgtktgccacatggtagaatcttagtaaatggtaacttccaacatgtttacatttggggaaactgaagctcgagagatgagtcgatgtgttcaagcccccacac

SEQ ID NO: 34299 - DNA, 201 bp, Homo sapiens
cactgcaagctccacctcccgggttcaagcggttctcctgcctcagcctcccgagtagctgggactacaggcgcccaccaccactcccggctaattttttktatttttagtagagacagggtttcaccgtgttagccaggatggtctcgatctcctgatctcgtgatctgcccctctcgcctcccaaagtactggaattac

SEQ ID NO: 34300 - DNA, 201 bp, Homo sapiens
ggtacccaaaagaaatgtgagaaagagttatttttcctgtttttttttaaataaataaaccagtttctcatggatagcatttatgcttatagttcaataayaatattaccaaaaattgcatggagaattcagttcactagggaattcctagtatataaacctaaacatttaacttatttcaagatcccatctgtgacaggt

SEQ ID NO: 34301 - DNA, 201 bp, Homo sapiens
aatgttcacatccaattggaaacattttgtatgtgttcattttgtatttcagttttatatcttttgacaaagttaatttttcttataaatattttcagatraactcaaaagcagaaagagtagcacaatgaatatctacttatatgactctcagagttaatggttatcaagattttgccacatttgctttatctatccctt

SEQ ID NO: 34302 - DNA, 201 bp, Homo sapiens
agacagactttttttgtttttgttttgagacggagtccggctctgtcgccaggctggagtgcagtggcgcgatctcggctcactgcaagctccacctcccrggttcaagcggttctcctgcctcagcctcccgagtagctgggactacaggcgcccaccaccactcccggctaattttttgtatttttagtagagacaggg

SEQ ID NO: 34303 - DNA, 201 bp, Homo sapiens
gggactaaaagatgaaagagaagatataagcctgggaaaagatggcaggcatcacaccataccaggccttggggatcttgctttcctcctgcagataatgsgggacttgagaaggattctaattagcagaaatacataatcagaattatgctttacaaagtggtagggagggctgggcacggtggctcatgcttgtaaccc

SEQ ID NO: 34304 - DNA, 201 bp, Homo sapiens
aaatataatcatgcagtatgtactccttgtgaggcttcttttatgcttccttactgtattctgagcttcatccatgctgttttttgtttcagtagttcatwcctctttattgctgagtagtagtgtttcattgtatggatgaatcactatttgcccatgtatttacttgtggatggacatttaggccattttccgtttttg

SEQ ID NO: 34305 - DNA, 201 bp, Homo sapiens
tgaatgagcatgcaaagttccaaaacttctgagtagaagtttggttgggttcacattggtcatatagactaatttgggtagaatttatatctttacattastgaatgttcacatccaattggaaacattttgtatgtgttcattttgtatttcagttttatatcttttgacaaagttaatttttcttataaatattttcag

SEQ ID NO: 34306 - DNA, 201 bp, Homo sapiens
cagccttgactatcaacattcaattctcacctgccccaccccacaacaccgtaactactgagtttcttttgcaaaaccctagcatgtcatgaagcacaatytgacatccaccacaccacttccacctgtgattaagtctggtcaccaccacactgtagctggggatttgtggttcacaaaacctggaaacgattttctaca

SEQ ID NO: 34307 - DNA, 201 bp, Homo sapiens
gccctgcctggctgttttctttcacattgttttttccagataagcttttgaatgagcatgcaaagttccaaaacttctgagtagaagtttggttgggttcmcattggtcatatagactaatttgggtagaatttatatctttacattactgaatgttcacatccaattggaaacattttgtatgtgttcattttgtatttc

SEQ ID NO: 34308 - DNA, 201 bp, Homo sapiens
ggaaatacatgcacagagaagcaggggtggcacaacataggaaatctgcccatataatcctatgcacaaattaaaggaaaaaattaggcaatcaaatcagyagtcacagaaaggtacatggtaaaattcagcatccagttttaggaagagtttaaggggaaaaatttagaaaaaaaacacctcaatgataataaagattgc

SEQ ID NO: 34309 - DNA, 201 bp, Homo sapiens
gctaatgacctgcattctctctcttaggtccgtggcactcaggtagttggttctgacatgactgtgacaattcagtttaccaatcctttaaaagaaacccygcgaaatgtctgggtacacctggatggtcctggagtaacaagaccaatgaagaagatgttccggtaaaccttgggttggggagaccgggcaggcagtgca

SEQ ID NO: 34310 - DNA, 201 bp, Homo sapiens
ttaccttctctgggtcgggaggacagtgggaatgtcagagggtgactgaaatccaccccaaattttcttggcccactcttttcttttttaactacccttcyattcccaccagaggaacagtaaaataaatgaggtcattattcttcactacatgcctcttgtaaattgttagtcagcctgcaagggtggttatttacgagg

SEQ ID NO: 34311 - DNA, 201 bp, Homo sapiens
tcagtaggctcagcatttgtttttacatgtttgttataaatccttaccttctctgggtcgggaggacagtgggaatgtcagagggtgactgaaatccaccscaaattttcttggcccactcttttcttttttaactacccttccattcccaccagaggaacagtaaaataaatgaggtcattattcttcactacatgcctc

SEQ ID NO: 34312 - DNA, 201 bp, Homo sapiens
tagtcattgttatttcgaggataccagtcctggcgaactactctactttatactgaaggggctaaaaggaaagaagcaaactcaactgactattgaggaamcatttgcttgtgcttcatagattgattccattccagtgttactagataggcaagcaacgtctctggagtggctatatgaaaccattttaggaaggcagtg

SEQ ID NO: 34313 - DNA, 201 bp, Homo sapiens
tcagccctttaggatatgcacagcttcatgcaccttgggttcccttcataccctctttctttcccctgtctcctcctgttacatccttccctttttcctcytcctgctctgcatttttccctctctcatacgtccattcctttaattcagatatttttgaggcctgttctataccagctctacaccatgcagcagtggtat

SEQ ID NO: 34314 - DNA, 201 bp, Homo sapiens
ttccttgtagagtctcttatatgcttcaaagtgtgctcatagtcagtatctccctagattgtgtgtttggaaggtgtaatccttatctcattcagcctttygtggtgcctggaattgagtcaatgttcagtaaatgtttgctgaactgaactgataatcaccattctgagaggcaaggagacgattattagactcagattt

SEQ ID NO: 34315 - DNA, 201 bp, Homo sapiens
ctagtttctctttgtttttctttctccaaatagtttgaagatggcatcctggacacttgcctgtatgtgatggacagagcacaaatggacctctctggaakagggaatcccatcaaagtcagccgtgtggggtctgcaatggtaagcagcaattactgatacctaaaatctgttacacctgtcatttgcctcagtatatat

SEQ ID NO: 34316 - DNA, 201 bp, Homo sapiens
attccttcttaagcattctaaaatggcacactcatcagcataagcttactcacacactgtgtgtacttttacgcacccagaagtcagaaatcactgcctarcagaagccagtgcaaaagagaagcagacaggaagcagttaacctaatgtgtctgtggtggcagctggctaagcggaagctgttaattattgaataagcac

SEQ ID NO: 34317 - DNA, 201 bp, Homo sapiens
gagtttgagaccagcctgccctacatggcaaaaacttgtctctactaaaaatacaaaaagttagccaggcatggtggtgggtgcctgtaatcccagctacytgggaggctgaggcaggaaaattgcttgaacccaggaggcagaggttgcagtgagctgagactatgccactgcactccagcctgggtggcaagagtgaaa

SEQ ID NO: 34318 - DNA, 201 bp, Homo sapiens
tcacccagtggccactagtggcctctaagaggccttgtatccgcggttaccaatctgcggatgatgactttggctccaggaacaccagccccaagttaaaytcttgtctccatttttttcagtggccactcttccagttagcaagctgctcttgtaatactgactgagaaatgcagagaggcaagaagaggaaaagggggg

SEQ ID NO: 34319 - DNA, 201 bp, Homo sapiens
gtaatactgactgagaaatgcagagaggcaagaagaggaaaaggggggaaatggcgggtttttcatttctaatagttctgtagcagtgagtcctgcccatyactgtgtgtgatatatacagtgttctaaggtatactgagtgtatataacgcccttaagtcatggctttggtaacatttggttaagaattattttggtaaa

SEQ ID NO: 34320 - DNA, 201 bp, Homo sapiens
ttggcaattgctggagacacttttggttgtgatggctggggtgcggggctgctcctggcatgcagtgggtagacaccagggatgttgcttaacatcgtacmtggcacaggacagctctgcaacaaagatgcatccagcccgatatgtcagtagtgttgatgctgagaagccctgatctagatcatgattactgtttttgcc

SEQ ID NO: 34321 - DNA, 201 bp, Homo sapiens
ttaggaagttatttaagagccaactgtcttgtctttcccgagtccgtttgaggaagtccccgaggcgcacagagcaagcccacgcgagggcacctctggasgggagcgcctgcaggtaagccaccgcccctgcaccctatgagccagggcccgctgcgtccaccttctgcacctcggtttcctggttgaaccagcaagcgg

SEQ ID NO: 34322 - DNA, 201 bp, Homo sapiens
aacaagagagcagaacgaggttttatttgctgctaatgacctgcattctctctcttaggtccgtggcactcaggtagttggttctgacatgactgtgacarttcagtttaccaatcctttaaaagaaaccctgcgaaatgtctgggtacacctggatggtcctggagtaacaagaccaatgaagaagatgttccggtaaac

SEQ ID NO: 34323 - DNA, 201 bp, Homo sapiens
caccttctacaccggggtcccgaaggcagaattcaagaaggagacgttcgacgtgacgctggagcccttgtcctgtaagctaacaatggtgtggttctttstgagactcgctgtctggcccctgtcttgctaggtgttaatgcccgttatagctttatatcaaagttaaagttccctccaagatctcagaagtgtgagcct

SEQ ID NO: 34324 - DNA, 201 bp, Homo sapiens
tcttgtctttcccgagtccgtttgaggaagtccccgaggcgcacagagcaagcccacgcgagggcacctctggaggggagcgcctgcaggtaagccaccgmccctgcaccctatgagccagggcccgctgcgtccaccttctgcacctcggtttcctggttgaaccagcaagcggcttgctctgggccctgtggcgccggt

SEQ ID NO: 34325 - DNA, 201 bp, Homo sapiens
ttcaaatggcactactgagtttaattctatctcaatcaatgcttagtgtccgctctatgcctgcaattggtttggtgctggcgattccagcagtgagcagractcagttcctgtcctggtccgagtgacaggattattgtgcagaggggtctttggaaacaataagtaggggcatttagtccaactgattcagaaaaagac

SEQ ID NO: 34326 - DNA, 201 bp, Homo sapiens
gtcttgctcttcctctctgtctgtctctcatgcatacatacacactgtcctgtggatgcacgtctaggtgttagtggcagcaaatgtactggagtcccacrgcaccaaagtatgttagcagcagtgaatccacatggatctacagcagcctcaattcttgcctcctcataaggcaggagagactggggcaagttttagagc

SEQ ID NO: 34327 - DNA, 201 bp, Homo sapiens
aagagagcagaacgaggttttatttgctgctaatgacctgcattctctctcttaggtccgtggcactcaggtagttggttctgacatgactgtgacaattsagtttaccaatcctttaaaagaaaccctgcgaaatgtctgggtacacctggatggtcctggagtaacaagaccaatgaagaagatgttccggtaaacctt

SEQ ID NO: 34328 - DNA, 201 bp, Homo sapiens
actgactgagaaatgcagagaggcaagaagaggaaaaggggggaaatggcgggtttttcatttctaatagttctgtagcagtgagtcctgcccatcactgygtgtgatatatacagtgttctaaggtatactgagtgtatataacgcccttaagtcatggctttggtaacatttggttaagaattattttggtaaaatctg

SEQ ID NO: 34329 - DNA, 201 bp, Homo sapiens
cgaaatgtctgggtacacctggatggtcctggagtaacaagaccaatgaagaagatgttccggtaaaccttgggttggggagaccgggcaggcagtgcagrgctgtgggaagctttctctgtgtgtgtcttttccaaacatagatctgctccccagtgaaaatgtcttggaagctgcctcctccttgccgaccatttctgt

SEQ ID NO: 34330 - DNA, 201 bp, Homo sapiens
aaagtcatttctatgattctaaaatgacccagggaattcaatgatgaatgagaggtacagactcaaagcaattctctaatgtattcaaagtaaacaatacyataaggtcaccttattcaccagggattttcatttctgttcattgaagatttttaaaaaattgacagatatattggaagccagtgggaaaatagaatttat

SEQ ID NO: 34331 - DNA, 201 bp, Homo sapiens
aatgcagagaggcaagaagaggaaaaggggggaaatggcgggtttttcatttctaatagttctgtagcagtgagtcctgcccatcactgtgtgtgatatayacagtgttctaaggtatactgagtgtatataacgcccttaagtcatggctttggtaacatttggttaagaattattttggtaaaatctgtattttaaaat

SEQ ID NO: 34332 - DNA, 201 bp, Homo sapiens
ggagagatgggacactaacaaggtggaccaccacactgacaagtatgaaaacaacaagctgattgtccgcagagggcagtctttctatgtgcagattgacytcagtcgtccatatgaccccagaagggatctcttcagggtggaatacgtcattggtgagtgccatgtgcaagctccagtcttgacaccatgggttgcatt

SEQ ID NO: 34333 - DNA, 201 bp, Homo sapiens
tattgtctctttctatgattcatatcaggaatgaaatttctcagtttggaacagcagaaaaaggcagaagcctccggtgttccttgcaacctttccaattrtaacgcatatcaattagtaggagctctcggggtgacaactttgggagaatccactgatttatattaatgaagagtgttactgtagtccaacagagtaaag

SEQ ID NO: 34334 - DNA, 201 bp, Homo sapiens
aaataaatcaatttaatttaatatgaagaaatcaatatgttcccaatatcttggatgcttttaacagcaaataaataaatatgacctgcttgtattttatyattaaattcatccttagccaatttgctttgtatttatataaggtctttttagcccctttcatacagaatggagtaagtaaccaagactggtgtcctcaga

SEQ ID NO: 34335 - DNA, 201 bp, Homo sapiens
taggctaaattgtgttaggtagacagtttgaaagctgtcactttgaaagagcgagctgccaagtttctagctaccgtatttaaaaaaaaaaaaaaaaaaaaggcggcttagcaatgagctgttccattttgccaggaactaggcttggacaggggaagcaaattcatttcctgtttgtggcaaacggagtctggatgatga

SEQ ID NO: 34336 - DNA, 201 bp, Homo sapiens
agcagcctgcggtcccagctacttgggaagctgaggcaggaggattgcttgggcccaggagttcgaggcagccccgccagcctgtctctaagaagaaagaragacaataagcaataactttaaaactcaagaggcagggccgggcccagtggctcacgcctgtaatcccagcacttcgggagaccaaggcaggcagatcat

SEQ ID NO: 34337 - DNA, 201 bp, Homo sapiens
ggcacctttctcaagactttctgtagcacctagatgttgaagcgaaggtcaaaggagaattttttaaagacaagagagagtgggtgttattttatggtgayggagaggaaccaggaaagagagtttgcagtccagagagaggacggtggttcacagccttggctgcacgttgcaatcatctgggaagctttgaaactatgg

SEQ ID NO: 34338 - DNA, 201 bp, Homo sapiens
gaaggtggaggttacaatgagctgagatggcacccctgcactccagcctgggcaacagagcaagactccgtctccaaacaaaacaaaacaaacaaaaaaaataaaaaaaatggtgcctggcaccttgtaggcactgaaaaactctttcaagaatgaacaaaacctggggtcgcctatggctctgcccccctacttaatgcc

SEQ ID NO: 34339 - DNA, 201 bp, Homo sapiens
tgatcttgaaaaggacggtttcactaaagtgatagagacagaagccagggagatggtcatgggctgtgttgtaaacaggaggcgagaaagtagagacggcrggagatggcacctttctcaagactttctgtagcacctagatgttgaagcgaaggtcaaaggagaattttttaaagacaagagagagtgggtgttatttta

SEQ ID NO: 34340 - DNA, 201 bp, Homo sapiens
gttttcagttcatggaaaggattggaggaaggtgggacaaaaaccagagaccaatttggaagctgtggtctaggacaaagatgatgataaactaaacatgstggtaccagtggagatgagaaggggttagattggagatctattttgtatttagaacaaaaattgcacagggattcaagatgagaagtaaagaaatgggag

SEQ ID NO: 34341 - DNA, 201 bp, Homo sapiens
agtaacttatgtaaccacctccttagaatgttctctctctgacaatatgcctaccaaagactcttttaaagatctttgaaattagtaattagggaggttamaatggagcactgtttgcttgtcttaatgtggaatcctctacatgctttatagaaaacaaatgaagtgaataagttttgctcttgaaggttctcctgctta

SEQ ID NO: 34342 - DNA, 201 bp, Homo sapiens
aacctctttttttggagtgaacggtcgtagatacatctgaggacccaggtgctcaatgggcattgtccttggcatttctaaatcaccaaggaactttttcrcatttacccatatggattttaatttttgaaaaagttcatctatcaaaacaaatcatgattatgtaataataccttgttaccccattcttgtgtcagattt

SEQ ID NO: 34343 - DNA, 201 bp, Homo sapiens
gagctgaaaccagatatggtccttactctcagatcatattaccttagagggccactatcaacacgttattgccaataacacaataattatgtaagattgarttgccatttcctagaaaagaagagagccccaagggaatggagcccagatgaggcaaattattgaaaatggggaataagtgaagaaaggtatcaatcagag

SEQ ID NO: 34344 - DNA, 201 bp, Homo sapiens
ggagcaaagagaacaggcttccctgtccccagttctgtctccacttctgcctagctatgtgatgtgcacacatgacgccctcaccaagcctcagtttcccrtctgtaaaaatttcctcacagaggttttgtaaggaccccaagaaataaaacttatttcctgtcactttatttgcatcactatgtgaactgccttggcaac

SEQ ID NO: 34345 - DNA, 201 bp, Homo sapiens
gtctatgcctgttcctgcctcccgactgataggatctggcagcaactatgggcagagaatttcccccaaggagatgcagctgcttctgcaaaggctgccgytactgcagataaaggctcgttattcactgtgacacacctacatgtaccacctccatccatatttgctccagtgggtcaaggcattaccagtggaggatct

SEQ ID NO: 34346 - DNA, 201 bp, Homo sapiens
gaccctcatgcaggttctctccacctggtcttccttctcttcactcactcagttgttacctcctttgatccacatttctggctcacacaactcttatccayggcagcatattttctcaatgtcccttttcctcatattcctttggactttccagttttattcttctcttgtctcctttcatctccctagatcccttttgcc

SEQ ID NO: 34347 - DNA, 201 bp, Homo sapiens; identical to SEQ ID NO: 34159

SEQ ID NO: 34348 - DNA, 201 bp, Homo sapiens
acagtggtgtgatctcagctcactgcaacctcttcctcctaggttcaagcgattctggtgcctcagcctccagagtagctgggaccacagttgcacaccaytacgcccagctaattttatgtatttttggtagaggcagagtttcaccatgttgtccaggctggtttcgcactcctaacctcaagttatccacccacctca

SEQ ID NO: 34349 - DNA, 201 bp, Homo sapiens
gtacattaatcttgtatccagaaactttgctgaattcttttatcagtcctaggagctttctggaggagtccttggggttttcaaggtaaacaatcatatcrtcagcaaacagtgacagtttgacttcctctttacctatttggatgtcctttatttctttctcttaacttattgctctggctaggacttccagtactatgt

SEQ ID NO: 34350 - DNA, 201 bp, Homo sapiens
tgtgtgatatatacagtgttctaaggtatactgagtgtatataacgcccttaagtcatggctttggtaacatttggttaagaattattttggtaaaatctrtattttaaaatgtataaactcatgtaagtttcctctcatacacaccatgatattcaagaaaaaaaaatgaaatatttgaggtaggcacggaaatcccaga

SEQ ID NO: 34351 - DNA, 201 bp, Homo sapiens
caaagcctagagccccatgagttgtgagaattaaatgtaacttcttgctactcaaagtgtggtccatgagccagctgcatcagcattccccaggagtttgwaaaaaatgtagaatctcatgtcccaccccacaccctctgaatcaaaatccatgttttgacaagatcccaagcagactggagtgtacaggagagtttgtgg

SEQ ID NO: 34352 - DNA, 201 bp, Homo sapiens
agctttgttacaagctggctagagggaacttaagatcccagggaaattccatttttccttgagaccccctaagtccaaatcaatacactaagaagaaacgraaaaaatcctaagagtttaagtaggaagaatttttatcaaggtctgtgtgggaggaaattggggcataagttcctctgtggtcaggcattgagctaggta

SEQ ID NO: 34353 - DNA, 201 bp, Homo sapiens
aaaaaggtcatagttttagctgctgcatatgcctatactagttcctctctaccttgatatattaatattacagttaatagcagaagtattggagccaagcrttctctgggtcagtgccctgggactaatagagctaacatttatttagtatttactatgcatcggtcttggtgtatgcatgatcttatccagttcttttta

SEQ ID NO: 34354 - DNA, 201 bp, Homo sapiens
ccagctgaattgctttccccttagccacaatatctcaatcaacacaagtaacgtactttccttgggacattcacctttcttcagattcagaaccagagagsaaaaaagaaatcaccccttcttccttctgcctttactttctagtagaagttatacttaaaaaaaaaaaacaatttgccaggcatggtggctcacacctgt

SEQ ID NO: 34355 - DNA, 201 bp, Homo sapiens
ccgcccagaagcgagggctcctgcccgccgcactcacccagccaggcgtgcacctggggctccccccttctcccccttagcactgtgtctcccgacagcgygccacactgttctgcacccctggcaatgccgcagcctaccttcggtatttctcactagaggatggctctcgcagccttctccctatcattaacccttttt

SEQ ID NO: 34356 - DNA, 201 bp, Homo sapiens
cttcatgcagttcacccagtggccactagtggcctctaagaggccttgtatccgcggttaccaatctgcggatgatgactttggctccaggaacaccagcmccaagttaaactcttgtctccatttttttcagtggccactcttccagttagcaagctgctcttgtaatactgactgagaaatgcagagaggcaagaagag

SEQ ID NO: 34357 - DNA, 201 bp, Homo sapiens
gtttcttaatgtcacgagcgttcacctgttcaaggagagatgggacactaacaaggtggaccaccacactgacaagtatgaaaacaacaagctgattgtcygcagagggcagtctttctatgtgcagattgacttcagtcgtccatatgaccccagaagggatctcttcagggtggaatacgtcattggtgagtgccatgt

SEQ ID NO: 34358 - DNA, 201 bp, Homo sapiens
tatctcctggttaccttttgcatttcagatttatatttaattgttctaaaagcaggttttctggcactatatatcaagttttctccaagtcactaagggaygaaatttgctaagcgactaaaccttggaaagaacactcatttttaaaatgccatcttcatgcagttcacccagtggccactagtggcctctaagaggcct

SEQ ID NO: 34359 - DNA, 201 bp, Homo sapiens
atcagtcattatttacttggcagacatatgtgtccacaacccaagtgacattctgggatatccattagaggcactggcataggaatatgaatgtccagtgrctgtagaatgaatgaacgaacagtcaatcacttgtgaattgaatgactcatagctctagtggcattataatttattattaataacaagctacagatttca

SEQ ID NO: 34360 - DNA, 201 bp, Homo sapiens; identical to SEQ ID NO: 7130

SEQ ID NO: 34361 - DNA, 201 bp, Homo sapiens
gggaggccgaggtgggcagatcaccagatcaggagttcgagaccagcctggccaacatggtgaaaccctgtctctactaaaaatacaaaaattagcctggkgtggtggtgggcgcctgtaatcccagctactcgggaggctgaggcaggagaatcgcttgaacctgggaggtggaggttgcagtgagccgagattgtgcca

SEQ ID NO: 34362 - DNA, 201 bp, Homo sapiens
cagtaattaaccatgctattatttgaagaaaccctttctccatggtggaaattatatacaaacagctagtcaccaaaagcactgaagaaaaatgtagtagrgggttatttgctcttctgggggcttgtttgttttgcaattcagaaaactaaggttgacacaactgaagtttattccataggatctcaacatttacagtta

SEQ ID NO: 34363 - DNA, 201 bp, Homo sapiens
aatgaatgatttgactttattagtatgaaaagatgtgcctagagagcccacaagaaaatgttctgaagttgtggactcttagccagaaccctgttgcaggkcgacagagctgtgtgtgttttctcaggggctgggcccaggcctcacaggtaaaacagaggctggtgcagagttgttctgaattcctctcaaacacctccc

SEQ ID NO: 34364 - DNA, 201 bp, Homo sapiens
tttctgttaagcagctggttagatctacagactctgtcagattcagctccaagtggcattttttttttggaggaaggggcaaaaatatttcataagtcacrccattgcttcctaggacattcatcctggcagaagatacatatatttaggtttgtcaatagtatctggttcacgttttatcagtctcatccacccgttacg

SEQ ID NO: 34365 - DNA, 201 bp, Homo sapiens
aaaaaaaaaaaaaaaaaagtgtaaggagaaaatggagaacaggagatatgtttggaagctgtagagatactccaggctagaagaggaatagaccagagggrttttagcccctggaggtatggggctcatttctcttgttccagcttcctctgagcacctgagcaatccttcaacattataggttccaggatgtattaataa

SEQ ID NO: 34366 - DNA, 201 bp, Homo sapiens
gccggcggatcacctgaggtcaggagttcaagaccagcctggccaacatggtgaaaccccgtctctattaaattttttaaaaatacaaaaattagcggggyatggtggtgagtgcctgcaatcccagctactcaggaggatgaggtggggaggattgcttgaacccaggaggcagaggttgcagtgagccgagatcgcgcc

SEQ ID NO: 34367 - DNA, 201 bp, Homo sapiens
cccacccagcaagtctacccagctctggagtgacactgggcattgtctgcacagaatcctgtgatgtgagccatctctgggtccctctcagccaccggaayagcgcctattccggtggaggtggcagggggtacaatggacactgttagggttcttagctttggtgtttaatgctctatttttgtgctggttggctccctg

SEQ ID NO: 34368 - DNA, 201 bp, Homo sapiens
atatgaagaaatcaatatgttcccaatatcttggatgcttttaacagcaaataaataaatatgacctgcttgtattttatcattaaattcatccttagccwatttgctttgtatttatataaggtctttttagcccctttcatacagaatggagtaagtaaccaagactggtgtcctcagagtaacaatgacccacattcc

SEQ ID NO: 34369 - DNA, 201 bp, Homo sapiens
accaaatgaacatccccctcctgctgtcaaagagcagtcagtggccaccgctattgacctgagctctaattaggctggttttataatgaggaaaagagtgygattctaattagtaaatttccatctctttctcaataggtatcctccagtcaaagcaatcagctatcctcatcacactggttccattgccaaaaaaataac

SEQ ID NO: 34370 - DNA, 201 bp, Homo sapiens
actgaaggggctaaaaggaaagaagcaaactcaactgactattgaggaaccatttgcttgtgcttcatagattgattccattccagtgttactagataggmaagcaacgtctctggagtggctatatgaaaccattttaggaaggcagtgcgtttggatccttccagaataaaaagctcagactctaaaaatgccattcct

SEQ ID NO: 34371 - DNA, 201 bp, Homo sapiens
ggtaacatttggttaagaattattttggtaaaatctgtattttaaaatgtataaactcatgtaagtttcctctcatacacaccatgatattcaagaaaaaraaatgaaatatttgaggtaggcacggaaatcccagaggtgggaccagccattcagtggtagcgtttgacatctttgcatgattttaggcatctttaatgt

SEQ ID NO: 34372 - DNA, 201 bp, Homo sapiens
tcatttaacagttctattgtattgaattaaaactggaaagcaagcctggccctatttaaaaactgggttctagtagtttttcaggctaatggggtcttatrcctttctaagaatctcctccatcccaccactccttgtcagaattaaatcaaccaattaatgataaacctcctctttgtgcagagtaaacctctctggatt

SEQ ID NO: 34373 - DNA, 201 bp, Homo sapiens; identical to SEQ ID NO: 7156

SEQ ID NO: 34374 - DNA, 201 bp, Homo sapiens
cgtggttgtcttttctccagcatgttgttagtgctccacatgtctctggaaccatctctctactctggtggcctctataatggggactcttcacctcttgkgggtgtgcctggtttttgaaaatagccaagtctccaggagtcatgactgggtaatccaggggatcaagggggaaccttcactgggcccagaaacaaagtc

SEQ ID NO: 34375 - DNA, 201 bp, Homo sapiens; identical to SEQ ID NO: 7159

SEQ ID NO: 34376 - DNA, 201 bp, Homo sapiens
gggagtggggccaagtgagaacagcctgctagactggaaccccgccggcttggctccccactcctgcgcgcctccccactcctgcgcatcgcctgcctccrtcccaatttggagctgaactcgagccacttctcctccttagacccgcccagaagcgagggctcctgcccgccgcactcacccagccaggcgtgcacctgg

SEQ ID NO: 34377 - DNA, 201 bp, Homo sapiens
caggcttggggaatgggaaatgttggcaaccctgacttcttaagcctattgatagccctattgaaaattgcatgcccaacctctccacctccttatcctcytccatgtggctcaatttccaaagcagttcctacctcctcacccctaagtggatttacttatggctcttcttgggctccaccctaaccctatcagactata

SEQ ID NO: 34378 - DNA, 201 bp, Homo sapiens
atttctctccagagcagcctggtgagctggcaaggcaagctgcttccccagcctcttgcctctgcctgatccctagaaacctgttccgggtacagcagccrgcagctgacctcctctcagccctgtcagtggtgacaaggtccaggtgccagcactggtttggtgatacagacatcattcccctgggccatggcagggaca

SEQ ID NO: 34379 - DNA, 201 bp, Homo sapiens
tgcttccccagcctcttgcctctgcctgatccctagaaacctgttccgggtacagcagccggcagctgacctcctctcagccctgtcagtggtgacaaggyccaggtgccagcactggtttggtgatacagacatcattcccctgggccatggcagggacattcagactcatgtccccgagtggcattgagcagggagtct

SEQ ID NO: 34380 - DNA, 201 bp, Homo sapiens
cctacaagaagggttttttcactctgtgtttattaaatgctggtgatgtgtttagctgtggtctgtcctttcctgtagttttacgatgccttggaataccmgcaagaattgttaccaattatttctctgcccatgataatgatgccaatttgcaaatggacatcttcctggaagaagatgggaacgtgaattccaaactca

SEQ ID NO: 34381 - DNA, 201 bp, Homo sapiens
ttcaatattttcttcatgttcagtcaggatattaattcctagcttgctatgccagagtggtaaaagggggtagggcttcattttcaaaatgaacccagcaragggaacccagaagtgctcagaaagggctttctgctaactaatgatggcaaacgtggtctgtgtgatggggtggcatctactttctgaaaatttttaatt

SEQ ID NO: 34382 - DNA, 201 bp, Homo sapiens
tggaaaccattgcccctctgagatatctgtggtatacatcagcatattaaagtctcacatgaatgcttcagtaaagaatcctgatcagctttggttaggcyagcattttccacactggtttaaacatggagctctaattcttccaatacctgtcaatatcccataaaactagcactatgccatgatggactgactctaacc

SEQ ID NO: 34383 - DNA, 201 bp, Homo sapiens
ctcggttcaagccatcaagcacggccatgtctgcttccaatttgatgcaccttttgtttttgcagaggtaagcaggaagctggaggaaagtgctgtttttytccccaacctcttaacacatgaaagagtaagctaaaagttgttgtttctaagttttccaggtacatagcgtatgcttcgtgttgacaaaggtaactaggc

SEQ ID NO: 34384 - DNA, 201 bp, Homo sapiens
tggtgtcagccactctataagataggtacttcattcccatattaaagataagaaaactgaggctcagatagattaaataacttttctgaggctgcacaatwagtaagtagtgaagcatttccaaaaacatattctgaaaaatgcagatctccaaagaaaaaagtttccatagtcatttacatttggaaaccattgcccctc

SEQ ID NO: 34385 - DNA, 201 bp, Homo sapiens
caataataataaacatttattaagaatgtacttggtgtcagccactctataagataggtacttcattcccatattaaagataagaaaactgaggctcagakagattaaataacttttctgaggctgcacaataagtaagtagtgaagcatttccaaaaacatattctgaaaaatgcagatctccaaagaaaaaagtttcca

SEQ ID NO: 34386 - DNA, 201 bp, Homo sapiens; identical to SEQ ID NO: 34159

SEQ ID NO: 34387 - DNA, 201 bp, Homo sapiens
tttattttgctactatcttatcagatgcagcctatttttttggcatctcctacttggctataaaataatccagtcatttattcaaatagcatacaaaactytggaattattttagctttccttcttaacctcccttatgcatcttgccaaaaataccttcccaaaattatcataaatccagccacttctacaatctctatc

SEQ ID NO: 34388 - DNA, 201 bp, Homo sapiens
tgttccggtaaaccttgggttggggagaccgggcaggcagtgcagggctgtgggaagctttctctgtgtgtgtcttttccaaacatagatctgctccccartgaaaatgtcttggaagctgcctcctccttgccgaccatttctgtagggcgtggagtaaaactagggttggtttgaccagcactttcatcatttaatcct

SEQ ID NO: 34389 - DNA, 201 bp, Homo sapiens
aggctgagacatgagaattgcttgaacccgggaggcagaagttgcagtgagctgaaattgcaccactgaactccagcctgagcaacagagcaggactctgyctcaaaaaaaaaaaaaaaaaaaaaaaagaatgtgttttaagggttttgctttatcagatgcataatataaatcaacagtgagttaagagtatccaagaca

SEQ ID NO: 34390 - DNA, 201 bp, Homo sapiens
gggaggctgaggcagggggattacctgaggtcaggagttcaagaccagcctgaccaatatagtgaaaccccatctctactaaaacaaaaacaaaaacaaamaaattagccaggcatggtggtgtgagcctgtagtcttagcaacttgagaggctgagacatgagaattgcttgaacccgggaggcagaagttgcagtgagc

SEQ ID NO: 34391 - DNA, 201 bp, Homo sapiens
actgagattataaaggtagcaagagcctctgtaaagaaatcatatcccattagccaaaagaaatccagtggtcaaacatagtcctctagaaatagtcagargaagtcattttattattgttattactggaaacagctagaggcaaaaggcatcttcttcgaggccttccaccttgccacttcatccattctatctagagac

SEQ ID NO: 34392 - DNA, 201 bp, Homo sapiens
agtcttggtgccctcatccataatacggttacaatatatacctcacaggcttgttgttgtgaggttcaaactaaatcctttataaaatgtccctgaaacaytgtaggtatgcaacaaatgttggctatctcccccttagtagaaatccgacttcatgtgcactcagaacattctgtgagaaagtaaaattgctctctttaa

SEQ ID NO: 34393 - DNA, 201 bp, Homo sapiens
tccaatacatctctttttgaaggggtagtaagattattctaaatacatatgcctctcctacatataccatctttaatgattgaaagagaaagatagaaaaytcatcctccatgtgtatgaagataaaacctctatatgtgaagtcaatgctgctatacatttatttcgggattaattggagattgtctaaagttgcagtta

SEQ ID NO: 34394 - DNA, 201 bp, Homo sapiens
catacatacacactgtcctgtggatgcacgtctaggtgttagtggcagcaaatgtactggagtcccacagcaccaaagtatgttagcagcagtgaatccayatggatctacagcagcctcaattcttgcctcctcataaggcaggagagactggggcaagttttagagcaggagtgaaagtttattcaaaagctttagaac

SEQ ID NO: 34395 - DNA, 201 bp, Homo sapiens
aggggtagtaagattattctaaatacatatgcctctcctacatataccatctttaatgattgaaagagaaagatagaaaattcatcctccatgtgtatgargataaaacctctatatgtgaagtcaatgctgctatacatttatttcgggattaattggagattgtctaaagttgcagttagttatttgtggagctattaa

SEQ ID NO: 34396 - DNA, 201 bp, Homo sapiens
gaaatttctgccataataaataaatacataaataaataaataaattcaggttgatatttacaagatcaaatgaaagctttctctgggaaaaaaaattaaarcataccaacaagggcacaggctcccttagaggatatgtgctaagtaaagaagctctgacattttctttgtagaattgcttcatgaataatagtctatctt

SEQ ID NO: 34397 - DNA, 201 bp, Homo sapiens
gctgtcccttgggacatgaagttgagtaagttagtccctggcctcaagaaactctcagtgtagaagacaaaataaataaaagatcattgcaattcagtgtrataaagactgtgactgtgatttatgcaaattgcagtgaaataacagaaatcaatgtctagcggtgtggtggagtggggaagaggatgaggagggcttcct

SEQ ID NO: 34398 - DNA, 201 bp, Homo sapiens
gaggaagtccccgaggcgcacagagcaagcccacgcgagggcacctctggaggggagcgcctgcaggtaagccaccgcccctgcaccctatgagccagggmccgctgcgtccaccttctgcacctcggtttcctggttgaaccagcaagcggcttgctctgggccctgtggcgccggtcacaggcagctccacttgcccaa

SEQ ID NO: 34399 - DNA, 201 bp, Homo sapiens
ctccatccatcttccacgaacagagatttgcaaatttagatcttcttcttaaattattccaatggctttttatagcctaagaataaagcatgaatgtttartttgatatcaaaggatttcacaatcttatccttacctatatcataggtcagtgttgaagagtgtggatttcagagctctatcactaactagctgtgacct

SEQ ID NO: 34400 - DNA, 201 bp, Homo sapiens
gaagacaaaataaataaaagatcattgcaattcagtgtaataaagactgtgactgtgatttatgcaaattgcagtgaaataacagaaatcaatgtctagcrgtgtggtggagtggggaagaggatgaggagggcttcctgatgcaaggatattggagccgagacttagaggatgagtatgagtgttcctgacaggcaagcg

SEQ ID NO: 34401 - DNA, 201 bp, Homo sapiens
ccctctgaccaaaggggacgggtggggacttcctggcactgcagggccccttgcctggtactcccagcaactggttgcggtggggagggcagatctagggrtggggatggggaggagaagtgggaatgggaaattgggagtcagaggggcaagtgggagagaagggcgcacctgccgggataacaggccagatgaagtaaa

SEQ ID NO: 34402 - DNA, 201 bp, Homo sapiens
tgtggtggagtggggaagaggatgaggagggcttcctgatgcaaggatattggagccgagacttagaggatgagtatgagtgttcctgacaggcaagcgcrtggaaaagtgtttgcagtagagggaacagtatattgcaagtgaggagggactaaaagatgaaagagaagatataagcctgggaaaagatggcaggcatca

SEQ ID NO: 34403 - DNA, 201 bp, Homo sapiens
agcagccggcagctgacctcctctcagccctgtcagtggtgacaaggtccaggtgccagcactggtttggtgatacagacatcattcccctgggccatggsagggacattcagactcatgtccccgagtggcattgagcagggagtcttttttgtcaataacattcatgcaccaaaatctaattttactcctaagggtgtt

SEQ ID NO: 34404 - DNA, 201 bp, Homo sapiens
actcatgtccccgagtggcattgagcagggagtcttttttgtcaataacattcatgcaccaaaatctaattttactcctaagggtgttctgtgctgggttycactggggataaacacctatttgctgggataggtgagcatggtcatgctggagctgtgtggtcgattcccctcattagaaggagaccaatgcctgaaagc

SEQ ID NO: 34405 - DNA, 201 bp, Homo sapiens
agacacaatggagtactatacagcccttagaagaaggaaaattctgccattctcaacaagggtagaactggagagcactatgctaactgaaataagccagrcacagaaagatgaatactgtatgatctcacttatatgtggaatctgaaaaagtcaatctcagaaacacagtagaaagttgtttaccagaggctggggctt

SEQ ID NO: 34406 - DNA, 201 bp, Homo sapiens
agtggcattgagcagggagtcttttttgtcaataacattcatgcaccaaaatctaattttactcctaagggtgttctgtgctgggtttcactggggataarcacctatttgctgggataggtgagcatggtcatgctggagctgtgtggtcgattcccctcattagaaggagaccaatgcctgaaagcccagattgatgca

SEQ ID NO: 34407 - DNA, 201 bp, Homo sapiens
cagcctagctccacagtctatgctcttactatgctcttctacttctcttaataataataacaacaacaataataataaacatttattaagaatgtacttgstgtcagccactctataagataggtacttcattcccatattaaagataagaaaactgaggctcagatagattaaataacttttctgaggctgcacaataag

SEQ ID NO: 34408 - DNA, 201 bp, Homo sapiens
aaaatggcatgcttccctgggaaggctggaaggccactgctaaaaagcttcccagggacattctttaccttgtgacttccattgctcagattccagcctcrcaccatgccttctcagatacctgactacttaatgattggtcctaagggccaatccaaatgctcagtgctattatgattattattgccatcaatttctgag

SEQ ID NO: 34409 - DNA, 201 bp, Homo sapiens
aaattcaaagcaagcctgtctgctcagaagacaaggagtataaaatggcatgcttccctgggaaggctggaaggccactgctaaaaagcttcccagggacmttctttaccttgtgacttccattgctcagattccagcctcgcaccatgccttctcagatacctgactacttaatgattggtcctaagggccaatccaaat

SEQ ID NO: 34410 - DNA, 201 bp, Homo sapiens; identical to SEQ ID NO: 34159

SEQ ID NO: 34411 - DNA, 201 bp, Homo sapiens
ccatggcctaggtgagacacttcttatttgacaagggatcctatgtggaatgggggccttggacttcagcaccccacatgttccattttgggatgatcccrgcccaaatcaaagccaccattaaaacccattggtccttctttgccatgaaaatcacatcttttccatggcatttcttttacaacagcaaaagaactgttt

SEQ ID NO: 34412 - DNA, 201 bp, Homo sapiens
taagtccctatgaggcactcctacaaataaccccacaggccctaaacagagttaatacaaaatagcgaaggtagatcttgcccttggtaaccctgtcctcwttcaggtccctgctccaaattacttccccttttcctgacaccatttgttcctttggtgccttactcaaatatcccatcaccctgagactgttcttcctgg

SEQ ID NO: 34413 - DNA, 201 bp, Homo sapiens
atctggacagaattggagatgacaaactcacaccgcccttcctctgtgcaatgcaggcatgtatcggtgtggccccgcctcggttcaagccatcaagcacrgccatgtctgcttccaatttgatgcaccttttgtttttgcagaggtaagcaggaagctggaggaaagtgctgtttttctccccaacctcttaacacatga

SEQ ID NO: 34414 - DNA, 201 bp, Homo sapiens
agtccttgcaatgaaagacactggccagggaagctggttggacacacacacatacttgcacattcacaagtatctttcattaaaaggagatgacctactgsttccctcctgccagtgatgggccacaaaacagacatgacacgtgggccttctcacgtgtcccagatttgttttaaaaatcattttcaattcatctagttt

SEQ ID NO: 34415 - DNA, 201 bp, Homo sapiens
ccaggcctgggaataagtaccagactgatgatagacggggaggatgatcctcctgaaattctagccacagggaagaaaagtccttgcaatgaaagacactrgccagggaagctggttggacacacacacatacttgcacattcacaagtatctttcattaaaaggagatgacctactgcttccctcctgccagtgatgggc

SEQ ID NO: 34416 - DNA, 201 bp, Homo sapiens
cgaactgggtggagcccaccacagctcaaggaggccagcctgcctctgtaggctccacctcagggcacagacaaacaaaaagacagcagtaacctctgcasacttaaatgtccctgtctgacagctttgaagagagcagtggttctcccagcacacagctggagatctgagaacaggcagactgcctcctcaagtgggtcc

SEQ ID NO: 34417 - DNA, 201 bp, Homo sapiens
cctcctgccagtgatgggccacaaaacagacatgacacgtgggccttctcacgtgtcccagatttgttttaaaaatcattttcaattcatctagttttctrttaatgttaaaaggttggaaattatattttaattagtgttagagatgtacatcagcatcatagaattctgaaactactgatgcaacagaatcataaaatg

SEQ ID NO: 34418 - DNA, 201 bp, Homo sapiens
tgacaggcaagcgcatggaaaagtgtttgcagtagagggaacagtatattgcaagtgaggagggactaaaagatgaaagagaagatataagcctgggaaargatggcaggcatcacaccataccaggccttggggatcttgctttcctcctgcagataatgggggacttgagaaggattctaattagcagaaatacataat

SEQ ID NO: 34419 - DNA, 201 bp, Homo sapiens
aacgttgacatggactttgaagtggaaaatgctgtgctgggaaaagacttcaagctctccatcaccttccggaacaacagccacaaccgttacaccatcayagcttatctctcagccaacatcaccttctacaccggggtcccgaaggcagaattcaagaaggagacgttcgacgtgacgctggagcccttgtcctgtaag

SEQ ID NO: 34420 - DNA, 201 bp, Homo sapiens
taatatgattgttggtttcatgaagtaagaagaccatatgagattttatctgtttgcttgtttgtttttacataaatgatgcagaaataactgactctccractggaagaaagtttaaaaattgaccctcatcttgtcccatatacagtagtaaatctcagatggaatgagtattaatgtaaaaaagacaattttttgagg

SEQ ID NO: 34421 - DNA, 201 bp, Homo sapiens
ggcattgagcagggagtcttttttgtcaataacattcatgcaccaaaatctaattttactcctaagggtgttctgtgctgggtttcactggggataaacamctatttgctgggataggtgagcatggtcatgctggagctgtgtggtcgattcccctcattagaaggagaccaatgcctgaaagcccagattgatgcagct

SEQ ID NO: 34422 - DNA, 201 bp, Homo sapiens
cattgagcagggagtcttttttgtcaataacattcatgcaccaaaatctaattttactcctaagggtgttctgtgctgggtttcactggggataaacaccyatttgctgggataggtgagcatggtcatgctggagctgtgtggtcgattcccctcattagaaggagaccaatgcctgaaagcccagattgatgcagctct

SEQ ID NO: 34423 - DNA, 201 bp, Homo sapiens
tctgtgctgggtttcactggggataaacacctatttgctgggataggtgagcatggtcatgctggagctgtgtggtcgattcccctcattagaaggagacsaatgcctgaaagcccagattgatgcagctctccatatagcaaagggaaaggggaagtgcagtttatccagcaagccagacacttgcccaggtgttgtgga

SEQ ID NO: 34424 - DNA, 201 bp, Homo sapiens
tttttttttaaaaagaagacagatgtttcctgcgaatcaagaggagaaatgctttctatttacctgtggaaattcaaagcaagcctgtctgctcagaagayaaggagtataaaatggcatgcttccctgggaaggctggaaggccactgctaaaaagcttcccagggacattctttaccttgtgacttccattgctcagat

SEQ ID NO: 34425 - DNA, 201 bp, Homo sapiens
ccaggcactatagcaagataattaagacatggtccagtcttcaaggggattacaatcccatggctaaaaaatcacctatataaagataatacaaagagacratgatacttttttttttttaaaaagaagacagatgtttcctgcgaatcaagaggagaaatgctttctatttacctgtggaaattcaaagcaagcctgtct

SEQ ID NO: 34426 - DNA, 201 bp, Homo sapiens
agcgagtgaatgactaagaagccaaacaaacgacatggtgaggcaacccaggaattaggaacagtagaaaactgccaccacaccaggagctggaggcacayggaggaggaggtcccatcagaacccagaaggcatcagcaggtgctggagccatggaggagactcagactctcacctcaagacagagagagcacaggagac

SEQ ID NO: 34427 - DNA, 201 bp, Homo sapiens
aacaaaactgctgatctggaggtcttatgttataaattcccacatcataccttcaactatatatatgtcctgaaactagcatattttgagaataaaatggkaaatgacatttaaaggacacctatggttaatcctacagtaaatgagataatttattttgaaatgaatgatcaactctacgctccaaattttcacgtaaaa

SEQ ID NO: 34428 - DNA, 201 bp, Homo sapiens
gaatcaaaagatcacttagaaaaagtaacatgttagaaaacatcatgcttagaattaaatgtctaaagtataccagtatagatgatataatttaaaacaaytgatactatcagctgtcataagaaccaaatacttggttgacctgtgggtggctgactcatgggcaatgaaataaattttgttttatacgtataactttat

SEQ ID NO: 34429 - DNA, 201 bp, Homo sapiens
aaagatcacttagaaaaagtaacatgttagaaaacatcatgcttagaattaaatgtctaaagtataccagtatagatgatataatttaaaacaattgataytatcagctgtcataagaaccaaatacttggttgacctgtgggtggctgactcatgggcaatgaaataaattttgttttatacgtataactttatatatat

SEQ ID NO: 34430 - DNA, 201 bp, Homo sapiens
atataaaaagtttgcttatatataatatatatacacatatcatatataaatatattgtttataatatgtaaacaatatatacataaataatatataaaaastatatattatatatgtaaacaatatatttttaaaacccaaactcatgggtttatagttttttcatagtgaaaacaaacaaatatatagtttgcttatatc

SEQ ID NO: 34431 - DNA, 201 bp, Homo sapiens
ggaaaaactataaacccatgagctggggttttgtctttttttttttgacttaggttttctattctcaaaggcattaatcagcaccctttttctcacccttygttatcaacatataagcaggctagaaagacagtattttattccaatgtgaaacaaaactgctgatctggaggtcttatgttataaattcccacatcatac

SEQ ID NO: 34432 - DNA, 201 bp, Homo sapiens
gggttttgtctttttttttttgacttaggttttctattctcaaaggcattaatcagcaccctttttctcaccctttgttatcaacatataagcaggctagraagacagtattttattccaatgtgaaacaaaactgctgatctggaggtcttatgttataaattcccacatcataccttcaactatatatatgtcctgaaa

SEQ ID NO: 34433 - DNA, 201 bp, Homo sapiens
ttgacttaggttttctattctcaaaggcattaatcagcaccctttttctcaccctttgttatcaacatataagcaggctagaaagacagtattttattccratgtgaaacaaaactgctgatctggaggtcttatgttataaattcccacatcataccttcaactatatatatgtcctgaaactagcatattttgagaata

SEQ ID NO: 34434 - DNA, 201 bp, Homo sapiens
cttttctgaggctgcacaataagtaagtagtgaagcatttccaaaaacatattctgaaaaatgcagatctccaaagaaaaaagtttccatagtcatttacrtttggaaaccattgcccctctgagatatctgtggtatacatcagcatattaaagtctcacatgaatgcttcagtaaagaatcctgatcagctttggttag

SEQ ID NO: 34435 - DNA, 201 bp, Homo sapiens
tcccagaaccgttattagagttgtcaatctgatgtctcgtcatccctgaatactttagtgtgtactacctatgagcaaagacattcttctgtgcaaccatmaaaataaggaaattaacactgatatttgatggtagtctaatctttagaacacatttgagtttttctacttgttcagtaatgtaccttatagcaacagaag

SEQ ID NO: 34436 - DNA, 201 bp, Homo sapiens
atgtaatatcagtatattccttccattggtgctggtaaacggagaactgatgaaacccatttctaaggactttggtgtttagctatttttaaaaaaaaaaytttaaagcccctgtgctaagaaagaggaccagaggagttgattgctaagctccttttcaacaggaacatttgtgctcctccagctcattcttgggctggt

SEQ ID NO: 34437 - DNA, 201 bp, Homo sapiens
aagttttccaggtacatagcgtatgcttcgtgttgacaaaggtaactaggcattattccaacttccaggctattaatgctaaatgcagttcttgtttaacrtttttctttccttgatgttttgggattccctactcccaaaagtaaatgctttactaacattagcttagttctctgcacccattaagtatcaactgctcca

SEQ ID NO: 34438 - DNA, 201 bp, Homo sapiens
acatcaagaccagaagctggagctatggtcaggtgagccacttaaaatttgttattgtcaaggacatttttacttcatattttttgtcacatgtatccctrcaggatcccatatatcgatattagacaagcacaatttcctgctttttaggatctgagactccaaggcagagagcataggagtagggactcataaagacaa

SEQ ID NO: 34439 - DNA, 201 bp, Homo sapiens
tacttcatattttttgtcacatgtatccctacaggatcccatatatcgatattagacaagcacaatttcctgctttttaggatctgagactccaaggcagwgagcataggagtagggactcataaagacaactgcgtaatttatcagctgaaaccacatatctctgggtattacagtgttacagaaatgagagattccatg

SEQ ID NO: 34440 - DNA, 201 bp, Homo sapiens
tgcataggtgatcttatgagattctgatggagctgaaaaattcctgttacatagtgatgtcatagctatcataatagaatagtgagattacttatttttttaaatgtactgtagcctaagtttatagtgtttataaagtctacagtagcatgcagtaatgacctaggccttcgcattcactcaccactcacccagggctac

SEQ ID NO: 34441 - DNA, 201 bp, Homo sapiens
tcctgctttttaggatctgagactccaaggcagagagcataggagtagggactcataaagacaactgcgtaatttatcagctgaaaccacatatctctggktattacagtgttacagaaatgagagattccatgaataatgtggcattctattgagaaatgctttggccacttagaacagtgaaatctcattagttcaacc

SEQ ID NO: 34442 - DNA, 201 bp, Homo sapiens
aggccttcgcattcactcaccactcacccagggctacttctggtcctgcacgttccattcatggtaagtgtcctatgcaggtgtaccattttttacttttyatattgtatttttactgtactttttctatgtttatatataaatgtttctatgtttatatataaatacttaccattgtgttacaattgcctgcagtgctgt

SEQ ID NO: 34443 - DNA, 201 bp, Homo sapiens
attcaggataggagaggagatgatcagaagagagaggatgagaaccggggttatggctgcagttgtagacatggacaggagtgacagggtttgagaaatayttaggaggcaaaatctgcaggacttgtgttggggagtctgtgaggggtggaagggaggagggtcaaggtcgacttccaggtggctggcttatgtgactat

SEQ ID NO: 34444 - DNA, 201 bp, Homo sapiens
tatagcaaagggaaaggggaagtgcagtttatccagcaagccagacacttgcccaggtgttgtggactggtgtcattgtgttactgtcacactagatgatwtgatatcaaatagtgaaatcagggaggtatccagtaccatccaagtttgggaaaagaagttcacagaacagaagggcatcttcagtcaggtggtagagtt

SEQ ID NO: 34445 - DNA, 201 bp, Homo sapiens
atatttaattgttctaaaagcaggttttctggcactatatatcaagttttctccaagtcactaagggacgaaatttgctaagcgactaaaccttggaaagmacactcatttttaaaatgccatcttcatgcagttcacccagtggccactagtggcctctaagaggccttgtatccgcggttaccaatctgcggatgatga

SEQ ID NO: 34446 - DNA, 201 bp, Homo sapiens
aaagagtgctttcagatgtacttctctagttttttgctattccccaaagtgcatccttacataattagctttaaaattcctttcatcccttatttttttttaaatctatcattaacacgtagatttttatctctaagtttatttttactaaacttgcatctttttaaatacgacgtattctgaatctaaatcagtatttag

SEQ ID NO: 34447 - DNA, 201 bp, Homo sapiens
tctgagaaggggcagactgcctcctcaagtgggtccctgacccctgacccccgagcagcctaactgggaggcaccccccagcaggggaacactgacacctyacacagcagggtattccaacagacctgcagctgagggtcctgtctgttagaaggaaaactaacaaacagaaaggacatccacaccaaaaacccatctgta

SEQ ID NO: 34448 - DNA, 201 bp, Homo sapiens
gtggaaaatgggaacagactatgtgttctaattattgctgaaccctgaccattttcccctccatgtccacaaccgagcacgttctctctccagcctcctgyactctctgtggctccatcgcactctcgtcaccaagattcacccctgcccacacccacacccttcatggggaggccggggatgggaaccaggaggtgggct

SEQ ID NO: 34449 - DNA, 201 bp, Homo sapiens
tggaaaatgggaacagactatgtgttctaattattgctgaaccctgaccattttcccctccatgtccacaaccgagcacgttctctctccagcctcctgcrctctctgtggctccatcgcactctcgtcaccaagattcacccctgcccacacccacacccttcatggggaggccggggatgggaaccaggaggtgggctt

SEQ ID NO: 34450 - DNA, 201 bp, Homo sapiens
taaagttagttgattattttcttcaacccttgtttttcttgttcatagagtttcttaatgtcacgagcgttcacctgttcaaggagagatgggacactaamaaggtggaccaccacactgacaagtatgaaaacaacaagctgattgtccgcagagggcagtctttctatgtgcagattgacttcagtcgtccatatgacc

SEQ ID NO: 34451 - DNA, 201 bp, Homo sapiens
attctctttttaaaagtggcatctctcatttttaaaagagaaaatcctagatagtgactcctattatcatcaagtaatatatatcaaggccccaaggctamcttgtcacattttactctggcatagaaatctaattccttctctataaagtcaaaaagagagaggtgagttatagatgttttctaatttagtttagggtca

SEQ ID NO: 34452 - DNA, 201 bp, Homo sapiens
tcttaggtccgtggcactcaggtagttggttctgacatgactgtgacaattcagtttaccaatcctttaaaagaaaccctgcgaaatgtctgggtacaccyggatggtcctggagtaacaagaccaatgaagaagatgttccggtaaaccttgggttggggagaccgggcaggcagtgcagggctgtgggaagctttctct

SEQ ID NO: 34453 - DNA, 201 bp, Homo sapiens
aaggctaccttgtcacattttactctggcatagaaatctaattccttctctataaagtcaaaaagagagaggtgagttatagatgttttctaatttagttyagggtcaacttataatcctcgtcctcaactgatggtttagcgataacttaaaaggtgatgctgcaaatgattctttgctggatttcagaaaataaagaag

SEQ ID NO: 34454 - DNA, 201 bp, Homo sapiens
ataaatatgcgtatttatttattattgagaattttataaatatatccacttaatttttatcccagttatggaaggtattatagcaggtggtctcatattcrtttttccacatttctcaatgcccctgagcaattagagatcagaacataatgaacaatctttccctctccagtttcccctctggtttttaatccacccaac

SEQ ID NO: 34455 - DNA, 201 bp, Homo sapiens
caatctttccctctccagtttcccctctggtttttaatccacccaacatccaatctgtagaggaaagcatatgagaacagaattattctcttcagtgtcaygcatcatttttcagaggcatttgcctctctagacccagacgatattacaattaattcagtgaatatttttaaaaatacatttatttcagtatgtcttcat

SEQ ID NO: 34456 - DNA, 201 bp, Homo sapiens
gtacagactcaaagcaattctctaatgtattcaaagtaaacaataccataaggtcaccttattcaccagggattttcatttctgttcattgaagatttttwaaaaattgacagatatattggaagccagtgggaaaatagaatttatctaacagaaagtatcttcatagccacttttgagaaattgcataaatccattcca

SEQ ID NO: 34457 - DNA, 201 bp, Homo sapiens
tgagttttttcgtatgtacacatcattatgccggatggttttatgagtaagagaaaatgataagagggggctaaatacttagcttctatttgaggtggttrtctacagtacatggtctcaggtcgggtccttaaccagggccactgtttcacaaagtgcttctgattgatcacttgggggaaccagaggagagagaatgaa

SEQ ID NO: 34458 - DNA, 201 bp, Homo sapiens
aagtactaagtattggagttaaaagtgggctgaaatataaggtgaataagacaaactacccagagcattgctaccctaaaaagcatcaactgtaatgcatygggcctttgccatgtgccttgcaatatgtttgccgttttatgagcatttttcattccaaacctttcttgcaagggaagaactattattcttatcttattc

SEQ ID NO: 34459 - DNA, 201 bp, Homo sapiens
ctctttacgtccattcttaaaaacgcctcatttccatatattttctcccatattatatagtggctaaaggaacatggaatagtaatggctgtgttgtcatmtggaagatccagacatccagtaaattccatttttgagccattgacttaatttaataaatatttactggacattggtattgaagtactaagtattggagtt

SEQ ID NO: 34460 - DNA, 201 bp, Homo sapiens
ttagtataaaggacaggaatgtcaatatcagtaagtgatatgtaacttgaaaaagcatactacgggttgatttttttaaaacagagagagatattttcaayagaatattgagaaaaacttaaggccatcaagtatatgcaaaagcatttgacgtcaccaagtaagacatatgctttattcttttctctggcccaagtaatg

SEQ ID NO: 34461 - DNA, 201 bp, Homo sapiens
ttggaggctggagggaggtcatttaaaaaaatgattacaaaacctatttgttttagctcaaagtctcaacagtctaagacttggtgatctaaatttaaaamaaaaaagtcatgagttttgttttgttttattttcccatagtatcaaacaggataagattattttcttagccatttaaatataacccagggaagaaggaat

SEQ ID NO: 34462 - DNA, 201 bp, Homo sapiens
ttgtttaccaaagaatcagagtagcagctcattatcatgaattagtataaaggacaggaatgtcaatatcagtaagtgatatgtaacttgaaaaagcataytacgggttgatttttttaaaacagagagagatattttcaatagaatattgagaaaaacttaaggccatcaagtatatgcaaaagcatttgacgtcaccaa

SEQ ID NO: 34463 - DNA, 201 bp, Homo sapiens
tcaacagtctaagacttggtgatctaaatttaaaaaaaaaaagtcatgagttttgttttgttttattttcccatagtatcaaacaggataagattattttyttagccatttaaatataacccagggaagaaggaatacatatttcttgggagcaatgaaaatcaaaagtatagtcccctagaagcactggtctctgaagtt

SEQ ID NO: 34464 - DNA, 201 bp, Homo sapiens
gaaatcgacttcaacaagcagaatatctgcatgaccagcactgattggtggggaattgtatagataacacaagatccatgggaagtatcactgttgacccyggagaggaggcagggaccttcctctgggcggcttccctccaggccagcactcacccctgtgcagattgtgcccatctgcaggtgggaaggagacagtgag

SEQ ID NO: 34465 - DNA, 201 bp, Homo sapiens
taattgttctaaaagcaggttttctggcactatatatcaagttttctccaagtcactaagggacgaaatttgctaagcgactaaaccttggaaagaacackcatttttaaaatgccatcttcatgcagttcacccagtggccactagtggcctctaagaggccttgtatccgcggttaccaatctgcggatgatgactttg

SEQ ID NO: 34466 - DNA, 201 bp, Homo sapiens
cttataaagaaaggtattttcaaagtgatgcaaagaatactgcaaggggtgtgcccaattcaaagaaatagcttctttttttttttttttaagtgttagcstagggtactgctaattagaaaagagtgttatcatttcatcaaaggaagggccactgagcttttacatagaaagattttatcagctgcaagttgattgtct

SEQ ID NO: 34467 - DNA, 201 bp, Homo sapiens
gcttctttttttttttttttaagtgttagcctagggtactgctaattagaaaagagtgttatcatttcatcaaaggaagggccactgagcttttacatagraagattttatcagctgcaagttgattgtctagacacaaagtagcaaatggcatttctttaagatgttcagtcattcaaactatttcagtttggtatcttt

SEQ ID NO: 34468 - DNA, 201 bp, Homo sapiens
acacgtgcatggaggttccctgtatggagccatgttttccatccagattgggccaaggatagctgatgggcagtcatggatgttgatggatgggttttccmagggtagctggattgtggtctcgtaaccatgccgactcctggggctgagaagggctatttagtgaaatgaaatactactctgtcacaacttcctcactca

SEQ ID NO: 34469 - DNA, 201 bp, Homo sapiens
tcagaagagagaggatgagaaccggggttatggctgcagttgtagacatggacaggagtgacagggtttgagaaatatttaggaggcaaaatctgcaggayttgtgttggggagtctgtgaggggtggaagggaggagggtcaaggtcgacttccaggtggctggcttatgtgactatgatgacagatgctagcacttcca

SEQ ID NO: 34470 - DNA, 201 bp, Homo sapiens
tggacaggagtgacagggtttgagaaatatttaggaggcaaaatctgcaggacttgtgttggggagtctgtgaggggtggaagggaggagggtcaaggtcracttccaggtggctggcttatgtgactatgatgacagatgctagcacttccaaatgagataaagaatgcctggaattccagagggaaaaaatcgagtgtg

SEQ ID NO: 34471 - DNA, 201 bp, Homo sapiens
accagaagctggagctatggtcaggtgagccacttaaaatttgttattgtcaaggacatttttacttcatattttttgtcacatgtatccctacaggatcycatatatcgatattagacaagcacaatttcctgctttttaggatctgagactccaaggcagagagcataggagtagggactcataaagacaactgcgtaa

SEQ ID NO: 34472 - DNA, 201 bp, Homo sapiens
acatttttacttcatattttttgtcacatgtatccctacaggatcccatatatcgatattagacaagcacaatttcctgctttttaggatctgagactccwaggcagagagcataggagtagggactcataaagacaactgcgtaatttatcagctgaaaccacatatctctgggtattacagtgttacagaaatgagaga

SEQ ID NO: 34473 - DNA, 201 bp, Homo sapiens
tgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaag

SEQ ID NO: 34474 - DNA, 201 bp, Homo sapiens
ttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaa

SEQ ID NO: 34475 - DNA, 201 bp, Homo sapiens
cttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaa

SEQ ID NO: 34476 - DNA, 201 bp, Homo sapiens
ttagcgataacttaaaaggtgatgctgcaaatgattctttgctggatttcagaaaataaagaagctattccagcaaaaaaaaaagtttctatttttacctstattctgtcagggatcacagtatatgtagttttgaagatgaatgttttagagtcagaaagacctggatttatatccaacttccgccagattcctaactct

SEQ ID NO: 34477 - DNA, 201 bp, Homo sapiens
tgcaaatgattctttgctggatttcagaaaataaagaagctattccagcaaaaaaaaaagtttctatttttacctgtattctgtcagggatcacagtatakgtagttttgaagatgaatgttttagagtcagaaagacctggatttatatccaacttccgccagattcctaactctgtaggctttttatttatcttctaaa

SEQ ID NO: 34478 - DNA, 201 bp, Homo sapiens
gaacaatactgggctcacatgtctgaatccaagtcaccgtcaaccaaagcaggccagtggcttcctgtttgtgcatcccagtggacccagtcgtggatttyactggtccctgtggtgataaagatggggcctgggctcaatagtgctcccagtcaaccattcccagcacccaccatgtgtgagtcagagtgtgtgatcctc

SEQ ID NO: 34479 - DNA, 201 bp, Homo sapiens
agacagaaaggacccaagttctccccatgcctacaatttcactatcccagtgtaattccttccggctcacaacaagataaaatagtgaacaccttacatcygttcgtgtctttggcataaaaaggttatccaatctatgcctgaaaacaggctttggcggtaaatcaagaaaaggcagaaacacacagtggggaagtcaca

SEQ ID NO: 34480 - DNA, 201 bp, Homo sapiens
gtagagatggatggagagaccccttcagatactaggaagaaaatgttagcaagggctagaggggaggtggacggcagtatgtagagcagtgagaagcgtgycttggctggggtggaggctgggagcagggatgagtaagggtaacctgaaaaagatagcttgaggctatgtggaggggagtctacaattttggatgagagc

SEQ ID NO: 34481 - DNA, 201 bp, Homo sapiens
acgttactataaccctattttactgattagaaaactgagaggaccagagaaggcagtgccttgtagcacagtggtcagaacatgggctctggaaccaaatyatctgagtttaaagcttgttttctgaacatcataactgtgtaaacctggacagatcatttcacctctgttggcttctgcattctcatctgtaagtcaaaa

SEQ ID NO: 34482 - DNA, 201 bp, Homo sapiens
caatttaaaacccaggtagttctcagtccaccctaactctgccctaacttaccccttctgctgttagaacctcctgtctctcagagtatctcacacttcartaggcattgtctggggtcttattcaaatgcagatcctgacttcactggtgcagtaagaagtcagagaatctgcatctgtaacaagctcccaggtgatgat

SEQ ID NO: 34483 - DNA, 201 bp, Homo sapiens
tgttgtgggactatcctgtgcattgtaggatgtttaactgcatttttggcccctatccaccagattccagtagtaacccaccctccaccccagttgtgacmatcaaaaagttctccagacattgccaaatgtcccctggggataacattgcctcctattgacaactactagtctaggatgaccaacctttctagttttcca

SEQ ID NO: 34484 - DNA, 201 bp, Homo sapiens
tctatccttagggatacacaaagataaacccaaaggtatttaggatggaaaagaggatgatgaccatccctcacatctgcatgagccctgtttccaagccraagccttttgtccaaggctctgtaaggaccgttctcccaccttcccagtgtctgaggcataagctccttctgaggcctgacttgtatctgtattttctgc

SEQ ID NO: 34485 - DNA, 201 bp, Homo sapiens
tctctatccttagggatacacaaagataaacccaaaggtatttaggatggaaaagaggatgatgaccatccctcacatctgcatgagccctgtttccaagscaaagccttttgtccaaggctctgtaaggaccgttctcccaccttcccagtgtctgaggcataagctccttctgaggcctgacttgtatctgtattttct

SEQ ID NO: 34486 - DNA, 201 bp, Homo sapiens
aggagggtcaaggtcgacttccaggtggctggcttatgtgactatgatgacagatgctagcacttccaaatgagataaagaatgcctggaattccagaggraaaaaatcgagtgtggaaaatgctaatggaggtagtagcttcattgataactcattggcactgttgctgtgcagaggtgctgtatgcctcccatttaatt

SEQ ID NO: 34487 - DNA, 201 bp, Homo sapiens
attatgtaagatgccagagcacgcagcataactgtagagaaacaggaattactctgccaggctctgggaaagccgtgcagttgttttctcctctctgggcstgcgcttcctggaacagccccagcctgcttctgtttggcggtctccgctcacagaggacagtgcttccccagaaggaagctccaggttcctgcacccatg

SEQ ID NO: 34488 - DNA, 201 bp, Homo sapiens
atttcatcaaaggaagggccactgagcttttacatagaaagattttatcagctgcaagttgattgtctagacacaaagtagcaaatggcatttctttaagrtgttcagtcattcaaactatttcagtttggtatctttaacaatggagcaaatgaatgatattttaccaattttccataaatgaatgcatgtcctgtgatt

SEQ ID NO: 34489 - DNA, 201 bp, Homo sapiens
catttaacagcatcattaaggcccccaaatccccaaacgcctctcagctttctactctgccaccttctcattgtcagcagtgtttctgttcactgtctcaygatggccacagcagcttcaagcatcccttcacctgaaaacacctgaaaacagctgaaagcagaaggggaaggacaaactcatccatgtacctctctcctt

SEQ ID NO: 34490 - DNA, 201 bp, Homo sapiens
tagcgacacaagcgggggcgaatgtcatttctcaggagttttggctgggatggctggaactgtgcatcattgcgctgggcatccagcagggagttttcatrgaatctggtggtcacagggtactttcttggctccggatgccttgctttgacttccatatgggatctccctgtgttccttacccactgctccagtacccgt

SEQ ID NO: 34491 - DNA, 201 bp, Homo sapiens
tgttccttacccactgctccagtacccgtgttatcctgcctacctggctttgtgaacagcttccctgactccggagaattacatgcccagtgctcaggctyccccgcctgcatttctaatgtcctgccaagctacaagctagttggcaccccctgttcttggattcctgcctgactccctggtttcaagccatcccctcct

SEQ ID NO: 34492 - DNA, 201 bp, Homo sapiens
taggagtcctactcacacttgtgctgctgcaagtgagaaacttgaccgtcaccttcaatttcaatgttggcaacaacaacaaaagcagccacacacaacayctgtgaatgcccagaccttaactgcagtttgggatggagggtgagagcaggaaggatgcactctgtggtcaccacgcttggagcacatcagaatcacctg

SEQ ID NO: 34493 - DNA, 201 bp, Homo sapiens
gaggcagagcttgcagtgagccaagattgcaccactgcactccagcctgggcaacagtgcaagactccatctcaaaacaaaacaaaataaaacaaacaaamaaaaaaacagtaggtaagctacatttggcccgcagactatagttttctaaccattgctctaaaggatgaatggagattacattgatcattaacaactcag

SEQ ID NO: 34494 - DNA, 201 bp, Homo sapiens
caatgccgcagcctaccttcggtatttctcactagaggatggctctcgcagccttctccctatcattaaccctttttcgctcttctccctcccttcccccstcagctcaccaatgactgtaaatatatttatctatacttatggatacccattcacaccttatgcatccaaacactcctgtctccttctcagaccagacac

SEQ ID NO: 34495 - DNA, 201 bp, Homo sapiens
tgggttcaagcaatcctcctgcctcagcctcccgagtagctgggattacaggcacatgccaccacgccaggcaaatttttgtatttttagtagagacgggrtttcactatgttggccaggctgatctcaaactcctgacctcaggtgatccacccacctcggcctgccaaagtgctggaattataggcgtcagccaccgca

SEQ ID NO: 34496 - DNA, 201 bp, Homo sapiens
cttttctccagcatgttgttagtgctccacatgtctctggaaccatctctctactctggtggcctctataatggggactcttcacctcttgtgggtgtgcmtggtttttgaaaatagccaagtctccaggagtcatgactgggtaatccaggggatcaagggggaaccttcactgggcccagaaacaaagtcccccttcat

SEQ ID NO: 34497 - DNA, 201 bp, Homo sapiens
agagcagcccccaagcctgctttccaccccacctttactgagaagctagggccctgaccaatggtagaggctactatgtaggaagtgcctgtacttaagasgcaagggtgtggtgttgtgaaaaaaatatccaatttcatgcaccaatgcccagattttgtgtgatgataacccttcaagtgtagggatagaaaaagggga

SEQ ID NO: 34498 - DNA, 201 bp, Homo sapiens
cttggaattttatcccctcgttttcactttgggatttgaagatttccacaaacctcccagctgtcatttgatagtttatgatgctacgagagcccctaatsaggagatcactctgaaatccacaaagccttgttttcagctttttattacactttattgctgcaaagaaggagaaggaggacctccctccacaagcaagct

SEQ ID NO: 34499 - DNA, 201 bp, Homo sapiens
ttggttaacttttcttccccaccctgtcggtacctagtaagttctgtttcgttagtcagcagaaaatggttaagattaaaactgttcaatgcactgattcmaatatctttgggtggccttgaagctgctcttagcagagggaaagagacatccagccatgtgagtgtcctgagggatgccaatgagaatgaatctgcccag

SEQ ID NO: 34500 - DNA, 201 bp, Homo sapiens
gcaagttcctgaccctgttatgaaactcccaccctaaatacacagataacgtctcagccatgagtgaaactagaagagatcatgtgtaactaattagatgkcagagtgagagaaaagaaacttttccccgggtcctggtcatttgaaaagaaatattatcctcaaagaaaagtctttacttgagatctgaagtgcaaagca

SEQ ID NO: 34501 - DNA, 201 bp, Homo sapiens
gcagctatgaatcactggacagtttaatgaagacgcttgctcaatgtttagctgcagtccaaacagcaaatagaatacgagggctcagtgaggagggagtsagggctactcagaggggcagggggacagcaatggtttggcctcaccttggaagagctcagcttgatcacctcattatacaaaggtcacagtcaaaatgga

SEQ ID NO: 34502 - DNA, 201 bp, Homo sapiens
tacaatttgaggccaatgtaccacattctatctactcttcagtactctgcaagagattggagtgaggactacagtattagaagatgaacaatctttggtakcatgcttagggtctgctctttcccttaagattctcctacatctgtcactccagaacccacccccacaactggaggcatatctcagttccattgggggata

SEQ ID NO: 34503 - DNA, 201 bp, Homo sapiens
attgctacaaaggaatatgctttttctaaataggaactatattaaaaagttcaaaataaatatttcagttttggttaacttttcttccccaccctgtcggyacctagtaagttctgtttcgttagtcagcagaaaatggttaagattaaaactgttcaatgcactgattcaaatatctttgggtggccttgaagctgctct

SEQ ID NO: 34504 - DNA, 201 bp, Homo sapiens
tttggttcttccacacctgtggagtctgcacaccggatttgcaccctcccccaagttttggccaggaggcttctcaccccattcaaattgctacaaagttsagctagagatttccttctccatgtggagttttatcctctgctcctctgtccacctttctgatggatctctgtggtgccaggcagggatggcctgctaggg

SEQ ID NO: 34505 - DNA, 201 bp, Homo sapiens
tccaaatgagataaagaatgcctggaattccagagggaaaaaatcgagtgtggaaaatgctaatggaggtagtagcttcattgataactcattggcactgktgctgtgcagaggtgctgtatgcctcccatttaattgttcaagcagccctctgggcattggactatggccatctccatttttcccatgagataatggttg

SEQ ID NO: 34506 - DNA, 201 bp, Homo sapiens
aaaggattaagtaatttacccaggtcacacctggaaagtgctgggacctcaatttggacccaagcagcctcttctacttacaatgcttactacctccaccragggagcctccaccaaggagatggtggaggtatgaatatgcttctgtttgaattgatgagtgtgaattacttgagggactttcaggtaaacctgtccaat

SEQ ID NO: 34507 - DNA, 201 bp, Homo sapiens
ccttacccactgctccagtacccgtgttatcctgcctacctggctttgtgaacagcttccctgactccggagaattacatgcccagtgctcaggcttcccygcctgcatttctaatgtcctgccaagctacaagctagttggcaccccctgttcttggattcctgcctgactccctggtttcaagccatcccctcctcagt

SEQ ID NO: 34508 - DNA, 201 bp, Homo sapiens
taaataggaactatattaaaaagttcaaaataaatatttcagttttggttaacttttcttccccaccctgtcggtacctagtaagttctgtttcgttagtsagcagaaaatggttaagattaaaactgttcaatgcactgattcaaatatctttgggtggccttgaagctgctcttagcagagggaaagagacatccagcc

SEQ ID NO: 34509 - DNA, 201 bp, Homo sapiens
ctttagaaaacaatgatagatataatgatactgtagaccagttattcttaagaaccccttgcctagagactgaggagtgatcatgacaaaaatgtcaatgmctataatcaaacagttgatcaaccaaacatcaaggtgcacagaagatgtgcaaggcacagcttttctcaattttcacactgatagtaagagtgaagaaat

SEQ ID NO: 34510 - DNA, 201 bp, Homo sapiens
cttctacttacaatgcttactacctccaccaagggagcctccaccaaggagatggtggaggtatgaatatgcttctgtttgaattgatgagtgtgaattasttgagggactttcaggtaaacctgtccaatagataatatgagtctgaagcttcgggaggaggtttgggttggacaggagataatttggatatcatacaca

SEQ ID NO: 34511 - DNA, 201 bp, Homo sapiens
ctgcctactgcctgatgcccttgtcttgggtccccaatttctagcctttagcctggtgattctatttatggcccaaatatgacaatctatagatagctaamaaggggaaaagtcatcaaggtgggcagcaaggaggtctggaaaagtgtcccaagcccagtcagggcactcttcgccagcttgcctttgggtaggcaccct

SEQ ID NO: 34512 - DNA, 201 bp, Homo sapiens
ttatggcccaaatatgacaatctatagatagctaacaaggggaaaagtcatcaaggtgggcagcaaggaggtctggaaaagtgtcccaagcccagtcaggkcactcttcgccagcttgcctttgggtaggcaccctggagcacagtcacttgattgtatcttctgccactcaaagaggctattggtgtgtatcctttggcc

SEQ ID NO: 34513 - DNA, 201 bp, Homo sapiens
tacaaacatataaacaactaaccaagcataatgaggtgaatgctcactagagatgcccataaaggtgttacagaggttcagagaacagaaattattctatrgggaatcacaaacacctctgagtggcagcatttgaaggttaggaggctttctaggcacagggaaccacgaacaaagtgtagaagcatccaaggacatggt

SEQ ID NO: 34514 - DNA, 201 bp, Homo sapiens
tcaaagggagcaagagagagcccctaaggcagaaaccagttttttgagaccgaatatcggcagtgatagcctatcacttctgctatactctatgcactagmagaagcaagacactactaatgcagcccaaactcaaggggattgcttaaggctataatacatgaggagatggagatcactgggggctgcttagatgctgcc

SEQ ID NO: 34515 - DNA, 201 bp, Homo sapiens
cttaattaaaactcacaagaattgtaggttagtactactattttcccagttttacagaggagcttagggaagttaagtaaattgcctatgatctcaaagtkaagtggcaaagccaaaatccaagctcaagtctggagtgctgaactacttattttatcttatgctgagtccttgtttcctttcccatccttatgatccaca

SEQ ID NO: 34516 - DNA, 201 bp, Homo sapiens
tagatttattattatagagaggtcacaatggccaagcacatggaatacaaagatttctaagacactggtcctgcacatcagcagcttgtaccctattaggrttgatagacaaatagatcaacaattacagagccctgggtaagtgctggcgtctacacaggagacaggagacagtggggccaaaagacctgtgggaaaaag

SEQ ID NO: 34517 - DNA, 201 bp, Homo sapiens
taacacttattctttgtgtataataacatggacaattgtagtgccttctccctctcagcactgtggctttgcatccactcaggtttttgggatttccttasacattttttcatataaactcaggaagttcccaagggaacacactccaagaattagatgaaaaactctgcagaaaaatccacctcacatgaaaatctctgt

SEQ ID NO: 34518 - DNA, 201 bp, Homo sapiens
gaggtcacaatggccaagcacatggaatacaaagatttctaagacactggtcctgcacatcagcagcttgtaccctattagggttgatagacaaatagatmaacaattacagagccctgggtaagtgctggcgtctacacaggagacaggagacagtggggccaaaagacctgtgggaaaaagcagttgtgttccctgagc

SEQ ID NO: 34519 - DNA, 201 bp, Homo sapiens
cacccccagggtcgtgatcactgccaccagcatcattacatgccacacacatcaaaattaaacaaacatgaaaactggacgaaaaagcattccactgtttrttataaagttggatatggtttttctaactagtctgtcattctgagagatgggaaaacttagaagaatttttcctgcggtgaaaatgactttttttttttt

SEQ ID NO: 34520 - DNA, 201 bp, Homo sapiens
ggcattcaaggccagcctgggcaacatagcgagacctaatctctactaaaaatttaaaaaattagctgggtgtggtggtgtgcacccgtagacccagctayttgggaggctgaagtgggaggatcacttgagcccagggggttgaggctacagtgagccatgatcaatcacaccactatgctccagcctgggtgacagagg

SEQ ID NO: 34521 - DNA, 201 bp, Homo sapiens; identical to SEQ ID NO: 7193

SEQ ID NO: 34522 - DNA, 201 bp, Homo sapiens
cagacacatagcacagggtggtcccttaaagcaaaaatggatccttggagttctgaatgtggagcaggggtggaattgggaacttctccaggaaatcctgyagtgtttgaggaagtagcatttccctctctgtgttccttgagacacatttggctgaagaagtcagagtcttaccttctccacggggtcttaaaaagagct

SEQ ID NO: 34523 - DNA, 201 bp, Homo sapiens
gcaggttctgctgccagtgcaaccctccaggtgccaaagaccatcccctgggtgcacctccaggttgcagagggtctgtgaccaggagccgccgccccccsatgcctgtgaagacacctatatgaggagattccatggtagggcccctctcccttcaccagaagtggagagagcctgttagtgtcatgccagcagttgtaa

SEQ ID NO: 34524 - DNA, 201 bp, Homo sapiens
ttgcttgagctcaggcattcaaggccagcctgggcaacatagcgagacctaatctctactaaaaatttaaaaaattagctgggtgtggtggtgtgcacccrtagacccagctatttgggaggctgaagtgggaggatcacttgagcccagggggttgaggctacagtgagccatgatcaatcacaccactatgctccagcc

SEQ ID NO: 34525 - DNA, 201 bp, Homo sapiens
caaccaaacatggtcctaccgcatccaccagaacatcacttaccaggtgtgcaggcacgcccccagacacccgtccttccccaccacccagcagctgaacrtggaccgggtctttgccttgtataatgacgaagaaagagtgcttagatttgctgtgaccaatcaaattggcccggtcaaaggtaaggtttccttttttgt

SEQ ID NO: 34526 - DNA, 201 bp, Homo sapiens
agatttctaagacactggtcctgcacatcagcagcttgtaccctattagggttgatagacaaatagatcaacaattacagagccctgggtaagtgctggcrtctacacaggagacaggagacagtggggccaaaagacctgtgggaaaaagcagttgtgttccctgagcagagccataaaggtctcttggaactaacatcc

SEQ ID NO: 34527 - DNA, 201 bp, Homo sapiens
tctggtcgttttgttgtcaagtcaaaaagttacccaagcacctgccgtgtacctgtctctgactcggtgctagtggaagttttggctggcatttgctaagygcagcctgctgctctaaagtgagaacttggcattagattgcattatcacagttagtcctcagaattgccctgtggggagttcgagaccagcctgggcaac

SEQ ID NO: 34528 - DNA, 201 bp, Homo sapiens
gggacaggtgtagattacacctgtgagtgcgcatctgggtaccagggagatggacggaactgtgtgggtaagagccatgttctcgtgtctccttcttgtarcccttgtttttcctctgccctccccagccttatgtctgtagaagacaagtatctgtcacctttacaacctccattgtcaatgattttagcagctgttaat

SEQ ID NO: 34529 - DNA, 201 bp, Homo sapiens
atgatgggagccacatgtgtgacacaacagcacggtgccatccagggacaggtgtagattacacctgtgagtgcgcatctgggtaccagggagatggacgkaactgtgtgggtaagagccatgttctcgtgtctccttcttgtagcccttgtttttcctctgccctccccagccttatgtctgtagaagacaagtatctgt

SEQ ID NO: 34530 - DNA, 201 bp, Homo sapiens
gggttgtgatttccttccctgggaagagcgtgggaatattaaaaagcagatctatggagtcatgtattaaagggttaagaagggactgcacaccctgcttygggctctgagagcttgagatcactggagtaaagtgcaggaggcttcaggaaccagccatagagtagaacagaggcacagctataacccttgtggggcatg

SEQ ID NO: 34531 - DNA, 201 bp, Homo sapiens
aaacacagacatgcagtcagttccgaggactcctctatctccgtgacatttgcttaccaatagccagattgtgcttttatttcccctctactcatgcagargattcagaccccactccggtgaatccttgctatgatgggagccacatgtgtgacacaacagcacggtgccatccagggacaggtgtagattacacctgtg

SEQ ID NO: 34532 - DNA, 201 bp, Homo sapiens
gatccttctgagaatctccagaatttacagtatgagtttcctctaaatacattttaaggccaagtatcaaagattttcacaaagggatttgaggtaaagaygcattcctgaatggccttctcatttgtgggttgtgatttccttccctgggaagagcgtgggaatattaaaaagcagatctatggagtcatgtattaaagg

SEQ ID NO: 34533 - DNA, 201 bp, Homo sapiens
gtattatctgcaggctattgcatggagaggtactaatttcaggagggaagaaaatattttctgactaatgtggcattgtgtaaggattcgagggagtacaytggtgtcggcttcgagtttgaatcctggctgccaagcttgctgggtgacctgaagtaacttatgtaacccataagcctctgatttctcaggaattacttg

SEQ ID NO: 34534 - DNA, 201 bp, Homo sapiens
ttgtctatagggtaggcaataggaagccatgctggagtttaaaactgaagtgcagaaaatccaccctagcttcagatatggataatttagtaaggtcttcmggtgtgtcacaaaacacagacatgcagtcagttccgaggactcctctatctccgtgacatttgcttaccaatagccagattgtgcttttatttcccctct

SEQ ID NO: 34535 - DNA, 201 bp, Homo sapiens
tttctcagacatgtttgtccttttggattgttgtgacttggccaggtgcaaaagcagattgtcttgagttgggaccttcccaggaggagcaagtgtgagtkgaggaagctgggttacagatggcccattacccagagccatcattactcaggggcctgagggaagatactgacattattctttcttgggtttcctggcgtt

SEQ ID NO: 34536 - DNA, 201 bp, Homo sapiens
ggcgaaagcaggcggtggttaattatcatggacatggggtctatgtcagtcttctagtccttgttgagacttgtcatgccagctgtttcttccccatcagrcatggaaagatgtgaatgggaaactgactccagattgtttgttccagggactgctcatctgacctctgataggaagaaagaggtcagaggtgactgcttt

SEQ ID NO: 34537 - DNA, 201 bp, Homo sapiens
gggtcatgttagggctctgaaattgactacttttccatattgggaatttaagtattgtcattttttaatttgccctatttttgtcattttcaattgtcccyattttatttctggttctctgcttttaggattctttccaaagcctacaaactaaaaatatgccaaacccatcaggtgcttcccccagtgtattggttatct

SEQ ID NO: 34538 - DNA, 201 bp, Homo sapiens
agtgaccctcctgcctcagcctactgagtagctagaagcacaggcatgtggcaccatgcctggctaagttttttagaaaagggttttgtagaggcagggtstcactatgttgcctagactggtctcaaactcctgggcttaagtcatcctcctactttggccttgcaaagtgctgggattataagtgtgagccaccatgcc

SEQ ID NO: 34539 - DNA, 201 bp, Homo sapiens
aaataatagagcaaaagcacttttaaacagatgttttgggcgtttttattccctggatgcaaacctactgaaagcaagtaaaggtactagttgtctatagkgtaggcaataggaagccatgctggagtttaaaactgaagtgcagaaaatccaccctagcttcagatatggataatttagtaaggtcttccggtgtgtcac

SEQ ID NO: 34540 - DNA, 201 bp, Homo sapiens
cagcagagatggtgcttttaaaatatttagttccttagctctctggtttaaagcaaagaagttgaaattaatttcagcctagatatgatgagtgttaatcrgaatattaatttagattaggtgctgcatgctttgatcacttctacaatgattctctccctccttttttcttctacttgtcctgcaagactttgattacct

SEQ ID NO: 34541 - DNA, 201 bp, Homo sapiens
gggagaggagacggttcgtatcactcaaactgctgagggacttgacccagagaactacctgagcattaagaccaacattcaaggccaggtgccttacgtcycagcaaatttcacagcccacatctctccctacaaggagctgtaccactactccgactccagtatgtataaccagtcttcacatctgtaaaatggggatta

SEQ ID NO: 34542 - DNA, 201 bp, Homo sapiens
tagcccctgtgtctttttctcatctgtgaaatgaggataaccctgatgctcgtatgaaagggtagatggaagaggaaagagagtgatgctgtgagacagtwaggaggccttttgaccaactagtgcctaacacagtgcctgcccatagtggtcatttaataaatggatgaatgaatgaatgaatgaatgatgcaaatgaga

SEQ ID NO: 34543 - DNA, 201 bp, Homo sapiens
aagtccagtatgatccctttagttaccatgtaagtctgcttttatttggttttatataccagtgaaaactgaacctgatcttaatagcctttcaggttttytgtttttttgagacagggtctcactctgccacacaggctggggtgcagtggttgcaaccaaagcccactgtaacctggaactgctgggctcaagtgaccc

SEQ ID NO: 34544 - DNA, 201 bp, Homo sapiens
atttcctagtgccccggagaaagcaccctcctgtccatccacaacccccgccacaccctacccccttggctatttcctttatgaactatggcatttgctcyagtttccccatttctttgcagcacagatggccctcttcttttaatgggcagaataagtaggaaatggaagaaacagctgccagagcactgaatttatcct

SEQ ID NO: 34545 - DNA, 201 bp, Homo sapiens
tctataaaattgaatatgatcacctctatttgcagattgtattgaagaatgtgaaacacttggcacagggaaggggcatcaccaattcatgaaagtatgtygtagtcatttgggtgtcagtatttggtagagttttaagcatacatttttaaaatgtgttatgtttccagacaagtagaggaaggatgaaacattcctaca

SEQ ID NO: 34546 - DNA, 201 bp, Homo sapiens
tctgctactgcgtggaaatcatgcttgtaccatacccatcatagttaaaccctgccaagggcatagggcattttaatagcttgaatccctgttgttttgcsctcctctgtccccttctccccatgccttttctttgaggtaggtgcgtgtgttctttaagacccttccctcaaaacaatcttggtagcgagaccagctatt

SEQ ID NO: 34547 - DNA, 201 bp, Homo sapiens
gtcctcattgaaggctcagtataagacaagaacctgattctctcctgttgttatttctccattttaatagaagattctgtacaaagtggggtgggagacaygggtcagaaagagtgaaatgatagagaatccaggaggaggtggtaaaatgggtggtactgccagtgtctgcctacagatgccatgatgctggtgtctgtg

SEQ ID NO: 34548 - DNA, 201 bp, Homo sapiens
ttgctccttaactttttcagtgcaaaaacaaattttttaggttttggcatttgtatttatttgaatttttttacattgactcaccattctttgtggattarggaattaatcagttcaagtgaataaacaatgaaatgtctttaatattctgtagagtaatgataattcagatgcttattgactgcagtgtgtggtatggtt

SEQ ID NO: 34549 - DNA, 201 bp, Homo sapiens
ctgctactgcgtggaaatcatgcttgtaccatacccatcatagttaaaccctgccaagggcatagggcattttaatagcttgaatccctgttgttttgccmtcctctgtccccttctccccatgccttttctttgaggtaggtgcgtgtgttctttaagacccttccctcaaaacaatcttggtagcgagaccagctatta

SEQ ID NO: 34550 - DNA, 201 bp, Homo sapiens
gaagctctgctgcatggttttctcgaacaatttatgctgaactaacccaaagccgtggctcagttcagcccttttatttttttctttcactaaatagatayttttggtggtggtattgaaagttgaagctatggcttgaatattcgtcttcttcaaaactcatgttgaaacttacattccactgtggcagtattgagaggt

SEQ ID NO: 34551 - DNA, 201 bp, Homo sapiens
ctcagccaaggcatcccagctcacagcaggctatgacagggcactggaagagccataacgtgggcagtagggcaggcacgggggagaatgccagacacccygaaggacttgggagcgagtccagtctatgaggtcagctgcagcagtcagcacttgggatctagattaggagtcactctgggcaagtctccccccatagca

SEQ ID NO: 34552 - DNA, 201 bp, Homo sapiens
attttcaaattgtactgaaaaatattgttactatagaaatccacatgaacatgatgagtacccacccaaatgaaggaaaatcttttgttcttatacaattyagtgaagtttttattatcttattaggcatggactgttattcctcattgactgacttttgaggaaattccattgcttgggagaatgtgagcatagtgtttt

SEQ ID NO: 34553 - DNA, 201 bp, Homo sapiens
cactgtactccagcctggcgacagagtgagactccatctcaaaaaaaaaaaaaaaagaaagaaaatgcactctttaattcagtgggatgagggtaaaagtrataggagaaactgcgtgtgtgtgtgtgtgtgtgtgtgtgtgtgtgtgtgtagcaattgctctggagtgttataaactttaattgaggactgcttaggtga

SEQ ID NO: 34554 - DNA, 201 bp, Homo sapiens
tgacctcggttcactgcaacctctgcctcctgggttcaagcttttcttctgccttagcctccagagtagctgggattacaggcacacaccatcacacctgrctattttttttgtatttatagtggggtttcaccatgttggccaggctggtcttgaactcctaacctcaggtgatccgcccaccttgatttcccaaagtgc

SEQ ID NO: 34555 - DNA, 201 bp, Homo sapiens
cttcctcaaatttgtctcacaactgtgagctcaaaggtcataaattatatagttcataatgtttgtcatactcttcctctgcaaatttaaatacgaattcrcacgtgtatattttgaaatcatacttttctatcttctggaagacaagacagtagttaataagtatttatgatgtttagggccagtgataggcattttatt

SEQ ID NO: 34556 - DNA, 201 bp, Homo sapiens
tactcaggaggctgaggcaggagaatcacttgaaccagggagttggaggttgcagtgagccgagatcacgccactgtactccagcctggcgacagagtgasactccatctcaaaaaaaaaaaaaaaagaaagaaaatgcactctttaattcagtgggatgagggtaaaagtgataggagaaactgcgtgtgtgtgtgtgtg

SEQ ID NO: 34557 - DNA, 201 bp, Homo sapiens
acttcccagggcgaggatgcagaactggggtgtctttcccagtgagtaattggagcctctgtccctcggtgacttctcaaccagcagtgccaccccccacyagttgtttgagctttaagctttaagtgtgagtcagctgttttttgttgttgttggttggttggttgttttgtggggtcataaaacacgatccaaaaatgc

SEQ ID NO: 34558 - DNA, 201 bp, Homo sapiens
tttttaaaacagttaaagaattcttagaatattcacttaaaaatttatcttcctgtggtgtttacttgaatggcatgaaatttttactatttctgattatstgcaacatgcattcatatctgatttttaaaaattctacatctgccaaccatttgtcccattgaagcatcatactagtgagaaaacattgagtttttagac

SEQ ID NO: 34559 - DNA, 201 bp, Homo sapiens
atcatcttgttggaattcatgtgaaacagcgcagctgtccacacctgatgtgggtgtggtgcgacttcccagggcgaggatgcagaactggggtgtctttyccagtgagtaattggagcctctgtccctcggtgacttctcaaccagcagtgccaccccccaccagttgtttgagctttaagctttaagtgtgagtcagct

SEQ ID NO: 34560 - DNA, 201 bp, Homo sapiens
gttttctttagaattttatgattttccctcccaccccagtcaaataataatatcaaagcatggtttacttggtgccaagtactgttctaagcaccttacaygaattaactcatttaatccccacaatgacctctacccaatggtggggtgggggtggggttatttgttatcccattttacagatgatgagactgaggtata

SEQ ID NO: 34561 - DNA, 201 bp, Homo sapiens
gctcagagcccacccagaggcccccgaccatctgtgagcgctggagggaaaacctgctggagcactacggtggcaccccccgggatgaccagtacgtgccmcagtgcgatgacctgggccacttcatccccctgcagtgccacggaaagagcgacttctgctggtgtgtggacaaagatggcagagaggtgcagggcaccc

SEQ ID NO: 34562 - DNA, 201 bp, Homo sapiens
aaaagaaacacccaaaagttttttctttcccctcttggtacacagcagtatcttcctaagaactgctcagtttttccagagggaactatcatcttgttggrattcatgtgaaacagcgcagctgtccacacctgatgtgggtgtggtgcgacttcccagggcgaggatgcagaactggggtgtctttcccagtgagtaatt

SEQ ID NO: 34563 - DNA, 201 bp, Homo sapiens
gacacctctggcttcagtgttgctgtagcagaaatcaagataaacattttccctgtctgtataattgctaaggtcatcaaatgtgacatacaggatttgtycactgtctcagtacttgttacaatcagggagaatttttatatcttgagaaactcttgccatgtttaagtggagtttctacgaaatgaaattcccagatgc

SEQ ID NO: 34564 - DNA, 201 bp, Homo sapiens
tcctctcaggatgtgtttaggttgaaccatataaaagtgctgatatttagccctttttgacccacaaaaatagtggtttcatgaagttcaacctaacatgwacttactggtttgctttcattttactgcactcaaacccacgggtgcagtctcatcttagttcaccaactctgcaatgggacccagccgggagcagtaagc

SEQ ID NO: 34565 - DNA, 201 bp, Homo sapiens
tcttaagcacagctgtccaaagcctcctatttcagggagaattcagccactttatgcagacaggaaaacaaaactgttcgttttagcatcttctctattgkaactatttttttgtactcagattgcatcagattcaaaactagtgacatcctcttatgctctgtttccccaaccagatcatgagctctttaaggttagggg

SEQ ID NO: 34566 - DNA, 201 bp, Homo sapiens
aaggcttaaatgacttacatggcatgtccttagaacagtgcatggaacataaaatgagctctattatgttattactcttattgttaccatgaaatatatcrtgtaagtgagcagaatggctgctatacataagaatatctatatccctacatagtattttcaaataataaaatcaatagcaacattgtccatggggtgggt

SEQ ID NO: 34567 - DNA, 201 bp, Homo sapiens
ctgttgggttttcttaattttctttagcaggattggcagatgtacatgttcctatttccattttacatggcagactcagaagtacacagaagtgccagagktgatagattcattctacctgagcatctgacactccttccaatacctctgtgccattggcttagactagataacttcatgaagttccttcagtgagggttg

SEQ ID NO: 34568 - DNA, 201 bp, Homo sapiens
cctgaggaagacctgttagcccctgtgtctttttctcatctgtgaaatgaggataaccctgatgctcgtatgaaagggtagatggaagaggaaagagagtkatgctgtgagacagtaaggaggccttttgaccaactagtgcctaacacagtgcctgcccatagtggtcatttaataaatggatgaatgaatgaatgaatg

SEQ ID NO: 34569 - DNA, 201 bp, Homo sapiens
agaagacaagtatctgtcacctttacaacctccattgtcaatgattttagcagctgttaatctgaatatagttatttaaaaattaaagcatagctgtttakgtttgaaaagatggtttggagtggagtggattttgcaccggggctgtgaaaagaaaacatctgttgcagttcctggatgttttgagttaagttttgtaat

SEQ ID NO: 34570 - DNA, 201 bp, Homo sapiens
agtaattagggacactttcttctcaattttaggtaggataatatatcctgtccaagtttgcaagtcaacttttgagctgagattttttttttttttttttyttttaatgcctagcagggtggtaagctcttgatgtccatgtgaacacactaatctttgctggaatgtgccatggtgaaattttgatgctggaaagtactg

SEQ ID NO: 34571 - DNA, 201 bp, Homo sapiens
agaaatgtccttcaatataatcttctatttcacttttcattatttaaaatttcaaaaatatacagaaaagtggagagaataactagatgaacacccaaatrcccatcacctagatttatacattgtaaacattttgccatattcatttttttgtttgtttacatttttttcttttctttttttttttttttttttgagacg

SEQ ID NO: 34572 - DNA, 201 bp, Homo sapiens
aaatgtgatgttcttctctgtgcccgagtttgtctgtctagcagaatggaaaggtaatgatacttaccagtaaataatatttctaagagtcacattatttrtgaagtaagttgtgttttaaaaataccttcccagttccttactaaattgtaaaagtagtgtgatttagtgagagagagacagtttcagaagcctaaacat

SEQ ID NO: 34573 - DNA, 201 bp, Homo sapiens
atgaactatgatatttatcagctgccggatgcagtctactatagacatcctggtaatggcaaaaaacgcctgtgaaaaagctggttaatacgcattttggrggaagaaatctagaagtgtttgaaacttagacaaaaaaaatccagtttttgttttaaaagaatttacggggatgtatgaagtatagaagcatgcaattgt

SEQ ID NO: 34574 - DNA, 201 bp, Homo sapiens
ttttaaggctacaaaacgttatgtcatatatgtataaagacagcttattaatgaacatttcatgtatttctgatttttcttgttataaatatcattgcagkaaacagcataataaacattgctcacattctcgtttctccctaaaacaaattcttaaaagtggaattgctgagaaagggtgtatgatttaaaagttgtaca

SEQ ID NO: 34575 - DNA, 201 bp, Homo sapiens
gaaaggatcagagaaagcaaactggcaggtaccaagttgcttgttttctttagaattttatgattttccctcccaccccagtcaaataataatatcaaagsatggtttacttggtgccaagtactgttctaagcaccttacacgaattaactcatttaatccccacaatgacctctacccaatggtggggtgggggtgggg

SEQ ID NO: 34576 - DNA, 201 bp, Homo sapiens
tgatcactacttcaagtgataacaagtgttaatggtccttctagaatttaggtatatacaaaacttttaaaaccaaaatggttcttttgctatgtaagtgktgttttcacattaatcacttcttataggggtcttttagtcagatgtctgtctatactaccattttaaggctacaaaacgttatgtcatatatgtataaag

SEQ ID NO: 34577 - DNA, 201 bp, Homo sapiens
gtaaaagcaactgttagtgaaataatttcccaggctatggagtcccattcagattctggaaccatttaggaaaaagatgtgtctctgggtatatttttccyagagacataccaaatgagagtaagaaaggatcagagaaagcaaactggcaggtaccaagttgcttgttttctttagaattttatgattttccctcccacc

SEQ ID NO: 34578 - DNA, 201 bp, Homo sapiens
aggctgccgcttagtctggactctggagcaaactcagttccttactctccctcctctggttccaccctctcttctacttgggagctcatagatttattatyccatagatttattattatagagaggtcacaatggccaagcacatggaatacaaagatttctaagacactggtcctgcacatcagcagcttgtaccctatt

SEQ ID NO: 34579 - DNA, 201 bp, Homo sapiens
tcctttcccatccttatgatccacattgggcatctttagggctccatctaggctgccgcttagtctggactctggagcaaactcagttccttactctccckcctctggttccaccctctcttctacttgggagctcatagatttattattccatagatttattattatagagaggtcacaatggccaagcacatggaatac

SEQ ID NO: 34580 - DNA, 201 bp, Homo sapiens
aaagtgacttgtaatgagaatcccgaggtgctttggttttaagaaacttggttgggaatgtaggcattaggtgcccagagattggattgtaaggtagcaartgaacacatgaaaatgtgagttgattttagaggaacatgtaaattagaaagggaaagattgctgtagtagatttctcaaagagagatttaaacctactgg

SEQ ID NO: 34581 - DNA, 201 bp, Homo sapiens
tagactcttttctaggatgcgaaagtgacttgtaatgagaatcccgaggtgctttggttttaagaaacttggttgggaatgtaggcattaggtgcccagakattggattgtaaggtagcaagtgaacacatgaaaatgtgagttgattttagaggaacatgtaaattagaaagggaaagattgctgtagtagatttctcaa

SEQ ID NO: 34582 - DNA, 201 bp, Homo sapiens
taaataatattgcttatgaaattatattgttaacttgaagaggaaattttaaagaaggttatgtttaaaaacaatttggaggaatcctgaaaaaggggaarttctttgcacgttatgatgctttgcttgcattctgtttctttcttcttttatttgttttttacaggatgtttctctctctctctctctcttttttttttt

SEQ ID NO: 34583 - DNA, 201 bp, Homo sapiens
tgtcagtattgattggggataacaaatgcaccacactaatgcacaatgttgataataggggaaactgcacattttgggtggggggatatgggagctctgtrctttctgctccatttttctctaaatgtaaaaccatcctaaaaagcaaggtcttaattattaaaaaatgtttcaagcaagccagaggatgagcttgtgaag

SEQ ID NO: 34584 - DNA, 201 bp, Homo sapiens
tcagggagctaggcttatgctgacatagttcatcaggtttaaaaagtgctggaattatttattggtcctttgttttggcaaagattctgttactccagccracaacattgtggtgaactgaggataaacccatagccctccttattttcagccaataatacgggaatcaataatacgggaatattccactacaagaatgca

SEQ ID NO: 34585 - DNA, 201 bp, Homo sapiens
ataaataatattgcttatgaaattatattgttaacttgaagaggaaattttaaagaaggttatgtttaaaaacaatttggaggaatcctgaaaaaggggamattctttgcacgttatgatgctttgcttgcattctgtttctttcttcttttatttgttttttacaggatgtttctctctctctctctctctttttttttt

SEQ ID NO: 34586 - DNA, 201 bp, Homo sapiens
agaggaacggacctccaaggatgtctgcatgcttcagggagctaggcttatgctgacatagttcatcaggtttaaaaagtgctggaattatttattggtcytttgttttggcaaagattctgttactccagccaacaacattgtggtgaactgaggataaacccatagccctccttattttcagccaataatacgggaatc

SEQ ID NO: 34587 - DNA, 201 bp, Homo sapiens
ccaaaaggtggaagcaacatacatgcccatcagttgatggacaccaaaaaatatattcatatactggaatattattcaaccataaaaaggaatgaagtacrgatacatgctgcaacatggatgaactctgaaaaccttaagtgaaggtagtcagtgacaaaggacagcatactgaatggttacaattatgtgaaatatcca

SEQ ID NO: 34588 - DNA, 201 bp, Homo sapiens
gactgactcaggaacctggtctaggctcaagttaactcggcaaccacaaccccagtgcggtgcctctttcctgtcagccaagagatccagaggaacggacstccaaggatgtctgcatgcttcagggagctaggcttatgctgacatagttcatcaggtttaaaaagtgctggaattatttattggtcctttgttttggca

SEQ ID NO: 34589 - DNA, 201 bp, Homo sapiens
tatattcatagtggcagtattcataatagccaaaaggtggaagcaacatacatgcccatcagttgatggacaccaaaaaatatattcatatactggaataytattcaaccataaaaaggaatgaagtacggatacatgctgcaacatggatgaactctgaaaaccttaagtgaaggtagtcagtgacaaaggacagcatac

SEQ ID NO: 34590 - DNA, 201 bp, Homo sapiens
ggtagatggaagaggaaagagagtgatgctgtgagacagtaaggaggccttttgaccaactagtgcctaacacagtgcctgcccatagtggtcatttaatraatggatgaatgaatgaatgaatgaatgatgcaaatgagagatgctgagtgcctagggttataaactagggcagtgactgcaggatggacaagttaattt

SEQ ID NO: 34591 - DNA, 201 bp, Homo sapiens
gaaaaaggggaaattctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcc

SEQ ID NO: 34592 - DNA, 201 bp, Homo sapiens
aaaaaggggaaattctttgcacgttatgatgctttgcttgcattctgtttctttcttcttttatttgttttttacaggatgtttctctctctctctctctytttttttttttttttcctcacagctgaacactttccaggcagttttggcatctgatgggtctgatagctacgccctctttctttatcctgccaacggcct

SEQ ID NO: 34593 - DNA, 201 bp, Homo sapiens; identical to SEQ ID NO: 7184

SEQ ID NO: 34594 - DNA, 201 bp, Homo sapiens
cctcagttgggatttctggcccagtcatgtaacaagatgatgaacttcactagtaaacacctccagctctttagatagagcctaaagtatttttcaaattrgaagagatggatttataattcactgatgcatgtcctacttgactggctaaagagctccttctgtaacaaattacctcttctatatttccagaaaatacta

SEQ ID NO: 34595 - DNA, 201 bp, Homo sapiens
atccaacagttcctgctggttttgctcagtacttgggcagtgagaaggatgttgaagcacgaaagcatgaactcgaaggatttttaacacattttccaaayaggttctttactagcttaatagagtgtaggattgcactgagattaagctacctctcattacctgagtgataaaggggctctacgacttcttgaacgtttt

SEQ ID NO: 34596 - DNA, 201 bp, Homo sapiens
tggagtctcgttctgtcatccaggctggagtgcagtggcatgacctcggttcactgcaacctctgcctcctgggttcaagcttttcttctgccttagcctccagagtagctgggattacaggcacacaccatcacacctggctattttttttgtatttatagtggggtttcaccatgttggccaggctggtcttgaactcc

SEQ ID NO: 34597 - DNA, 201 bp, Homo sapiens
gtctcaggaattcctgcttcctgtcattgcttggggttcctgttaccattagaagtacttttagcatgcgtattgtgaatagctttaatttcctgcattcrgctgaatgttaatttttacaggtttagttttacagccagttttacagcctattccaggtccaaggtattggatggtcaccagttttgcccagctgggcat

SEQ ID NO: 34598 - DNA, 201 bp, Homo sapiens
agtctcgttctgtcatccaggctggagtgcagtggcatgacctcggttcactgcaacctctgcctcctgggttcaagcttttcttctgccttagcctccagagtagctgggattacaggcacacaccatcacacctggctattttttttgtatttatagtggggtttcaccatgttggccaggctggtcttgaactcctaa

SEQ ID NO: 34599 - DNA, 201 bp, Homo sapiens
cttgcagatgaattgatatctgctttcttgcctttataggcgaaatgatggtatccagggaggccaaccactcacctgggtggagactctatgggttgcawtgagttcagaatttttgggggaggactcctaggaactgatatatgctgactaaactccccagagacagaagataagcagaatacttaccttctaattata

SEQ ID NO: 34600 - DNA, 201 bp, Homo sapiens
taaagtatttttcaaattggaagagatggatttataattcactgatgcatgtcctacttgactggctaaagagctccttctgtaacaaattacctcttctrtatttccagaaaatactacagacctaaaaatggatcaaaagaactatcccaattcatcccattgataaagatggatgagagtaaagaaaatgcactcttt

SEQ ID NO: 34601 - DNA, 201 bp, Homo sapiens
tgtcatgccagcagttgtaaaaggccacccccagggtcgtgatcactgccaccagcatcattacatgccacacacatcaaaattaaacaaacatgaaaactggacgaaaaagcattccactgtttgttataaagttggatatggtttttctaactagtctgtcattctgagagatgggaaaacttagaagaatttttcctg

SEQ ID NO: 34602 - DNA, 201 bp, Homo sapiens
ccaacatggcacatgtacacatatgtaacaaacctgcacgttgtaaacatgtaccctaaaacttaaagtataataataatagaattctgatggttaaaagmcaaaacaaaacaaaaaacacagtgccaaaacaattcaatggagaaagaatagtcttttaaactattgttaactatggtgctgggaccactgagtgaccac

SEQ ID NO: 34603 - DNA, 201 bp, Homo sapiens
gtcatgccagcagttgtaaaaggccacccccagggtcgtgatcactgccaccagcatcattacatgccacacacatcaaaattaaacaaacatgaaaactggacgaaaaagcattccactgtttgttataaagttggatatggtttttctaactagtctgtcattctgagagatgggaaaacttagaagaatttttcctgc

SEQ ID NO: 34604 - DNA, 201 bp, Homo sapiens
gggatcctgggggagctgggaaccagtgactcgtttgtcaggtttggcagcccatctgagggcttctctttggagacagagcctgtgcggctcttgcaaargcttgtatctaggaatgtgaggacctttcctgtttggaagccagtcaaggagttttttgagagggggagcccttcaagacttcatgaagtgggctcttta

SEQ ID NO: 34605 - DNA, 201 bp, Homo sapiens
ccactcaccctgatcctctctgtgctgctcctctccctgtggaggcccctctctcctctctgggatcctgggggagctgggaaccagtgactcgtttgtcrggtttggcagcccatctgagggcttctctttggagacagagcctgtgcggctcttgcaaaagcttgtatctaggaatgtgaggacctttcctgtttggaa

SEQ ID NO: 34606 - DNA, 201 bp, Homo sapiens
ggtgggtggatcacctgaggtcaggagttcaagaccagcctggccaacatggtgaaaccctgtctctacaaaataaaacatataaatatatatatatatatgtatatatatatacatatatatatacacaaaaaaatttagccaggtgtggtggcatgtgtctgtagtcccagctactcaggaggctgaaacaggagaact

SEQ ID NO: 34607 - DNA, 201 bp, Homo sapiens
tttaattgaaatgaatttgttggctggttgaatgaatgaatgaataaaataaagtgctaaatgcccagagttcacagcaaaaagtcagactctcctcttcwcagctctgtttactactctcttccccccttccccatccccttcaattcttcacagtctctacaacctccttatcttatggaatttctctaaatttagaac

SEQ ID NO: 34608 - DNA, 201 bp, Homo sapiens
aagagtcaccctaattcttcatttccattttcattttcattttgataagcctctataggcaagccccttgaagaaaaggatgtcactattctgatttttgkccagatagctgcagttaattaaatgaattgaaaaaattagaaactcttagaggggtgtatgttgcatgcatcagcctggctctgatgagtgtcacttcaa

SEQ ID NO: 34609 - DNA, 201 bp, Homo sapiens
aaattaaatacttgccacccataatgagtgctcatctcaagaacagtatatagaagatgttgaataaattttaattgaaatgaatttgttggctggttgamtgaatgaatgaataaaataaagtgctaaatgcccagagttcacagcaaaaagtcagactctcctcttcacagctctgtttactactctcttccccccttc

SEQ ID NO: 34610 - DNA, 201 bp, Homo sapiens
caacacctccaggcctctgcccaaatgtctttttctcccgaggtcttccctgaccatactatttcaaagagccaggtgcgcctgccctctctcaccctctkgtctgaccctgccatattcctctgcacttcagtgattctgatgccccctcaatttgatgggatttagagccagaagattgtttcatctctgtaggcctca

SEQ ID NO: 34611 - DNA, 201 bp, Homo sapiens
gtgggtggatcacctgaggtcaggagttcaagaccagcctggccaacatggtgaaaccctgtctctacaaaataaaacatataaatatatatatatatatgtatatatatatacatatatatatacacaaaaaaatttagccaggtgtggtggcatgtgtctgtagtcccagctactcaggaggctgaaacaggagaactg

SEQ ID NO: 34612 - DNA, 201 bp, Homo sapiens
ggcttctctttggagacagagcctgtgcggctcttgcaaaagcttgtatctaggaatgtgaggacctttcctgtttggaagccagtcaaggagttttttgrgagggggagcccttcaagacttcatgaagtgggctctttagcaattagatgtagaattttgtagaactgaccaagaactttacaagtgatcatttagtgt

SEQ ID NO: 34613 - DNA, 201 bp, Homo sapiens
tctaaggtgggccctcagaatttgcatttttaacagaaatctcaggtgatcctgatgcagtggtctctggaatccaccgggagaaatgcagctctccgtgygaaggactgcatggtgctgtgctgagggtgtaagttgttattcaccccttggtgaatttccttgatgcctcatgctgttgtcagaactgaaccccacaaa

SEQ ID NO: 34614 - DNA, 201 bp, Homo sapiens
cctgaggtcaggagttcaagaccagcctggccaacatggtgaaaccctgtctctacaaaataaaacatataaatatatatatatatatgtatatatatatacatatatatatacacaaaaaaatttagccaggtgtggtggcatgtgtctgtagtcccagctactcaggaggctgaaacaggagaactgattgaacccagg

SEQ ID NO: 34615 - DNA, 201 bp, Homo sapiens
tgtcccctctgaaaatcatgttgaaacttaatcctcaatgtgacagtattgagaggtggggcctttgaaaggtgactgggtcatgagggctctgccctcakgaatggattaatttattcattcatggattactggattatcatggagtgggcctggttgctttataagaagaggaattgagacctgagctagcacattagc

SEQ ID NO: 34616 - DNA, 201 bp, Homo sapiens
cccaggttagcttaacagtaactagttagcccattgtaattacagtttaagtctcataatagcctttcatgggagcctgctcattgttataacttcttttyctgtaatagaaaaatgtagtacagcttccaatctatttataaacctttgcacagttgcacttgtaagttgctggctgcatcgccctgcctctttttactt

SEQ ID NO: 34617 - DNA, 201 bp, Homo sapiens
tgggacttgagttcttgttttaatagttctttggagatagactttggcaaacagtaatctaatttgcttgaaggactgagttctacatggcgttcttaaaktttggcttactaactttatattgcaaagttactggaaactggaagattcaaagcaatggcatctttgccattaaaaacaattgcagttggtgcccttttt

SEQ ID NO: 34618 - DNA, 201 bp, Homo sapiens
ctaaaacactattagaactaaagaacaagttcgcaatgttataagatatgcaagatcagtacaccaaattgtatttctctatagtagcaatgagcaaactraagattaagaaattgtttcaaaaagagataaatttttaaaaagaagtgcagtacttgtacattgcatcccacaaaacatttttggaaaaaaatttaagac

SEQ ID NO: 34619 - DNA, 201 bp, Homo sapiens
tgaggaagtagcatttccctctctgtgttccttgagacacatttggctgaagaagtcagagtcttaccttctccacggggtcttaaaaagagctttgtctyccatgggtcatgagctacagtgacaacttaacggcattcgcttcccccaattctggtgagtcgtgcagttgagctagagctagttgggtttgagctctga

SEQ ID NO: 34620 - DNA, 201 bp, Homo sapiens
cctgctctatactcagggccagcagattggctacttacccctcaatggcaccaggcttcagaaggatgcagctaagaccctgctgtctctgcatgtaaagyggatttctcctgtagggggcagggctgcgtggctttcccagtgggagccacctcacaggccctgttgcagtgaggtggactggtgcagggaagtcctgga

SEQ ID NO: 34621 - DNA, 201 bp, Homo sapiens
taataggacaggtaattttacagttgctaatctatgactgtaatggaagtaaaatatcctatttccccattctatcactgtgtcactatcactatgtcacyatcatttttggcaaagcagctgaaggacctcattttccccctttgttttaaaaggaaccaaaaaactggagtgtacactacctgatggaactggacggcg

SEQ ID NO: 34622 - DNA, 201 bp, Homo sapiens
cagggtctcactctgccacacaggctggggtgcagtggttgcaaccaaagcccactgtaacctggaactgctgggctcaagtgaccctcctgcctcagccwactgagtagctagaagcacaggcatgtggcaccatgcctggctaagttttttagaaaagggttttgtagaggcagggtctcactatgttgcctagactgg

SEQ ID NO: 34623 - DNA, 201 bp, Homo sapiens
ctgaggtcaggagttcaagaccagcctggccaacatggtgaaaccctgtctctacaaaataaaacatataaatatatatatatatatgtatatatatatacatatatatatacacaaaaaaatttagccaggtgtggtggcatgtgtctgtagtcccagctactcaggaggctgaaacaggagaactgattgaacccagga

SEQ ID NO: 34624 - DNA, 201 bp, Homo sapiens
aggcggaggttgcagtgagccaagattgtgccatcgcattccagcctgtgcaacagagtgagactccgtctcaaaaaataaaaataaatggaagcaaatastagtagaaacaaaactctaaaaccattctcatcgggtacaatggcttacacctgtaatcccagctactctggaggctgaggtgggaggatcacctgagcc

SEQ ID NO: 34625 - DNA, 201 bp, Homo sapiens
agtaagggcttccttctatggaattagacctgaatctaaaataccatactctaggggctgaaaccatatgattcatctcaattttaacttacggaaatgcytcttcactatagaaggatggtacatgccccctgtaagaggtgaggttgcttgcccatgtcactgatctctatcttgtaaggatgctgtgacttatatctt

SEQ ID NO: 34626 - DNA, 201 bp, Homo sapiens
atccagactccctggccagtggggaaggagagagaggctttttgcctaagtcagttcccttccctccctgcgcgaaagggtagcgtccttgggcttgagcractgtcacctttttgtccctctcctctcccaggtgggcaccaacggcatcatctccactcaggacttccccagggaaacgcagtatgtggactatgattt

SEQ ID NO: 34627 - DNA, 201 bp, Homo sapiens
gggagcaggtaggcgcttacgaggaggtcaagcgcggggcgctgccctcgggagaggtaagtgaccagggatatttgactgctgaggaaattgaaggatgrgcttaaattctggggcagcgacccagggactggctcggagttgtttctgagcctactcttgcgctgaacctgaccttggaggcagcagggctggagtggc

SEQ ID NO: 34628 - DNA, 201 bp, Homo sapiens; identical to SEQ ID NO: 7204

SEQ ID NO: 34629 - DNA, 201 bp, Homo sapiens
tacgtaagttcagccccctcctggcacttttcccgcagcttcttccctggggtcggtctcacggaaaccctgcctccagaggggaggaaacagaccccackcctggagccccccagcacccttgcggtggtacccggccagagagcgatgccgctgcctgccccgctgctgtaggggagcaagaatgacctggaggggaga

SEQ ID NO: 34630 - DNA, 201 bp, Homo sapiens
cttctacgaagcccgattcagcaacctctacgtaagttcagccccctcctggcacttttcccgcagcttcttccctggggtcggtctcacggaaaccctgyctccagaggggaggaaacagaccccacgcctggagccccccagcacccttgcggtggtacccggccagagagcgatgccgctgcctgccccgctgctgta

SEQ ID NO: 34631 - DNA, 201 bp, Homo sapiens
agcctttcatgggagcctgctcattgttataacttctttttctgtaatagaaaaatgtagtacagcttccaatctatttataaacctttgcacagttgcamttgtaagttgctggctgcatcgccctgcctctttttacttagataaaagctatgactccacctagtttaactctccatatctagactgtctctcctccat

SEQ ID NO: 34632 - DNA, 201 bp, Homo sapiens
aaacgtgtttagaatgggaaagggcctgctggggaacatgaaccttaaaaggcagactttcccctgctcctggtgttgctgtgtgcatctgcctccatccrcccaggcccaccgagctgatgtgctaagaacagctttgcaattcctgggagctttataccagatccgaatagcacgggcctccctcctcctcaccagatg

SEQ ID NO: 34633 - DNA, 201 bp, Homo sapiens
tatggtaaaatcagtgtggttataggaggaggcaaggatgaagcttgaaaggaagtagtttattacacttacaggtctggagtgggttcaccacatgccayacaggggtacaatcagcagggtgcccaattgaacagattgtgcagtagagagagagtgggacctgtgggttgaatcctttattgggatctgggatgggtt

SEQ ID NO: 34634 - DNA, 201 bp, Homo sapiens
accttgggtagggtctgagaacctgcattccctggtctgttgctgttggtctgtggatcatgccatgaggagtgaggctcatcctttgcaggcctaaactstggatgcccttatcttcttctcttttcagtgatcaccccacctgccaacccctgtgaggatggcagtcatacctgtgctcctgctgggcaggcccggtgt

SEQ ID NO: 34635 - DNA, 201 bp, Homo sapiens
atacattttagtttccctttgaagctttagggtagtcatcttgctaaaccaagaaattaagatttagttaaaggcccagaaaatatcactcctttttacatttttttccccttagggactcattttacagacctttctttttgttcagaaatttagattttcagatcatatctacaccaggcaggaatgtcctggccacac

SEQ ID NO: 34636 - DNA, 201 bp, Homo sapiens
ttgagcccaagagttccaggctacagtgagccatgattgtaccactgcatagcctgagcaacagagagaaatattgtctgaaaaaaaaagttgtcctgtagggtaggtacaatcatccttcccattttacagagatggaaactgagcttggaaatacttagtgacttgtctagcaagggcaaagactgcaacaaagtcatg

SEQ ID NO: 34637 - DNA, 201 bp, Homo sapiens
agatttaaacctactggggagaatggtctttacctttaaatgtccaggtcagccctgtgttgggtgtaggcatctgatctgtaaaagcaactgttagtgaaataatttcccaggctatggagtcccattcagattctggaaccatttaggaaaaagatgtgtctctgggtatatttttcccagagacataccaaatgagag

SEQ ID NO: 34638 - DNA, 201 bp, Homo sapiens
tccactgtttgttataaagttggatatggtttttctaactagtctgtcattctgagagatgggaaaacttagaagaatttttcctgcggtgaaaatgactttttttttttttgaggtagcagtaaaaattgttagtagttgctccagctgtcctgaagcagccctgtgcacgaagcctcctgtgtccctctgtgttggccc

SEQ ID NO: 34639 - DNA, 201 bp, Homo sapiens
ttttagtcgagacagggtttcgccattttggtctccaactcctgaccctgggtgatccacctgccttggcctcccaaagtgctgggattataggtatgagrcactgcgcccggccccttattccttcttggtgcttgacctgaaaactggggagagctgccatcttgtaggcaatgaaactttggccatgtctctggagtc

SEQ ID NO: 34640 - DNA, 201 bp, Homo sapiens
gatttaaacctactggggagaatggtctttacctttaaatgtccaggtcagccctgtgttgggtgtaggcatctgatctgtaaaagcaactgttagtgaaataatttcccaggctatggagtcccattcagattctggaaccatttaggaaaaagatgtgtctctgggtatatttttcccagagacataccaaatgagagt

SEQ ID NO: 34641 - DNA, 201 bp, Homo sapiens
tgttagtagttgctccagctgtcctgaagcagccctgtgcacgaagcctcctgtgtccctctgtgttggcccagtgaacccagtcgacaccatggaacctcccctgtgtctggcccagggccttctgtgaagaagggcaggccggccaagggctgcagacaggtgcttaagtgtttctgggaaaatgaagattgaaagatg

SEQ ID NO: 34642 - DNA, 201 bp, Homo sapiens
gaatggtcattttcctaaagacccatgcataaatcaggctaggctaatcatgaaagtaacttgaagaataaatattgaaatatatgtgtatgtgtgcatawttaaaggcattccatagggtacatgtgtctcagtgaccaaagaacagaggctgtattttgtgggtgctatgcattgttaaagcacatgctcttttactcc

SEQ ID NO: 34643 - DNA, 201 bp, Homo sapiens
atttaaacctactggggagaatggtctttacctttaaatgtccaggtcagccctgtgttgggtgtaggcatctgatctgtaaaagcaactgttagtgaaataatttcccaggctatggagtcccattcagattctggaaccatttaggaaaaagatgtgtctctgggtatatttttcccagagacataccaaatgagagta

SEQ ID NO: 34644 - DNA, 201 bp, Homo sapiens
aggctaatcatgaaagtaacttgaagaataaatattgaaatatatgtgtatgtgtgcatatttaaaggcattccatagggtacatgtgtctcagtgaccamagaacagaggctgtattttgtgggtgctatgcattgttaaagcacatgctcttttactccatcaaactaacaataagggggtgtgggagtttttctccag

SEQ ID NO: 34645 - DNA, 201 bp, Homo sapiens
tgggtgctatgcattgttaaagcacatgctcttttactccatcaaactaacaataagggggtgtgggagtttttctccagccatagtttgttaaaaaaacyggctccctggagaggctgcacttggatttgggttctcagtctggtctgagtcactagccaggaggcttttatccaagtagagttaaatcctctgcagctt

SEQ ID NO: 34646 - DNA, 201 bp, Homo sapiens; identical to SEQ ID NO: 7206

SEQ ID NO: 34647 - DNA, 201 bp, Homo sapiens
ttttagaaatgtattttaaaaatgttttgggaagccaagttcagtgaatggggccctgtgctcagaagagccccatgcttggtttaacgctttgctttgamccatgggctccacattttcattttgcactggggattgcaaattatggaactaatcctgtcagtgacatacattttaaatcagtattgagtaattagggac

SEQ ID NO: 34648 - DNA, 201 bp, Homo sapiens
ctttcccctcttggtacacagcagtatcttcctaagaactgctcagtttttccagagggaactatcatcttgttggaattcatgtgaaacagcgcagctgyccacacctgatgtgggtgtggtgcgacttcccagggcgaggatgcagaactggggtgtctttcccagtgagtaattggagcctctgtccctcggtgactt

SEQ ID NO: 34649 - DNA, 201 bp, Homo sapiens
agacctatagcagattgcctttttacttggtgttcagaagtacattaagaagaaatgcgacttctggcaatgcaggggtgaggaagaggtgttctacttawtttagagatgaggaagctgaaagacacagtttgcacagtttccacaaagcccccgagggagggctgaggttgagtcctagagcttggcgctttctgcagc

SEQ ID NO: 34650 - DNA, 201 bp, Homo sapiens
gtttccacaaagcccccgagggagggctgaggttgagtcctagagcttggcgctttctgcagcccctcattccttgagctctgggagaaagtcctgatggsccttaagccatgagcacactggtgagtgtgtgagtccctcctgtagctgcttccttacacttagttgtgaatttctgagctggagaaacctgagattttg

SEQ ID NO: 34651 - DNA, 201 bp, Homo sapiens
tctaaatgtttttttccctttcttaaactaatagacagtgatacagttttcttcacagccatctattttaccatgatccatcctgggtttttttttttttwtttttctgccttgagttttatatcacttttctgtttaagttaagcttgtcactttcttgtttaaataaagttgagtcatgcctaattttctatttttatc

SEQ ID NO: 34652 - DNA, 201 bp, Homo sapiens
gttggttaggaaatcattaaagtgacttgctaaagagtgagttttggaagttgtcagtggaataattatacctgggtacacccatctctagccaggatgaygtccaagcctaactggatttgctgtcttttaggggcacctcaccgagtgaatgggaaagtgagtggccacctccacgtgggccatacacccgtgcacttc

SEQ ID NO: 34653 - DNA, 201 bp, Homo sapiens
agtagttgctccagctgtcctgaagcagccctgtgcacgaagcctcctgtgtccctctgtgttggcccagtgaacccagtcgacaccatggaacctcccctgtgtctggcccagggccttctgtgaagaagggcaggccggccaagggctgcagacaggtgcttaagtgtttctgggaaaatgaagattgaaagatggctc

SEQ ID NO: 34654 - DNA, 201 bp, Homo sapiens
acctgcattccctggtctgttgctgttggtctgtggatcatgccatgaggagtgaggctcatcctttgcaggcctaaactctggatgcccttatcttcttytcttttcagtgatcaccccacctgccaacccctgtgaggatggcagtcatacctgtgctcctgctgggcaggcccggtgtgttcaccatggaggcagcac

SEQ ID NO: 34655 - DNA, 201 bp, Homo sapiens
gagggagggctgaggttgagtcctagagcttggcgctttctgcagcccctcattccttgagctctgggagaaagtcctgatggcccttaagccatgagcayactggtgagtgtgtgagtccctcctgtagctgcttccttacacttagttgtgaatttctgagctggagaaacctgagattttgacacatccaagttacat

SEQ ID NO: 34656 - DNA, 201 bp, Homo sapiens
catttccttttactctaaatgtttttttccctttcttaaactaatagacagtgatacagttttcttcacagccatctattttaccatgatccatcctgggtttttttttttttatttttctgccttgagttttatatcacttttctgtttaagttaagcttgtcactttcttgtttaaataaagttgagtcatgcctaatt

SEQ ID NO: 34657 - DNA, 201 bp, Homo sapiens
ctttgactctaacagccttgtggctgccaaaatagtgagaaaaaagcgtcctttgagttagaaaggggagccaagggtgatttcctctggactagatgggsgagcatatatggcttccttggcggagacgttcctgtagcactcgggagcttctaaccttggttccttggagccagcgcaggctggaggaatttagggaaa

SEQ ID NO: 34658 - DNA, 201 bp, Homo sapiens
ggctaagcattagtatttataaatcaaaacatgttgacaattacttcctgctttggtggggtatgccaggcattttgtacagaatcttcctaaaatggagaaatgatggggatgatcacgttcttgtcttacattgggtcctaatggatgaggacatgaccttgtccttagttataacctattgaggactgactcaggaac

SEQ ID NO: 34659 - DNA, 201 bp, Homo sapiens
gctaagcattagtatttataaatcaaaacatgttgacaattacttcctgctttggtggggtatgccaggcattttgtacagaatcttcctaaaatggagaaatgatggggatgatcacgttcttgtcttacattgggtcctaatggatgaggacatgaccttgtccttagttataacctattgaggactgactcaggaacc

SEQ ID NO: 34660 - DNA, 201 bp, Homo sapiens
taagcattagtatttataaatcaaaacatgttgacaattacttcctgctttggtggggtatgccaggcattttgtacagaatcttcctaaaatggagaaatgatggggatgatcacgttcttgtcttacattgggtcctaatggatgaggacatgaccttgtccttagttataacctattgaggactgactcaggaacctg

SEQ ID NO: 34661 - DNA, 201 bp, Homo sapiens
ttttgcatagcgttgtgatttttctcttaagtgggtaggtgaaaagtttagcaaaaagaagattggatctaatttttaatccctgtgtttcaagagatagwgtaaatttcctttgccaaataaatcttggcaggcagattctgttcggaatctcttgatcattaataatgtttttttaaaatatgggcctcatgaagtgag

SEQ ID NO: 34662 - DNA, 201 bp, Homo sapiens
aagcattagtatttataaatcaaaacatgttgacaattacttcctgctttggtggggtatgccaggcattttgtacagaatcttcctaaaatggagaaatgatggggatgatcacgttcttgtcttacattgggtcctaatggatgaggacatgaccttgtccttagttataacctattgaggactgactcaggaacctgg

SEQ ID NO: 34663 - DNA, 201 bp, Homo sapiens
tggatgaggacatgaccttgtccttagttataacctattgaggactgactcaggaacctggtctaggctcaagttaactcggcaaccacaaccccagtgcrgtgcctctttcctgtcagccaagagatccagaggaacggacctccaaggatgtctgcatgcttcagggagctaggcttatgctgacatagttcatcaggt

SEQ ID NO: 34664 - DNA, 201 bp, Homo sapiens
gtccttagttataacctattgaggactgactcaggaacctggtctaggctcaagttaactcggcaaccacaaccccagtgcggtgcctctttcctgtcagycaagagatccagaggaacggacctccaaggatgtctgcatgcttcagggagctaggcttatgctgacatagttcatcaggtttaaaaagtgctggaatta

SEQ ID NO: 34665 - DNA, 201 bp, Homo sapiens
tccttagttataacctattgaggactgactcaggaacctggtctaggctcaagttaactcggcaaccacaaccccagtgcggtgcctctttcctgtcagcsaagagatccagaggaacggacctccaaggatgtctgcatgcttcagggagctaggcttatgctgacatagttcatcaggtttaaaaagtgctggaattat

SEQ ID NO: 34666 - DNA, 201 bp, Homo sapiens
gagtctcgttctgtcatccaggctggagtgcagtggcatgacctcggttcactgcaacctctgcctcctgggttcaagcttttcttctgccttagcctccmgagtagctgggattacaggcacacaccatcacacctggctattttttttgtatttatagtggggtttcaccatgttggccaggctggtcttgaactccta

SEQ ID NO: 34667 - DNA, 201 bp, Homo sapiens
caaaaccctgtctcaacaacagcaacaaaaaaagtccctgctacctagggttgttgtgcaaattaagagttgttggccgggcggggtggctcacgcctgtwatcccagcactttgggaggccgaggcaggtggatcacgaggtcaggagatcaggaccatcctggctaacatggtgaaaccctgtctctactaaaaaatac

SEQ ID NO: 34668 - DNA, 201 bp, Homo sapiens
catttcttacctgtgctgtttttcaacatgctgtaatagtcatctcgataatcttccctgcttgcttctaccattaaacccagtttataaagtatgactcraattatacttgaagtctgtgctgattaaccccagacatgtgatgacccctaatctagtgctcatgatctccgtacttggatcccattgaaggggtcgtgg

SEQ ID NO: 34669 - DNA, 201 bp, Homo sapiens
gtccctggccagagtggtggctcatacctgtaatcccagcattttgggaggcctaggtgggaagatcacttgagcccaggagttcgagaccgagaccaacytgggcaacgcagggagacccctccccccaacccaccctaccaaaaaataaagtaggcaggtgtgatgcatgcttgtggctgcggctactcaaaaggctga

SEQ ID NO: 34670 - DNA, 201 bp, Homo sapiens
ttggaagtcgtcacttctgtgaaatgtagaagatggattggtttaaaatttagggtgtagagtcaaaccaatgtgagtttcagttccagctctaccatgtrgcagcattgcatcttaggctacttaacctttgtgagcctctgatcacatgatttagtgcccacctcaccaggctgttgtgaggaataaatgaggcagtat

SEQ ID NO: 34671 - DNA, 201 bp, Homo sapiens
agagcatagggcgttaatagctaaagggtacagggttaattttgggggtgatgaaaatgttctgaaattgattgtggtgacggttggataacactgaatakactaaattgtttaattatgtactttaaacggatgaattgtatggtatgtgaattacttctcaactgaaggccaggcatactggcttatgcctgtaatccc

SEQ ID NO: 34672 - DNA, 201 bp, Homo sapiens
gttttatataccagtgaaaactgaacctgatcttaatagcctttcaggttttttgtttttttgagacagggtctcactctgccacacaggctggggtgcaktggttgcaaccaaagcccactgtaacctggaactgctgggctcaagtgaccctcctgcctcagcctactgagtagctagaagcacaggcatgtggcacca

SEQ ID NO: 34673 - DNA, 201 bp, Homo sapiens
acatggacaattgtagtgccttctccctctcagcactgtggctttgcatccactcaggtttttgggatttccttacacattttttcatataaactcaggargttcccaagggaacacactccaagaattagatgaaaaactctgcagaaaaatccacctcacatgaaaatctctgtatttaatatttttaaaaaattacca

SEQ ID NO: 34674 - DNA, 201 bp, Homo sapiens
ggctttgcatccactcaggtttttgggatttccttacacattttttcatataaactcaggaagttcccaagggaacacactccaagaattagatgaaaaamtctgcagaaaaatccacctcacatgaaaatctctgtatttaatatttttaaaaaattaccactgtgtttgttgcagctgtgacctctacaagttccagag

SEQ ID NO: 34675 - DNA, 201 bp, Homo sapiens
gctttgcatccactcaggtttttgggatttccttacacattttttcatataaactcaggaagttcccaagggaacacactccaagaattagatgaaaaacwctgcagaaaaatccacctcacatgaaaatctctgtatttaatatttttaaaaaattaccactgtgtttgttgcagctgtgacctctacaagttccagaga

SEQ ID NO: 34676 - DNA, 201 bp, Homo sapiens
aatagagcaaaagcacttttaaacagatgttttgggcgtttttattccctggatgcaaacctactgaaagcaagtaaaggtactagttgtctatagggtaggcaataggaagccatgctggagtttaaaactgaagtgcagaaaatccaccctagcttcagatatggataatttagtaaggtcttccggtgtgtcacaaaa

SEQ ID NO: 34677 - DNA, 201 bp, Homo sapiens
tttcttaagaagacagtttacatcaaaataacccaaagctggctggatgtggtggctcacgcctgtaatcatcgctttggaaggctgaggcaggtggatckcttgagttcagaagttcgagaccagcctgggcaacatagcaaaaccccgtctctacaaacaatacaaaacattagccaggtgtggtggcacacgcctgta

SEQ ID NO: 34678 - DNA, 201 bp, Homo sapiens
agagagagcccctaaggcagaaaccagttttttgagaccgaatatcggcagtgatagcctatcacttctgctatactctatgcactagaagaagcaagacactactaatgcagcccaaactcaaggggattgcttaaggctataatacatgaggagatggagatcactgggggctgcttagatgctgcctaccacaggcta

SEQ ID NO: 34679 - DNA, 201 bp, Homo sapiens
gagagagcccctaaggcagaaaccagttttttgagaccgaatatcggcagtgatagcctatcacttctgctatactctatgcactagaagaagcaagacactactaatgcagcccaaactcaaggggattgcttaaggctataatacatgaggagatggagatcactgggggctgcttagatgctgcctaccacaggctac

SEQ ID NO: 34680 - DNA, 201 bp, Homo sapiens
agagagcccctaaggcagaaaccagttttttgagaccgaatatcggcagtgatagcctatcacttctgctatactctatgcactagaagaagcaagacactactaatgcagcccaaactcaaggggattgcttaaggctataatacatgaggagatggagatcactgggggctgcttagatgctgcctaccacaggctaca

SEQ ID NO: 34681 - DNA, 201 bp, Homo sapiens
atccagccctacccagatggagggccagtgccttcggaaatggatgttcccccagctcatcctgaagaagaaattgttcttcgaagttaccctgcttcagrtcacactacacccttaagtcgagggacgtatgaggtgggactggaagacaacataggttccaacaccgagggtgagtgcattagaaaactgggtgctaag

SEQ ID NO: 34682 - DNA, 201 bp, Homo sapiens
aaacagccaaactcttttggcgtgtactttgggatcataaattctacttaaaaggaagttgtttccttcctctgatatttgcctattttggtggagacaargaaattaaatacttgccacccataatgagtgctcatctcaagaacagtatatagaagatgttgaataaattttaattgaaatgaatttgttggctggttg

SEQ ID NO: 34683 - DNA, 201 bp, Homo sapiens
gagtgctcatctcaagaacagtatatagaagatgttgaataaattttaattgaaatgaatttgttggctggttgaatgaatgaatgaataaaataaagtgstaaatgcccagagttcacagcaaaaagtcagactctcctcttcacagctctgtttactactctcttccccccttccccatccccttcaattcttcacagt

SEQ ID NO: 34684 - DNA, 201 bp, Homo sapiens
tcagccacatcccacagccagcagcccaggccctcctccccctcacaccaattggaggcctgtttggctggctctttgctttagaaaaacctggctctgakaacggcttcagcctcgcaggtgagtagggcctctgagaaggccggtagtcagcattgctttggcagtggtgctccttggggcactgtctttaggccttta

SEQ ID NO: 34685 - DNA, 201 bp, Homo sapiens
gatagacatgaggcagaacagcctttgtttatatttggcagtagttgtggcttcctagtattgagaagctctaaaaacatttcttgctttttgtttttggraaagtcaagctttgctgatgaacaatcaacaactggaacaataacaaataaactaggcacctgttactttgtgaattgaatgaatgaaaaaagcaaagca

SEQ ID NO: 34686 - DNA, 201 bp, Homo sapiens
aagtgtgttacatctatatttctttatcctattagcaaaacctcaaaaccttactttgaaattaaacattgaaaggaaaaattaacattagaaaagagctrgaacaactgtgggagtagacttagaacaaagggaagagcccattccttccttgctgtttccttcagtgaaatgtgatgttcttctctgtgcccgagtttg

SEQ ID NO: 34687 - DNA, 201 bp, Homo sapiens
aaatacaaaaaattagtcaggcgtggtggtgggtgcctgtagtcccagctactcaggaggctgaggcaagagaatggcgtgaacctgggaggtggagcttkcagtgagctgtgatcgtgccactgcactccagcctgggcgacagagcgagactccgtttcaaaaaaaaaaaaaaaaaaaggttgttaaatgtaaagcttg

SEQ ID NO: 34688 - DNA, 201 bp, Homo sapiens
tctttgcacagctcttacacatccaccccactaagtaatttacttgtttattgactgctgctggggagaatgtaagcttcaggatgtgaatttttgtctcytttgctccctgccatgtcctcagtttctagactaggtacaggtctatagtgaatgctcagtaaatacttgttgaattagtgaatgaatgaacaaaaattg

SEQ ID NO: 34689 - DNA, 201 bp, Homo sapiens
gaagtacattaagaagaaatgcgacttctggcaatgcaggggtgaggaagaggtgttctacttattttagagatgaggaagctgaaagacacagtttgcayagtttccacaaagcccccgagggagggctgaggttgagtcctagagcttggcgctttctgcagcccctcattccttgagctctgggagaaagtcctgatg

SEQ ID NO: 34690 - DNA, 201 bp, Homo sapiens
gcatagggcgttaatagctaaagggtacagggttaattttgggggtgatgaaaatgttctgaaattgattgtggtgacggttggataacactgaatatackaaattgtttaattatgtactttaaacggatgaattgtatggtatgtgaattacttctcaactgaaggccaggcatactggcttatgcctgtaatcccagc

SEQ ID NO: 34691 - DNA, 201 bp, Homo sapiens
cagcctgtgcaacagagtgagactccgtctcaaaaaataaaaataaatggaagcaaatagtagtagaaacaaaactctaaaaccattctcatcgggtacartggcttacacctgtaatcccagctactctggaggctgaggtgggaggatcacctgagcccaggagtttgaggccagagttggccacataacaagaccccg

SEQ ID NO: 34692 - DNA, 201 bp, Homo sapiens
catcattcccgggcttattgcaccctttacctgaacaatatggggtttctaaaaccaaaaaaaaaaaaaaaaaaaaaaaaagaggggatggctgttgggaraggttccaatagtgtctgccacaccaaccctctctctacttaaaaatgtcacagcagaattgcatctgcagtgattcatatcaaaagcttgaacagtctt

SEQ ID NO: 34693 - DNA, 201 bp, Homo sapiens
tcaattcagccactgtattgaaactgttgagcccagagttagctcctcagtgaggtgaatctgtaagtgatacgcggttctgtgctttgttattggagctragggctccttaagcctcagcaggctcaataaagaagtgttgcttcagcaatatgacaagattaaggtacaaggactagactcttttctaggatgcgaaag

SEQ ID NO: 34694 - DNA, 201 bp, Homo sapiens
aaatgtacaattaagttattattgactataataacctgttatcacaggttatagtcaccctgttgtgctatcaaatggtaggtcttattcattccttctatttttttttttttggtacccgttaactgtgtccaccttcccctgacccctactacccttcccagcctctggtaaccatcctgttactctctatgttgcata

SEQ ID NO: 34695 - DNA, 201 bp, Homo sapiens
tacttttcaagcaatgctgtgatgtaccctgaggatccaatccaagaagggtaaaaactgctacagacgtcctctataacctccagcctgaaaggggcctytgcctcttcagccagtctggcaggtcatggaaattctactcttgcaaagagagctgtggatacaagcaaagtatttcttcagtatttactttgactggtg

SEQ ID NO: 34696 - DNA, 201 bp, Homo sapiens
atctgtcttcccatgctgatgtgtctctaccatgggctgcaccgtattgatgcaacacattctcattttctaggtttcacactgatcacaccatcccacattttttttttttctattcacacattttaaagaaacttggttattactatggatggaactactgctttgttttattttcagccaagccttaatcggacctac

SEQ ID NO: 34697 - DNA, 201 bp, Homo sapiens
tgcctggctaagttttttagaaaagggttttgtagaggcagggtctcactatgttgcctagactggtctcaaactcctgggcttaagtcatcctcctactwtggccttgcaaagtgctgggattataagtgtgagccaccatgcccagctgtctttccgttttaaaataagttgttcaccttctaggaaggtgggtgaatg

SEQ ID NO: 34698 - DNA, 201 bp, Homo sapiens
tgaactcctggcttcaaactatcctcctacctcagcctcccaaagtgctgggattacaggcatgagccaccatgctcagccaaaatagatttctctagggragatttcagtcgttaagtaatcgctacctagtgagtagatggatccttggtaaggctactcctgaagagtaaatactgggaaagtcattcctgtttagtc

SEQ ID NO: 34699 - DNA, 201 bp, Homo sapiens
aagtgctgatgacattgggaaaagattcagtttttacccagtaaaatattaaaaacttattttgcttaaggccatgtcctctaattactgaaggggctgatttttttttttttttaaatcatcagtcataatagcacctattgaagggcttactgtatgccaattactgattaggacactttacaagcacttatagtatta

SEQ ID NO: 34700 - DNA, 201 bp, Homo sapiens
tgagataggaggattgcttgagcgcaggaggcagaggttgcagtgaactgacagcatgctagtgcattccagcctaggtaatagagtgagactctgtctcaaaaaaaaaaaacaaaaaaaacaacaaaatctctcaaagctatggctcagtttcagccctgtttattttcactgtttttccctaaatagatatttttggtg

SEQ ID NO: 34701 - DNA, 201 bp, Homo sapiens
atttagagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggcca

SEQ ID NO: 34702 - DNA, 201 bp, Homo sapiens
ttagagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggccagt

SEQ ID NO: 34703 - DNA, 201 bp, Homo sapiens
cttcaaactatcctcctacctcagcctcccaaagtgctgggattacaggcatgagccaccatgctcagccaaaatagatttctctaggggagatttcagtygttaagtaatcgctacctagtgagtagatggatccttggtaaggctactcctgaagagtaaatactgggaaagtcattcctgtttagtcttagaaatctt

SEQ ID NO: 34704 - DNA, 201 bp, Homo sapiens
tagagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggccagtt

SEQ ID NO: 34705 - DNA, 201 bp, Homo sapiens
gagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggccagttta

SEQ ID NO: 34706 - DNA, 201 bp, Homo sapiens
tccacaaagcccccgagggagggctgaggttgagtcctagagcttggcgctttctgcagcccctcattccttgagctctgggagaaagtcctgatggcccytaagccatgagcacactggtgagtgtgtgagtccctcctgtagctgcttccttacacttagttgtgaatttctgagctggagaaacctgagattttgaca

SEQ ID NO: 34707 - DNA, 201 bp, Homo sapiens
tggcgacagagtgagactccatctcaaaaaaaaaaaaaaaagaaagaaaatgcactctttaattcagtgggatgagggtaaaagtgataggagaaactgcktgtgtgtgtgtgtgtgtgtgtgtgtgtgtgtgtgtagcaattgctctggagtgttataaactttaattgaggactgcttaggtgatgggtttttgtgctt

SEQ ID NO: 34708 - DNA, 201 bp, Homo sapiens
tcagtgagccgagatggcaccactgctctccagcttgggtgacagagcaaaaccctgtctcaacaacagcaacaaaaaaagtccctgctacctagggttgytgtgcaaattaagagttgttggccgggcggggtggctcacgcctgtaatcccagcactttgggaggccgaggcaggtggatcacgaggtcaggagatcag

SEQ ID NO: 34709 - DNA, 201 bp, Homo sapiens
caaaaaaaaaaaaaaaagaaagaaaatgcactctttaattcagtgggatgagggtaaaagtgataggagaaactgcgtgtgtgtgtgtgtgtgtgtgtgtgtgtgtgtgtgtagcaattgctctggagtgttataaactttaattgaggactgcttaggtgatgggtttttgtgcttagtattttaacagcaaattcatac

SEQ ID NO: 34710 - DNA, 201 bp, Homo sapiens
gatggttagacataagacatttgttagcttctctattatgtcttcctctcaggatgtgtttaggttgaaccatataaaagtgctgatatttagcccttttkgacccacaaaaatagtggtttcatgaagttcaacctaacatgtacttactggtttgctttcattttactgcactcaaacccacgggtgcagtctcatctt

SEQ ID NO: 34711 - DNA, 201 bp, Homo sapiens
aatgggagacagtattttaaatcatgtgatatttgttctagagtatacgaagtactcttacaactcaataaaaaaacaagctaactaaaagatgggcaaargctctgcaaggacctctctccaaaaagatatacagatacccaatgggcatgtgtaaagatgctcagcatcattagtcatcagggaaatgcaaatcaaaac

SEQ ID NO: 34712 - DNA, 201 bp, Homo sapiens
ggaggctgaggtgggaggatcacctgagcccaggagtttgaggccagagttggccacataacaagaccccgtctcaaagtaagcagtggttctcaaatttyaatgaccattagcctcacctgtgaagactgattttaaaatgttctaggcatatcatgtcacagaaagacatgcaggaaacttaaaagcatgttgctctgt

SEQ ID NO: 34713 - DNA, 201 bp, Homo sapiens
ctgaaaaccttaagtgaaggtagtcagtgacaaaggacagcatactgaatggttacaattatgtgaaatatccaaaataggcaaatccacatacatagaargcatattcatggttgcccagggctaagagataatgagagcatagggcgttaatagctaaagggtacagggttaattttgggggtgatgaaaatgttctga

SEQ ID NO: 34714 - DNA, 201 bp, Homo sapiens
tgggaatggaactagaggcttgataagaagggaggcctgcctaaaataacatgttagcacactcagccccctcaccatgtgatgtcctgcaccacctcagscctctactgagagtcccaaccagcaggaaggccatcaccagatttcaacccttgaccttagacttctcagcctttagaactataagaaataaattccttt

SEQ ID NO: 34715 - DNA, 201 bp, Homo sapiens
tttggtggggtatgccaggcattttgtacagaatcttcctaaaatggagaaatgatggggatgatcacgttcttgtcttacattgggtcctaatggatgargacatgaccttgtccttagttataacctattgaggactgactcaggaacctggtctaggctcaagttaactcggcaaccacaaccccagtgcggtgcctc

SEQ ID NO: 34716 - DNA, 201 bp, Homo sapiens
taatcgctacctagtgagtagatggatccttggtaaggctactcctgaagagtaaatactgggaaagtcattcctgtttagtcttagaaatctttaaaaarcaagatttttaaaattaattggatttacctataaaaattgggaattttagtaagagatcaacagatttagaaccaggaagttggagtctgagtctttgct

SEQ ID NO: 34717 - DNA, 201 bp, Homo sapiens
ctgagtctttgctgtgccacttcctgactttgtgagcttgggcaatttttcccatgtctcactcgatttccttatctgtgaaaattacacataatggggamaacaactcaccacatagaatcatcccaagaatcacaggaaataatagagcaaaagcacttttaaacagatgttttgggcgtttttattccctggatgcaa

SEQ ID NO: 34718 - DNA, 201 bp, Homo sapiens; identical to SEQ ID NO: 7181

SEQ ID NO: 34719 - DNA, 201 bp, Homo sapiens
taagagatcaacagatttagaaccaggaagttggagtctgagtctttgctgtgccacttcctgactttgtgagcttgggcaatttttcccatgtctcactygatttccttatctgtgaaaattacacataatggggacaacaactcaccacatagaatcatcccaagaatcacaggaaataatagagcaaaagcactttta

SEQ ID NO: 34720 - DNA, 201 bp, Homo sapiens
ggaggattgcttgagcgcaggaggcagaggttgcagtgaactgacagcatgctagtgcattccagcctaggtaatagagtgagactctgtctcaaaaaaamaaaacaaaaaaaacaacaaaatctctcaaagctatggctcagtttcagccctgtttattttcactgtttttccctaaatagatatttttggtgttgagtt

SEQ ID NO: 34721 - DNA, 201 bp, Homo sapiens
caggtgcttcccccagtgtattggttatctattgctgtataataaattaccctaaaatgtagcagcttcaagcaatagacatttaatatcagtggtccagrgacctgggaatggctcagctgggtcctgtgctttaggatctctcacaaggccacagtcaaagtgtctggtgggtcagtggtctcatctgaaggcttaact

SEQ ID NO: 34722 - DNA, 201 bp, Homo sapiens
gtctgggaaattttaagctcttgataataaaaatggtaataaaatctcctccagctcctgaggcttcgcagaggggatgtttatggtggatggggttcccyttctcctgcgcagctggtttcgaggttgtgcggtttccagtcctgcggagcagctcaggttaccgcctccgtggccgcgggggagggcatctccgacggc

SEQ ID NO: 34723 - DNA, 201 bp, Homo sapiens
agaatggaaaggtaatgatacttaccagtaaataatatttctaagagtcacattatttgtgaagtaagttgtgttttaaaaataccttcccagttccttactaaattgtaaaagtagtgtgatttagtgagagagagacagtttcagaagcctaaacataacagctttttgagaatcaagcactgttcacagatctttagg

SEQ ID NO: 34724 - DNA, 201 bp, Homo sapiens
gagttcctgatccagaccctaagagagggctcctggatctggtgcaagaaagaatttggagtgagtctacaaagtaaagtgaaagtgactttattagatargtaaagaaacaaaagaataggcagagcagtggcgtcggctgcttgactgattatacttatggttatttattgattataagctaaatggggtggattatta

SEQ ID NO: 34725 - DNA, 201 bp, Homo sapiens
gaattaaaacttttgtctggtccttttctggggtgggggaggtttagggtagaagagatttgtaaattccatctctcttttacttttctaattaaaatccmcctgcagacattaccatttgctagttggcttcagaatgtttcattaagaaaactagaaataccatttgacccagccatcccattactgggtatataccca

SEQ ID NO: 34726 - DNA, 201 bp, Homo sapiens
caaggcttaaatgacttacatggcatgtccttagaacagtgcatggaacataaaatgagctctattatgttattactcttattgttaccatgaaatatatygtgtaagtgagcagaatggctgctatacataagaatatctatatccctacatagtattttcaaataataaaatcaatagcaacattgtccatggggtggg

SEQ ID NO: 34727 - DNA, 201 bp, Homo sapiens
gagtcacaggcagtaacataagacagatgagtgcaaggttgcccgctatggttgaatatttgtcccctctgaaaatcatgttgaaacttaatcctcaatgwgacagtattgagaggtggggcctttgaaaggtgactgggtcatgagggctctgccctcaggaatggattaatttattcattcatggattactggattatc

SEQ ID NO: 34728 - DNA, 201 bp, Homo sapiens
agaacatcacttaccaggtgtgcaggcacgcccccagacacccgtccttccccaccacccagcagctgaacgtggaccgggtctttgccttgtataatgaygaagaaagagtgcttagatttgctgtgaccaatcaaattggcccggtcaaaggtaaggtttccttttttgttgttgggtaaaaatgacatccttttaagt

SEQ ID NO: 34729 - DNA, 201 bp, Homo sapiens
ttccgaggactcctctatctccgtgacatttgcttaccaatagccagattgtgcttttatttcccctctactcatgcagaggattcagaccccactccggkgaatccttgctatgatgggagccacatgtgtgacacaacagcacggtgccatccagggacaggtgtagattacacctgtgagtgcgcatctgggtaccag

SEQ ID NO: 34730 - DNA, 201 bp, Homo sapiens
aaaaggggaaattctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcctg

SEQ ID NO: 34731 - DNA, 201 bp, Homo sapiens; identical to SEQ ID NO: 7196

SEQ ID NO: 34732 - DNA, 201 bp, Homo sapiens
aaaggggaaattctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcctgc

SEQ ID NO: 34733 - DNA, 201 bp, Homo sapiens
gctgtgctttttgtggggaaagaggagtgttttgtttttgtcattttagggatggggttagagacagctgagttatatagatctctgtaatgtggggaatrttttgtttatctggaatttaagtcaggttgaaagggctaaaaagaatggatattgagaatgaggtatcaagagagattgttctgagcaaaaacatgaccc

SEQ ID NO: 34734 - DNA, 201 bp, Homo sapiens
tcctgcccctacagtgtcatggcagcactggtttctgctggtgcgtggaccctgatggtcatgaagttcctggtacccagactccacctggctccaccccrcctcactgtggaccatcaccaggtgagcttaggcctggggctcaagaagcagaatggcactggtggtaggtagatcataattcctgcccagaccacgcag

SEQ ID NO: 34735 - DNA, 201 bp, Homo sapiens
aaggggaaattctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcctgca

SEQ ID NO: 34736 - DNA, 201 bp, Homo sapiens
aggggaaattctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcctgcag

SEQ ID NO: 34737 - DNA, 201 bp, Homo sapiens
gggaaattctttgcacgttatgatgctttgcttgcattctgtttctttcttcttttatttgttttttacaggatgtttctctctctctctctctctttttytttttttttcctcacagctgaacactttccaggcagttttggcatctgatgggtctgatagctacgccctctttctttatcctgccaacggcctgcagtt

SEQ ID NO: 34738 - DNA, 201 bp, Homo sapiens
cgcccaggctggagtgtagtggtgtgatcttgtgctcattgcaacctctgcctcctgggttcaagcaattctcctgcctcagcctcccagtagctgggatwacaggcgcccaccaccacacccggctaatttttgtatttttcgtagagactgggtttcatcatgttggccaggctggtctaaaactcctgacctcaggtg

SEQ ID NO: 34739 - DNA, 201 bp, Homo sapiens
gatcttgtgctcattgcaacctctgcctcctgggttcaagcaattctcctgcctcagcctcccagtagctgggattacaggcgcccaccaccacacccggstaatttttgtatttttcgtagagactgggtttcatcatgttggccaggctggtctaaaactcctgacctcaggtgatcctcctgcctcagcctcccaaag

SEQ ID NO: 34740 - DNA, 201 bp, Homo sapiens
gcgcccaccaccacacccggctaatttttgtatttttcgtagagactgggtttcatcatgttggccaggctggtctaaaactcctgacctcaggtgatccwcctgcctcagcctcccaaagtgcagggattatgggtgtaagccaccatacccggcctgtttaaatgttttaaagtaagtcacaaacatcatgccagttca

SEQ ID NO: 34741 - DNA, 201 bp, Homo sapiens
taattcttctcttacctgtagatcctgatgtgaagcccttgggttttaaatacaatgtggggaaggtcagaacaagagagtgaaagctcaaatgcattcakgtaacaaagatttactgaggatctaagaggtgtcaggacctgttctaggaaaagacaaggtctgttctttcatggcacttatattttattaggaggaaac

SEQ ID NO: 34742 - DNA, 201 bp, Homo sapiens
ttcatggattggaagacttaatactgttaagatgtgaatacttcccaaattgatctattaattcaacataatccctatcagaatctcagctggctctttgmagaaattggcaagctgattctagaatttatatggaaattcaaagaacacagaatagccaaaacaatcttggaaaagaataaagtcagacttgtatttctc

SEQ ID NO: 34743 - DNA, 201 bp, Homo sapiens
actttacatcatgtggtcgagtataatcaaaaaacgggtaataacaagtgttggcgagaacatggaaaattcggaaccctcatacgttgctggtgtgattrtaaaatgatgtggctactgtgaaaaacaaaatagtggtttctcaaagtgaaacacaaagttaccatttaatggagcaattctactcctttctatataccc

SEQ ID NO: 34744 - DNA, 201 bp, Homo sapiens
tcatcagggaaatgcaaatcaaaaccacaatgagatactactttacatcatgtggtcgagtataatcaaaaaacgggtaataacaagtgttggcgagaacrtggaaaattcggaaccctcatacgttgctggtgtgattataaaatgatgtggctactgtgaaaaacaaaatagtggtttctcaaagtgaaacacaaagtt

SEQ ID NO: 34745 - DNA, 201 bp, Homo sapiens
ccacaccaggagaaaaaaaccatcttcctcaattcagccactgtattgaaactgttgagcccagagttagctcctcagtgaggtgaatctgtaagtgataygcggttctgtgctttgttattggagctgagggctccttaagcctcagcaggctcaataaagaagtgttgcttcagcaatatgacaagattaaggtacaag

SEQ ID NO: 34746 - DNA, 201 bp, Homo sapiens; identical to SEQ ID NO: 7182

SEQ ID NO: 34747 - DNA, 201 bp, Homo sapiens
atgtgtaaagatgctcagcatcattagtcatcagggaaatgcaaatcaaaaccacaatgagatactactttacatcatgtggtcgagtataatcaaaaaaygggtaataacaagtgttggcgagaacatggaaaattcggaaccctcatacgttgctggtgtgattataaaatgatgtggctactgtgaaaaacaaaatag

SEQ ID NO: 34748 - DNA, 201 bp, Homo sapiens
gttctaagcaccttacacgaattaactcatttaatccccacaatgacctctacccaatggtggggtgggggtggggttatttgttatcccattttacagaygatgagactgaggtatagaaatgaagtaatttgcctggtcatagtaagtgacctgggtgagctgggactcaaactcaggcactggctccagtacgcacac

SEQ ID NO: 34749 - DNA, 201 bp, Homo sapiens
cctgacaggcttagctggggctctggaaatcttttgagtctaagattagagttaattctagggactgaggttgagctagaacctcaaataatgatgaacaktggccccactgagaaggcagaaggagtgcagtcagtagagactgggtagacctgccaatggggaattgcctttcaaatatgttctgttgggttttcttaa

SEQ ID NO: 34750 - DNA, 201 bp, Homo sapiens
aaaagatgggcaaaggctctgcaaggacctctctccaaaaagatatacagatacccaatgggcatgtgtaaagatgctcagcatcattagtcatcagggaratgcaaatcaaaaccacaatgagatactactttacatcatgtggtcgagtataatcaaaaaacgggtaataacaagtgttggcgagaacatggaaaattc

SEQ ID NO: 34751 - DNA, 201 bp, Homo sapiens
taaaacttaaagtataataataatagaattctgatggttaaaagacaaaacaaaacaaaaaacacagtgccaaaacaattcaatggagaaagaatagtctyttaaactattgttaactatggtgctgggaccactgagtgaccacatacaaaagaatgaagttgaaccttttacctcacagcatatccaactcaaaatggg

SEQ ID NO: 34752 - DNA, 201 bp, Homo sapiens
caacttttgagctgagattttttttttttttttttcttttaatgcctagcagggtggtaagctcttgatgtccatgtgaacacactaatctttgctggaaygtgccatggtgaaattttgatgctggaaagtactgaataagaaggctaagcattagtatttataaatcaaaacatgttgacaattacttcctgctttggt

SEQ ID NO: 34753 - DNA, 201 bp, Homo sapiens
accaaattgtatttctctatagtagcaatgagcaaactgaagattaagaaattgtttcaaaaagagataaatttttaaaaagaagtgcagtacttgtacaytgcatcccacaaaacatttttggaaaaaaatttaagacccagttaaatgggaagatgttccacattcatggattggaagacttaatactgttaagatgtg

SEQ ID NO: 34754 - DNA, 201 bp, Homo sapiens
attttaagacatggtcctgttctgtcacctaggctggagtgcagtggcacaatcatggctcactgcaagcttaagctcctgggctcaagtcatcctcctgyctcaccctctggagtagctgggactacaagcatgggccaccatgctcggctaattttctttcttttcttttccttttctttcttttctttttctttcttt

SEQ ID NO: 34755 - DNA, 201 bp, Homo sapiens
tcaggaagttcccaagggaacacactccaagaattagatgaaaaactctgcagaaaaatccacctcacatgaaaatctctgtatttaatatttttaaaaarttaccactgtgtttgttgcagctgtgacctctacaagttccagagactactctctgacttttggtgcaatcaaccaaacatggtcctaccgcatccacca

SEQ ID NO: 34756 - DNA, 201 bp, Homo sapiens; identical to SEQ ID NO: 7200

SEQ ID NO: 34757 - DNA, 201 bp, Homo sapiens
cctccagctcctgaggcttcgcagaggggatgtttatggtggatggggttccccttctcctgcgcagctggtttcgaggttgtgcggtttccagtcctgcrgagcagctcaggttaccgcctccgtggccgcgggggagggcatctccgacggccgcagcaatgggcaagagatcagggtcttcccatccccgcgactcgc

SEQ ID NO: 34758 - DNA, 201 bp, Homo sapiens
gcagatcacttctaccacacagactggaggaggtgagccccacaaattctggacaagcctgaaaaggccaactgttccagaggacacaccacttgttttamcaaaagtcagtacctgacttgactcattaagccctctgaggcttttgtttcatcacctcctcattggcagataagatccttcaaggatgtttttcatcct

SEQ ID NO: 34759 - DNA, 201 bp, Homo sapiens
gacctaatctctactaaaaatttaaaaaattagctgggtgtggtggtgtgcacccgtagacccagctatttgggaggctgaagtgggaggatcacttgagyccagggggttgaggctacagtgagccatgatcaatcacaccactatgctccagcctgggtgacagagggagaccctacctctaaataaataagtaattaa

SEQ ID NO: 34760 - DNA, 201 bp, Homo sapiens
ggctactctgaatcaaatgatcaggcgaggcctcagctgacacttaaactggaagtgaagtgggattcctccagcagcacatttagaaaccagggttgacrctcacagtagggctgacctacatcaagtgacattagccaaagctcagacacctctggcttcagtgttgctgtagcagaaatcaagataaacattttccct

SEQ ID NO: 34761 - DNA, 201 bp, Homo sapiens
ttacacacaatctaattacactcttagttatttaaaaatgtacaattaagttattattgactataataacctgttatcacaggttatagtcaccctgttgwgctatcaaatggtaggtcttattcattccttctatttttttttttttggtacccgttaactgtgtccaccttcccctgacccctactacccttcccagcc

SEQ ID NO: 34762 - DNA, 201 bp, Homo sapiens
catttcttcttagatgaaaatgaatgtgcaactggctttcatcgctgtggccccaactctgtatgtatcaacttgcctggaagctacaggtgtgagtgccrgagtggttatgagtttgcagatgaccggcatacttgcatctgtgagttccaaaatcattttcctgtgtggccaaaatggtgctctttaatcttgctcttt

SEQ ID NO: 34763 - DNA, 201 bp, Homo sapiens
tggtcagtgtccggatcactgacctgagcttgactcctagactcagatggtgagagacaaccctttcccttctctggaatccttcagatttactgaagtgmgaggtgttggaagtcgtcacttctgtgaaatgtagaagatggattggtttaaaatttagggtgtagagtcaaaccaatgtgagtttcagttccagctcta

SEQ ID NO: 34764 - DNA, 201 bp, Homo sapiens
ttttgaaaggcagtgatttcgtctaaatgttctcccagctgttctgagaaacaggatgattccattcagaacatttgtgtcctcttaccccaatttgttgmagcatatttgtcaggctttttaaattatgcacagatctgtcaaatgcaaaaatggtacttggggcacctggggatgattttacttcatggggaaggggtg

SEQ ID NO: 34765 - DNA, 201 bp, Homo sapiens
gggcagatgcaggtaatactactgatggaatgcaaatagataacctctcatcacagtgaatgtgagcactaacagattttactacaaaatgaaatcccatmacttagatctcctttctttggtctgtaaacttttaagtactagtaaatttaagtactagtaaatgagtcttaaaatgaactttctggggtttgggtggag

SEQ ID NO: 34766 - DNA, 201 bp, Homo sapiens
cagtggtgctccttggggcactgtctttaggcctttacgcagtgacagaggaatcacttgtttaatgtactagagccacatgtgtgtagttttctggccasaggttgttgggaatggtttgacctcacatcactgatttttgaaaggcagtgatttcgtctaaatgttctcccagctgttctgagaaacaggatgattcca

SEQ ID NO: 34767 - DNA, 201 bp, Homo sapiens
taatagcgtgaatcactttttaaaaagctaaatctttgcacatgttcttagttgacattccaggaagtgcaattggtaggtcagagaggatgcacttttgrtaaagttcttgataacttctgcctaattgccttccaggtaccagtttacaagtttcttagtttataggagtctgccgtcaatgtgctttacagtctctac

SEQ ID NO: 34768 - DNA, 201 bp, Homo sapiens
gacaatgctcccggcatgccttctgcacggactatgccactggcttctgctgccactgccaatccaagttttatggaaatgggaagcactgtctgcctgarggtaattgactggggccaggaactcctgtgtgtctattcctgctgcttacctgtttccagctaccactgtgagctctgctttatggaccaaacatctcca

SEQ ID NO: 34769 - DNA, 201 bp, Homo sapiens
gccctttttgacccacaaaaatagtggtttcatgaagttcaacctaacatgtacttactggtttgctttcattttactgcactcaaacccacgggtgcagyctcatcttagttcaccaactctgcaatgggacccagccgggagcagtaagcaattcttcttgccagcagacaaagcagattaattcccttgggttgaatg

SEQ ID NO: 34770 - DNA, 201 bp, Homo sapiens
aactctggatgcccttatcttcttctcttttcagtgatcaccccacctgccaacccctgtgaggatggcagtcatacctgtgctcctgctgggcaggcccrgtgtgttcaccatggaggcagcacgttcagctgtgcctgcctgcctggttatgccggcgatgggcaccagtgcactggtgagtaactgcaggtcagcctc

SEQ ID NO: 34771 - DNA, 201 bp, Homo sapiens
atgccttttctttgaggtaggtgcgtgtgttctttaagacccttccctcaaaacaatcttggtagcgagaccagctattatcttttttaagttcagtgttmcctaaaagaaggatggttagacataagacatttgttagcttctctattatgtcttcctctcaggatgtgtttaggttgaaccatataaaagtgctgatat

SEQ ID NO: 34772 - DNA, 201 bp, Homo sapiens
ctttttacttagataaaagctatgactccacctagtttaactctccatatctagactgtctctcctccatcttctctctccttgtttcataattcagcctyagaataagaattgggttgcagaataaggcttcacaaaataactgaaataagatacaatccaagcctgttatttccttaatttgtgggcagaacagcttgt

SEQ ID NO: 34773 - DNA, 201 bp, Homo sapiens
tctgattatctgcaacatgcattcatatctgatttttaaaaattctacatctgccaaccatttgtcccattgaagcatcatactagtgagaaaacattgartttttagaccctccacttctgggacccttgaattaagcagaatttttctcttctcatttcttcttagatgaaaatgaatgtgcaactggctttcatcgct

SEQ ID NO: 34774 - DNA, 201 bp, Homo sapiens
agaggtgtgtgcagccgcttggcctcctggtggccatgcttgggattggcatatttcctagtgccccggagaaagcaccctcctgtccatccacaaccccygccacaccctacccccttggctatttcctttatgaactatggcatttgctccagtttccccatttctttgcagcacagatggccctcttcttttaatggg

SEQ ID NO: 34775 - DNA, 201 bp, Homo sapiens
tccgtacttggatcccattgaaggggtcgtggagagtagcagttaagattctccagctagatgtcctaggttcggttcccacctttgccactcactgcctrtgcgacttcaggtgctttagtctactgtgcctcagctttatctgcaaacgggttaaaaaattgtccctggccagagtggtggctcatacctgtaatccca

SEQ ID NO: 34776 - DNA, 201 bp, Homo sapiens; identical to SEQ ID NO: 7199

SEQ ID NO: 34777 - DNA, 201 bp, Homo sapiens
tttgttggctggttgaatgaatgaatgaataaaataaagtgctaaatgcccagagttcacagcaaaaagtcagactctcctcttcacagctctgtttactrctctcttccccccttccccatccccttcaattcttcacagtctctacaacctccttatcttatggaatttctctaaatttagaaccaggattctctccta

SEQ ID NO: 34778 - DNA, 201 bp, Homo sapiens
aatatgagttatgttaccattttagtcacttttttcctcctacctagaaaatattttaaaaatactaaggattttggttaaaaggttgcctcagtaattayagacatagcttacaaagggcaagtatttacccagatgttataatttataagctaaggcttgaaatcacacaaattataaaaataattatgtttaatgccc

SEQ ID NO: 34779 - DNA, 201 bp, Homo sapiens
tgccagattcacgccattctcctgcctcagcctcccgagtagctgggactacaggcgcccaccaccacgcctggctaattttttgtatttttagtagagayggggtttcaccgtgttagccaggatggtctcagtctcctgacctcgtgatccgcctgcctcggcctcccaaagtgctgggattacaggtgtgagctgccg

SEQ ID NO: 34780 - DNA, 201 bp, Homo sapiens
caaagaccatcccctgggtgcacctccaggttgcagagggtctgtgaccaggagccgccgccccccgatgcctgtgaagacacctatatgaggagattccvtggtagggcccctctcccttcaccagaagtggagagagcctgttagtgtcatgccagcagttgtaaaaggccacccccagggtcgtgatcactgccacca

SEQ ID NO: 34781 - DNA, 201 bp, Homo sapiens
aaatttaaatcggctccatgagaaatgtgaaacttggaaattcttgaatggtttagctattgtaaaaatttttaagactgattcctttacattgaaatatragttatgttaccattttagtcacttttttcctcctacctagaaaatattttaaaaatactaaggattttggttaaaaggttgcctcagtaattatagaca

SEQ ID NO: 34782 - DNA, 201 bp, Homo sapiens
tttgtactgcttgcctgaccatgagtgcctggcatatttttaacagttaaaagaattagccattgttgaattgacaaacttaagtgaagttattcttatgyggggagagggtcactataacttacctataaacatctgttataatgctaaggacattctttggaaagcattgtagcagggtagcttccttcagtaataaca

SEQ ID NO: 34783 - DNA, 201 bp, Homo sapiens
tgtatagcatattgcacacaaaatcagtttttctttctatgcttttttccctaaatttaccacaacagtaaccacagcatatacatatatgtacatgcatacacacacacacacacacacaaacacacacaaacacacacaagagaaagacattttcaaattgtactgaaaaatattgttactatagaaatccacatgaac

SEQ ID NO: 34784 - DNA, 201 bp, Homo sapiens
ctaatgcagcccaaactcaaggggattgcttaaggctataatacatgaggagatggagatcactgggggctgcttagatgctgcctaccacaggctacatrgctattcttttacaatcttgatttttaacttacagcaacttgtactggacagactggaatagagaagctcctaaaattgaaacgtcatctttagatggag

SEQ ID NO: 34785 - DNA, 201 bp, Homo sapiens
gtatagcatattgcacacaaaatcagtttttctttctatgcttttttccctaaatttaccacaacagtaaccacagcatatacatatatgtacatgcatacacacacacacacacacacaaacacacacaaacacacacaagagaaagacattttcaaattgtactgaaaaatattgttactatagaaatccacatgaaca

SEQ ID NO: 34786 - DNA, 201 bp, Homo sapiens
atatgtaacaaaagtacttgtttctctattaacctggttcttggggacttggagacacttgggctttgctttcccctgctgacccccctgcccacccgacygttggagggcttcaggtttgccctccatatcctgcaaacactccagtcctgactttgctttatttccaggtctgataagccctgaaggacttgccataga

SEQ ID NO: 34787 - DNA, 201 bp, Homo sapiens
tatagcatattgcacacaaaatcagtttttctttctatgcttttttccctaaatttaccacaacagtaaccacagcatatacatatatgtacatgcatacacacacacacacacacacaaacacacacaaacacacacaagagaaagacattttcaaattgtactgaaaaatattgttactatagaaatccacatgaacat

SEQ ID NO: 34788 - DNA, 201 bp, Homo sapiens
atagcatattgcacacaaaatcagtttttctttctatgcttttttccctaaatttaccacaacagtaaccacagcatatacatatatgtacatgcatacacacacacacacacacacaaacacacacaaacacacacaagagaaagacattttcaaattgtactgaaaaatattgttactatagaaatccacatgaacatg

SEQ ID NO: 34789 - DNA, 201 bp, Homo sapiens
gataggtgaacgagttttagggcccctggacctactgcagcgcggagctgggacagtcgcaaaagttgcgcttgtttccctgaatccagactccctggccrgtggggaaggagagagaggctttttgcctaagtcagttcccttccctccctgcgcgaaagggtagcgtccttgggcttgagcgactgtcacctttttgtc

SEQ ID NO: 34790 - DNA, 201 bp, Homo sapiens
cactgtggaccatcaccaggtgagcttaggcctggggctcaagaagcagaatggcactggtggtaggtagatcataattcctgcccagaccacgcaggcasggggccagtcaccatccttcatagcctctttcctcctgagaagacttgaataatagtgcgtacaaatatgcatgtttgtgtcataaggacatagagatat

SEQ ID NO: 34791 - DNA, 201 bp, Homo sapiens
ctgagcctactcttgcgctgaacctgaccttggaggcagcagggctggagtggcttgggagtgaggaaagacgttgtctctaggcatcttctgaggccctrgcaggtggtcactcccttgaggaaaaaaatgcttagcggatatgagagcgggagtgcagatgtgggagcccctttgaacataaggcaatttactgtttgg

SEQ ID NO: 34792 - DNA, 201 bp, Homo sapiens
tctcgataatcttccctgcttgcttctaccattaaacccagtttataaagtatgactcgaattatacttgaagtctgtgctgattaaccccagacatgtgrtgacccctaatctagtgctcatgatctccgtacttggatcccattgaaggggtcgtggagagtagcagttaagattctccagctagatgtcctaggttcg

SEQ ID NO: 34793 - DNA, 201 bp, Homo sapiens
tagtagttgctccagctgtcctgaagcagccctgtgcacgaagcctcctgtgtccctctgtgttggcccagtgaacccagtcgacaccatggaacctcccstgtgtctggcccagggccttctgtgaagaagggcaggccggccaagggctgcagacaggtgcttaagtgtttctgggaaaatgaagattgaaagatggct

SEQ ID NO: 34794 - DNA, 201 bp, Homo sapiens
ggctacttacccctcaatggcaccaggcttcagaaggatgcagctaagaccctgctgtctctgcatgtaaagtggatttctcctgtagggggcagggctgygtggctttcccagtgggagccacctcacaggccctgttgcagtgaggtggactggtgcagggaagtcctggagggtttctgagctgcagcccatcggcat

SEQ ID NO: 34795 - DNA, 201 bp, Homo sapiens
gtcacctttttgtccctctcctctcccaggtgggcaccaacggcatcatctccactcaggacttccccagggaaacgcagtatgtggactatgatttcccyaccgacttcccggccatcgccccttttctggcggacatcgacacgagccacggcagaggccgagtcctgtaccgagaggacacctcccccgcagtgctgg

SEQ ID NO: 34796 - DNA, 201 bp, Homo sapiens
attgttataacttctttttctgtaatagaaaaatgtagtacagcttccaatctatttataaacctttgcacagttgcacttgtaagttgctggctgcatcrccctgcctctttttacttagataaaagctatgactccacctagtttaactctccatatctagactgtctctcctccatcttctctctccttgtttcataa

SEQ ID NO: 34797 - DNA, 201 bp, Homo sapiens; identical to SEQ ID NO: 7188

SEQ ID NO: 34798 - DNA, 201 bp, Homo sapiens
cattgttataacttctttttctgtaatagaaaaatgtagtacagcttccaatctatttataaacctttgcacagttgcacttgtaagttgctggctgcatygccctgcctctttttacttagataaaagctatgactccacctagtttaactctccatatctagactgtctctcctccatcttctctctccttgtttcata

SEQ ID NO: 34799 - DNA, 201 bp, Homo sapiens
gcacttatattttattaggaggaaacaagactggtataaacaatattagtctgtgatgtgatatgtagaaaattcagatagtgttgtgagaactagggctrctctgaatcaaatgatcaggcgaggcctcagctgacacttaaactggaagtgaagtgggattcctccagcagcacatttagaaaccagggttgacgctca

SEQ ID NO: 34800 - DNA, 201 bp, Homo sapiens
tgtaacctggaactgctgggctcaagtgaccctcctgcctcagcctactgagtagctagaagcacaggcatgtggcaccatgcctggctaagttttttagraaagggttttgtagaggcagggtctcactatgttgcctagactggtctcaaactcctgggcttaagtcatcctcctactttggccttgcaaagtgctggg

SEQ ID NO: 34801 - DNA, 201 bp, Homo sapiens
ggtctgctggtctagaagctagaggtagtggaatatgtaacaaaagtacttgtttctctattaacctggttcttggggacttggagacacttgggctttgytttcccctgctgacccccctgcccacccgactgttggagggcttcaggtttgccctccatatcctgcaaacactccagtcctgactttgctttatttcca

SEQ ID NO: 34802 - DNA, 201 bp, Homo sapiens
gacacttgggctttgctttcccctgctgacccccctgcccacccgactgttggagggcttcaggtttgccctccatatcctgcaaacactccagtcctgamtttgctttatttccaggtctgataagccctgaaggacttgccatagaccacatccgcagaacaatgtactggacggacagtgtcctggataagatagaga

SEQ ID NO: 34803 - DNA, 201 bp, Homo sapiens
gcttgttgtatcccaagccttctatcaacaccaattggtgtgagaatcactggcggggtggctaaagtgtagattgctaggatgcacccagagagtggaaytggtaggtctaaggtgggccctcagaatttgcatttttaacagaaatctcaggtgatcctgatgcagtggtctctggaatccaccgggagaaatgcagct

SEQ ID NO: 34804 - DNA, 201 bp, Homo sapiens
taaatttgttaacgacattgatgagcaacacctagctcagaaatccaaggcttgttgtatcccaagccttctatcaacaccaattggtgtgagaatcactkgcggggtggctaaagtgtagattgctaggatgcacccagagagtggaattggtaggtctaaggtgggccctcagaatttgcatttttaacagaaatctca

SEQ ID NO: 34805 - DNA, 201 bp, Homo sapiens
tttgatgcacaaagggctccataatcgtgggaattgattacgactgccgggagaggatggtgtactggacagatgttgctggacggacaatcagccgtgcyggtctggaactgggagcagagcctgagacgatcgtgaattcaggtcagcagcttcactcagcagtctgcatttcatttgattctacaaagtcacttgtct

SEQ ID NO: 34806 - DNA, 201 bp, Homo sapiens
attcttgtggatggatgcccaaatgggccgtaagcactgagctcagcttctcaggtggccagaaatgagcacgagaaatttcctaacattctgcccacccyaggagctgccaattggtcagattaaatttgttaacgacattgatgagcaacacctagctcagaaatccaaggcttgttgtatcccaagccttctatcaac

SEQ ID NO: 34807 - DNA, 201 bp, Homo sapiens
ggaaactgagcttggaaatacttagtgacttgtctagcaagggcaaagactgcaacaaagtcatgaagaaattagagaaagctgtagggtgacagagagtsaaaggcactgtccaggagtgtcactgctgttggggaagtctttgtgaggaaggaggggcttgagccaggcctggggtcaaagtctgagagggagaatgtg

SEQ ID NO: 34808 - DNA, 201 bp, Homo sapiens
gggctatctggctgctgtgcgtctgtattaccttcactaaagaatcttcacgttgtattcttgtggatggatgcccaaatgggccgtaagcactgagctcrgcttctcaggtggccagaaatgagcacgagaaatttcctaacattctgcccaccccaggagctgccaattggtcagattaaatttgttaacgacattgat

SEQ ID NO: 34809 - DNA, 201 bp, Homo sapiens
ctcttaccctaagtccccagggttgtatgtcataacatctccatggaaatcctggaaatcaaagtgacaggacaactagtcacaaggtgtgatctctgcgrtttgttggggactccaagtggaagtcagttaatgactgtctcaccgttgcagcccttccctttcactttggttctgtccctttgacccacttctttccta

SEQ ID NO: 34810 - DNA, 201 bp, Homo sapiens
gccctggataaatagctgcacgtgggctcagcaccgttctagctccaggtctcccccttcttcagggaagggctatctggctgctgtgcgtctgtattacyttcactaaagaatcttcacgttgtattcttgtggatggatgcccaaatgggccgtaagcactgagctcagcttctcaggtggccagaaatgagcacgaga

SEQ ID NO: 34811 - DNA, 201 bp, Homo sapiens
ggctgcgtggctttcccagtgggagccacctcacaggccctgttgcagtgaggtggactggtgcagggaagtcctggagggtttctgagctgcagcccatyggcatgggcccgatgccaccaccataggaccagggctctctcttgctgggagtcacctgtcactgaccaaggctgtgctctctggttcgttcatggagtt

SEQ ID NO: 34812 - DNA, 201 bp, Homo sapiens
gagtaggaagaagtgcatgaaaatacactcaaagccatgatagggacatgcaaatgaccaccgaaaagaaaaagtgccacttttcctcgggtgtgtttatygcacatctcatctagctgggatccagatcttgattcccagccttcaagaagttcagcctctttgaatttcactgcaattcccatagaaatttgagcagtc

SEQ ID NO: 34813 - DNA, 201 bp, Homo sapiens
cttacccctcaatggcaccaggcttcagaaggatgcagctaagaccctgctgtctctgcatgtaaagtggatttctcctgtagggggcagggctgcgtggytttcccagtgggagccacctcacaggccctgttgcagtgaggtggactggtgcagggaagtcctggagggtttctgagctgcagcccatcggcatgggcc

SEQ ID NO: 34814 - DNA, 201 bp, Homo sapiens
ctaactagagtaggaagaagtgcatgaaaatacactcaaagccatgatagggacatgcaaatgaccaccgaaaagaaaaagtgccacttttcctcgggtgkgtttatcgcacatctcatctagctgggatccagatcttgattcccagccttcaagaagttcagcctctttgaatttcactgcaattcccatagaaatttg

SEQ ID NO: 34815 - DNA, 201 bp, Homo sapiens
gcagcctgggaggaaactgctttgcaaccaaagccagcaggacttcaaccatggagtgagctgtgagggaggggacaagaggagaggatgctggagaaagrgggggaaagggcaacacggcaggaagctagagcctgcaggaaaagattcagctttgagataatcccaggcgcagggtggctaaagcaattctggaaactg

SEQ ID NO: 34816 - DNA, 201 bp, Homo sapiens
tgctggaacctgatcataatgctcccagctttgttctttagagtcactggagggttttgaacggagtgacatgaaatgcctttatgtttaaaatgggccaytctggctgctgctaattgaatttacactggttttggagagagtgagggcatagaagggtggaagcaggaaaaccagtgggaaggctgttgcagaaattgc

SEQ ID NO: 34817 - DNA, 201 bp, Homo sapiens
tcatcagtcataatagcacctattgaagggcttactgtatgccaattactgattaggacactttacaagcacttatagtattaatttttatagcaaccatrtgaggcaggtacactattggcctcattttgcaaatgagacaaacgcatagaggttaaatgcccaaagccacatggctactaagtggctgagcctagattt

SEQ ID NO: 34818 - DNA, 201 bp, Homo sapiens
agccagttagttttctctaaactgacaatcccagccctctgtaacccagcccaacatctcagaggaggcacagacatctggtttctgttagcccatacaayctgagaacatgcctgctaccatctagagcattccccagctgggtggggcatggtgatcaagtgctcacagtcgattccaacagcaggcagataaggcaac

SEQ ID NO: 34819 - DNA, 201 bp, Homo sapiens
cttaatcggacctacaccctttgtttatcctccttttactctgaaagacttcctgtctcttaaagtagcttatctcatcccttgggcgttagttttaaccrttcaattctcagagctgctttttttctgctggggatgggaggggtgggtgacttgctattgtcggcatatgcggatttcattaaataaaaggaatgtaag

SEQ ID NO: 34820 - DNA, 201 bp, Homo sapiens
gtgagtgaagtcatagtgttctttgcttctttcttctgtttctgacctctgcagatgtagatgaatgctcagaaaacagatgtcaccctgcagctacctgytacaatactcctggttccttctcctgccgttgtcaacccggatattatggggatggatttcagtgcatacctggtaagtttcagagggccagattaggca

SEQ ID NO: 34821 - DNA, 201 bp, Homo sapiens
ttgcaaagtgctgggattataagtgtgagccaccatgcccagctgtctttccgttttaaaataagttgttcaccttctaggaaggtgggtgaatggacacktttgttacatttgttacaatgactgtttcctttttatttagactaagcaacctggggatccctggagtgtgggctttccatatcggcagcacttccccgt

SEQ ID NO: 34822 - DNA, 201 bp, Homo sapiens
gtgatccaagggaaaatggaccgactcttaccctaagtccccagggttgtatgtcataacatctccatggaaatcctggaaatcaaagtgacaggacaacyagtcacaaggtgtgatctctgcggtttgttggggactccaagtggaagtcagttaatgactgtctcaccgttgcagcccttccctttcactttggttctg

SEQ ID NO: 34823 - DNA, 201 bp, Homo sapiens
tcaaaagtccagtatgatccctttagttaccatgtaagtctgcttttatttggttttatataccagtgaaaactgaacctgatcttaatagcctttcaggktttttgtttttttgagacagggtctcactctgccacacaggctggggtgcagtggttgcaaccaaagcccactgtaacctggaactgctgggctcaagtg

SEQ ID NO: 34824 - DNA, 201 bp, Homo sapiens
aatgaggaggaagctgaataccttccgggtgaaccagaggaggcattgaatggccacagcagcattgatgtttccttccaatccaaagtggatacaaagcmtttagagggtaggatctcccctccagattctgatctgtcctcccccttgcatccaacacctacttattggccattctatcctgaaacagaatcttccacc

SEQ ID NO: 34825 - DNA, 201 bp, Homo sapiens; identical to SEQ ID NO: 7189

SEQ ID NO: 34826 - DNA, 201 bp, Homo sapiens
tgtgttatgtttccagacaagtagaggaaggatgaaacattcctacattccttgtttattttcaaatagccagattttagataaaccatttggattatggrgcagattgataatttgatgatctggcattctgtggcatacagctttgaaacataatgttaaataaaaggtagttcacatcaaaagtccagtatgatccct

SEQ ID NO: 34827 - DNA, 201 bp, Homo sapiens
tctgtaggcctcaattttctcatttataaaatggagatatcttctaactagagtaggaagaagtgcatgaaaatacactcaaagccatgatagggacatgmaaatgaccaccgaaaagaaaaagtgccacttttcctcgggtgtgtttatcgcacatctcatctagctgggatccagatcttgattcccagccttcaagaa

SEQ ID NO: 34828 - DNA, 201 bp, Homo sapiens
ttctatcttctggaagacaagacagtagttaataagtatttatgatgtttagggccagtgataggcattttatttatttatttttttgagatggagtctcrttctgtcatccaggctggagtgcagtggcatgacctcggttcactgcaacctctgcctcctgggttcaagcttttcttctgccttagcctccagagtagc

SEQ ID NO: 34829 - DNA, 201 bp, Homo sapiens
gatgccccctcaatttgatgggatttagagccagaagattgtttcatctctgtaggcctcaattttctcatttataaaatggagatatcttctaactagartaggaagaagtgcatgaaaatacactcaaagccatgatagggacatgcaaatgaccaccgaaaagaaaaagtgccacttttcctcgggtgtgtttatcgc

SEQ ID NO: 34830 - DNA, 201 bp, Homo sapiens
ggaggaaaaaaaagggtggctgtctcgaatggcatcgacacagtggaaaatcatctgattccattgttgaacttcacactccaggcacttgctcatccctragaaagaatagtacggcattcaagtttacatttacttctgttaatgaacgacacttatttggttccagaaaagcttagaggcagccagtgtttaggaaga

SEQ ID NO: 34831 - DNA, 201 bp, Homo sapiens
cttccctcttccccatctgctcagagcccacccagaggcccccgaccatctgtgagcgctggagggaaaacctgctggagcactacggtggcaccccccgrgatgaccagtacgtgccccagtgcgatgacctgggccacttcatccccctgcagtgccacggaaagagcgacttctgctggtgtgtggacaaagatggca

SEQ ID NO: 34832 - DNA, 201 bp, Homo sapiens
tttttaagccacctcactccttcaacacctccaggcctctgcccaaatgtctttttctcccgaggtcttccctgaccatactatttcaaagagccaggtgygcctgccctctctcaccctcttgtctgaccctgccatattcctctgcacttcagtgattctgatgccccctcaatttgatgggatttagagccagaagat

SEQ ID NO: 34833 - DNA, 201 bp, Homo sapiens
gtctcatcttagttcaccaactctgcaatgggacccagccgggagcagtaagcaattcttcttgccagcagacaaagcagattaattcccttgggttgaaygttatgccggtctcttaaacatcaaaaactgtttgttatgatctaaactgcttctatggagcagatgttgtgtccccgatgcagcagtgacattggaatc

SEQ ID NO: 34834 - DNA, 201 bp, Homo sapiens
acactgatttccaagcgcctcctctaccttctgaaccagaaactgcatttttaagccacctcactccttcaacacctccaggcctctgcccaaatgtcttyttctcccgaggtcttccctgaccatactatttcaaagagccaggtgcgcctgccctctctcaccctcttgtctgaccctgccatattcctctgcacttca

SEQ ID NO: 34835 - DNA, 201 bp, Homo sapiens
gggagcctgggggaactcgaggccaggggttaggtttatcatccaacagttcctgctggttttgctcagtacttgggcagtgagaaggatgttgaagcacraaagcatgaactcgaaggatttttaacacattttccaaacaggttctttactagcttaatagagtgtaggattgcactgagattaagctacctctcatta

SEQ ID NO: 34836 - DNA, 201 bp, Homo sapiens
gccttctgcacggactatgccactggcttctgctgccactgccaatccaagttttatggaaatgggaagcactgtctgcctgaaggtaattgactggggcyaggaactcctgtgtgtctattcctgctgcttacctgtttccagctaccactgtgagctctgctttatggaccaaacatctccactacttaaatcagagtg

SEQ ID NO: 34837 - DNA, 201 bp, Homo sapiens
aacactgatttccaagcgcctcctctaccttctgaaccagaaactgcatttttaagccacctcactccttcaacacctccaggcctctgcccaaatgtctytttctcccgaggtcttccctgaccatactatttcaaagagccaggtgcgcctgccctctctcaccctcttgtctgaccctgccatattcctctgcacttc

SEQ ID NO: 34838 - DNA, 201 bp, Homo sapiens
ttttttaatttttatttatttatttatttttttaggcagggtcttactttatcacccaggctggagggcagtggtgtgattacagctcactgcagcctcarccttccaggctcaagtgatcctcacatctcagcccccccaagtagcatgcccagctaattttggtatctcttgtagagatggggtttcatcatgttgccc

SEQ ID NO: 34839 - DNA, 201 bp, Homo sapiens
ccttctgcacggactatgccactggcttctgctgccactgccaatccaagttttatggaaatgggaagcactgtctgcctgaaggtaattgactggggccrggaactcctgtgtgtctattcctgctgcttacctgtttccagctaccactgtgagctctgctttatggaccaaacatctccactacttaaatcagagtgc

SEQ ID NO: 34840 - DNA, 201 bp, Homo sapiens
ttgaaaacttactacttgccaagcatcatgctaaacactttccagatgttatcttaattaaaactcacaagaattgtaggttagtactactattttcccarttttacagaggagcttagggaagttaagtaaattgcctatgatctcaaagttaagtggcaaagccaaaatccaagctcaagtctggagtgctgaactact

SEQ ID NO: 34841 - DNA, 201 bp, Homo sapiens
aggcaggactgtttcatagatggataattggttggttaggaaatcattaaagtgacttgctaaagagtgagttttggaagttgtcagtggaataattatayctgggtacacccatctctagccaggatgatgtccaagcctaactggatttgctgtcttttaggggcacctcaccgagtgaatgggaaagtgagtggccac

SEQ ID NO: 34842 - DNA, 201 bp, Homo sapiens
agttcattcaaacctggccagcctccaccctcctgctgtgccctgaggtgtcagcaaacttctttatggtctgactctccgtggcaggagcttcctggcakagtgtgggtcccagaggaggccatggactagaaactgtatttctcaaagtgtgggcactcatccaccttcctctcactcagctgggagcctggttaaaaa

SEQ ID NO: 34843 - DNA, 201 bp, Homo sapiens
tttaaaggcattccatagggtacatgtgtctcagtgaccaaagaacagaggctgtattttgtgggtgctatgcattgttaaagcacatgctcttttactcyatcaaactaacaataagggggtgtgggagtttttctccagccatagtttgttaaaaaaaccggctccctggagaggctgcacttggatttgggttctcag

SEQ ID NO: 34844 - DNA, 201 bp, Homo sapiens
tttagcaactatcaaacctcagttaacaaatccatgacaaaatgagttcattcaaacctggccagcctccaccctcctgctgtgccctgaggtgtcagcaracttctttatggtctgactctccgtggcaggagcttcctggcatagtgtgggtcccagaggaggccatggactagaaactgtatttctcaaagtgtgggc

SEQ ID NO: 34845 - DNA, 201 bp, Homo sapiens
aaatatttagttccttagctctctggtttaaagcaaagaagttgaaattaatttcagcctagatatgatgagtgttaatcggaatattaatttagattagrtgctgcatgctttgatcacttctacaatgattctctccctccttttttcttctacttgtcctgcaagactttgattaccttctggggtcatgttagggct

SEQ ID NO: 34846 - DNA, 201 bp, Homo sapiens
gacattttgtgtagaaaatctcaggaattcactaaaacactattagaactaaagaacaagttcgcaatgttataagatatgcaagatcagtacaccaaatygtatttctctatagtagcaatgagcaaactgaagattaagaaattgtttcaaaaagagataaatttttaaaaagaagtgcagtacttgtacattgcatcc

SEQ ID NO: 34847 - DNA, 201 bp, Homo sapiens
tccagctgtcctgaagcagccctgtgcacgaagcctcctgtgtccctctgtgttggcccagtgaacccagtcgacaccatggaacctcccctgtgtctggsccagggccttctgtgaagaagggcaggccggccaagggctgcagacaggtgcttaagtgtttctgggaaaatgaagattgaaagatggctcagaacaagt

SEQ ID NO: 34848 - DNA, 201 bp, Homo sapiens
agtaccagctctaagaaatgtgaatccactgagaaaaatcttgtctgtagaatttatttaaacatctggctgctcagatcagcagagatggtgcttttaaratatttagttccttagctctctggtttaaagcaaagaagttgaaattaatttcagcctagatatgatgagtgttaatcggaatattaatttagattaggt

SEQ ID NO: 34849 - DNA, 201 bp, Homo sapiens
tagggtaaaacgacacactggggatgagagaatggtgggaaacgtgtttagaatgggaaagggcctgctggggaacatgaaccttaaaaggcagactttcycctgctcctggtgttgctgtgtgcatctgcctccatccgcccaggcccaccgagctgatgtgctaagaacagctttgcaattcctgggagctttatacca

SEQ ID NO: 34850 - DNA, 201 bp, Homo sapiens
gttccttggagccagcgcaggctggaggaatttagggaaagttgcataccttcctgttaggcggtctccaccttaattcaacacttatggttgtgctcttmtgctttaagtgatattttaagcaatctctaaacacatatgtaatttctaatttttctcctctttcaaaagagagaactccacatatataaaaagacacat

SEQ ID NO: 34851 - DNA, 201 bp, Homo sapiens
tcagtactagaatttctagccagggtgattaggcaagaacacaaaataaaagccatctaaattggaaaaggacaaagtaaaattagtctcagatgacattytgtgtagaaaatctcaggaattcactaaaacactattagaactaaagaacaagttcgcaatgttataagatatgcaagatcagtacaccaaattgtattt

SEQ ID NO: 34852 - DNA, 201 bp, Homo sapiens
cattctgtccttgactcacaatcaaaggtttttcttcttccctcttccccatctgctcagagcccacccagaggcccccgaccatctgtgagcgctggagrgaaaacctgctggagcactacggtggcaccccccgggatgaccagtacgtgccccagtgcgatgacctgggccacttcatccccctgcagtgccacggaa

SEQ ID NO: 34853 - DNA, 201 bp, Homo sapiens
cctgccaaagtcaggaaatagagcatagtatgtgaagctggtttatagcaatacccaactgtgcgtgccaatcaggaatatacctgtgaacaaggcagacyggaattaggagggagagtgatgctgacaagtatttgttacaagtgtgatgagagcagggcactgtgagtctagtttgaagattcagaaaagatgtcccca

SEQ ID NO: 34854 - DNA, 201 bp, Homo sapiens
ggttttgaacggagtgacatgaaatgcctttatgtttaaaatgggccattctggctgctgctaattgaatttacactggttttggagagagtgagggcatrgaagggtggaagcaggaaaaccagtgggaaggctgttgcagaaattgcagggagaggatgaggctttttgaccagggtgagggggtgcagtagtgagaag

SEQ ID NO: 34855 - DNA, 201 bp, Homo sapiens
taaatagatatttttggtgttgagttattgaaggatgcccacctcagttgggatttctggcccagtcatgtaacaagatgatgaacttcactagtaaacayctccagctctttagatagagcctaaagtatttttcaaattggaagagatggatttataattcactgatgcatgtcctacttgactggctaaagagctcct

SEQ ID NO: 34856 - DNA, 201 bp, Homo sapiens
agatccttgcccttgagttggaaacagaggcagaaaagagttttagggcagggaacagtgtccctgccaaagtcaggaaatagagcatagtatgtgaagcyggtttatagcaatacccaactgtgcgtgccaatcaggaatatacctgtgaacaaggcagactggaattaggagggagagtgatgctgacaagtatttgtt

SEQ ID NO: 34857 - DNA, 201 bp, Homo sapiens
ggtttccttttttgttgttgggtaaaaatgacatccttttaagtagagttagaatgattcacagaggttactaagggttacctagcgccatgctgtgttaygtgctaggtataaggatgaatagagcagatccttgcccttgagttggaaacagaggcagaaaagagttttagggcagggaacagtgtccctgccaaagtc

SEQ ID NO: 34858 - DNA, 201 bp, Homo sapiens
cccggtcaaaggtaaggtttccttttttgttgttgggtaaaaatgacatccttttaagtagagttagaatgattcacagaggttactaagggttacctagygccatgctgtgttacgtgctaggtataaggatgaatagagcagatccttgcccttgagttggaaacagaggcagaaaagagttttagggcagggaacagt

SEQ ID NO: 34859 - DNA, 201 bp, Homo sapiens
ccagtgatggacgggtttgtgctttttaaagtggtgagttgtgctggctcagatgaacatgccagattcatactctgttgtgagacaagcctagcgcttcycttggttggggagatatgcttgtgatgtgtgggagaggagagcccacagggaaagaaaatgactaaacacctgtgtctgttgtcatttctggttcatggc

SEQ ID NO: 34860 - DNA, 201 bp, Homo sapiens
aaattttaaagaaggttatgtttaaaaacaatttggaggaatcctgaaaaaggggaaattctttgcacgttatgatgctttgcttgcattctgtttctttyttcttttatttgttttttacaggatgtttctctctctctctctctctttttttttttttttcctcacagctgaacactttccaggcagttttggcatctg

SEQ ID NO: 34861 - DNA, 201 bp, Homo sapiens
taataaataatattgcttatgaaattatattgttaacttgaagaggaaattttaaagaaggttatgtttaaaaacaatttggaggaatcctgaaaaagggkaaattctttgcacgttatgatgctttgcttgcattctgtttctttcttcttttatttgttttttacaggatgtttctctctctctctctctctttttttt

SEQ ID NO: 34862 - DNA, 201 bp, Homo sapiens
cagcccaaaatctccttaagctgacaagcaacttcagcaaagtctcaggatacaaaatcaatgtgcaaaaatcacaagcattcctatgcaacaataacagacaaacagacagccaaatcatgagtgaagtcccattcacaattgctacaaagagaataaaatacctaggaatacaacttacaagggatgtaaaggacctct

SEQ ID NO: 34863 - DNA, 201 bp, Homo sapiens
gttctgaaactattccaaacaatagaaaaagagggaatcctccctaactcattttatgaggccagcatcatcctgataccaaaacctggcagagacacaayaaaaaaataaaatttcaggccaatatccctaatgaacattgatgcaaaaatcctggcaaaccgaacccagcattacatcaaaaagcttatccaccacgat

SEQ ID NO: 34864 - DNA, 201 bp, Homo sapiens
gttctcctgccctaactccttctttccgacttctcttgtcccattctccctcagatcctcccttccgcttatgccaaggcttccacagcctcgctctgcckggccttggcattcctagcctgagtgttgaaaccattggccgggacctcaaggcagctggggcagggagaggacggttagaagcccagggcacactgccac

SEQ ID NO: 34865 - DNA, 201 bp, Homo sapiens
cacatgggacccaatgggcaggaaagggcaagtctgggcagaaagaatacagacccctaaatgtgcagagaaacacttgacctattggaggatgatggacytctcaaagagtggaggatgatggctttgtgtttggattgcagatccttccactctgcaagtcgagatgttttgtcaacgtgaagcagaacggtgcactgg

SEQ ID NO: 34866 - DNA, 201 bp, Homo sapiens
aaggtcaaaagccttccctgtgtgggtgtcagtgtgtgtgtgcgatagaaaatttgattgacttctccgtgggcttcctgtctggagagtcagtgatggcyataaggatttcccaccatcctccctttcccatcccacctcccactgtttcttcctcagtgtagaaaccccttcccattaaccaatgatccagtcacaatg

SEQ ID NO: 34867 - DNA, 201 bp, Homo sapiens
cccccacactacacagcagggctggcagcacaatgtgcagtgagaggagggatgaagcaatcatctcctctcgaggaggggcaaggtcaaagatctggaaygcctgcctggggtgttgtctccttgccatccggcccaggtttcatccagctctttgacggaaagtttgtttgctgtctgcgtttaccgtgatttagctca

SEQ ID NO: 34868 - DNA, 201 bp, Homo sapiens
tctgatgtaagaaatgattctacccttttcattgcttaaacgaataccatgactcagatatgtgtctgttttgcaggggccctgacatgaaaagtgagttygccaagatcggtgtcacaacaggcttggcaagatatggcttgagtcagataagggccactggtccagaaggggctcgtgtggtgggtggtgtgatggcag

SEQ ID NO: 34869 - DNA, 201 bp, Homo sapiens
ggtctcttcaaacacctggcgtcgacccagcacatctgctaagaaagcattcgtactggtctggattgagcctccacaggccatcattgtcctcttcagaktctcctcaggtacttggccagcacagaacatgttcctgtcagcaaagtactgggcggccacatctccagtggggagttcagacaagacaactttggctcc

SEQ ID NO: 34870 - DNA, 201 bp, Homo sapiens
tcaaaaccacaatgagataccatctcacgccagttagaatgacgttcattaaaaagtcaggaaataacagatgttggagaggttgtggaaaaatagaaacrcttttacactgttggtgggagtgtagattagttcaaacattgtggaagacagtgtggcaattccttacggatctagaacgagaaataccatttgactcag

SEQ ID NO: 34871 - DNA, 201 bp, Homo sapiens
agtgacaacaacatggtcaaacctctgggcctcctggggaagaaggtaaatgccaccagcacttggggagaattgacccaaacgctgggagaagtggggcragacctcaggatgctcctttgtgacatcaaaccccagataaagaccagtggtaagtgtggaatggggtgggcaaacagaggcaggcagtaagagagggga

SEQ ID NO: 34872 - DNA, 201 bp, Homo sapiens
aattttcagaattcaaaacttagagccctaagacttttcccaatgatagacttggctttccttgaggtcttggccccagtaggactgctggagtctattayaaaactcatctggaaggacctctgccgttgctgaggcttgaggaaatggttttaaggtcacagtgtaaacaaaactgctgggaagttggaactgggcgga

SEQ ID NO: 34873 - DNA, 201 bp, Homo sapiens
catcatcactggtcgttagagaaatgcaaatcaaaaccacaatgagataccatctcacgccagttagaatgacgttcattaaaaagtcaggaaataacagwtgttggagaggttgtggaaaaatagaaacacttttacactgttggtgggagtgtagattagttcaaacattgtggaagacagtgtggcaattccttacgg

SEQ ID NO: 34874 - DNA, 201 bp, Homo sapiens
caagcgccggtggaggtcagtgcccacagctgagctgaacagaagtgggaggcagagtgggcctggggaaaggtgtattacaattcaaggggaaaaaaatrtatctgccaccctttggggagggcctccccactgtgtcgcatggatttctctgtcacggggaagagcagcacccagggaaaaagagctttgtgtgcccat

SEQ ID NO: 34875 - DNA, 201 bp, Homo sapiens
ctgtgcgccttcttttgtttctgctgttgctactaatagccttggagatcatggttggtgagtgtcctgagcacaagaactggctgaggacaaggaggagrgagaaaggtagggggtaggcgaatggggcttcatgcaggcttcagacaagtgggtgcctgctcttaaggatgacgtgaggaagaggatccctgggatgtt

SEQ ID NO: 34876 - DNA, 201 bp, Homo sapiens
ctgggaagttggaactgggcggagcccactgcagctcagcaaggctgctatggccagactgccagatttctcctctctggtcagggcatgttggtaaacarggcagcagccccaatcaggggcttatagcagacttaaatgtccccgcctgatggctctgaagagggcagcagacctcccagcacagcattcgagctctgc

SEQ ID NO: 34877 - DNA, 201 bp, Homo sapiens
tcctaatctcttcttcatagtttcaacaaacataaaggtaacaattcaaagcacctgtcgcttcgacaagaagatattttacatatttaaaaaaacagataacaattttaaaatacttgctataagaataaaattgtatttaataagtagaactaaaattttgactgatgttgcaatagatttggtgggggctttttttgt

SEQ ID NO: 34878 - DNA, 201 bp, Homo sapiens
acatgtagtagacactctgtgtttattgagtgactcaatatgttttattacaattacacacacacacacacacacaaaacccatctgtcatggtagaccasttgctgcctgtttgcagctagtttaattaatactggggtgtgcttggtgagagaaaatctcaaccatttaagaggaaagagtttgaacgggttagggaca

SEQ ID NO: 34879 - DNA, 201 bp, Homo sapiens
gtctgggcaggagcaggcagggatcaagcgccggtggaggtcagtgcccacagctgagctgaacagaagtgggaggcagagtgggcctggggaaaggtgtrttacaattcaaggggaaaaaaatatatctgccaccctttggggagggcctccccactgtgtcgcatggatttctctgtcacggggaagagcagcacccag

SEQ ID NO: 34880 - DNA, 201 bp, Homo sapiens
cctaatctcttcttcatagtttcaacaaacataaaggtaacaattcaaagcacctgtcgcttcgacaagaagatattttacatatttaaaaaaacagataacaattttaaaatacttgctataagaataaaattgtatttaataagtagaactaaaattttgactgatgttgcaatagatttggtgggggctttttttgtg

SEQ ID NO: 34881 - DNA, 201 bp, Homo sapiens
ctaatctcttcttcatagtttcaacaaacataaaggtaacaattcaaagcacctgtcgcttcgacaagaagatattttacatatttaaaaaaacagataacaattttaaaatacttgctataagaataaaattgtatttaataagtagaactaaaattttgactgatgttgcaatagatttggtgggggctttttttgtgg

SEQ ID NO: 34882 - DNA, 201 bp, Homo sapiens
caaggatgccctctctcaccactcctattcaacatagtattggaacttctggccagggcaatcaggcaagagaaagcaataaagtacattcaaacaagagragaggaagtcaaattgtctctgtttgcagatgacatgattgtatatttagaaaactccatcatctcagcccaaaatctccttaagctgacaagcaacttc

SEQ ID NO: 34883 - DNA, 201 bp, Homo sapiens
aggggaaaaaaatatatctgccaccctttggggagggcctccccactgtgtcgcatggatttctctgtcacggggaagagcagcacccagggaaaaagagytttgtgtgcccatgacacattcctattttgttgtctctggcatttctgggcattgtttctgctgaagtgacagaagagagaaaaagctgatcaaagctaa

SEQ ID NO: 34884 - DNA, 201 bp, Homo sapiens
ctctgtcacggggaagagcagcacccagggaaaaagagctttgtgtgcccatgacacattcctattttgttgtctctggcatttctgggcattgtttctgmtgaagtgacagaagagagaaaaagctgatcaaagctaaatgacagagcaaaggggttgacagggagtgtcttttcaaatacacagggacattcaccaaga

SEQ ID NO: 34885 - DNA, 201 bp, Homo sapiens
atttttcaataaatgattatattctgaatacttggaaaacactctcttcacaaaattgttctttaattgggtctctacaggcctgacctcagttgttccarggtaaagaatttgggcagtgcccacacccacgctgttggataacatttcttcaccataccagtgagggtgaatgtgtacacgcccagcttcctgcctgtt

SEQ ID NO: 34886 - DNA, 201 bp, Homo sapiens
ctctccacacccagagagactgaactggtttctgctcctcagagagtttgcacagagactctgaggaagcagtcacctcaggcctctccatcctagagacrgcagaaggacaaacatctcctgctggcacaaggtagggggtgggggatggctggtgttccaaacacccgtgcagagggaacgtgtgcatgtttgggagtg

SEQ ID NO: 34887 - DNA, 201 bp, Homo sapiens
ttcttcaccataccagtgagggtgaatgtgtacacgcccagcttcctgcctgttactctccacagtatgcgaagaatatccctgacttctagccctgtgcrccttcttttgtttctgctgttgctactaatagccttggagatcatggttggtgagtgtcctgagcacaagaactggctgaggacaaggaggagggagaaa

SEQ ID NO: 34888 - DNA, 201 bp, Homo sapiens
gcagtcacctcaggcctctccatcctagagacggcagaaggacaaacatctcctgctggcacaaggtagggggtgggggatggctggtgttccaaacaccmgtgcagagggaacgtgtgcatgtttgggagtgaaggaggaaagcaggggctcgagtggtgagagaaccaggggcagataatgaagtaaaagtggggttgg

SEQ ID NO: 34889 - DNA, 201 bp, Homo sapiens
ggctgaggacaaggaggagggagaaaggtagggggtaggcgaatggggcttcatgcaggcttcagacaagtgggtgcctgctcttaaggatgacgtgaggragaggatccctgggatgttacacccagttcatgggagaccacagcctgaggccctaggcaaggcactggctcacagagggcagttctacaatgctacccc

SEQ ID NO: 34890 - DNA, 201 bp, Homo sapiens
aggatccctgggatgttacacccagttcatgggagaccacagcctgaggccctaggcaaggcactggctcacagagggcagttctacaatgctaccccccrccttctactccaggtcactttcctgaacatctgggaccccacaggaattcagcgtgtgtcctgtgataaatgcctctttttcctttctattgaatgtcat

SEQ ID NO: 34891 - DNA, 201 bp, Homo sapiens
gcctgaggccctaggcaaggcactggctcacagagggcagttctacaatgctaccccccgccttctactccaggtcactttcctgaacatctgggaccccrcaggaattcagcgtgtgtcctgtgataaatgcctctttttcctttctattgaatgtcatgtgtgttcagctagagtttaagtctcaggaggtcatacact

SEQ ID NO: 34892 - DNA, 201 bp, Homo sapiens
acctattggaggatgatggacttctcaaagagtggaggatgatggctttgtgtttggattgcagatccttccactctgcaagtcgagatgttttgtcaacrtgaagcagaacggtgcactggtgcatcctggcagttcgccaccaatggagagaaatccctcctctttgacgcaatgaacatgacctggacagtaattaat

SEQ ID NO: 34893 - DNA, 201 bp, Homo sapiens
ggaaaagcaaaagaggcagggaggagaagggaagaggaaactggaggaaaggagaaggagctcacataacctccaaccatcctgctcacaccagagggggktttttttgcaggggcagcagggacaggagaggagagagagtttattcaaagttaattttgtttttaaatgtcttcttttatttttcaataaatgattata

SEQ ID NO: 34894 - DNA, 201 bp, Homo sapiens
atgatggctttgtgtttggattgcagatccttccactctgcaagtcgagatgttttgtcaacgtgaagcagaacggtgcactggtgcatcctggcagttcrccaccaatggagagaaatccctcctctttgacgcaatgaacatgacctggacagtaattaatcatgaagccagtaagatcaaggagacatggaagaaaga

SEQ ID NO: 34895 - DNA, 201 bp, Homo sapiens
agcccaaaatctccttaagctgacaagcaacttcagcaaagtctcaggatacaaaatcaatgtgcaaaaatcacaagcattcctatgcaacaataacagacaaacagacagccaaatcatgagtgaagtcccattcacaattgctacaaagagaataaaatacctaggaatacaacttacaagggatgtaaaggacctctt

SEQ ID NO: 34896 - DNA, 201 bp, Homo sapiens
tggctttgtgtttggattgcagatccttccactctgcaagtcgagatgttttgtcaacgtgaagcagaacggtgcactggtgcatcctggcagttcgccaycaatggagagaaatccctcctctttgacgcaatgaacatgacctggacagtaattaatcatgaagccagtaagatcaaggagacatggaagaaagacaga

SEQ ID NO: 34897 - DNA, 201 bp, Homo sapiens
gcccaaaatctccttaagctgacaagcaacttcagcaaagtctcaggatacaaaatcaatgtgcaaaaatcacaagcattcctatgcaacaataacagacaaacagacagccaaatcatgagtgaagtcccattcacaattgctacaaagagaataaaatacctaggaatacaacttacaagggatgtaaaggacctcttc

SEQ ID NO: 34898 - DNA, 201 bp, Homo sapiens
cccaaaatctccttaagctgacaagcaacttcagcaaagtctcaggatacaaaatcaatgtgcaaaaatcacaagcattcctatgcaacaataacagacaaacagacagccaaatcatgagtgaagtcccattcacaattgctacaaagagaataaaatacctaggaatacaacttacaagggatgtaaaggacctcttca

SEQ ID NO: 34899 - DNA, 201 bp, Homo sapiens
ttctactgatggtgaatccagtactgaattggatccaattctggacgagttaccctgtcctagaatcactcacacgtgacagttgacaggtggccccaccbggtttgcatggtggacgggtgttctgctaggccggcctctccacacccagagagactgaactggtttctgctcctcagagagtttgcacagagactctga

SEQ ID NO: 34900 - DNA, 201 bp, Homo sapiens
agtgattatgtggggcaccatgtgttcctggggaaagcaggggctaaggaaagcatatttttatgctttttttttttatgtgacagggcttgtgctttttyttctttttttttttttttttttagtgtcaccagtaaatgcttcagatatccactggtcttcttctagtctaccagatagatggatcatcctgggggcatt

SEQ ID NO: 34901 - DNA, 201 bp, Homo sapiens
acttcagcaaagtctcaggatacaaaatcaatgtgcaaaaatcacaagcattcctatgcaacaataacagacaaacagacagccaaatcatgagtgaagtmccattcacaattgctacaaagagaataaaatacctaggaatacaacttacaagggatgtaaaggacctcttcaaggagatctacaaaccactgctcaagg

SEQ ID NO: 34902 - DNA, 201 bp, Homo sapiens
aaagtctcaggatacaaaatcaatgtgcaaaaatcacaagcattcctatgcaacaataacagacaaacagacagccaaatcatgagtgaagtcccattcamaattgctacaaagagaataaaatacctaggaatacaacttacaagggatgtaaaggacctcttcaaggagatctacaaaccactgctcaaggaaataaga

SEQ ID NO: 34903 - DNA, 201 bp, Homo sapiens
catcactggtcgttagagaaatgcaaatcaaaaccacaatgagataccatctcacgccagttagaatgacgttcattaaaaagtcaggaaataacagatgytggagaggttgtggaaaaatagaaacacttttacactgttggtgggagtgtagattagttcaaacattgtggaagacagtgtggcaattccttacggatc

SEQ ID NO: 34904 - DNA, 201 bp, Homo sapiens
gttgatgggtgcagcaaactaccagggcacgtatatacctatgtaacaaaactacacgttctgcacatgtaacccaaaacttaaagtataataaaaaaaawtttttttttgtagagatggagtcttactatgttgcccaggctggtcttgaactcccggcctcaagtgatcctcctgcctcatcctcccaaagtgctggga

SEQ ID NO: 34905 - DNA, 201 bp, Homo sapiens
cccagggcctggtagagtggctgtcacatgagccagtgattatgtggggcaccatgtgttcctggggaaagcaggggctaaggaaagcatatttttatgctttttttttttatgtgacagggcttgtgcttttttttctttttttttttttttttttagtgtcaccagtaaatgcttcagatatccactggtcttcttcta

SEQ ID NO: 34906 - DNA, 201 bp, Homo sapiens; identical to SEQ ID NO: 7211

SEQ ID NO: 34907 - DNA, 201 bp, Homo sapiens
tgaataaaaatcttttccttcagtacaacagtgacaacaacatggtcaaacctctgggcctcctggggaagaaggtaaatgccaccagcacttggggagarttgacccaaacgctgggagaagtggggcgagacctcaggatgctcctttgtgacatcaaaccccagataaagaccagtggtaagtgtggaatggggtggg

SEQ ID NO: 34908 - DNA, 201 bp, Homo sapiens
attccttacggatctagaacgagaaataccatttgactcagtgatcccattactgggtatatacccaaaggattataaatcatgctgctataaagacacaygcacacgtatgtttattgtggcactattcacaatagcaaaacttgtccatcaatgatagattaagaaaatgtggcacgtatacaccatggaacactatgc

SEQ ID NO: 34909 - DNA, 201 bp, Homo sapiens
gaagggaggcaaaagaacagttttagaagctgggtctgaacagtagggatttaaaggaggtgggacctccatagacacctgggagttcctggcctctagcytcatcctggtaaccgagtcggctgctgaagggcttcctgtctgggcaggagcaggcagggatcaagcgccggtggaggtcagtgcccacagctgagctga

SEQ ID NO: 34910 - DNA, 201 bp, Homo sapiens
aaaagaacagttttagaagctgggtctgaacagtagggatttaaaggaggtgggacctccatagacacctgggagttcctggcctctagcctcatcctggyaaccgagtcggctgctgaagggcttcctgtctgggcaggagcaggcagggatcaagcgccggtggaggtcagtgcccacagctgagctgaacagaagtgg

SEQ ID NO: 34911 - DNA, 201 bp, Homo sapiens
ctgtgaccccatccggagactggtctatctaaagaccaggacattgaccagcagcccagtgctctgctccacggcctctgtcaggcaggacggagctggakcccaggcagagataaggacaggggaagatggcccttgtcagccagggatgttctgtcctgctgggcatgcggcctctctcacagagaacctacgtgatct

SEQ ID NO: 34912 - DNA, 201 bp, Homo sapiens
ttggaataaagtacggttttcaaacaacctgatatagcagaactgactgtataaattatgtgagcacagtgcaagtaattctttgtttgtttgtttgtttktttgagacagagtctcactctatctcccaggctggagtgtagtggtgcgatcccggctcactgcaacctcgatctcccaggctcaagcgattcccctgcc

SEQ ID NO: 34913 - DNA, 201 bp, Homo sapiens
ggctgaatgagtctcggggactgtctctgctttgcaagtgggccctgaggtgaacagggacctttccaaattaatgcatccacagcggtttggcaaagtcrggctttaaaccagggtcactctccaggggttgcctatgtgatgggtggtctgatggacagaaacacagagggtgggcaagacacaattttgggtggggca

SEQ ID NO: 34914 - DNA, 201 bp, Homo sapiens
ccaaacgctgggagaagtggggcgagacctcaggatgctcctttgtgacatcaaaccccagataaagaccagtggtaagtgtggaatggggtgggcaaacrgaggcaggcagtaagagaggggagggaagaacacagatggggaggggctttaggtatatctgtgtattgatcattggcccaaccatagaggcacatggga

SEQ ID NO: 34915 - DNA, 201 bp, Homo sapiens
ttggaaaacactctcttcacaaaattgttctttaattgggtctctacaggcctgacctcagttgttccagggtaaagaatttgggcagtgcccacacccaygctgttggataacatttcttcaccataccagtgagggtgaatgtgtacacgcccagcttcctgcctgttactctccacagtatgcgaagaatatccctga

SEQ ID NO: 34916 - DNA, 201 bp, Homo sapiens
ttttttttttttagtgtcaccagtaaatgcttcagatatccactggtcttcttctagtctaccagatagatggatcatcctgggggcattcatcctgttasttttaatgggaattgttctcatctgtgtctggtggcaaaatggtgagtggcaggctggtctctggcccttgaggacgtcttagtctggtaaggactcaag

SEQ ID NO: 34917 - DNA, 201 bp, Homo sapiens
cagtgcccacacccacgctgttggataacatttcttcaccataccagtgagggtgaatgtgtacacgcccagcttcctgcctgttactctccacagtatgygaagaatatccctgacttctagccctgtgcgccttcttttgtttctgctgttgctactaatagccttggagatcatggttggtgagtgtcctgagcacaa

SEQ ID NO: 34918 - DNA, 201 bp, Homo sapiens
tgtgctccttcctgtgagtcatcagacttgtagaaaatattggccctgctaaggagctactcagtggtcatatcacacatatgcacgcacacacacacaarcacccatgcacacacacacacacacacacaaacacacacatacactctgttcttggcccacccccgctggtgtccccacagcagcagtattggcagggcg

SEQ ID NO: 34919 - DNA, 201 bp, Homo sapiens
ggagaggagagagagtttattcaaagttaattttgtttttaaatgtcttcttttatttttcaataaatgattatattctgaatacttggaaaacactctcktcacaaaattgttctttaattgggtctctacaggcctgacctcagttgttccagggtaaagaatttgggcagtgcccacacccacgctgttggataacat

SEQ ID NO: 34920 - DNA, 201 bp, Homo sapiens
ttgacccaaacgctgggagaagtggggcgagacctcaggatgctcctttgtgacatcaaaccccagataaagaccagtggtaagtgtggaatggggtgggsaaacagaggcaggcagtaagagaggggagggaagaacacagatggggaggggctttaggtatatctgtgtattgatcattggcccaaccatagaggcaca

SEQ ID NO: 34921 - DNA, 201 bp, Homo sapiens
cgagttaccctgtcctagaatcactcacacgtgacagttgacaggtggccccacccggtttgcatggtggacgggtgttctgctaggccggcctctccacrcccagagagactgaactggtttctgctcctcagagagtttgcacagagactctgaggaagcagtcacctcaggcctctccatcctagagacggcagaagg

SEQ ID NO: 34922 - DNA, 201 bp, Homo sapiens
tcctattcaacatagtattggaacttctggccagggcaatcaggcaagagaaagcaataaagtacattcaaacaagagaagaggaagtcaaattgtctctrtttgcagatgacatgattgtatatttagaaaactccatcatctcagcccaaaatctccttaagctgacaagcaacttcagcaaagtctcaggatacaaaa

SEQ ID NO: 34923 - DNA, 201 bp, Homo sapiens
ggataaggcagggaggacggggtggctctgcgggtcctctgcctccacaccaagcactcagggatccgtgcctccttccagtctggagtcccaatcgcccytctctccaatttgggggacagggatttctccttgttctcctgccctaactccttctttccgacttctcttgtcccattctccctcagatcctcccttccg

SEQ ID NO: 34924 - DNA, 201 bp, Homo sapiens; identical to SEQ ID NO: 7232

SEQ ID NO: 34925 - DNA, 201 bp, Homo sapiens
taattggggcggggggggggggcggcgggggaggagggaactggcgcgcggcttggtttccattagagacgcaaagtttctgctccgggaggaggcggcgrcgccgcgggctcgtcgcctgggggagcagaagcgggtgggaggtgcgggtggccttggcctcagccctggtgcgcgggggccgggggtggtgaccctcct

SEQ ID NO: 34926 - DNA, 201 bp, Homo sapiens
ggcggcatagcgcacagcgcgccttagcagcagcagcagcagcagcagcatcggaggtacccccgccgtcgcagcccccgcgctggtgcagccaccctcgytccctctgctcttcctcccttcgctcgcaccatggtaggtcgggagtggcaaatgccggcgtagcagctgcccgagatttcttcccagatttctagttgt

SEQ ID NO: 34927 - DNA, 201 bp, Homo sapiens
attagagacgcaaagtttctgctccgggaggaggcggcggcgccgcgggctcgtcgcctgggggagcagaagcgggtgggaggtgcgggtggccttggcckcagccctggtgcgcgggggccgggggtggtgaccctcctggccgaggaggggcggcgtccagacgcccgctcgggggccgccttcccccccacgcctgcc

SEQ ID NO: 34928 - DNA, 201 bp, Homo sapiens
gccattactgcctcgaacgaagtgtgtttattaagaacagttcttatgtcattcttaaggtaggtagggttaatactctccagcaaatttagtagatactstttgccagaaaagagaggagtatatatagtttgataattattgtgtagttttctgtgtacttaatttttgcagttttgtaacacttcatttgtaagatgg

SEQ ID NO: 34929 - DNA, 201 bp, Homo sapiens
gccagtactttatagatgaggtgaaaggaagtaaaactaaggatgcccacatgttaaactctggagaatttgaccatgtttcacaatgtgcaaagtttgcrtatgattaattgtactgagcctgctactcagcggtttagtttacaattcttatgccatgggtctttcagtaatctgccacgaaagcttgtgctcgctatc

SEQ ID NO: 34930 - DNA, 201 bp, Homo sapiens
tagtgttttggaaagaaaaggttgtccatagttctctagtttgctaagatgatcagctacccaggaacgtggagtaacttcctcttgtttgtgggagcccygggaatctgtgcctggggaggggagaagtctgttaggctcttggattgtgtggaagaaggagaagttgtgccaggctacagaatcctgtgtttgcactga

SEQ ID NO: 34931 - DNA, 201 bp, Homo sapiens
tttattctatttactttcattaaatgaccgtgctacaggtttcaaaggattttaagattgatttttgaaagatcacaatattaaaagtataactggaaaayctatgttgaaatcaaccaaacatgtcgtggactgaatgataaccttttctttcttcatataggctgatcagctgaccgaagaacagattgctggtaagtt

SEQ ID NO: 34932 - DNA, 201 bp, Homo sapiens
ggtagaaagaaagatccgtttataatttgtaaaaacaaattttcacccagaatcaatatattggaacaccattcctactgttaaagttttcacttaagagyataaacttcatcagctttctattaggacttattttgtaattggcttcttaggcatccttctttaaaagagaaatccacgttagctctccttgaggtctcg

SEQ ID NO: 34933 - DNA, 201 bp, Homo sapiens
cttccagtccgcagagagatgccctccacgtttctgctttctctgcagcctctagattgccagatgcgactgtgcgcctcgctgggtgtgttttccacagmcccttcctcctcggcgtgcagggctgacatcaccgactgcgtttctggtttggcgggtggggagatggttccccgcagggttctggtacacctttgcccc

SEQ ID NO: 34934 - DNA, 201 bp, Homo sapiens
gacctgagtgatttccctaactcagggatggcagtcgggggcgctttcttccctcggagtggaaagattcagcctgcggagtggtgtatgctatttttctyttgaactgtacagcccttcatgacccttccatgggcttgaatccagatgtgcagtttcctttgtataattaaatactatcctgggcactgatgatgagtt

SEQ ID NO: 34935 - DNA, 201 bp, Homo sapiens; identical to SEQ ID NO: 7236

SEQ ID NO: 34936 - DNA, 201 bp, Homo sapiens; identical to SEQ ID NO: 7238

SEQ ID NO: 34937 - DNA, 201 bp, Homo sapiens; identical to SEQ ID NO: 7239

SEQ ID NO: 34938 - DNA, 201 bp, Homo sapiens; identical to SEQ ID NO: 7241

SEQ ID NO: 34939 - DNA, 201 bp, Homo sapiens
aagttgcccttcaccatggctatttgaaaaggagatgtacttggacgtttctgtaaatcttgagataaactgtttggagatttaaccacctctctgatggrggaccaactctatggaaattgtaaatacgttttatttataaacctggcactgtattcaataaacatttctgcagcctttcatctctaactgcgaactgtg

SEQ ID NO: 34940 - DNA, 201 bp, Homo sapiens; identical to SEQ ID NO: 7243

SEQ ID NO: 34941 - DNA, 201 bp, Homo sapiens
gcactgatgatgagtttgaaattatgtgaaattgccctgtgaagtgtttgaacgttttagacctgcagatgattgaacctagtaagatagtctgccccttygtcctagtacatgtttaccgttccgtacagtggttctgaaatgattactgcagagcagcgttaatggagtgcttactttacatgagctttttgtttttta

SEQ ID NO: 34942 - DNA, 201 bp, Homo sapiens
atgtcgtggactgaatgataaccttttctttcttcatataggctgatcagctgaccgaagaacagattgctggtaagttgacaactccaaggagtccccaraaggccagaactaggcactgactcagttttggtgactcctctgttcctccccgctacagtctgggcagttttctaagaatttatttaaataagaacagta

SEQ ID NO: 34943 - DNA, 201 bp, Homo sapiens; identical to SEQ ID NO: 7246

SEQ ID NO: 34944 - DNA, 201 bp, Homo sapiens; identical to SEQ ID NO: 7244

SEQ ID NO: 34945 - DNA, 201 bp, Homo sapiens
aacttgaagtgagcagatgttgtcacttccttgtaatcctttgttaaaatagcataaggagttttctttattctatttactttcattaaatgaccgtgctrcaggtttcaaaggattttaagattgatttttgaaagatcacaatattaaaagtataactggaaaatctatgttgaaatcaaccaaacatgtcgtggactg

SEQ ID NO: 34946 - DNA, 201 bp, Homo sapiens
caataagatgggaattttagatgacaaccaagatgataccttggttcatgtcaagagcgggacagctgaggaaagtggggtgggatgcaagtacaatttargaccttggcattgaagccttccccttagtcaacactggcccagaccctggttcttagatgtagcaggagaggctgcctgcttctgccccctttgcttcca

SEQ ID NO: 34947 - DNA, 201 bp, Homo sapiens
ataagcatactattctttagtatgtacaattacatgttgtatatatacgaatatattacaatcttcttactccttataactttttctcctcacgatataayttatgtaccataaaattcaccttttaaaaatacacaatttggtggtttttagtatattgacagggttgtacaaccatcaccactatataattttagaaca

SEQ ID NO: 34948 - DNA, 201 bp, Homo sapiens
gtgtcgtggacgccgtgccgttactcgtagtcaggcggcggcgcaggcggcggcggcggcatagcgcacagcgcgccttagcagcagcagcagcagcagcrgcatcggaggtacccccgccgtcgcagcccccgcgctggtgcagccaccctcgctccctctgctcttcctcccttcgctcgcaccatggtaggtcgggag

SEQ ID NO: 34949 - DNA, 201 bp, Homo sapiens
aatatattatctaaattagagcccctgagcaaggactcaagctctattttatgccccatccctgactcacagtaagatcctgggcaagtcacttgaccttyttatatttcagagtgtcaaactgtgaaaagcatgtccataaaactgtgcaagcatgacctcattataaacccgatgaacttgaaagcaaagatgtgcttt

SEQ ID NO: 34950 - DNA, 201 bp, Homo sapiens
attggatttagtcccttgaacctgggaggcaggggttgtagtgagctgagattgcaccactgcactccaatctcggtgacagagcgagactccattgtttaaaaaaaaaaaaagattggatttaggactaatttaagcatgttccagcttagccgccttgaaacctttgggaatattgtggtgtgtggcactgtttattgg

SEQ ID NO: 34951 - DNA, 201 bp, Homo sapiens
tgatgggccttgcgtccatcctgcttagtgtctagaatgttttctgcatgggatcactattgttttcttcctgcttggtgcgacctagagctcaaatctatttttttttttttttttggagacggagtctcgccctgtcgcccaggctggagtggcactggcgcgatctcggctcactgcaacctctgcctcttgggttcc

SEQ ID NO: 34952 - DNA, 201 bp, Homo sapiens
tgcagttttgtaacacttcatttgtaagatggtaccattttttcctggcttctgaatcataggatagtttgacccagggcattagccattgtaatggtagscttttaacaaataactgcctaatttaaaggattggaaagcatttgttacatggaaatgaagttggtggcgtacccagttgctgtatctttattttttcta

SEQ ID NO: 34953 - DNA, 201 bp, Homo sapiens
gttagctctccttgaggtctcgagttccctcggctggaggcacaggttcagtggagaccaaataatgcaggtgaattaccttcgtggccattactgcctcsaacgaagtgtgtttattaagaacagttcttatgtcattcttaaggtaggtagggttaatactctccagcaaatttagtagatactctttgccagaaaaga

SEQ ID NO: 34954 - DNA, 201 bp, Homo sapiens
tcttgaggggggaggtgaaattaaatagccatagaaagtgctttttaacaaacttactgtgtttaaagaggaggaggaacccccagatgaagtaggtgacragcactcttagaagttaccataaaagtgagtacagtgtgagctgtagatgtgtttgctgcagaggagcatgtgaggtttggaggcggatgtgtggtgact

SEQ ID NO: 34955 - DNA, 201 bp, Homo sapiens
agccttttaacaaataactgcctaatttaaaggattggaaagcatttgttacatggaaatgaagttggtggcgtacccagttgctgtatctttattttttstacttaattatttctcataaaatggatataaaagcctgttaatccaacccaatgccattatgtaacgccagtttggagatttcgagggcctggagcagtg

SEQ ID NO: 34956 - DNA, 201 bp, Homo sapiens; identical to SEQ ID NO: 7235

SEQ ID NO: 34957 - DNA, 201 bp, Homo sapiens; identical to SEQ ID NO: 7237

SEQ ID NO: 34958 - DNA, 201 bp, Homo sapiens; identical to SEQ ID NO: 7240

SEQ ID NO: 34959 - DNA, 201 bp, Homo sapiens
cggggcgcagactcgcgctccggcagtggtgctgggagtgtcgtggacgccgtgccgttactcgtagtcaggcggcggcgcaggcggcggcggcggcatakcgcacagcgcgccttagcagcagcagcagcagcagcagcatcggaggtacccccgccgtcgcagcccccgcgctggtgcagccaccctcgctccctctgc

SEQ ID NO: 34960 - DNA, 201 bp, Homo sapiens; identical to SEQ ID NO: 7245

SEQ ID NO: 34961 - DNA, 201 bp, Homo sapiens
cggctccgccgcggcggagggatacggcgcaccatatatatatcgcggggcgcagactcgcgctccggcagtggtgctgggagtgtcgtggacgccgtgcygttactcgtagtcaggcggcggcgcaggcggcggcggcggcatagcgcacagcgcgccttagcagcagcagcagcagcagcagcatcggaggtacccccg

SEQ ID NO: 34962 - DNA, 201 bp, Homo sapiens; identical to SEQ ID NO: 7249

SEQ ID NO: 34963 - DNA, 201 bp, Homo sapiens
agtctctgggcttcttagagcaaaagttttaaaaccatcatttatatgtttaatatatttttatctatttctagatttattttaaaggcagtaaaataatmtaacaggctcctgggtacccatggtgtttattatattatgaagaaataaaatattactcatacagtcgaaaccctacaattaaattcctttccctccctt

SEQ ID NO: 34964 - DNA, 201 bp, Homo sapiens
tcgacgaggtgagagctgcagcagaatgtcactgctctgataaaaggacaactaaaagccaaatatgattattttcagaagaatattttgcagtaaatgtyattcatgtaataaatttattctttaatctatcagtgtattagcgttccctccaggaagtagtttttaaactcatctcaataattactttcatgtttaatt

SEQ ID NO: 34965 - DNA, 201 bp, Homo sapiens
tactaaacaacagtttcatatgatatatcttggacattctgtgaaatagtaagttgctgatgatagagaaaaaacatggctttgtgatcagttactagccrtattcttgaaggttacagacagagcggggtaggctgcagcctacagacagaaagtggggctgtaggtgtagggtcctggctgcacagagtgtgtgatgga

SEQ ID NO: 34966 - DNA, 201 bp, Homo sapiens
ctaatccatttattgctctttaaagattaccatgtactcctttttcttattataaaatattgcatattcatattaaaatctggaaaattcatagaagcagmaataagtaatctaatgaatcaaaaacaatgtcaagtagtgtttcttaatcattacaattatttatgaattttggttttaatttttcaacatttggtctac

SEQ ID NO: 34967 - DNA, 201 bp, Homo sapiens
aggtccttgagagctcttagctcatcatcctttaagtatagtttggagtattcttcccaggctgtactacttcatgcatttttttttttttttttttttttgcctattgtatttagagtttttcctgaaatgaatttctcactatgtatttgactatcaagaagagttgtatcatctgcaagtttgaggtttcacttgaaa

SEQ ID NO: 34968 - DNA, 201 bp, Homo sapiens
tacataccaggaaatgtcctgaactctttacacatgattcattaattttctgaattacacttgtagataggaactattgttatcctcattttatagacaaagacacagagatagaggttaagtatctttactggggccacacagctaggaattggcagaaccaggatttaggcactaaaatctgtttatttaaccactagc

SEQ ID NO: 34969 - DNA, 201 bp, Homo sapiens
tatttcttcatcattcagtcttggtcgattctatgtgtctagcctttatcaacttcttgtaggttattgtatttattggtgtataattgttcatagcagtstctatgatccttttttatttctgttgcaatgtctcctctttaatttataattttatttagttgaatcctcattccttttttcttagtttggctgaaggtt

SEQ ID NO: 34970 - DNA, 201 bp, Homo sapiens
gtcttccttgggttgtgctggctattatcttcttgctagggaacaaaccatgctcctgagagcttagattgcaggaatcaacagcaaacacttaaagcacmttttataaagaatgtagctgatggcttttgaatagaagaggcaggcaaggacaccctgctaattgttccttgcaatgattttccttagtggctgtttcat

SEQ ID NO: 34971 - DNA, 201 bp, Homo sapiens
tgtataattttatgcgtagagataagagatgagtactttcgcagaaacaaatgaataattatataccaacatggagaacttaagctcataggtgaatgtgrgaatatggaggagaatgaaaatcattgccaggtgagtgatcaaagagtgcattctagaaaaggtggtacctgtacaggggtttggaggatgcattggtat

SEQ ID NO: 34972 - DNA, 201 bp, Homo sapiens
aagcgttcatgcagaatggctactgagacgtttagaaaccatgatcgagacaaatgagggatcatttatttggacaaactgagaacttttactaatctaayagccagatattgtagtcatggtctctgaggagaaatgcaaactgaatgctctcatttgaatcttagaatgctttagaatcctggtttcacatgtcttcta

SEQ ID NO: 34973 - DNA, 201 bp, Homo sapiens
tctgttatcccagcttctaagctaaccagactcatcattttggcctttcatgtatgcttttcctatggccaaaacgtccacaaattactaataaatgctgrcaaggagagaggttaaaaccaggaagccatgccttttagctgacaaaacattcattgaaatgctatctgggtgaagcactgagaaattaatcatctgaat

SEQ ID NO: 34974 - DNA, 201 bp, Homo sapiens
aagtaggtaagcagagtccaaaatgtagggtcattttcaatggcagagaggaataggagagtcaataagaagcaaatgctcaaggagcttgagtagagackggaataggcatctctttattatcttattggctgatttatacttcttgtaaaataattagcttaagctaattatctaagaaacaagaatctctcctaggca

SEQ ID NO: 34975 - DNA, 201 bp, Homo sapiens
ggggatagttacagaggcaagagctcccacccagcgccttctgagcttcttcctctgattgatgtactgtaagagaccgtcaatggctaagttcccgtcaytgatgcggatccctgcccacatgtcccacagctcactctcacagagccaagtacacggcccaaagactggggtgagacctcgagagaatacaaagaagtt

SEQ ID NO: 34976 - DNA, 201 bp, Homo sapiens
ccaattttgcttttaccaagccttagtgaaaagtgaatgaattctaacaagaagactcaaagacactggtgctccccctgtgtctcccttcacttattctrcatggtcagcacctcttcaaaagaccaataataatggtcccctacaagaagtatacaattgctcctctgatgtgaaagcatatgaagaaaataagtgtcc

SEQ ID NO: 34977 - DNA, 201 bp, Homo sapiens
gggtcccatcagtcttccaggtgtaaaccattagattcctactagatccctatctttcttcccgttactatatcagtgagcaaggtcttgattctatttcrttttttgtcacaattaattattattaatagaaaataaacacttattccagtttcaaagttgttataattgaagttgctaattttaaaaaatgaattttaa

SEQ ID NO: 34978 - DNA, 201 bp, Homo sapiens
aacccccaaatcttaaaatcttagcattatagaggtttatttctcaatgatgcaatgacaaatacaggtccatctggtgactcagggtcccagttgtcctycgcttatgatgtttccaactcaggaaatgccttttatggttgctatggcagaggaagagaggagtggggagctggcacctaggtcttcagtgcttcagct

SEQ ID NO: 34979 - DNA, 201 bp, Homo sapiens
gcttaaaatatattcacattatcttaatttctactgtctccaagtccgactccttaccaaatctgtagacagtcagcttcggtcccttaaatttaaatgtraattcctctaagatcattttcccagttgcacaagctgaagtaatagtcttttgggcctgactcatcccatcctctctggacacaaagaagggcagaaaat

SEQ ID NO: 34980 - DNA, 201 bp, Homo sapiens
tcatattaaaaatagcaaaaatattacttcttcaaaaatgctttatacttcatgtatattactgattttaagtaaaagtacaattaagacaattagccagwcctatttatgagtagctctaattggagcagcttgttgctggaccctattcagtggtagagataaggttgagatggctgaatagttcatctaatttgaaat

SEQ ID NO: 34981 - DNA, 201 bp, Homo sapiens
atcaaggatgcatatgaagtagttaaaggctagatctaaggacatgtggtagaaaagcatgtaattcagaaaaagcctagcttgacccctaagaagggggyggtagtgagagggatcaatgagataaggagttcctgtctgctttctaaacaatgcagtttgaacagagaagtgcctcatctttccttttttccatctatt

SEQ ID NO: 34982 - DNA, 201 bp, Homo sapiens
taattttgcactttagaaaatgtctgcatgtttattagagaagtgaatgctgaaatcagcgaacaaaatgtaaagtgagcaactaagaaatacttataagrgctcacttgtattatttaactgtgtaatcctctatctcatatatatgtaatactttcttcaagttcattatagctcccgggcccagtacatcctagtcca

SEQ ID NO: 34983 - DNA, 201 bp, Homo sapiens
ttatattagctaatcactaaacagaaattttaaaagaagtatttaatattaattctcaagtcttaggagaatatttagctaataattctacagttgactgsagagtttattcattatttaattcataatgtcttttcaatcactttactgtttcttgattcatgaagaatacatgccaagtgtattagtctgttctcacac

SEQ ID NO: 34984 - DNA, 201 bp, Homo sapiens
tatattgttatgagcacaatttctacccagattttgttggttcttttcaaatccatcaagtaaaacagtgtgcgtatgatttgtgaatactgcagttgctrtaatcacaataaaagagggtttcttgcaagaaactatgtaaaacaacttttatgaagaatagctgtccttagccccagataaaaactactgtcagccaca

SEQ ID NO: 34985 - DNA, 201 bp, Homo sapiens
aagcactctatctcggaaatgttcgtggcccacgtcttttccgtcattgtgcatttttgccccatcgctaacacttggcagtgtcagccctttcttatacyccttgtcatcaaactatattcacattttccttttaaggtgaagtgatatgtatactgaaataatcctatattttttaatgttttagtgtatctttttgag

SEQ ID NO: 34986 - DNA, 201 bp, Homo sapiens
cttttcctggtccattaatggatatatgacaagtgatggcaaaaggatagttacagttattaacttaatcattaattggctcagggtatccccaaaaccgyagttggaactgaagtgctacaaaaatgaccattttgttgttatagcttttcttcacataaggaaataaataagcaaaaagagggagtgtcttatctattt

SEQ ID NO: 34987 - DNA, 201 bp, Homo sapiens
gaatagagtatctactgtatgactagaggtatagctaagaaaaaagactatagggagaaattaatattgtaggacaaagcatttaattctagaatgatccyactaaggtaagaccaccgtcatcggttgcaaaattgctgaatcactagggttaatagttacagatcctaaatactcctcacatgttttctttcctcgtta

SEQ ID NO: 34988 - DNA, 201 bp, Homo sapiens
actttaaatacctgcaaagttaacatgtcataacagcaactcaaaaaccattaagtgctaaggagtttgtgttattttccatttaaaggatatacatacgyttctaggacccaaatcctagcaaagtacacttcacatttctttctctacatctctagagtttcatagaagaaagtagccccaaaatgttatccctctaaa

SEQ ID NO: 34989 - DNA, 201 bp, Homo sapiens
atggaaaaattaatgaatttgaagacagaaaatattagacctgataaatcaaaaaggtgactccttaggaatatagattaaaaattaagtgattgtcaagwttcatcaagaaaaataaaggacaaataggcaaagctctaaaagaggtatcactagacaagggaggaaatttaacacataagagatcacttggaaaaactt

SEQ ID NO: 34990 - DNA, 201 bp, Homo sapiens
aacaattctaaacaatcaactttgctgactttagaaaaagcagagttaacttaaagaatgaaaaagatggaaaaattaatgaatttgaagacagaaaatawtagacctgataaatcaaaaaggtgactccttaggaatatagattaaaaattaagtgattgtcaagtttcatcaagaaaaataaaggacaaataggcaaag

SEQ ID NO: 34991 - DNA, 201 bp, Homo sapiens
gagggcaattttaaaagaaggtagtttctcaggtgtttctagtcaaaatgacaaacctacaaagtacatttgcattattttatgtatactttactgatagwgtcctttaaatgttgagttcaagctaatttttcttaatcttcaaaaagtttagggatcaaattgtatcctgcagatttttgttatgctaaatttcatttc

SEQ ID NO: 34992 - DNA, 201 bp, Homo sapiens
tctatagaattaactagattatgctgtttctgataacacaaattcaccccaacacacgaatgacttaattgcaagaggattaaaatagataaggtctacaytgttgttgtttttacccactgaagctcactttttcctctccttgtaattattctcaacttctgtagaattatatttggagaaacacataataaaactagg

SEQ ID NO: 34993 - DNA, 201 bp, Homo sapiens
ctatactgagggcaattttaaaagaaggtagtttctcaggtgtttctagtcaaaatgacaaacctacaaagtacatttgcattattttatgtatactttaytgatagagtcctttaaatgttgagttcaagctaatttttcttaatcttcaaaaagtttagggatcaaattgtatcctgcagatttttgttatgctaaatt

SEQ ID NO: 34994 - DNA, 201 bp, Homo sapiens
actgaatttctctatagaattaactagattatgctgtttctgataacacaaattcaccccaacacacgaatgacttaattgcaagaggattaaaatagatwaggtctacactgttgttgtttttacccactgaagctcactttttcctctccttgtaattattctcaacttctgtagaattatatttggagaaacacataa

SEQ ID NO: 34995 - DNA, 201 bp, Homo sapiens
atcagatgtctgcaccatggttcctgtacagcctgcagaacagagaaccaattaaatatcttttctttataaattacccagcctcagatgtttcttaaaarcagtgcaaaaaatggcttaacactgtgatatttggtattttctagtccattagtgcacatccccccgatgtaggataaatatggtatgaatatttgaata

SEQ ID NO: 34996 - DNA, 201 bp, Homo sapiens
gaagtttgagatcagcctgggaaacatagcaagactctatctctacaaaaaggaaaaatgagtgaaatatctgtatgatagccacataaaagtggaaaacwgaatttctctatagaattaactagattatgctgtttctgataacacaaattcaccccaacacacgaatgacttaattgcaagaggattaaaatagataag

SEQ ID NO: 34997 - DNA, 201 bp, Homo sapiens
aaatcgcatgttgaaatggtattcccagtattggacgtggggactggtgggaggtgattggatcatggggacagatccctcatgaatggtgtagcaccatycccttggtgataagtgagttctcccttagttcccatgagatctggttgtttaaaagaaattgggatctccccctgctctctcttgctcccactccctcca

SEQ ID NO: 34998 - DNA, 201 bp, Homo sapiens
ttccatccaagactatcactaccacttctaaaccacctccagccacacaaaaaacacacactatgcttgagtcattccaaattacacaccttcctctaaayattagtgtgaaattaggacatttgggaaatgtgattgatatgatttgcatgtttgcccccttcaaatcgcatgttgaaatggtattcccagtattggacg

SEQ ID NO: 34999 - DNA, 201 bp, Homo sapiens
aaaaatccaagcaaagcaggtaacaagaggacttgattccagactgtgaacagatttgaggcagggtcagaaagccaccctgaaatttcagtgctataaamctgtagtgggaactctataggaatactaatttctcccttcatcaacaaagatattatactggtcctgtgaagaggcttagtcacttcccagtttatgtat

SEQ ID NO: 35000 - DNA, 201 bp, Homo sapiens
agtgagaagctaaaatggaagggagacgataaatagctcagcaaggtttttagggaagcagaaatgactcagatttgaaatataggtgacagaattagccytaaggaggagaaagaaaagatcttttgagactataagaaaggaggtgagagttgatgtagccataaaaaatacagagatgaaagggtggggagttaaaag

SEQ ID NO: 35001 - DNA, 201 bp, Homo sapiens
agatgagattgtgtgtgatttttaaaaattatatttattctacctaataagcatttattacttttataacctgagagataaacattattgaaaaagaagakcatggatttaaagcgaggatgtgagactgtggctgttacatatttttttggtttggaccttggttaagaaggcaaagagggatagagattgtgggacata

SEQ ID NO: 35002 - DNA, 201 bp, Homo sapiens
taactaccaggtttgcacgttgacttctttatgcttcatttggattttctgaggctttaacgttttccgtttttaagactaagctcaagggtcaactcttycatgaaaattaattgctatttatgtttccatctataagaagagtgaaataaacaatgaaatctaatgacactgaaaagtgctttcaatgtactgttgagt

SEQ ID NO: 35003 - DNA, 201 bp, Homo sapiens
tatcctgtaccaaatggtatgccaggggtgaggatacaaagatagaatagaactttttagtacaatgtgaagaaagaaacataaagaaataagactgctgragtattttaactaccaggtttgcacgttgacttctttatgcttcatttggattttctgaggctttaacgttttccgtttttaagactaagctcaagggtc

SEQ ID NO: 35004 - DNA, 201 bp, Homo sapiens
cggctaattttgtatttttagtagagacgaggtttctccatgttggttaggctggtcccgaactccagacctcagttgatccaactgcctcggcctcccaragtgctgggattacagacatgagccactgcgcccggccgactctggtgaatttctcggatgtaagttgttatggtatgtgtgtaggagtggggagtatag

SEQ ID NO: 35005 - DNA, 201 bp, Homo sapiens
gaatttccgagaaaaagaaggtgactgcaaaggatgcactgtcaggttagttgagatgagaactctcccagggtctgtcctgtgcataataaaagcttcgwttttattgcataatattctattatcatgtggatgatgtggagcaggtttgaaaggattatactcagaggtggaattaccacaaaactaatgaatcttcaa

SEQ ID NO: 35006 - DNA, 201 bp, Homo sapiens
tgtcacatactagacaaagatgatttgttttcattgttctgaatgtatgtgagatctgtaataacatcctttcatcacagatgagaaaatattaactaacytgcccaaaatcatgtactacaaataacaggaccaggtattaaatgagatgatatatttgacttaaatacctccatctatgcacagccaatagattattct

SEQ ID NO: 35007 - DNA, 201 bp, Homo sapiens
tacttacgtagcagagctgtttagtagattaatataattatcctcagtttgtagaaggaaaatatgcccagcaacttgtcaaggacaaacaaaaattccartgcttattttagaattagaaattaaattacggtcctgctcttgactttgtagatgctaactatcacctcttttggacttttatatatttatctttcataa

SEQ ID NO: 35008 - DNA, 201 bp, Homo sapiens
ctctttgagaggatctcactttggcaaacacttgaagatgacgtgggagtgatttgtgcagttatcagggggaagagtactctctgtacagggagcaggcytatgaggatctaagcttggagcatggtgagaaggctcagaggagaaatgggaaactggaacacatagcattgttgaccttaattttaaagattttgcctt

SEQ ID NO: 35009 - DNA, 201 bp, Homo sapiens
tgggcctatatgcattggaatgtggtaaatgaatgaatgtttacagtgagtaaagaagataaaaaaattcctgctcttgtggaactaatatttagttgggrtggagatgagcagacaggactatgatgaatatatgatgaagcaacaaaagaacacctatattgtataaaatgtagttgatgaaaaatgtcctggacaaac

SEQ ID NO: 35010 - DNA, 201 bp, Homo sapiens
tgaattagttattgcagtgcccaacagatatttagtattgctgtgtgtccttcaaatgtttacaatattccactgtgcctttgtgagttcactgcagcacsctggggcacctctacacacagtttgtgaacacaggggtagatagatcctagaggcattgaaactacacggaaacttgaatgacgttagggatcccagagc

SEQ ID NO: 35011 - DNA, 201 bp, Homo sapiens
gcatggtgcttattgcgaacaagatctaatttcttactttcagatcagaagagggtttctccataacctgactccctgtgaaacagtcatctctgaggttsccatatgtggtcactctagtatgtatgtctgtctgtgcagaataagtaatcagatatacagcacatcccaaacttgtgacagctactagggaaagggaag

SEQ ID NO: 35012 - DNA, 201 bp, Homo sapiens
tccctcctttcctgaagctcctactatgaccccctagtgggaggaagagcatatgcaagcatggtgcttattgcgaacaagatctaatttcttactttcasatcagaagagggtttctccataacctgactccctgtgaaacagtcatctctgaggttcccatatgtggtcactctagtatgtatgtctgtctgtgcagaa

SEQ ID NO: 35013 - DNA, 201 bp, Homo sapiens
gtcaagaatataatatatggaaaaaataccttgatatagaaaactgcctacaggtctttgatttgtttagcacctaatgtttgagatatttattgttgtckcaatatcctagatttataataagattaatggttcttacttaataccgcagtgtgtcatcctaaggtaacaatttttatttgcttctgtgtattttctttt

SEQ ID NO: 35014 - DNA, 201 bp, Homo sapiens
gagcttcagtcatgaatgacttagtactgctccctgccatttttatgctgtccttgccttgagggaatctgaacttgccgggagcaatttgttttgctttytaatttttgaatatacatctgttaaaagtaaatttgcccttgtgtgagtttgagatttgaagcctgtctacattgcactgatcgaatgtttgtggagata

SEQ ID NO: 35015 - DNA, 201 bp, Homo sapiens
tacattaaaataaatttgaccacagccataccaagttctgtaatcttttctagtttaatgttcaaataatgtgactgataaaaataatgtaactaaggcartccagatgcctttaacgagtgttatgtctgtgataatctgagttcagatttatatcttcaacagtaagtatttagcactctccaacccttcttgcacttg

SEQ ID NO: 35016 - DNA, 201 bp, Homo sapiens
gaacatagccctaggctacacttagaaaaaattattttctgttctttattaaaaagcacagtggttgccttattagcattttaaataacatatatgaaaayacattctgtttcaaatttcagtttcatgtttctaatggaatcaaaacaatttattgttaaaaggatggcttttgaaaatttggccccatacgtagtcttt

SEQ ID NO: 35017 - DNA, 201 bp, Homo sapiens
aggggaacagaaagactgaaaatgagagataagatacactatgcaaactctaaccagaagaaagctggtatgctaccattaatagcaatcaaaaagacttyaatttttttaaaagaattattaaggacaaagaaagtgatcatgatagaataaaaggaacaaggaaaactaaaaaattatgagcctgcaaggtcataataa

SEQ ID NO: 35018 - DNA, 201 bp, Homo sapiens
ataacatatatgaaaatacattctgtttcaaatttcagtttcatgtttctaatggaatcaaaacaatttattgttaaaaggatggcttttgaaaatttggycccatacgtagtctttaagtcttttttatttttcctcttttaagctccagggagacattacattttctcctgtaaaatagcagcttattctagctgggat

SEQ ID NO: 35019 - DNA, 201 bp, Homo sapiens
gagaaaaaatgaagagacatgtaggcccctaccatactggctcatgaagcctggaccacgtctggtctgagtcattgaccagaagtagccgtgtgccccargctaactgtaagggaggtctggaaaagtaggaggcacataggatatttgatgagcactaactatctctgcttcaggttgtcttcataataaatgcaaaca

SEQ ID NO: 35020 - DNA, 201 bp, Homo sapiens
agcctggaaaaatatcaaaattcaaaatttgaagtatgatttatattgactatgtattgctttggcactatcacaaaatcgaaaaataccaagttcaaccrtcataaattgatgactatctgtaccaccaaatagcccattactcaaatcctcaactttttctcttcaatgtatgtgacctctatttatatagtcaatact

SEQ ID NO: 35021 - DNA, 201 bp, Homo sapiens
gaggatatgaggccctcctctgcccatttacactggaaatgtcttagatgtcttagtgcttttcaatcaggtatatccaaacaacaaacaaacaaataaartaagactaatgcagaatgaattccatagttcagattcttcaagataatggaaaattatcacataatctccacctgttttgaaacattatcttctttcctt

SEQ ID NO: 35022 - DNA, 201 bp, Homo sapiens
cttcaatacaatcaagttggcactcagtattaaccatcacagtgaatgaatagattttctatgacgttgactccttggaatgaccaccagaggcaataagyacactctcagtgacacgaggatatgaggccctcctctgcccatttacactggaaatgtcttagatgtcttagtgcttttcaatcaggtatatccaaacaa

SEQ ID NO: 35023 - DNA, 201 bp, Homo sapiens
gaggcctctagaagctgagagcagcactggattgataatcagcaagaaagcacagctgagctaacatggagactgcagcctctctaggtcgacaggaactkattatcaatgaatgttgttttaagtcactacgtttgtgataatttattatacagtaataaaaaccaaatacaaaagattaaaaagaaatctaagttgaag

SEQ ID NO: 35024 - DNA, 201 bp, Homo sapiens
tcaaacaggatccctgtctgccattgacacctcaaggactattggatctgctaggtcatacggcccaatcggcagagcagtttgcacagcagtctggactygttgcagagcccacttaaaattggcagcctttcaggtcactcaataaatgggcccattttaacacacccaggaacaatgctttgcatccttcaatacaat

SEQ ID NO: 35025 - DNA, 201 bp, Homo sapiens
tcatgagaactcactgtcatgaggacagttccaagggggatggtgctaaaccacttatgagaaatcagcccctattctccaatcatctcccaccaggcccytcccctaacattggagattacatttcaatacgagatttgggtaggatcacacatcctatatcacttttggagaaagaatggaggtagctctgaaggtttg

SEQ ID NO: 35026 - DNA, 201 bp, Homo sapiens
aaatgctcatctaaaataagaaagatgataggcctgatccatcttctgtttactaggttaaatctggaaaatataaacctcaggtgccagacttcagaggsatatagaaaaacaattactttttgcattagtccattcttgcattgctaaaatcctaaagactggataatttctaaagaaaagatgattaaggcgggatgc

SEQ ID NO: 35027 - DNA, 201 bp, Homo sapiens
tctactggagatttgttctccaaaacctgacaatctagtactttgtaggaactaatgtgtataatcttagggggcttagtggacagaaagttcattagccrttggtactgtgataggggaaaaagcaaatgggaccttaaacaatatgaatagacatggtttctcaaagaatagtctatggttcacctgagcacacatcac

SEQ ID NO: 35028 - DNA, 201 bp, Homo sapiens
tgaaaagattttcatcggttagagtgatacgtctgttatgatgcaattaattgtgatatactgtctactggagatttgttctccaaaacctgacaatctartactttgtaggaactaatgtgtataatcttagggggcttagtggacagaaagttcattagccgttggtactgtgataggggaaaaagcaaatgggacctt

SEQ ID NO: 35029 - DNA, 201 bp, Homo sapiens
agatgtatttatggcagcaagctcatttggtacatgtatgtatgagggaatcaagatctgaaaagattttcatcggttagagtgatacgtctgttatgatrcaattaattgtgatatactgtctactggagatttgttctccaaaacctgacaatctagtactttgtaggaactaatgtgtataatcttagggggcttagt

SEQ ID NO: 35030 - DNA, 201 bp, Homo sapiens
ccaaagggagctcatttggggtggcaggggtaaccgaaaagtgtgggagctgaggtattgtttgagagcctgtgggcagtgtgactgctccaatcgtagtytcagtgaggaagagcaccatctgtgcaagattttctcagatgtcctctataagactttcattgtcatcagttctatgtgctctcaaatcattgctttttc

SEQ ID NO: 35031 - DNA, 201 bp, Homo sapiens
ccccaaaatttttttaaataagaaagttttaataagcagaatattagtttaattatgaatgagaagagatgtatagcatttgtaggggtacagaaccatgyattccataaaggaagaagttaagagcaatgatgtggaataagcatggggcttttaagaacttgtctgaaaagaggatattctttggtcaatagttgaaaa

SEQ ID NO: 35032 - DNA, 201 bp, Homo sapiens
tacctggggccacagcattaccactggttgtaaggtgagtgaaccacttttttgctctgataattttttggggagatttttgttttgtagagctctgtaaytgggcatttcaaaattcaatattacatcacaaaataatgtagaagtattactataatgtgattacagatattaatcaatatcttacagtttacttgtagg

SEQ ID NO: 35033 - DNA, 201 bp, Homo sapiens
atatactcagtagtcccgattatgttggtgttaccaaaggatgttccctggaggttggtctgtttttgatagttctctaaacacatttatatcagatttcrcttacttagtgtggctgctcctacaaggatcagtcttttgttaatatattttacttttctactgatcctactcttaaacgataaagcaagattaaagcat

SEQ ID NO: 35034 - DNA, 201 bp, Homo sapiens
aggagtcacctatgggagcctgccaaaggcttcaaacaggatccctgtctgccattgacacctcaaggactattggatctgctaggtcatacggcccaatyggcagagcagtttgcacagcagtctggacttgttgcagagcccacttaaaattggcagcctttcaggtcactcaataaatgggcccattttaacacaccc

SEQ ID NO: 35035 - DNA, 201 bp, Homo sapiens
ttttccttatacagacatggacgcagctcataatgttgaaggatacctctgttgctgatacatctctttatttgcaggaaaatgttgaaggaggagactgyagtcgttgcaaatccggcttcttcaatttgcaagaggataattggaaaggctgcgatgagtgtttctgttcaggggtttcaaacagatgtcagagttcct

SEQ ID NO: 35036 - DNA, 201 bp, Homo sapiens
tccacctctaggagtcacctatgggagcctgccaaaggcttcaaacaggatccctgtctgccattgacacctcaaggactattggatctgctaggtcatayggcccaatcggcagagcagtttgcacagcagtctggacttgttgcagagcccacttaaaattggcagcctttcaggtcactcaataaatgggcccatttt

SEQ ID NO: 35037 - DNA, 201 bp, Homo sapiens
ccaggcacggtggctcatgcctgtaatcccagcactttgggaggccgaggtgggcagactgcctgagctcgggagttcaaaaccagcctgggcaacatggygaaaccccgtctctattaaatattcaaaaaattagctgggtgtggtggtgggcacctgtaatcccagctactcaggaggctgaggcaggagaattgcttg

SEQ ID NO: 35038 - DNA, 201 bp, Homo sapiens
ggcagtttaggttgcatggtgacttgatgacctacagtcaaacattcagtttctaccaaagcccagtaacaggccaagagttgtctctcaaatggagagtrgtgatctgcagaagatggcagggccttgctccaaaatcctagaggcttccacctctaggagtcacctatgggagcctgccaaaggcttcaaacaggatcc

SEQ ID NO: 35039 - DNA, 201 bp, Homo sapiens
tccattaaataatgactttaattctctattctttttgctatgttagtaagtttgaagtttcattttaaaactaaacatgtgggccaggcacggtggctcaygcctgtaatcccagcactttgggaggccgaggtgggcagactgcctgagctcgggagttcaaaaccagcctgggcaacatggcgaaaccccgtctctatt

SEQ ID NO: 35040 - DNA, 201 bp, Homo sapiens
acagcgaataaggcattctgggagttcacggatggtactcttggcagaaacattgggcgtaggatgggcaaatccatatccagaataagtgcctattccaktgaggacaaacctctgcctttgcatgatggaagaggtctgatataatcaacctgccaccaagaagctggctgatcaccctgaggaaggatgccagacgga

SEQ ID NO: 35041 - DNA, 201 bp, Homo sapiens
aaagcttaacaatacagaagagtcctctactcctttgagtctagccctataaagaaggaagaatgttttcaataacttaaaaggaaaaacaaagaaacaawttatacatttgcaggagaaaaggaaaaggtcaagtagtagagcaaccaacgaccactatgaagaaagtggaggtcagacaatttgagaagaaaaaaagca

SEQ ID NO: 35042 - DNA, 201 bp, Homo sapiens
aaatagtggcatgatcattgcagaagcatttctatgttcagttatcctttcagaatgaatctacttttcaaatctaaactaaattttaatccatcttctgwtagataattttctattttaaagaccctaatttcaagttcaccattttcatttcacctgttttattgtatgattattttcagcacctaaaatggtgcctgg

SEQ ID NO: 35043 - DNA, 201 bp, Homo sapiens
agtttcctttttttttttcatcccaatgcttgatacatagtagccatttgataagtacatgttgaatgaaagcatgaatttataacatatataccttcacytgacttggagtttcataaggaatgcaacagcttccaattcatttactttctttttgcttaacaaagtatctgacacgtagtacaaaagttaaatattata

SEQ ID NO: 35044 - DNA, 201 bp, Homo sapiens
aggttcattttgtgatcataatgaaacatcatattctatgagcaatttgtactgtttttggtttctcttgagtgagccctactaatgccatatgttctgtygacttcttattcaaaatagtggcatgatcattgcagaagcatttctatgttcagttatcctttcagaatgaatctacttttcaaatctaaactaaatttt

SEQ ID NO: 35045 - DNA, 201 bp, Homo sapiens
cactactgacttctaactcatctttttgctttctcttatttggaacagttattcagcttaccctaagtccagagtgaatttccaaaaaatcaaaggttctscaacttttcatttctcttcaattccaactcaggttcacacgtttatcacctagtgtagaagggctttcctccacagttttgcttggcaaactccttttca

SEQ ID NO: 35046 - DNA, 201 bp, Homo sapiens
ccagtcttagcaggttcattttgtgatcataatgaaacatcatattctatgagcaatttgtactgtttttggtttctcttgagtgagccctactaatgccrtatgttctgttgacttcttattcaaaatagtggcatgatcattgcagaagcatttctatgttcagttatcctttcagaatgaatctacttttcaaatcta

SEQ ID NO: 35047 - DNA, 201 bp, Homo sapiens
ttatgaggtccttagagtgctagacactgtttgcatgaattattttatatgatctcaccacaaccttataaaaaagtttttattgtccgatgttttagacrgcgtagttataggagttagtttcagccaccagttgtatatagagaagctgctaggcaaacataagatttttttaaatctagcacaaggacctgaacttta

SEQ ID NO: 35048 - DNA, 201 bp, Homo sapiens
gggatattagagatatcccctaaatgaaccagtcttagcaggttcattttgtgatcataatgaaacatcatattctatgagcaatttgtactgtttttggyttctcttgagtgagccctactaatgccatatgttctgttgacttcttattcaaaatagtggcatgatcattgcagaagcatttctatgttcagttatcct

SEQ ID NO: 35049 - DNA, 201 bp, Homo sapiens
ctgggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtcta

SEQ ID NO: 35050 - DNA, 201 bp, Homo sapiens
agccgatgagaaagctcagtaatagaagcaaatactagtacttgttttcttgtggagataaaattatttttgcattattctactgtgaccatgcctatctrttggtgacaactggaatatcactttgttctcccaatggacatgagtgtttgtgtaagtgtactcacacattcacacatatctgtttttgtccacagcgat

SEQ ID NO: 35051 - DNA, 201 bp, Homo sapiens
acatatagtatgctttttattctatgtatatacctatgaaaaagtttaatttatgttaggcacagcaagagattaacaacaatagagcaattataacaatwtactataataagagttatgtgaatgttgtctctctcactccccctcaaaatatcttattgtattatactcatctttctccttgtgatgatgtgagatgat

SEQ ID NO: 35052 - DNA, 201 bp, Homo sapiens
aaatagcattattataataaaaactggtaaaacacaccaggacaattttcaaaccaatgtcagtgtgttaccttttacttactgcctatggtaaatccagsactttctcatacatctcccagtttatttctcatatcagtcacatgaaggaagatgttttctttatttgccatatgtaaaaagggacagaaatgacatttg

SEQ ID NO: 35053 - DNA, 201 bp, Homo sapiens
gtctgaaactgcagattgtactgacacctacatatagtatgctttttattctatgtatatacctatgaaaaagtttaatttatgttaggcacagcaagagwttaacaacaatagagcaattataacaatttactataataagagttatgtgaatgttgtctctctcactccccctcaaaatatcttattgtattatactca

SEQ ID NO: 35054 - DNA, 201 bp, Homo sapiens
acattccaggacccccagagtatgtctgaaactgcagattgtactgacacctacatatagtatgctttttattctatgtatatacctatgaaaaagtttartttatgttaggcacagcaagagattaacaacaatagagcaattataacaatttactataataagagttatgtgaatgttgtctctctcactccccctcaa

SEQ ID NO: 35055 - DNA, 201 bp, Homo sapiens
tttctctgactaattttatttagctttcaagcatttctttgtggcttcagttttgacttcagtttttaaacaatttaaacaaataaaaattacattacagrattgttacttttaaactcttactttccacggggactgttattgtaaaatctgttcttattcttttaatttaactccattattttgttttaaatgtaatga

SEQ ID NO: 35056 - DNA, 201 bp, Homo sapiens
caaattaagaaacttaaagaatacagataatgccccatccgcactcgccccccaaaaaaacctagtccttaaatatctgttaaaatataataaacgtgcawgcatgtttagaaattgggaaaaatgctttttgttgttttttgcttgaagcagtaaaacatttttcttgctctgcaatattatgcattttagatactttgc

SEQ ID NO: 35057 - DNA, 201 bp, Homo sapiens
cccaggcttgctcaccaccccaaatcccacgtctatacaccagagaaaggattacccatcaccaaaggtgtctctcattccctaaattatgcatagatcargtggtctgattgtgtctgtccagatagggcacccttttctaatttatgtgaagtgccatgtgggatagctatactttagggaaataagaacaccactcac

SEQ ID NO: 35058 - DNA, 201 bp, Homo sapiens
caattcttctctgaatagcttctactcatctaattctatcaccaaagctacaaaatgtttagatgtagttcaagaaattccagaaactactttagaaaaargtgatcagcgtaagaaagggcaaattaataaggatcagagtcaagcagctgaaacattaaaaaaaaatcagaacagggttggaatatacacattgtaact

SEQ ID NO: 35059 - DNA, 201 bp, Homo sapiens
ttattttatgtgtttaattcaagattgggaaataattatcaagaaaacattgaaaaattgtacaattaaagcaggtgacttattgttatgctccaaaaaawgtcatctcccggaatcacagcctcctttttcttaagatggtctgagcttggtaccatggaaacacagccctaagaagaaacaaaagctggaatatcttat

SEQ ID NO: 35060 - DNA, 201 bp, Homo sapiens
gaataacagttaaatattccacagctaactattatttaatactaatattatgtcttggttaatggaagacaccatagaccacattttgaatatttgtgctyctttttaatattggtaatcctccttctgagataaattcaggaaatctgacctttctcctcagcccttttgaaataaagaccacttttccaattaggaata

SEQ ID NO: 35061 - DNA, 201 bp, Homo sapiens
actctgctccacatttttacaatctaagaatagtcagatgcccctcttaactgcaaggggctgagaagtgtagggaacacaagaatattttttgagagctmctatctctgcttacatataatggcagaagaaatatcctcctaaatctattaaaatcatactatgctctcaaagattctagctgctcccttaatttgatat

SEQ ID NO: 35062 - DNA, 201 bp, Homo sapiens
ttaggtgaagtaaacagtaagtttagagcaaaatttactcaaaaagaaatagtacacctgagaactataaccgttaaataaattgcatcagtagttaatasaacaaaataacaatatgtacaaaaatgtaaaggacccattatgcaatttgttcccaagaatggaaaaagaagaaaaatttcctcagcttattttatgagg

SEQ ID NO: 35063 - DNA, 201 bp, Homo sapiens
tcaactcccccttggcctccctaatgtgctccttggcacccaaaatccagaaggggccaagatagtagggggctagagtgtcagtgctgccccgagcatakgcacacctggctgggttgcaacagcctcagctttgctctgaaatcagcctgggtgccgggaacagtgagagaccaggaagaaggagcgggcacttctgag

SEQ ID NO: 35064 - DNA, 201 bp, Homo sapiens
cctggcttgaaggtggagcttcactgagggcccacccctttccacccaggaacctgtatgcctcctgccaccaccaacctgccatccacggcgcccactgrcacccaggctgttcatgcctagggtcaccttcaggcccatgcagagccaccctcaactcccccttggcctccctaatgtgctccttggcacccaaaatcc

SEQ ID NO: 35065 - DNA, 201 bp, Homo sapiens
cctacttaaatagtttaattaaaatgaacctcagaggagatagaaaatctgtcctgcaataaaatctgttctaaaataataaagaaaataggtctaaaatrggtctggaaatgaaacaacaaccctcatcctttacaccagcaagaagttctaaatttctttctttttctaaattcatgatgcatacatgttttaatttct

SEQ ID NO: 35066 - DNA, 201 bp, Homo sapiens
cacgtctggctgagtccggggttttttatgggcctcagaggggaggaagtgtatgctgattggtccatgggtggccatgagctggcccaaaaaaagcaccrtaagttctcactccagtttgtggaaccgacagtccagcccccttccttcaggcagtccctggcttgaaggtggagcttcactgagggcccacccctttcc

SEQ ID NO: 35067 - DNA, 201 bp, Homo sapiens
ccctcaacagaggtgagacacacagtgggtagctcctatccacaggtagatcatcctgttgtctgcccacgtctggctgagtccggggttttttatgggcytcagaggggaggaagtgtatgctgattggtccatgggtggccatgagctggcccaaaaaaagcaccataagttctcactccagtttgtggaaccgacagt

SEQ ID NO: 35068 - DNA, 201 bp, Homo sapiens
agcatctgtgcagcaccctcaacagaggtgagacacacagtgggtagctcctatccacaggtagatcatcctgttgtctgcccacgtctggctgagtccgrggttttttatgggcctcagaggggaggaagtgtatgctgattggtccatgggtggccatgagctggcccaaaaaaagcaccataagttctcactccagtt

SEQ ID NO: 35069 - DNA, 201 bp, Homo sapiens
gaggagatactggttgcattaaaaatcttgtaatcaaaaccattctgtaagtgatttgtgtgatcagcttatgcacatcatctaaataagaccagaatttraaaactaaatcaacatttcccaaattgtagatgttcctggaataaagaattctgtgatcacatgagtttgggaagcatccatttgcatgttaaaagttct

SEQ ID NO: 35070 - DNA, 201 bp, Homo sapiens
ttctattttgagacccctttctctatatgtgggaactgtgaggtcttagaaacataatctgagcccatttcaagttgttttcttctcctctctcccagctwgaatcaaagttctattaagcttacctagtaccaaaggccttatatgcaagggtagaggggagggtataatgtctgtgtgtatatgttgagcaaggggaca

SEQ ID NO: 35071 - DNA, 201 bp, Homo sapiens
acttgtgagtctccttgtgcctttgggtcctgaatgcagagcatgggctacagaaataacagaggaggggcagttatacctacctgtagtactgttagcaraattgtgactccagttgaggtgtcaagaggccactcatatgtggttgtgcagtttgtacactgcacaaaggcactcagggaaggggaagattgagggctt

SEQ ID NO: 35072 - DNA, 201 bp, Homo sapiens
accctcttcttttccatgaagtccctgggtgtctagtctgtttactttttctgcatatgtctagaaaggacaatttcttccaacttgtaaaaggcaccatktgagcagggaaacaccctcagtcttttgctgattatgtcaaatgggaggaagtaagaacacagcattacagccacgactctttatacagcagccaccctc

SEQ ID NO: 35073 - DNA, 201 bp, Homo sapiens
ggagaaaagaaaggctttactgcaaaattgttcagcaaggagacaagagtcaggttcaaatctgtctccctaatttgggatatggggaaggttgcaagggrtcagaaggcaaggcaaaggatttagaaatgctggcttggcagagtctgattggagggcttcaaatttgatcacttacagtaaggtatattgaggcagatt

SEQ ID NO: 35074 - DNA, 201 bp, Homo sapiens
attttccctagcactactcctgtcatcattcttagtgattttaatgtccatgaacttaactcttccatactcttcactttcagtttcttgtgcctctctgktctccatttgaagcgtttttttgttgttgtttggtttttgtttgtttttttttttttttcccactgtgtcgtttctctctagttcacttcttctaaatac

SEQ ID NO: 35075 - DNA, 201 bp, Homo sapiens
gatgaaacgagaaatacaggagtattacaaggtttagcaagagatgaacttcattgttgtcatttcaaatttaagacgcttctgtgttatacaatatttaytcaagaagcaattagaagcagaagtctggaacccattagagatatccaggctgaatacataaaatacagagttttgggcacaccattaactgaagtcata

SEQ ID NO: 35076 - DNA, 201 bp, Homo sapiens
cattactctgaaatctacatagtggtattcctgggactcaatccttggagcaatttgtttctctaactacattcattcagatggtgatcttacccaggcaygtggctttctgtactgagatattttgatattgacatcccacagtatttactattaagtttatgatttaattttatatccactcattactatggtgtgggg

SEQ ID NO: 35077 - DNA, 201 bp, Homo sapiens
cccacagctcatctttgttaagcccatctcccacctctgctcaccttctgaaaccattctactgagccttgtggaactcatggtcaaaacaggcaaaataycccgcagaatcctcctcttccctcagtgttctcttcatcatgctctgactgaaacccaactctcactttgcatgctgctaccccggcagccctcttaagg

SEQ ID NO: 35078 - DNA, 201 bp, Homo sapiens
cttctttctttttgaacacgtattctatttgccatcataagtttcagcagcctcggcttcctcaaactccactctttgtctctcaactcagctataatgcrggctttgggtttaccctctctgtgttgcagcctagaaattgcctctgtacactgcttcatgtttttttccttctctcagaaatcacagtcctgtgcttcc

SEQ ID NO: 35079 - DNA, 201 bp, Homo sapiens
acttggaggctgaggtgggaggattgcttgagcccagaagtttgagcctgcagtgagctgtgatcatgccacagcactccagcctggatgacagtgagacmctgtctcaaaaaaaaaaaaaagaaaaagaaaataaaagaaaacaataatagacaggaagatagcttttgcaggttcctgaagaatctaccacaccaacac

SEQ ID NO: 35080 - DNA, 201 bp, Homo sapiens
cttggaggctgaggtgggaggattgcttgagcccagaagtttgagcctgcagtgagctgtgatcatgccacagcactccagcctggatgacagtgagaccstgtctcaaaaaaaaaaaaaagaaaaagaaaataaaagaaaacaataatagacaggaagatagcttttgcaggttcctgaagaatctaccacaccaacaca

SEQ ID NO: 35081 - DNA, 201 bp, Homo sapiens
ttctcttcatcatgctctgactgaaacccaactctcactttgcatgctgctaccccggcagccctcttaaggagtagccatcacctttttgtttttttttycccctgagatgctgactcactctgtcgtgcaggctggagggcagtggcgatcctggctcactgcaacctccgactcccgggttcaagtgattctcatgcc

SEQ ID NO: 35082 - DNA, 201 bp, Homo sapiens
acaaagcctataacagatacatgattaatatgtgtttaatggaagcatagaaacattagaattaaaattttaagatatttcccataaagttgtgttaatgrttgctgtttttatctcctctataggcttgtaactgcagcacagtgggatccttggatttccaatgcaatgtaaatacaggccaatgcaactgtcatccaa

SEQ ID NO: 35083 - DNA, 201 bp, Homo sapiens
accttacaacaggaaacctccagtcccctttcctatcctttgtactatattgtcatatatttttacttctatatattatacatctgacaatataagcttaygattttgatttcaatagtcaattatctttttaaacaagaaaatttctcctataactctttttccttgtgtatatcaattttaatgctttaaattcctttg

SEQ ID NO: 35084 - DNA, 201 bp, Homo sapiens
ctccaaatttccatcttttctcggttcaaagctagaacccatcagtatctaatctgaaaacaagacacctctaaaatttatttaacctcatcccagcactytgggaggctgaggcaggaggatcatgaggtcaggagatcgagaccatcctggctaacatggtgaaaccccatctctactgaaaatgaaaattaaaaaaaa

SEQ ID NO: 35085 - DNA, 201 bp, Homo sapiens
aggtagagtttcaaaaagtagtgtggttaagatattcaagggtattatctgctgagaacctgtgacctgcagtgttaaattagcgacaatagtgaattagygacaatgagggcagaatagcagtaaattcttgtaacatggctattataattacataagaataggcaacttttgttttgttattgtttttatttgaaagta

SEQ ID NO: 35086 - DNA, 201 bp, Homo sapiens
caaggataggtgctattttagataggtaatcagaggagtggctattaccagaatggagggaggacacaagccaaagagtaggaagagcacatagtgggaakatctgcaagtgcaaaggcttagaggcaggaactagttgtatgtacctggcaacatactgaattggtcggtgaagggaaggaaagaagggtatgaaattag

SEQ ID NO: 35087 - DNA, 201 bp, Homo sapiens
ctctttttaaatactcccattacctttccaaaccttttgttcagctgttgggaccatcaacatcctggtcacacctctatggatgaagtctaatttgtcarctactctcttaaatggtggtgtcatgaattgatcacagtgctctggatgtgctctgactagctatgactgctcctggatcgccgtttcctttaatctata

SEQ ID NO: 35088 - DNA, 201 bp, Homo sapiens
cagtgaagtccccatcaccccccatgtgcctactgttttgccttctagcattataattttccaatttctacaacttcttaaaaatagaatcgtagtctgtytttttgagggggggtttgtttgtttctttgtttggcttccttcacttggtgttacgtttttgtaattcatccatattgttgcatgtatcagcagtttgtt

SEQ ID NO: 35089 - DNA, 201 bp, Homo sapiens
ggtagactggagatggagatttatcccaggcttgctcaccaccccaaatcccacgtctatacaccagagaaaggattacccatcaccaaaggtgtctctcrttccctaaattatgcatagatcaggtggtctgattgtgtctgtccagatagggcacccttttctaatttatgtgaagtgccatgtgggatagctatactt

SEQ ID NO: 35090 - DNA, 201 bp, Homo sapiens
tattgtgaactacgtattcttatattttcctcattatccttaaaaatatggaacactttgcatatttgcctgccagttttgcacatagacaatgctattcyactctgaataattacaacttggttatatatgttgcttaggtgaggcttctctgatttctgtaactgtgaccaatttctttaagacaacaaaggagaaaat

SEQ ID NO: 35091 - DNA, 201 bp, Homo sapiens
gtctccttgttatagtttcatgtggtagaaagggcaagggggttatctggcatcccttttataagagcactaatttcattcttgcccttatgacctaatckcctctcaaaggctctgtattaatctcttctcacgctgctataaagaactacctgagactgggtaacttatgaagaaaagacgtataaattgaccacagtt

SEQ ID NO: 35092 - DNA, 201 bp, Homo sapiens
aaagcgtaaattcagccttctgctgtattttgaccccttgcaggtgactctgaaggctgagcagaccattctacccctggtagatgaggctctgcagcacrcgaccaccaagggcattgtttttcaacatccagagattgttgcccacatggacctgatgagagaagatctccatttggaacctttttattggaaacttcc

SEQ ID NO: 35093 - DNA, 201 bp, Homo sapiens
gaagaggaagaagatacagaacgtgttctccagcttatgattatcttagaggtagagtactgagagcatgttcacccgtgttacttcctgatgttacttamggttaccagtactgtattttttacctgcctggtttgacactgacttacaggactactaaaaaaaaatataccttaggagatttttgtgccactcttttgt

SEQ ID NO: 35094 - DNA, 201 bp, Homo sapiens
tactgatcctactcttaaacgataaagcaagattaaagcattctctaaattaccatgataaaaaatggtattatgaagtcctagaattgtgatccaatttyccaaatgtatagctctttatagcacatatcattaatactaatctcttttctgtttttctctttttttccaacactacttttcccttttccttatttttgt

SEQ ID NO: 35095 - DNA, 201 bp, Homo sapiens
tttcccttttccttatttttgtcatccattttaaatttattttacttttatgtgttgtatatagctttattagcaaccttacattttttctggaaccattsaagtttacacaagtagcaagtagtaatttacaccgtagccattagtgcatagtctgttgtctacaaacttgaagtctagcccccttgtctttgaaataac

SEQ ID NO: 35096 - DNA, 201 bp, Homo sapiens
tcccgggttcaagtgattctcatgcctcagcctcctgagtagctgggactacaggctcacgccaccacacctggatattttttttatttttagtagagacrgggtttcaccatgttgtctaggctggtctcgaactcctaacctcaggtaatccacccaccttggcctcccaaagtgctgggattacaggcatgagccacc

SEQ ID NO: 35097 - DNA, 201 bp, Homo sapiens
tgcaaagacttgtgtttgacatgcctgcaaagtcctttgttagctgatatcctcagtaactcttctttgatgctaaagcatcctagcattcccctattttygtttaactattttgcactgtttcttcagttgacactgacccatatgtgagaaagaccccggccatagctctactctcttaaaatatccataagcaagagt

SEQ ID NO: 35098 - DNA, 201 bp, Homo sapiens
aggcacaaaatgagataaaagtaatgacaaggtaaaactggatgaaaattggtcaacaagtgaggaattaactgccttgcaaaagcagtttttattatacrgaaaccattttgaaagcagttattcagaaagtttctatcagtatatgatttgtagctcaaattattgttggtctatcaatcacaaatactattttctgca

SEQ ID NO: 35099 - DNA, 201 bp, Homo sapiens
gttctttacagggagtcaggcgaccttggtctcaatgacaactgtgccactatctagacatacaaattgggcaagtcaattaatctgtaagcatcagttcytcaaatctacaataagtgcattatactatagcatacatatagggtatcttcaaatattcatatcatattattttgcagctttcccaaactaattcacaaa

SEQ ID NO: 35100 - DNA, 201 bp, Homo sapiens
ttctttacagggagtcaggcgaccttggtctcaatgacaactgtgccactatctagacatacaaattgggcaagtcaattaatctgtaagcatcagttctycaaatctacaataagtgcattatactatagcatacatatagggtatcttcaaatattcatatcatattattttgcagctttcccaaactaattcacaaat

SEQ ID NO: 35101 - DNA, 201 bp, Homo sapiens
tctttttaagagttctgatggaactagaactaaaacagattcctccattattttttcttcttttttttccaatttctttcttaatcttaacatagtaaatwatcacttttcctaagagtaaactcagcacatataacagcagcaccctgtatttgatattaatatttaaacaacaacaactttctccccagagacaaattt

SEQ ID NO: 35102 - DNA, 201 bp, Homo sapiens
gactccattctcaccctagggaaacacggattttactgctcaggggatgatgaaaattggattccgacttttacacctcagattatttctattaattacayctcagattatttctattacacctcagattattatctcagattattatctattacacctcagattatttctattattcagtcttagccgaagattcccagc

SEQ ID NO: 35103 - DNA, 201 bp, Homo sapiens
tgctaagggggtgactaaaatctatattgaccaatacttgatgagtatatttgacagatgtttaaaagttaaccctgctcaaaaatgtaacgggatctttrctaatcaggatcataggtttgcatgggttcctaggaggaaaagaatgagtgggaccagtttatacaccaagcatcaaaggactccattctcaccctaggg

SEQ ID NO: 35104 - DNA, 201 bp, Homo sapiens
aaaaataattaataacctagcatttcaacaaaatatgcatacaatttaaatactgaaaagacacttagtgtagtgtatttaaatactgaaaagacacttartgtagtgtatttaaatactgaaaagacacttaatgtaacagttcatactgtttcacaaaaacatgatttgacatagatatgtcaactgattgtaaaaaca

SEQ ID NO: 35105 - DNA, 201 bp, Homo sapiens
cccccttgatccagtctcctccctccctccatacgtggagattacaatttcaaatgagatttgggtggggacacagagccaaaccatatcactgtctttcwgaagaaaaaaaaggaattcttgtatgttgccctaaagatataaaactgcttacaatgcctagtgatttgtattgattactatgtgttccctaaagtttga

SEQ ID NO: 35106 - DNA, 201 bp, Homo sapiens
gatatttttaaatgatatctcaccatctgtgtacatcacaatgttgagctacaaatgtggtggctctaacaaaattttaagtatgaagtcagatgtatagwggatcccttctccatcacgttcttctgtttttcatttcccgcttctcacaaactactccccagatgtcaataattctacaatctcctcttcctacaacct

SEQ ID NO: 35107 - DNA, 201 bp, Homo sapiens
tacaattagaaagtgggtaagtctcattcttaaacatatacttttgcattatagtcacatgaaaccactgagcgtgttcatgtgtgtgtgtgtgtgtgtgwgagagagagagagagagagagaaagcccaagagtgagagtttgtcttgaggagaagtgtttaaaaggaatatataaatcaaggatgcactatagtatcac

SEQ ID NO: 35108 - DNA, 201 bp, Homo sapiens
ttttcttcttttttttccaatttctttcttaatcttaacatagtaaataatcacttttcctaagagtaaactcagcacatataacagcagcaccctgtatktgatattaatatttaaacaacaacaactttctccccagagacaaatttacctttgctgttttcaaagtatctgactccaacaggtcagaaaacagcagca

SEQ ID NO: 35109 - DNA, 201 bp, Homo sapiens
ggaaatgtttctaatcaccctatcccccagctctggctgagttaggccttctctgcacaattcccatgaaagcacctaccacccagcaggcagaaatatcsctctttgactttctcactaaactgcaaattcctggtgagtgacaactggattctattcttcttctaacctctagaacctagcagattgctttggagacct

SEQ ID NO: 35110 - DNA, 201 bp, Homo sapiens
tatttaaacaacaacaactttctccccagagacaaatttacctttgctgttttcaaagtatctgactccaacaggtcagaaaacagcagcagacctatacrtcttctaacacataatttcaccgtcaacagtaactcagcaccctctggcatatagtatgtatgtagaaatgtttgttgaatgacagtaacaattgaatac

SEQ ID NO: 35111 - DNA, 201 bp, Homo sapiens
aaccaatttggagtctactgacatgctagcagtattccagaaatactgctgtgaggcaggatgctgggccactgtcctgtcacaggctccagcatgattcrccctgctcggtgacacaccagccgtgtgacttacccgaaggtgcacctgtctattttatggcaaccgtttgataaatgaaaattacctgtgtggaaagca

SEQ ID NO: 35112 - DNA, 201 bp, Homo sapiens
aaattttttaaaaagagtatgctcccgttatgcattctcagggtgatttctcccctaactttgccgttataaactctgagggtctcttgtctttcctcagrtgaatgtggaaggcatccactgtgacagatgccggcctggcaaattcggactcgatgccaagaatccacttggctgcagcagctgctattgcttcggcac

SEQ ID NO: 35113 - DNA, 201 bp, Homo sapiens
accaggaagaaatacacattaagtatcaaaatcggcacttgcgtttgtaagtgatgttgcccctgccgcaggtgggggaaggccagtctgtctttgcagcyactgaagagctcaagcgttgctaatgcagtatttctaactttgctgtcctaattggcttccttttctttcaggcatgcttgccgggattttatcgactgc

SEQ ID NO: 35114 - DNA, 201 bp, Homo sapiens
gaggtataattgacaattaaaaattgtgtatattctagatatgcatgacgatttaatatacatatacattgtgaaatgattaccacaaccaaattaattartatgtgtatcacctcacatagttatcactttgtgtgtgcgtgtttgtttatgcatggaggacatttaagatctgtgtttggaaaattccaaataaacagt

SEQ ID NO: 35115 - DNA, 201 bp, Homo sapiens
aaagaacatatctagtcctggagttaagatttctattttttctagatttatagaggtataattgacaattaaaaattgtgtatattctagatatgcatgaygatttaatatacatatacattgtgaaatgattaccacaaccaaattaattaatatgtgtatcacctcacatagttatcactttgtgtgtgcgtgtttgtt

SEQ ID NO: 35116 - DNA, 201 bp, Homo sapiens
agacttacatatattacagagaagcgtaacagagcaaatgattaagttctaagtttcactgtacaccctaaaaaaaaggagaaattgatatggaacatgartagtataggaaaatggtccttaggaaggccagacatgagagggtgagctctaggtgaccacctgtaggatcaggaaagaacatatctagtcctggagtta

SEQ ID NO: 35117 - DNA, 201 bp, Homo sapiens
gccagatatgggatataattccagcctgaagagtttatgctcaagacaagacttacatatattacagagaagcgtaacagagcaaatgattaagttctaartttcactgtacaccctaaaaaaaaggagaaattgatatggaacatgaatagtataggaaaatggtccttaggaaggccagacatgagagggtgagctcta

SEQ ID NO: 35118 - DNA, 201 bp, Homo sapiens
tagataaactaactgaatcaatatgaataaggcatagattatttatggttgcttaaaccaaataaataatttggttgctgccaaaatggctgaaaatcacrtggggtgtttgttaagccaacaggtttcatgggctcccacctagagagtctgtgtaggctgctctggggtttggccccatgtgtacattctaacactctc

SEQ ID NO: 35119 - DNA, 201 bp, Homo sapiens
agctcagctgtcataatatttggctccaatttcattcataatggacagaatatctacaatgttttgaatccctactttcaaatgtcagcacactggaacawatattaaagaatgggtttgaatctaagtagatgagtatttccttgaagcaacatgttatagcctaaatgttgtttccttcaattatgtttaaacaatgta

SEQ ID NO: 35120 - DNA, 201 bp, Homo sapiens
aaaactgctcagaagatttgaagttatcatataactagaaataatatttcttcaactgctcttaaactttccatgttttcctgctttctaaacctatgatstatttcataatcacattaattgcatcgaggagggtgagtgagatggagaacttatttaaattttcatttctaatggtttctactcttcttttcctttact

SEQ ID NO: 35121 - DNA, 201 bp, Homo sapiens
ctgaccaaaaggagctgtgggcctggcctatacaccttattgcctgttttcagcatcaactgatttagtgaagcagcaaaaagaaaaatggtgtgtgcagyattatctttctgccacagatacatgtttttaatttccaagtttccaatgcatcattcagttttatctaacgggaatgcagctgagagaagtttgtaacaa

SEQ ID NO: 35122 - DNA, 201 bp, Homo sapiens
agatcaatttgttcacatattttgcaaaagttagagcttattactcattcatgtactattgatgtaacgcattagaagacagttaacattaggtcctaatkgcacctgaccaaaaggagctgtgggcctggcctatacaccttattgcctgttttcagcatcaactgatttagtgaagcagcaaaaagaaaaatggtgtgt

SEQ ID NO: 35123 - DNA, 201 bp, Homo sapiens
gctcagggagtccataggtctcagctccccaaaaggccacagcccttctctcctgctcattgctgtcaacatggtgagctggggaagggggtgtgtttcarccctgtttgtgttgtagctctctcatttccaccatttgcgggggggtcccaagttcttgtcccacatcctggaagaatgaggtttgcagacaactggagg

SEQ ID NO: 35124 - DNA, 201 bp, Homo sapiens
tttccaccatttgcgggggggtcccaagttcttgtcccacatcctggaagaatgaggtttgcagacaactggagggttagcaaggtgaagaggtgctttaytgagtgacagtgcaactctcaggaggcctgaaatgggtagctccgttccacaggcaggtaattccagcatctgtgcagcaccctcaacagaggtgagaca

SEQ ID NO: 35125 - DNA, 201 bp, Homo sapiens
agaagagcagtgaacagcatcagttgctgctctcacaagggagacccaatgaatatggtggcaattgactattgtaattgagcaaataaatgggcttgccrcctgaagcacatagaagccaataacgttggcactggcttcggagaaaagaaaggctttactgcaaaattgttcagcaaggagacaagagtcaggttcaaa

SEQ ID NO: 35126 - DNA, 201 bp, Homo sapiens
gaagagaactttggaaaagtttaaattagagtagaaatgggtaagaggagctcaggaaagtatttatttgcttttctttaattccccattgtgttccagawaggattttagatgggactcaaaaagtaacttttttgcttccaattccaacataatcattctcacgaacttttgtctcagttcaccaagaggaaaaacatt

SEQ ID NO: 35127 - DNA, 201 bp, Homo sapiens
ttttcatataggttggctttttctttgaatgttttcacttagctagtgtaccaaaacagttctacatttccaccaaattaaaggtctgattagtttaatgyccttcatttgccatatttttctcaagaaagattatacagtgcatgaactcattcttattcagtaaatttaaatttgagtggcattatattccaactagtg

SEQ ID NO: 35128 - DNA, 201 bp, Homo sapiens
tgaaatagagaataaagtaggtgtatgctgaatcttattaaggttgacatccagtttgaatacattcatcctctaaggtatagttttgggtataaaccatygagcaagcacaaaacagtgaagctgagagctgcagaacatagagatctggtggattctaaaggactgagaatgatcgatggctactgaaatgaagtgtga

SEQ ID NO: 35129 - DNA, 201 bp, Homo sapiens
atgtcatcacaaagcattttcaaaatgcctgctatatttgtaaataggaagagatcagttcactagatgtataagaaggcatgaaggaggatagcaacagwtgagttcagacaggtagaaagcaggcctgattataaatgtttagatcaccaaggagtttgtctacgacactacaggtgacaggcaactcacaaaagtctt

SEQ ID NO: 35130 - DNA, 201 bp, Homo sapiens
tgaaaagaagttattgggtgaacatgatggctcatgcctgtaatctcaacagtttgggaggttgaggtgggaggatcacttgaggccaggagtttgagatmaacttgggcaacagagcaagatccatctttacaataattaaaaaaaaaatagaaattagctgtatgtgatggcttgcacctgtagttctagctactcagg

SEQ ID NO: 35131 - DNA, 201 bp, Homo sapiens
cagaactttcaggatcttcattgttcatagctacaggctccaatttggaattggccatagacacccactctgagaagtttgggaataagaaaagagaaaayacattaagaactaaaactgtaaggacccatactggcttcttaaaggaagttttactgagaattttaatcttcaaagcctaactctcattcacattcaaaa

SEQ ID NO: 35132 - DNA, 201 bp, Homo sapiens
cattttgtctgctgcttctaatcaaaattatcttaaaccactccaatagaattagggaaatgaagggaaaatgtgggtaaagaaaaaagtaaatccaccayttgaatgatgaggtttaaagactggaacagaactttcaggatcttcattgttcatagctacaggctccaatttggaattggccatagacacccactctga

SEQ ID NO: 35133 - DNA, 201 bp, Homo sapiens
ctcttctaagctttcctctttgttgtctttattttcactagggttttctctgtaaggtgcctaaaatggctactagtagctacaggtttaggacctggtcyttagcagtttaaatcggaggaggaaaaatacctcctgttcttaaagtccctattaatctctgttggccttgcatgggtgatgggcccaaccatgtaggaa

SEQ ID NO: 35134 - DNA, 201 bp, Homo sapiens
agtgtttggattttgtcattctaataagtgtgtatggtatctcattcttgttttagtttgcaattccttaatgacatatgatgtcgagcatcttttcataygcttatttgccatctgtatatcttctttggtaaggtgtctatttaggtctttttccattttttcattgggttgttttcttgtcgaattcagagttttttg

SEQ ID NO: 35135 - DNA, 201 bp, Homo sapiens
ttcatatcactagcctggaaaaatatcaaaattcaaaatttgaagtatgatttatattgactatgtattgctttggcactatcacaaaatcgaaaaatacsaagttcaaccgtcataaattgatgactatctgtaccaccaaatagcccattactcaaatcctcaactttttctcttcaatgtatgtgacctctatttata

SEQ ID NO: 35136 - DNA, 201 bp, Homo sapiens
tattgaccctgatcacctgactaacatagtgtttgccagatttttccactgtaaagttactcttttatgcccttttcatactctaatactatttttatctrcccattcttcagattcagtaacataaaaggcgcagaaataggactactgaaagcaaagatcactttgatgggttgagaagggggaggaaatgtaaatact

SEQ ID NO: 35137 - DNA, 201 bp, Homo sapiens
cacctgactaacatagtgtttgccagatttttccactgtaaagttactcttttatgcccttttcatactctaatactatttttatctgcccattcttcagrttcagtaacataaaaggcgcagaaataggactactgaaagcaaagatcactttgatgggttgagaagggggaggaaatgtaaatactcattaattacttt

SEQ ID NO: 35138 - DNA, 201 bp, Homo sapiens
aaataggactactgaaagcaaagatcactttgatgggttgagaagggggaggaaatgtaaatactcattaattacttttttcctaccatatttataattasaaatatatcttccatgcagaccataaatactcaagtcaacatgaccaattctctctttccctgtggtcaagctgcatgacaatcaaaaggtgaattaata

SEQ ID NO: 35139 - DNA, 201 bp, Homo sapiens
tatgagccagatgttagccagctgataggttgatgggcatatacgttgctaaaaaaatgtgacccagagtacactctagtgatatctccaatgatgaggcrtaagctttgtatttgaccttgttgtgttcaaaatatctgtaaatgctttggatgatatctatcaaatattcagataatataaagctgaaagtattatcta

SEQ ID NO: 35140 - DNA, 201 bp, Homo sapiens
tgtgaccgctgtgcccacggctatttcaacttccaagaaggaggctgcacaggtctgtaaatatgacttaagtcctacatattcactctgatagttttagrgtctgacttctgtaacagtttgttcttttaaaggaagcacagattgatacaacgtatttaacataatgagtaatgtctacttatttttacgttacttaaa

SEQ ID NO: 35141 - DNA, 201 bp, Homo sapiens
gtaaaccttaactattagaataggtgtttttacatgtatttgatatccaataacttttattttagttctagaagtttatcagttgattcagttattgttawgtttaccattttttttttttttttttttttttgagagggagtcttgctctgtcacccaggctagagggcagtggtgctatcatggctcactgcaacctcc

SEQ ID NO: 35142 - DNA, 201 bp, Homo sapiens
aaaagtaacagttttaaatgcttcgaagataattgagtaagaaaagcataaaataggtttcccttgcttttgacaacatggccatccattgaacacctttstaaagtactcagcagattcatagtggcaagaggcacactgaagaggtaataaatgaatgatgaagaagaagaggggactatagaaatattctgtcaagta

SEQ ID NO: 35143 - DNA, 201 bp, Homo sapiens
tttcccttgcttttgacaacatggccatccattgaacacctttctaaagtactcagcagattcatagtggcaagaggcacactgaagaggtaataaatgartgatgaagaagaagaggggactatagaaatattctgtcaagtatccttgatgtgaaagagaatgaaggacagaggaggttgtggagttgcaaaggttttc

SEQ ID NO: 35144 - DNA, 201 bp, Homo sapiens
tcaagtatccttgatgtgaaagagaatgaaggacagaggaggttgtggagttgcaaaggttttcaaagataagagacatttgagttggtttagatgcttgkggggaaaggcagggaagttgaagaccaagtggtggtgggcatggtgtctctctagaagtaaaaacatatgggtcattaagcataggcaaaaaccttatat

SEQ ID NO: 35145 - DNA, 201 bp, Homo sapiens
tcatctcccagtcctcctttttgtgactaattctcttatcagtttgacctgaggtggcagataccacaatttcctattagacaacttctctcacaattacytaagagccatgaatttgatttagaaatggggttgtatgtgtgtgtttttctatcacatattaaacgcacaatctgtaaaaaagattcaggaggatgtttg

SEQ ID NO: 35146 - DNA, 201 bp, Homo sapiens
atgctgaggatacctgcctgatcggacactaagttactttcagaataagtttgtaacctcagcaacatgtcatacattatggagaaggcatttcaaaaagrcaggcaagttcatctggtggattctataggacaacatgaaacttaatgggatacatagacttcttaagccctccccgctccccagctggcaaatttttaa

SEQ ID NO: 35147 - DNA, 201 bp, Homo sapiens
tgccaagaacacacaatgggattgaactgtctgtccagtgaagggtgtttggagcagtagatgtccacatgcagaagaatgagtatagacccttatctcaygccatataaaaaatccattcaaattctaaatgaattaaagactgaaactgtaaaactactgaaagaaaacacaggggaaaagttccatgacattggtctg

SEQ ID NO: 35148 - DNA, 201 bp, Homo sapiens
atgttccaaatgtagattataccttacctgagtataccttgtttaagtacaacagaatatagttaaaatcacagttctttacctgctttagttgtatataratttttaagatcatttgttcagtatcacaagtagaatctgtggttaattagaaaatatattttccctttaaaagaatttgtgctgacttttaaaattatt

SEQ ID NO: 35149 - DNA, 201 bp, Homo sapiens
agtctgaacaagactttctaaaatagattgaatgtgggcagttttcacagctgcctgatgacttccacacacaaaacatccacatttcatccttttggtggaatactgtgtattttccaattttattcttagagtttaattttttacttacatattatgcttatgtatatcatatttgttatatatattatatataactaa

SEQ ID NO: 35150 - DNA, 201 bp, Homo sapiens
gtttacatttttaatatttctattgacacttagaagatgctatgttcacgtaatcatagaaagcttttaattaaaccctctactctttggttttaactttyctttattgatatatataaaaaatctatttttgtgtcaaaatagcattttaaaggttactgtcattaaaactttaacaactaaattatgtacttgttttag

SEQ ID NO: 35151 - DNA, 201 bp, Homo sapiens
acaaatggcacatgtgctgggaatggaagtcaacctttttgaatttttcaaatgtaagtcagtctggaaaatcccagtaaattggtatatttgttttgggytatttttgaagacctcttttaaaatttgcctaaaataaattctcggtatgctataattatagcagaactcttttctcagtcacccactaccactgttagg

SEQ ID NO: 35152 - DNA, 201 bp, Homo sapiens
ctgctctttatgatttctacccgtaggtagaataatcaagaggtgagattgatgttgtttttgattctggacattaactagagggaaaattcgaagccctstaagaatggtatctaacttaatagacacctctccattacctttactcaaaactaagactctttgtggtatgggcccaccccacctctagtagccagctgc

SEQ ID NO: 35153 - DNA, 201 bp, Homo sapiens
gtccatgttaccatgtggggtatattattatttaacaagcctattaagactattagaaagttttcctgatcacaggtctctcttctctttgcagcctgtckctgtaatgccggtggctctttctctgaggtttgccacagtcaaactggacagtgtgagtgcagagccaacgttcagggtcagagatgtgacaaatgcaag

SEQ ID NO: 35154 - DNA, 201 bp, Homo sapiens
caatttgaaagtgtttcaataaactctcaatgtaaaacttcacgttgttttctgtagcttttcagtaacttcttacactcatgttctatgtgcggctcagkggggaactatctgtatccagtggattgttggttctgacacactagcctacgtgcatatggggcaacccccaacatgctggcccctgccacttgcaataga

SEQ ID NO: 35155 - DNA, 201 bp, Homo sapiens
ctgagcaggcaaacaatgaaaaagtcccctccatgcaaaatgtatgtaaaatcagctttcaataagtgaacagtatttactacctgctgttccttttcacyatttgcagtaccattcttagactcactgcaggcataaaccctgggataaggaaaagttaagcctccgttcttcatacctctaataaggctttgccaatgg

SEQ ID NO: 35156 - DNA, 201 bp, Homo sapiens
ctgcatgaatatattttagtaaaagttggagcaacagatgataaaattccacaaattcagtgaactctgagaataaatatggaaggtccgcagttaattaycctgcaaagaaaacgaaccttgaactttctgttaatagactttgcttcccaattaaaagctagcagtttgaaaggtttacctcatcagcgattccctatc

SEQ ID NO: 35157 - DNA, 201 bp, Homo sapiens
gcagctataaaattaagaagatacatgtttaactttgtataacccagtatttgtcatatttatttgagccaggaacatccaagaaactagcatcctaaagrataaacatttagaaattcccttataacccactggttcaaatgcccattttcaaacccttgcttattcagatcctacatcagacaaaggtttagaggccaa

SEQ ID NO: 35158 - DNA, 201 bp, Homo sapiens
gaatcatattagagcctacaaatgatatcccacttatctttttgtctgttaaatactttaaaaatgttttcagtgatttgtaggagtggttattatcaaayttttattttagaattgtagattattattattattattatttgaaatttgacagactttcctttgttcagatccaagctgtgccgcttattacatgtgtaa

SEQ ID NO: 35159 - DNA, 201 bp, Homo sapiens
ccctaatgcttatataaagcagttaacttacttttgtatttttagtttcgtatcatttatttctgctctcatcttggctagcaaggactgaacattccatwtttccatgctggcctcctatttcactcacatcatctccccaggacaattgtcttctctaggatgttcctgttgatcaattgtaggtgcaaagtcaccctc

SEQ ID NO: 35160 - DNA, 201 bp, Homo sapiens
taaaacagtatgacaacatttattgaatacatgttatgtgctaggtaccaagtgaggagttttatgtttattttctcatttcatcctaagagcaaacttcrgaggtaggtgtgattcgtctcattttagtgaaaattcactgatgctctgaaagcaaaattaactttcccaagggccttgtagtgcttaaaggcagaatca

SEQ ID NO: 35161 - DNA, 201 bp, Homo sapiens
atcatcatcactgacattctgatagcctttgtttgttgagcacttactgtgtgcagtgctattccttaatttattaaacctttgcaatttgattatgtagrtactatgattattattatcatgcccatttcacatataagaacactgagtcttggagaacttagatcacttgcaacatctggactcaagggcaaggacttc

SEQ ID NO: 35162 - DNA, 201 bp, Homo sapiens
tattctagtgatgattttaattatcataaaataatttttaggaattatctataaaggtgtgcctgttaaattctataaaatctgttaaaatctgaatctgytaaatgaatctttatcactaaaatgtttttactttcatgatacagcattgcataattacagtatactatttccatggtgtggcacattatttcaaaacag

SEQ ID NO: 35163 - DNA, 201 bp, Homo sapiens
ggggaggaccgaaatagtatgccaaattcttttccagccctcaaattttatgagcctgagttgcattgtgtgggtaaaagtcttgtgctctgtggatcagraggaagttagatgttttggatatttacatagaaacaaagaatttgaagactggaaagaacttgagcaggactctattaaatgtgttttgtgtgagatggt

SEQ ID NO: 35164 - DNA, 201 bp, Homo sapiens
tgagaggggtgaagggtggcaggaaagaatttgatttccaactgtattgaatcagatgtgacttatacttgtttatttttaatattttatcagcatctttrcagttcaagtggatgaaaacagaagatacatgcaaaacctgacagttgaacagcctatcgaagttaaaaagcttttcgttgggggtgctccacctgaatt

SEQ ID NO: 35165 - DNA, 201 bp, Homo sapiens
ctacctgtctcttagagttcttgttagcagaaacaaatttctgtgtaataaagtgcctggcaaaaagtaggtcctaaataaaatgttattttccccaaggraaagattattaggaattataacattgggacacacctttgtttaaaaagctctaattaacaagaaccacagcaggggcgcgcatacaggggttggagagaa

SEQ ID NO: 35166 - DNA, 201 bp, Homo sapiens
aactgatatggtttaaaaaaaaatcttaaacccacattccaaacaaataagaaatagggtataagtaatcaggtaattatgaaactctaagaatcagccaytgaaactgtaaaaaaaaaaataaagctgacctattacaatactaaagtaatacaaagtttaatgtacctttttgcacatagcaggcctcagtaaaaagct

SEQ ID NO: 35167 - DNA, 201 bp, Homo sapiens
aattttatagaagaagcatttctgaagatagaaaataaggataatttttaaacacaagaaatcacatgcttttcatatcattatcaatgtggaaaatgctraaacaacttgctattaaaaaccatttatcagaaacttgtttaattaatatgtcaaatatctgggtttttaaatcatgtataacaatgaaaatattcctaa

SEQ ID NO: 35168 - DNA, 201 bp, Homo sapiens
aatgaatttggcttataaaagatatgaggcatttaacagcaattggagccaaacttggtgttctttctgatttttttaaaattaatataccagaggaatchtaaaatgttatggaacttatttcctcaagttctggaaatcattgggttaaacatagctaatttcccccttatgttattatagagtttatatttatattac

SEQ ID NO: 35169 - DNA, 201 bp, Homo sapiens
tacctcggtgaggttctagacttctgccctgctgcagctactcagtactttaggccatgacctccgctctccttcctcagcaactcaccacagaccttccrgaaaaatgttaaacccttctcatccttttcttgttattggtttctattttctttctttcttttttctttagcgtcacaggggaagagctgataattgtat

SEQ ID NO: 35170 - DNA, 201 bp, Homo sapiens
tattattattaggaattctgaggtggtggaataattcattttccaatgtgttaacttctcatgagtttaatgtgagtataaaaagtctgttttaactgagrgcagagtattcctttttctcttataatacaggagccagttacaacacaggaggtgaaatggcctgtttgcttacctgcaacttcaggaatttcatgctta

SEQ ID NO: 35171 - DNA, 201 bp, Homo sapiens
gagtatctacctccctgactgattgtgaagatgaaatgaaatagtcagtagaaagtagttagaatagttcacagcatacagtatttattatttttatgattaactaatgttttatgaggtccttagagtgctagacactgtttgcatgaattattttatatgatctcaccacaaccttataaaaaagtttttattgtccga

SEQ ID NO: 35172 - DNA, 201 bp, Homo sapiens
aagtctccaaaattattcatccttttggggacaactataaccatgattttttgtgacactcataacctgttgaattggaaaaatattaatgttagaaatcygttctcatgtcacttttaaaattcttctccttttttgcctcctgtagcatgagtcctagtttgattaaactagacacttgattttctccaatggtaacat

SEQ ID NO: 35173 - DNA, 201 bp, Homo sapiens
attttgagagccagtgcaaactgcaccgcaggtgtattgcctgttcaaatttttctttaccactctatattaacacctaagttaaaggccggcacaataarcaatgtgttgcttgataatatttgtaaaacaaatggattagtgaacaagttaatatgtcactctgtggtctttaaaatatatatggaaatgcagaatatt

SEQ ID NO: 35174 - DNA, 201 bp, Homo sapiens
aatcctcacaactttatgaaggaagtatatgtgtgagaaaagatacacacgattagattttgagagccagtgcaaactgcaccgcaggtgtattgcctgtkcaaatttttctttaccactctatattaacacctaagttaaaggccggcacaataaacaatgtgttgcttgataatatttgtaaaacaaatggattagtga

SEQ ID NO: 35175 - DNA, 201 bp, Homo sapiens
cttaatatcttcttccacgtatgcaatccaactgatatggtttaaaaaaaaatcttaaacccacattccaaacaaataagaaatagggtataagtaatcargtaattatgaaactctaagaatcagccattgaaactgtaaaaaaaaaaataaagctgacctattacaatactaaagtaatacaaagtttaatgtaccttt

SEQ ID NO: 35176 - DNA, 201 bp, Homo sapiens
cctccccttgacactgatacgtattcagaggcacacacatacatgcatgttcattattccaaatgggtagatgttaatttagcaccaggctctgttgtttyctgtcttgaaactttcatgcatgtgaatctatgacaaaatgaaaaattcttttctcaaaatggacattttccagtattggatgaagtggtctgctctctc

SEQ ID NO: 35177 - DNA, 201 bp, Homo sapiens
agttctgaggctgggaagcccaagatcaaggtaccagcaatgttcgatgtctagtgaaggcctgttcctcacagagggtgacttcttgctatgaccccacrtttaattcatttaatatctggatactgaggaaaaggatagctagctctctggggtctctttaataagggcactaatcccaatcatgaaggctacattctc

SEQ ID NO: 35178 - DNA, 201 bp, Homo sapiens
ttacttcctgatgttacttaaggttaccagtactgtattttttacctgcctggtttgacactgacttacaggactactaaaaaaaaatataccttaggagwtttttgtgccactcttttgtttcactctgagacatatctagaagattgagtatatttgttgggtttgaatgataaaggagaactttagaccagacttgaa

SEQ ID NO: 35179 - DNA, 201 bp, Homo sapiens
ccttacaaaaccaataaaattcaaattaaaaacattaatataaagtaacatgattttggctgaatggaaattgctgcttgcaacaagaataggatattgastattttcacacagttcttccaccagagatgatgtggtaactcatttctcctaccttaccacatttgaaccagagagccccctacaaagggtcctgaaatg

SEQ ID NO: 35180 - DNA, 201 bp, Homo sapiens
tgtgtggttcatcctgggactttatggagggtagctgatgcatcaaaaaaaaattatatatatatatatacacacacacacacacacacacacacacacayacatatatatatatataaagttttacagaactttgttttcaacttttaaaacaggatttctaaagaagttatgtggttttttttctttcatggcaatggc

SEQ ID NO: 35181 - DNA, 201 bp, Homo sapiens
tcctgggagaaggggagaatgaaaaatatgtaaacattgccccaactgaggtccccccaaaggctcactgatgaaatttcttgccttaggtgtgcagaagrctattttggacaaccctctgtacctggaggatcatgtcagccatgccaatgcaatgacaaccttgacttctccatccctggcagctgtgacagcttgtct

SEQ ID NO: 35182 - DNA, 201 bp, Homo sapiens
atggggtatccatcacctcaaacatgtatcctttatgtttcaaacaatctgattatactcttttagttatttttaaatgtacaattatttttttttttttactgtagttacccttgtgctagcaaatactaaatcttattcaaactatttttgtatcattaaccatccctactcctccctgccactaaccttcccaacctc

SEQ ID NO: 35183 - DNA, 201 bp, Homo sapiens
ctactaattttttatttttatttcttgctattaggggtcccaatgcatctacattgtctacagctatgcaggggaggagggaaacaatgaggatcttcaayttagactgagaaaagcacactaatggacttaaaaaggcatgcggggattgggcttaattgtaaggaagcaaaaaaacgaaaataaaaaaatcttatttat

SEQ ID NO: 35184 - DNA, 201 bp, Homo sapiens
aagcagcaaaaagaaaaatggtgtgtgcagcattatctttctgccacagatacatgtttttaatttccaagtttccaatgcatcattcagttttatctaaygggaatgcagctgagagaagtttgtaacaacccaaaactacatgctaatatagtttagttttcaagtcttgtggagtctttttttttttaatggaataag

SEQ ID NO: 35185 - DNA, 201 bp, Homo sapiens
acgtcagctattgtttgttgtgaattgccacacattccctaccaacaattgtctggccattagaagacacatgaaacataaatacattcttcttgattgaytaaatgaagcagagcccagtctatgggatatcatccaagttcaagctggcggcttcgtggctccagctgagattatcaggaagtcaattcactaacatgt

SEQ ID NO: 35186 - DNA, 201 bp, Homo sapiens
gcccctcttgtgtcgcagaaggacttgacgactaccgctgcacggcttgtccacggggatatgaaggccagtactgtgaaaggtaccaacagccatgaaaygtacagagtaatgatatgtagggactatatggtaaagggtcacaataggaaaacattcattatttgaagaacttcaatatttgcatatcctttagaagtt

SEQ ID NO: 35187 - DNA, 201 bp, Homo sapiens
ctgtttagagacctaattgaattcttgccaagtttgggcatgatccagagctgctccaattctcggtattttccatgctatgtattttcccctattctaasatgtatatagcattgatacctctatctgcagaatgtaagaaattgtaactgtatacatgagagtatattataaatgcagtagttcctgctccttggcgtg

SEQ ID NO: 35188 - DNA, 201 bp, Homo sapiens
cacttttatatatgtattccttgggtttccttttgatatttctcactataacaggagattatttttatatgaaataataaaaaaaatatacttaaaaaacrctgttatctatactgttaattattttagaatatcacatgtaaattaggtggcagaagccatagcagatttgcatgtcttagaaaatagcaggtaatttcg

SEQ ID NO: 35189 - DNA, 201 bp, Homo sapiens
tcacacagaacagcaagaatgaatgcaatgttgtcgaacctacatgatgggaatacttcaagggagtattccgtgttttcttatgaccaaaattggccaaytgaaatgaggcttgttgggtctgacacttaggaccacactggtaacattcatgataccggtctcagtgtcctggggcagaattaatctcaagcttttaaa

SEQ ID NO: 35190 - DNA, 201 bp, Homo sapiens
tcaggggaaccaggcagggccaagttggtccagtctcctccaactgtgagcattctaatctgttcaccccagtgtgccatacaatgttgtcattttccctrtgcatcatgttgagaaatgattctgaatcactttgaaaaaaatcacacagaacagcaagaatgaatgcaatgttgtcgaacctacatgatgggaatactt

SEQ ID NO: 35191 - DNA, 201 bp, Homo sapiens
ctacaattagaaagtgggtaagtctcattcttaaacatatacttttgcattatagtcacatgaaaccactgagcgtgttcatgtgtgtgtgtgtgtgtgtkagagagagagagagagagagagaaagcccaagagtgagagtttgtcttgaggagaagtgtttaaaaggaatatataaatcaaggatgcactatagtatca

SEQ ID NO: 35192 - DNA, 201 bp, Homo sapiens
aactagataaagcaaagaaaaatctgtcaattactcagccagtttcatcttagtagcctactgtaaattgaggtctatgtttttgagtgaatgaaatctartaaattaagttcaccaggtcttattctagtttattttagatggaaatgtatgatttttaaaagtgggagtaaaatcttacacatatttctgaaatgttaa

SEQ ID NO: 35193 - DNA, 201 bp, Homo sapiens
tttgagatagagaaacctattgatttatgtatgacaattattaaacatgctttatctcaagtaatcctcagatccaccctatgaaaagcagaacctaccaytgattgagtgcttactatctcctgtacacttcctaatacagttacaccaacatcatcgactataatttatgatccccattttacgggtgagagaattgag

SEQ ID NO: 35194 - DNA, 201 bp, Homo sapiens
tctttaagaatgttgaatattggcccccactctcttctggcttgtagagtttctgccgagcgatctgctgttagtctgatgggcttccctttgagggtaamccgacctttctctctggctgcccttaacattttttccttcatttcaactttggtgaatctgacaattatgtgtcttgaagttgctcttctcgaggagtat

SEQ ID NO: 35195 - DNA, 201 bp, Homo sapiens
atttctccttcacttatgaagcttagtttggctggatatgaaattctgggttgaaaattcttttctttaagaatgttgaatattggcccccactctcttcyggcttgtagagtttctgccgagcgatctgctgttagtctgatgggcttccctttgagggtaacccgacctttctctctggctgcccttaacattttttcc

SEQ ID NO: 35196 - DNA, 201 bp, Homo sapiens
aaatgcttaattttatatgatgtgaatttcatctaaactaatgacaagaaaagtaaatgcctgtgacactgcatttttcattgacagggttcctcagtgargggggaaaaaagcatttaatgattttcaaatgacacatgtaacctaaacactataggacagtgatatttgcctaatctagaaccttctaccaggttgtcc

SEQ ID NO: 35197 - DNA, 201 bp, Homo sapiens
gaaatgtctctcttctcagtcctcaggtggaagatagtgaggggactattcaatttgatggagaaggttatgcattggtcagccgtcccattcgctggtamcccaacatctccactgtcatgttcaagttcagaacattttcttcgagtgctcttctgatgtatcttgccacacgagacctggtaaagatcatatgcatag

SEQ ID NO: 35198 - DNA, 201 bp, Homo sapiens
agaaaaaagattagattctatttattatgtaaattacaaacattaggacacatttctcttaatatcttcttccacgtatgcaatccaactgatatggtttwaaaaaaaatcttaaacccacattccaaacaaataagaaatagggtataagtaatcaggtaattatgaaactctaagaatcagccattgaaactgtaaaaa

SEQ ID NO: 35199 - DNA, 201 bp, Homo sapiens
tgctcgttagttgtttcagtttcttcctagcatcgatggtctttacaatttggcatgtttttgcagtggctggtactggttgttcctttccatgtttagcrcttccttcaggagctcttttagggcaggcctggtggtgacaaaatctctcagcatttgcttgtctgtaaagtattttatttctccttcacttatgaagct

SEQ ID NO: 35200 - DNA, 201 bp, Homo sapiens
gcatccgccttggtggccagcagttcttactggacaaaaacatcaaaccctaagagcctgaagtagttacttaagcaaataggacaagcaactgaactgaktttttcttctgggaaagctttcttcacacaggtacagaaataggctaaaggtcaggaagtagggtgagatattttaggagtcatttggggtttccagaat

SEQ ID NO: 35201 - DNA, 201 bp, Homo sapiens
tgttatgccacattatagaagccgtgagaagtgacataaaagttctagaaagaacaatcacctctagtagggcctgaagatttcctgaagggaaggatttsagccaggcattgaggtgggatagtgctggggagttgggggtggagtcaggtaacagggagagtattctgagaagagggaatgacttaaaccaaggcagtg

SEQ ID NO: 35202 - DNA, 201 bp, Homo sapiens
gattcccaaatctaacaagttatttggtaattgtgaatcactgatcaacaaaaatctaccatcactcctgagaaaggaactgaaaaatgcaggccatagcragaatcagttgcttctttcttatggttacaagatgccatatcatatgctataaaatgtctatcggtaatttttaaaactgtgattattatgagtcaatag

SEQ ID NO: 35203 - DNA, 201 bp, Homo sapiens
catttaattatgtgctcttagagtttatttaaaatttattttcatgcactaaaatgatttggagatacaaatagtgaaaagtatatttcttgtaatgtttygtagtaatttttatttggtttcaacagtcaatgaaaataggttaataaaatgtctagtatttcataataacctactgtgtgttacatattataccaagaa

SEQ ID NO: 35204 - DNA, 201 bp, Homo sapiens
gctataaatttccctctacacactgctttaaatgtgtcccagagattctggtatgttgtatctttgttctcattagtttcaaagaacatctttattccagmcttcatttcgttatatacccagtagtcattcaggaacaggttgttcagtttccatgtagttgagccgttttcagtgagtttcttaatcctgagttctagt

SEQ ID NO: 35205 - DNA, 201 bp, Homo sapiens
taatgttttgtagtaatttttatttggtttcaacagtcaatgaaaataggttaataaaatgtctagtatttcataataacctactgtgtgttacatattayaccaagaagtttatattcatttccttttaaatcaagctcatggtgtatggactattatattatctccattgtatagaagaaaaaattgaggcctagaaag

SEQ ID NO: 35206 - DNA, 201 bp, Homo sapiens
tagtgagccaagattatgccactacactccagcctgggtgacagagtgagactctgtctcaaataaataaataaataaataaataaataaaaagaaaaaaraaaagaaaagaataggaagagcaaatatattaagtggaagtggatcattgtaaaggtcttcatcctcgttgtcttcattttgagcagactaaagaggagg

SEQ ID NO: 35207 - DNA, 201 bp, Homo sapiens
tccattccccattgcttgtttttgtcaggtttgtcaaagatcagatggttgtagatgtgtggtattatttctgagggctcttttctgttccattgatctayatctctcttttggtaccagtaccatgctgttttggttactgtagccttgtagtatagtttgaagtcaggtagcatgatgcctccagctttgttcttttgg

SEQ ID NO: 35208 - DNA, 201 bp, Homo sapiens
agaccattaatgtcttaattccagcttgctgagaacctctggccaaaaaaggatcaaatgactccattgtagacattctcttttacttcatttggggccayagtgttgattcaggatcttttttctcatttctacttgacttcttgtgaagtgttctgcagttaaatctttcaaaaattttcttactttcatagtgctgtc

SEQ ID NO: 35209 - DNA, 201 bp, Homo sapiens
catactgataacatagtagattaacatatatttgtgtgggtattatatattgtattcttataataaagtgagctagagaaaagaaaatgttattaagaaartaataagggctgggctcagtggctcatgcctgtaatcccagcacttcgggaggccaaagcaggcagatcacttgaggtcaacagttcaagaccagcctgg

SEQ ID NO: 35210 - DNA, 201 bp, Homo sapiens
aggagaatcgcttgaacccaggaggcggaggttgcagtgagctgagatcgtgcctctgcactccagcctggtgacagagcgagactccatctcaaaaaaawaaaaaataataataataagggtaaatacaaggagtgtgttttgaatacaaaatatctatttttagaatctcaaacccatgagttactttcttccatatat

SEQ ID NO: 35211 - DNA, 201 bp, Homo sapiens
gatccacccttatcaaatgaacatatgttataacatgcattttgaattctaaatacacccttaagtttatcttttttttagtatttttttctctttaaccwtgctttattcttaatgcacatattttgacagatagaattaaattctttttagaacaaggttaattgtttctctatgtatgcattcacatacataaacata

SEQ ID NO: 35212 - DNA, 201 bp, Homo sapiens
acaaggcaaagaagcatggctggagtgaaacatgttgctgaaagctaaagctagcacctgagttctctgttggttcttcatctggtgttcagctctattgyttcagacccaaattagaaatatgtgcaaagagagaagtgaattttgaaacatgccagagggtatgagatggcaaggttgcttttgtttggttaggtttat

SEQ ID NO: 35213 - DNA, 201 bp, Homo sapiens
aaagaaaaaagaaaaaaaaatccaaagttataaatgcacagtcttacatacttctcttctgggaatttattctgtaagtatatatatatatatacacacayacacacacacacacacacacacacacacacacgtgtgtgaaatgacatatatgcaaagtgattcattccagaaatgtttgtaattgtcaccacaaagctg

SEQ ID NO: 35214 - DNA, 201 bp, Homo sapiens
tcccccttcgcttggcacttcttcttcctgctgccttgtgaggaaggtaccttgcttccccttggccttctgccacggttgtaagcttcctgaggtctccscagccgtgctgaactgtgattcaattaaaactttttcctttataaatcacccagtttcgggcagttctttatagccttgtgaaaacgactaatacagcac

SEQ ID NO: 35215 - DNA, 201 bp, Homo sapiens
gcttttcttgtgatagtgagtgagttctcatgagctctgatagttttataaggggctcttcccccttcgcttggcacttcttcttcctgctgccttgtgargaaggtaccttgcttccccttggccttctgccacggttgtaagcttcctgaggtctccccagccgtgctgaactgtgattcaattaaaactttttccttt

SEQ ID NO: 35216 - DNA, 201 bp, Homo sapiens
tgaacagtattactctattcatataggcattccttttttagcaatttatagtaatttttaaggtattattcaaaagaaaagggagctgttaaatacattartagtgatagccattggaaattatttccatttcatttcctgacaacttcatgaaaaggtacaatttattctgaaatgtatgttctgagtagaatgattaat

SEQ ID NO: 35217 - DNA, 201 bp, Homo sapiens
aacagtattactctattcatataggcattccttttttagcaatttatagtaatttttaaggtattattcaaaagaaaagggagctgttaaatacattaatwgtgatagccattggaaattatttccatttcatttcctgacaacttcatgaaaaggtacaatttattctgaaatgtatgttctgagtagaatgattaatat

SEQ ID NO: 35218 - DNA, 201 bp, Homo sapiens
caaaattgtattgataactaagtgctgatattccattttgagtatatgggttctgatacaatacacaaagaggagaatatttgaatgttgctcatcaaggrcattcttactgttcagctgaccctgcattttagcttcttgtttatttttcatggttttaacccaccattaagtagcatggtttttagcatgaaaaataaa

SEQ ID NO: 35219 - DNA, 201 bp, Homo sapiens
ttcctcttgaaaactaaaagaaaaatagtttcttagtttaagtgataccaaaaccgctgaaatttcaattgtaaaatttcattaaacaaccttaatgaagrtcattctcattagctccatgtaaaatcacctgcctaaaacgttcccatattgataatggagaaatgtatgacgttagaagtttgttagttgcatgcttca

SEQ ID NO: 35220 - DNA, 201 bp, Homo sapiens
actctggttcattttctatgcattaaggatgatgtaactttaaaacctctcatgtaaattctgcctgttttctaattctacaatcctcttgtttatgttcyattctaataattatcgagcttttaaagaagagaaatctgttcttaactcaaatttatacatacactgaaggaaataacaaaaccttgaagtaaaacactg

SEQ ID NO: 35221 - DNA, 201 bp, Homo sapiens
tttttaaggaagtttttcagcaaaagtgtgtgtgcatgtgtgagagagagtgacagagtgcttgcgtgtttggtggtgttgagggaattaagtacttaacygggtttaaggacatttatactcataaagtgcagttcttctttcagaaaagatacattctgttaaagaaggtgaaccttatttgataaattcattcttttg

SEQ ID NO: 35222 - DNA, 201 bp, Homo sapiens
aattatttttcatattgtgtagattcacatctctttaatcaatgggagaccaagtgccgatgatccttctccagaactgctagaatttacctccgctcgcyatattcgcctgagatttcagaggatccgcacactgaatgctgacttgatgatgtttgctcacaaagacccaagagaaattgaccccattgtcaccagaag

SEQ ID NO: 35223 - DNA, 201 bp, Homo sapiens
agtctctattgaattgccctgtcatatataatagaaaacaaatctacttagggaaaacataataagagaaagattaattgagggcatttccctttaaaacrgtagcgcaacagaccttacagaattcaaaatggttgatggcccttcagagagccagtcgagaacgcattaccgtgtgtcaatcttggggtaggggttcat

SEQ ID NO: 35224 - DNA, 201 bp, Homo sapiens
aacccatgagttactttcttccatatataagtcccaacatgttttctataatcagtctatgtctattagatgtgtaattatattaattatgtaaatgcacrtgaataccaaattatttggttaatcttcgaatttcttttagcaattatatactctcctccaggttagattgagctttcccttcaactcagagaaatcagt

SEQ ID NO: 35225 - DNA, 201 bp, Homo sapiens
ggtagggctggtgcttgttacagtggccagtaggcctggtttctggttatagcacatggcagagttaggagctctacctacattatgtccccacggcctcrtctgtggtttccccataagaaaactaccttttgggaaaacatgatacaaacagatcaggtgaattagaaggtctcctgcagatttaaaattttatgaata

SEQ ID NO: 35226 - DNA, 201 bp, Homo sapiens
gaagcagctcatgcatgtctagtaggttcctggtagctggtaccctaagccctcagtaatcagtgttttgtcctgactaggtaggatgctttaaattagasgtgtagctgtaggcctgaccttggctgaagcataaagatgtaaaaacaaatcattatgcattcccagattcctcctttaaggttccttccatttctgggc

SEQ ID NO: 35227 - DNA, 201 bp, Homo sapiens
taaggaccaaaattcacttttatatatgtattccttgggtttccttttgatatttctcactataacaggagattatttttatatgaaataataaaaaaaawatacttaaaaaacgctgttatctatactgttaattattttagaatatcacatgtaaattaggtggcagaagccatagcagatttgcatgtcttagaaaat

SEQ ID NO: 35228 - DNA, 201 bp, Homo sapiens
tcggggcatagtggacactggtgatgaatttggtgtcagatccagaacatgttgtctgtacccctcttacagcagtgattttcttccaccttgtaatatamttatctgaagtccgcctcatcagaaagtacatagggaaactatcgtgactctatttctccaagtagaaactgtgctaagggaactaaagcaaaaaagaaa

SEQ ID NO: 35229 - DNA, 201 bp, Homo sapiens
tgtgttaatttaaaaatatacggcactagaaatagcaaccctttaaaactaaagtgcattcaaatctacctttgcatctaattcagtaatgaattctgtcwagggttttattctgaatttttaaataatcttctaaagtttgaacccagataagccttaaaatactcattatattcaaatttttctgttcaattataaaaa

SEQ ID NO: 35230 - DNA, 201 bp, Homo sapiens
aaaaagaaaaaagaaaaaaaaatccaaagttataaatgcacagtcttacatacttctcttctgggaatttattctgtaagtatatatatatatatacacayacacacacacacacacacacacacacacacacacgtgtgtgaaatgacatatatgcaaagtgattcattccagaaatgtttgtaattgtcaccacaaagc

SEQ ID NO: 35231 - DNA, 201 bp, Homo sapiens
aaaaaaagaaaaaagaaaaaaaaatccaaagttataaatgcacagtcttacatacttctcttctgggaatttattctgtaagtatatatatatatatacayacacacacacacacacacacacacacacacacacacgtgtgtgaaatgacatatatgcaaagtgattcattccagaaatgtttgtaattgtcaccacaaa

SEQ ID NO: 35232 - DNA, 201 bp, Homo sapiens
aaaaaaaaagaaaaaagaaaaaaaaatccaaagttataaatgcacagtcttacatacttctcttctgggaatttattctgtaagtatatatatatatatayacacacacacacacacacacacacacacacacacacacgtgtgtgaaatgacatatatgcaaagtgattcattccagaaatgtttgtaattgtcaccaca

SEQ ID NO: 35233 - DNA, 201 bp, Homo sapiens
aacagaaaaattatgaagtctctcaatggccaactaatgaatataaaaatactatttttcaaatgtttatactggaataagcacacaagacagcagaaaaycttttatttcatgcagaagatccataatgcttttctgattgatgtagagacttttagtaaaagagtaaattaaggaccaaaattcacttttatatatgta

SEQ ID NO: 35234 - DNA, 201 bp, Homo sapiens
aatcgcttgaatccaggaggcagaggttgcagtgagcagagatcatgccactacactccagcctgggtgacagagcaagggattccatctcaaaaaaaaaagaaaaaagaaaaaaaaatccaaagttataaatgcacagtcttacatacttctcttctgggaatttattctgtaagtatatatatatatatacacacacac

SEQ ID NO: 35235 - DNA, 201 bp, Homo sapiens
aaggaagttttagggtccatttaggaaaaagaagtccagtttgcccagagtaattgataaaggaaacacataaccagaaagatcaacagaggccaggtctygtcaggccttcaataatcagttaagcaatttcatttaacaacactggtacttgggataagcctcactggttaggataagctgaaagctttgagcatggaa

SEQ ID NO: 35236 - DNA, 201 bp, Homo sapiens
tggagtaaatgcctttcttatttgttcttaaaagtagttcacttattgataaggaaatagatgccaagtgaaaaagaggaaccttgtccgggaagcattaygttttgagatgggaagagtgagggcaccagagcatgaatgttgatatgagctaacacaccaatgagaaccaggacttgtcacacattcattccaaccaac

SEQ ID NO: 35237 - DNA, 201 bp, Homo sapiens
gtataatcagagctgtgctttttaaatataaatccagaagcagtgtatggggtagatgaaagaaagaagaatgaaggacccaactatagctgtggcaagakaaaagaagaacgtgatgtaccactcctatattttgcaatgttaacttggaagaagcaataagagtaaatattattttgtgaatctcacatttagccacat

SEQ ID NO: 35238 - DNA, 201 bp, Homo sapiens
gctcggcttaacttcaactttctcaggaaagctgcccctgcatcctcaagtcatatcattctcatggcataatcacttttcaaacctttttcttttcttttatgatctcataatgagtaattctgttttatgtctatcttacctctggtgatgatatggaccctatatattttctttaccattgcacaataagaagataac

SEQ ID NO: 35239 - DNA, 201 bp, Homo sapiens
tatttctcatcccatagtcaccaattcaaagccagacttaccttgtttctcctagtgttttctaatgaattaaatgaactggggggatctacagctctgtktttagccactcccagtccacaactctttcccgcaggtatctccacaatcgcagtaacatcagacagataggtaggtagatagacagatacataaaaatag

SEQ ID NO: 35240 - DNA, 201 bp, Homo sapiens
aaagtacacaaaaggaaaataactacaaaaggaaaccagtagccacaaaaatgaggatatttgtacacaaagaactagaaagggtagtctgaaataaatttgtattcataaaaatctgtgatcatattcttatcacataaatcataaaaatatgtttaaaatgtacaattataaaagcatgattagaagattgaagaataa

SEQ ID NO: 35241 - DNA, 201 bp, Homo sapiens
ttccaacactatgttgaataggagcggtgagagagggcatccctgtcttgtgccagttttcaaagggaatgcttccagtttttgcccattctgtatgataytggctgtgggtttgtcatagatagctcttaatattttgaattacgtcccatcaatacctaatttattgagagtttttagcatgaagggttgttgaatttt

SEQ ID NO: 35242 - DNA, 201 bp, Homo sapiens
atgtttggctttcaagcttaccttgcttgattcacaaagcttctaggaactataaattgagattttattccacatttaggaaattttaggctattttttttatttttacttattttttttaggcttttgtttaaaacctgttttttgaccagtgtttttccttctctttctaggactccagctgcatgtgtgctagggcgt

SEQ ID NO: 35243 - DNA, 201 bp, Homo sapiens
tcaacacagtatcatttcagtataaaatctcatattttgaataaaacaaacatatctttacacattattaaatgaactacgctgacaaattttgtttcttyttttgagaaccagaaaaacaattatacttagatgggccatctaaaatgtccttccagcttgtggagtaggttgtgtttgtttttcaatgaacatctgttt

SEQ ID NO: 35244 - DNA, 201 bp, Homo sapiens
tgaagtctttaaaattggctgctaaaaccaataaaattatatttttggaacatagttaaccactttgtgcacataagtgaggctgtagaaactagggttttaaatgacttaaaagatatatatttctccaaactataggtaattatatcaatattactttgacagagatatagtaattctccatcttatagtaaaatttat

SEQ ID NO: 35245 - DNA, 201 bp, Homo sapiens
ttaaggaagtttttcagcaaaagtgtgtgtgcatgtgtgagagagagtgacagagtgcttgcgtgtttggtggtgttgagggaattaagtacttaaccggktttaaggacatttatactcataaagtgcagttcttctttcagaaaagatacattctgttaaagaaggtgaaccttatttgataaattcattcttttgtta

SEQ ID NO: 35246 - DNA, 201 bp, Homo sapiens
agccaagatcagactctgagtattgattcgagatctaatgaatttggaatgttagaaactaaacagccagttttctcttaaattcttaaaaacaagtctcygcattttatatcttttaaatctggaattaccagaaatgtgatgcatatttcattttctgtatgttcctccccttcacttcaacacgtacccttgaagaac

SEQ ID NO: 35247 - DNA, 201 bp, Homo sapiens
gagataagtggaaggaatgaagatgtatttagggtatttcctgccctacaacagcctatagtctcattgctattcagtgatgcattgaataatgacagacygaatagatatgatctgattcatgtgaaatgtctctcttctcagtcctcaggtggaagatagtgaggggactattcaatttgatggagaaggttatgcatt

SEQ ID NO: 35248 - DNA, 201 bp, Homo sapiens
acatccttttccagctgcatttccaacaggaaactctagagaaacctctcatatgggacaaaaactggctttgcaattctttattttggagtgctgctgcrtacattgttcctgtgtaagagaggcacaatgcacatttgcatgtcagaagctctgtgtagttagttgttcagtaagaagaatgtttagctgtttaaccca

SEQ ID NO: 35249 - DNA, 201 bp, Homo sapiens
ggaggtcattatcctaagtgacataacccagaaacagaaaatccaataccatatgttctcacttacaaggcgagaagctaaacaatggatacacgaagacrtgaagatggaaacaatagacactggggactccaaaaggggggagggaggagaaggggtgaagatttaaaaatcgcctgttgggtacagtgttcactgtgt

SEQ ID NO: 35250 - DNA, 201 bp, Homo sapiens
attttaagtagagatgtgacagggtaatttcaatttaagtatattactcgaggtgtcagtgtggaagacatattgtcagaagaccaaactgaagacaaagygaacaattggattcaataatagtctaggcaggaggtaaattatgcttgaagtaagagatgcagtgggaattgacatcaaagaaatgcagaataaatccac

SEQ ID NO: 35251 - DNA, 201 bp, Homo sapiens
attgttatgagcacaatttctacccagattttgttggttcttttcaaatccatcaagtaaaacagtgtgcgtatgatttgtgaatactgcagttgctatartcacaataaaagagggtttcttgcaagaaactatgtaaaacaacttttatgaagaatagctgtccttagccccagataaaaactactgtcagccacaggt

SEQ ID NO: 35252 - DNA, 201 bp, Homo sapiens
gtgttagacatagttgagatccattataataatgtcactacattttgaaataaaattctgaaatgccttaatacataaatccttttatgaagtctttaaaattggctgctaaaaccaataaaattatatttttggaacatagttaaccactttgtgcacataagtgaggctgtagaaactagggttttaaatgacttaaaa

SEQ ID NO: 35253 - DNA, 201 bp, Homo sapiens
gttttaggttaaaaaaattctttaccttttagctttgatgaattacttcatttttatatctaataggtttttttaaccttcactttaattgatttcttaamctctttatcttgctcattttttaatctttttaatgattttaaaatgctgattttaataattttatcttggcatatttatatttatcagtttttctgcttc

SEQ ID NO: 35254 - DNA, 201 bp, Homo sapiens
cttattttttattttggggttttagtattttcatgttttaggttaaaaaaattctttaccttttagctttgatgaattacttcatttttatatctaataggtttttttaaccttcactttaattgatttcttaacctctttatcttgctcattttttaatctttttaatgattttaaaatgctgattttaataattttatc

SEQ ID NO: 35255 - DNA, 201 bp, Homo sapiens
ttaagactattagaaagttttcctgatcacaggtctctcttctctttgcagcctgtcgctgtaatgccggtggctctttctctgaggtttgccacagtcaractggacagtgtgagtgcagagccaacgttcagggtcagagatgtgacaaatgcaaggtaaggagtagaggctgacccataaattactttctccttacag

SEQ ID NO: 35256 - DNA, 201 bp, Homo sapiens
cccctttgcccaaataccactaagacacccttaagcatcaatataactatctactaccaagtgcttttacaaaacataaagcacttaaaaaaactaatgayttagttattgcacacctcatgaaaggtgagaggtggtttttacttattctagcacggtggcagtagagatggagataagtggaaggaatgaagatgtatt

SEQ ID NO: 35257 - DNA, 201 bp, Homo sapiens
gcatatgatgggccagacatgatgctaaagcctttatgttaattatccctacagcttgtagagttgttatagggattaaatgatagaatgcctaacagggyacttaacaaatcagaaaacattctgttactgaacttaggcgtccatgttaccatgtggggtatattattatttaacaagcctattaagactattagaaag

SEQ ID NO: 35258 - DNA, 201 bp, Homo sapiens
aggatctgggatacaatgggttcccgagtgcagtggtgtgatctcggctcactgcaacctccgccttccgattttcaagcgattctcctgcctcagcttcyggagtagctgggattacaggcgcccaccaccacccccgactaattttttttttttgtattttttagtagagacggagtttcaccatattggccaggctgg

SEQ ID NO: 35259 - DNA, 201 bp, Homo sapiens
ataaatttaaagtgtcaagtcagaaaaacattacaaatcaaatttaaatagtaccacagttattacctagaaattcatttgccagtcattcaccaaaagtytgttgagtatctactatgtgacaggctccataccaaatactaggaatccagtggttgttcaaatctaagatttgctttacaagatcattaaccatatatt

SEQ ID NO: 35260 - DNA, 201 bp, Homo sapiens
tgaatttcagtgtcttcatgctcaaaattggaatgatgatgatgacattaatattttaatggcatatgatgggccagacatgatgctaaagcctttatgtkaattatccctacagcttgtagagttgttatagggattaaatgatagaatgcctaacagggtacttaacaaatcagaaaacattctgttactgaacttagg

SEQ ID NO: 35261 - DNA, 201 bp, Homo sapiens
cctccctagtgccatgctgtctgctgaagaatcaaactgtgctctcacatgcttaccactgccttcttgctttttgcaggcctgcagatatgcaaacattyacacagcctttgcacctcttgtcaaagctgtttatctattgacatgtttatttaaaactagctatggtgccagatgaaggaatctctggaaatactatat

SEQ ID NO: 35262 - DNA, 201 bp, Homo sapiens
aaatttgctgctaaccttttgtttttctttgaccaataacatttctcagcttagtgtatgggctatgtaaagtgcctgtcaaatggagggatgtctttgtkgaaagaatccagactcacagaaagtgagtgactttctggtcagatggttagaactctcccaattttgacaaagatcgttctctgtttgggatttgtaaag

SEQ ID NO: 35263 - DNA, 201 bp, Homo sapiens
attgccccaactgaggtccccccaaaggctcactgatgaaatttcttgccttaggtgtgcagaaggctattttggacaaccctctgtacctggaggatcaygtcagccatgccaatgcaatgacaaccttgacttctccatccctggcagctgtgacagcttgtctggctcctgtctgatatgtaaaccaggtacaacagg

SEQ ID NO: 35264 - DNA, 201 bp, Homo sapiens
ccattgttgtactctgtgacagtttcattgaaaggactgtcatgttccatgaggaactcagcctacctgctcttttaccagtagctggtgggaaagccatrctgtgccaatgacttattcacaggaggcaggtcaatcttttgaaaccacagattgtttcaaatgagagaaaaatatgtgagaagagaatagatgtcaagg

SEQ ID NO: 35265 - DNA, 201 bp, Homo sapiens
gatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttgtctttggtgaaaaaaataaaacttattt

SEQ ID NO: 35266 - DNA, 201 bp, Homo sapiens
gaaagtccctagagaaggataagaaaatggggcaatacataagcttggaaatagatgatgatatttcttttttttttaatttaattttatttatttatttwttttattaatcattcttgggtgtttctcacagagggggatttggcagggtcacaggacaatagtggagggaaggtcagcagataaacatgtgaacaaagg

SEQ ID NO: 35267 - DNA, 201 bp, Homo sapiens
ggatgatggagaaagactgaattttgcaagcaggttataataactcctgagagtgattgtaatagggtgattaggtcatgcatggactacaagggatcaartagaaaaggagtggtaaagtagtaaacagcagagggtacaggctactcttaagaaagtccctagagaaggataagaaaatggggcaatacataagcttgg

SEQ ID NO: 35268 - DNA, 201 bp, Homo sapiens
aaatgttattttccccaaggaaaagattattaggaattataacattgggacacacctttgtttaaaaagctctaattaacaagaaccacagcaggggcgcrcatacaggggttggagagaaattcagttagtgctgtcttctggacactccttctatcttcattctctcctctgccattgttaaccttccattttaggcaa

SEQ ID NO: 35269 - DNA, 201 bp, Homo sapiens
gagataaggagttcctgtctgctttctaaacaatgcagtttgaacagagaagtgcctcatctttccttttttccatctatttctgaattcttatcttcatmacattaaaaataccttgagagacccaaaagaaaagcaagaaggcatgaggactgtacctctgtcacaacacttagcatcctggtctaaaatgtaatttac

SEQ ID NO: 35270 - DNA, 201 bp, Homo sapiens
tacaatcatattttacaacagtgacactttgcagatgagtctaaatcccagtagttcctgtggatagtaaaacttacagaaagagccatagattaggcatrtttctaattaattatctgattcctaattagatatctttgttatttagcatttttaaccttgctttattttctaactacttatctagattatagaaaacta

SEQ ID NO: 35271 - DNA, 201 bp, Homo sapiens
atcctctctcctcagcatctccaagtaactgggactccaggcacacaccaacatgcccagctactttttttggaggggagggcaaagacagggtctcactmtgttgcctcaggctggtcttgtcttgaactcgtggcctcaagcgatcctccctcttcggcctcccaaaatgcagggattacaggaatgagccactacact

SEQ ID NO: 35272 - DNA, 201 bp, Homo sapiens
acaaagctaggtatcatcagatccaggctctaagtccttacttggggacatattggtcatttggcctgaaacaggccatttaaccttctgaaattcacttrgtctcttctgggaagtgcacctaccccagaaagattttgtgaaattaattccagtaatgtagtacaagtgctctgaatctcacagcatgcttcacaaata

SEQ ID NO: 35273 - DNA, 201 bp, Homo sapiens
ttgtgacaataagtgtgtaaaggacactgttggtgccctgcctaggcacctacactgaagccttctctccaacagaagaggcagaaaggcctgaatgtttmcccgcccttcctgcagtggcccatgactaaccagcgtgagagtacaaaagtccagctctttggcccctaagtggaacaagttttgagatcttattttatg

SEQ ID NO: 35274 - DNA, 201 bp, Homo sapiens
aaaatgcagggattacaggaatgagccactacactcggccagtaaacctaatttttaaacatctgttttttagactatataatccaaaagaatgtttcttrgactttgttttacttaaaagccttaaagagatatgtaatattatcttattttttagctatctcccaagaaaaagcctcaaataaaaaaaaatctttttca

SEQ ID NO: 35275 - DNA, 201 bp, Homo sapiens
aatgattatgcatcttctgtcttgtagctcccagcagtaggaggacagttgacatttaccatatcatatgaccttgaagaagaggaagaagatacagaacrtgttctccagcttatgattatcttagaggtagagtactgagagcatgttcacccgtgttacttcctgatgttacttaaggttaccagtactgtatttttt

SEQ ID NO: 35276 - DNA, 201 bp, Homo sapiens
taaatgacgagttaatggatgcagcacaccaacatggcacatgtatacatatgtaacaaacctgcacattgtgcacatgtatcctataacttaaagcatamcaataaaaaaagaaacttaaaaaaaatgaaatgtccgtatattttcttgattttttccaaatgttttgaagaaagtttttgtattattaaatgctattca

SEQ ID NO: 35277 - DNA, 201 bp, Homo sapiens
agtaaatcattaaatcaaaaaaactaactaaatttttctagattaatagtaacattaaaattttgccaggggtgctattaattttgaaaattcctcaaaaytattttagttctaaagtcagtatgcattacttacaatgggataatagtattttaagtgttaccctgatgtatctgtaaagaactaaaacagcgttacacc

SEQ ID NO: 35278 - DNA, 201 bp, Homo sapiens
tcatgtcctttgtagggatatggatgaagctggaaaccatcattctcagcaaactatagcaaggacaggaaaccaaacaccgcatgttctcactcataggwgggaaacgaacaatgagaacacttggacacagggtgggtaacatcacacaccggggcctgttgtggggtggggtgaggggggagggatagcattaggaga

SEQ ID NO: 35279 - DNA, 201 bp, Homo sapiens
gaatcttaaaaaaggcataaatatttcacctcaaaccattttttaaacttaacacaaaaccggcacacagtaaatcattaaatcaaaaaaactaactaaayttttctagattaatagtaacattaaaattttgccaggggtgctattaattttgaaaattcctcaaaactattttagttctaaagtcagtatgcattactt

SEQ ID NO: 35280 - DNA, 201 bp, Homo sapiens
actatatttaaaataagtatttgcgttaatagtaaagaagtgtgagatagttctcctagcttctcaggagcattttaattcttactagcattagcataaargctgtgagcaatgggcctccataaatggctgaacaaacctcagagatgtgcagggctggtatcctctggctagagctaaaagcctggtgttttggcattt

SEQ ID NO: 35281 - DNA, 201 bp, Homo sapiens
gcagttcttttgtttgtttatttgtttgttttttaaaaggagaacctagagccaggagaataaaatattagcataggctgatagagtacctgtttatagcwtaattttaggttgtgttcaaatcaaaatattcagaaatttaacaaaatcatctatgagtagcctaaattcccatgtcatctcctccttgtatttttattc

SEQ ID NO: 35282 - DNA, 201 bp, Homo sapiens
actgttctctcaatatcaagaggtagcaattttaaatgttctgtgttttaaactttaatgtataacttacgtcagtcaatcctgataataccactattctyactagtcatcaacatcattatcatcattgtcatcatcatgtaacaattatataatggttaatattggccacaaatcaatcctagttccttaaaatctatt

SEQ ID NO: 35283 - DNA, 201 bp, Homo sapiens
aaattgttatattgtattgaatcctgctcttatatgtcttgttttttacttctcgttattttttattttagtttactacattttcttagcttcttgaaatsgatacctatgttattaatatttcagttcttttttcctaatatatttattaacgcctacaatttgcctctacatagggctttagttgcctcctacaagttt

SEQ ID NO: 35284 - DNA, 201 bp, Homo sapiens
acttcacagctgttgaccatcaatccaacctttatttgattaagctcagtatatagtacatcactggaaaccagtcatttagttaattggccatataaacraacagttttgccattcattgttaattacaggataatatatgacatattagtgtgtagtcactgaactctgtgccaaaacagtaatacatttgctaccata

SEQ ID NO: 35285 - DNA, 201 bp, Homo sapiens
aaatctgactcatgatgtttctcctctcccatcacttttcactgtgttctgctgatctccatactgtttcctcaatgatgggcccaaaaaatgctggaagktttcttctatttctctctttgagaatcatgaggcactcattgggattgtggttcttggattgtttccctctttgtatgtatttatgtatgagccatatac

SEQ ID NO: 35286 - DNA, 201 bp, Homo sapiens
tgctggtattcaaatcccagcactgtaaccgaccatctgtgtgaatttgggaaagctacctgtccaatctatttctcagtttcccatccaagtactaaccrggcccaaccctgcttagcttttgagatcagaaaagatcggatgctttcagggtgatttggccatagactatttctgtttcctcatctgtcaaatgaggat

SEQ ID NO: 35287 - DNA, 201 bp, Homo sapiens
tactcctatcctcccgtaaacactatctagaaaattgtcacccaacctattgtagaactaaaaacctagtggtcttcctcatcttcattgtcttcattatytccactacacgaaacattcccttgtaacaaatataatattcacagcattgtgcaaaaaatgtacattttaaatttctagtataaaatttgatttgtgact

SEQ ID NO: 35288 - DNA, 201 bp, Homo sapiens
accctgtgtttgttggaggcttcccaggtgagtgttggctaccccagcaacaatttctttgctctcttatgttactggttttgaaaacatttatatttacrtgtgtctaagaatgtgtgcttatgtgtacttgcttcctagctttagaatctgcttagaatctgcaccttacctaaaatttccagtgtgtaaaatgaacat

SEQ ID NO: 35289 - DNA, 201 bp, Homo sapiens
ctttgccatgttgctcagactgaactcctgggctcaaacaatcctccccacctcggcctcccatagtgctaggattataggcatgagccactgcacctggyttttatattcttaatatttcttgtttcttctatttattttctttactttaaactcgttgttataaagtggtatgggttaatcaagagtgatggaaagatt

SEQ ID NO: 35290 - DNA, 201 bp, Homo sapiens
tatgagacagctgtcattgaagaaattctgttgagaatctgaattactctccttctgtattattttaatgtttgatattcacatgatggttgttttaaccrtttttttttactttaaagaaaaagctataaactagttatatgatcttttcttcttcctttcatatgatgctgctaactcaatagagagacacccgattac

SEQ ID NO: 35291 - DNA, 201 bp, Homo sapiens
catttgtatgtgtgaaccatcatgatacttctttaatgaaaccatctgtgactgttctatttcctactttccagttgatgtttcatgtggacaatggtgcrggcagattcactgctgtctatgatgctggggttccagggcatttgtgtgatggacaatggcataaagtcactgccaacaagatcaaacaccgcattgagc

SEQ ID NO: 35292 - DNA, 201 bp, Homo sapiens
atccaagatgttctcactggtccgtggcaaagtaagaaaatgagaacaactttccacatttttcataaaaatagaaaggatacaatttaaataattgtcckccattttgatattatgggttttaaaaactaatgatggtttttaaatgccctttgtttcatgaaataataatgatgctttattaaatgatagaaatatatt

SEQ ID NO: 35293 - DNA, 201 bp, Homo sapiens
cttttacaaaacataaagcacttaaaaaaactaatgacttagttattgcacacctcatgaaaggtgagaggtggtttttacttattctagcacggtggcartagagatggagataagtggaaggaatgaagatgtatttagggtatttcctgccctacaacagcctatagtctcattgctattcagtgatgcattgaataa

SEQ ID NO: 35294 - DNA, 201 bp, Homo sapiens
atttgtgcatgtacatagaattctttctgtattcagatggtgctaattcagactccagactgaattttaattcaagttctttctcaagtctataaataatattaaactgattatttcattctaaataattgcctgttttgtgtgattttaaggataaaaggtaactggccataaattgttgagtttgcaacatgccctcca

SEQ ID NO: 35295 - DNA, 201 bp, Homo sapiens
aagggaccctgggaattgccttctagcagagaggccaactcacatttcaaataagtatttttccctcctcaactgcttttctaagctttgcacattaacaytgacctagtgcaccatttaaaagtcctaaatatatcacacagtcgccagcccaatcaaggtgagtggtcagacaccagcatgctgtgcacagtatgctag

SEQ ID NO: 35296 - DNA, 201 bp, Homo sapiens
ggagtgcaatggcgtgatcttggctcactgcaacctctacctcctgggttcaagtgattctcctgcctcagcctcccaagtagctgggaatacaggcaccygccaccatgcctgtgctattttttttttttttcatagagatggggtttcactgtgttggccaggctggtcttgaactcctgacctcaggtgatctgccca

SEQ ID NO: 35297 - DNA, 201 bp, Homo sapiens
aatttgtgcatgtacatagaattctttctgtattcagatggtgctaattcagactccagactgaattttaattcaagttctttctcaagtctataaataatattaaactgattatttcattctaaataattgcctgttttgtgtgattttaaggataaaaggtaactggccataaattgttgagtttgcaacatgccctcc

SEQ ID NO: 35298 - DNA, 201 bp, Homo sapiens
aacaaatgatagacattacttccttctggatgagcaaaaccttgatgctttcagtagaaggtatttggaactatggttgaatcttttctgggggtattgaygggactagagtcaggatgaggtggatgaaatgccaggtactttcatctgtatgacttgagagtgtatgcatcaaattttgcaccctcgagcacctctctc

SEQ ID NO: 35299 - DNA, 201 bp, Homo sapiens
tgacctgaggtggcagataccacaatttcctattagacaacttctctcacaattacctaagagccatgaatttgatttagaaatggggttgtatgtgtgtktttttctatcacatattaaacgcacaatctgtaaaaaagattcaggaggatgtttgggaaatgttttctgtgatatttatttttcttcagaagaagtgcc

SEQ ID NO: 35300 - DNA, 201 bp, Homo sapiens
taatttgtgcatgtacatagaattctttctgtattcagatggtgctaattcagactccagactgaattttaattcaagttctttctcaagtctataaataatattaaactgattatttcattctaaataattgcctgttttgtgtgattttaaggataaaaggtaactggccataaattgttgagtttgcaacatgccctc

SEQ ID NO: 35301 - DNA, 201 bp, Homo sapiens
tgttctttgctgtataaatggttttgtatgagttacttaaccacactgagcctcaaattcccatcagttatatgtggattataatgtctgcctcatgcttrttgtgaacattcaatgtaatcattcatatgaagaagcaatgaacacagggtctggtgcacataaatgttcaacaaatgatagacattacttccttctgga

SEQ ID NO: 35302 - DNA, 201 bp, Homo sapiens
aagttatgatttgtatttccccatttttatttacctgtagtgttttctaaaccagtcacagtctggatttactttacattattattatttattattatttwttattattattattattattattattatttgagatggagtctcactctgtcacccgggctggagtgcagtggcacaatcttggctcactgcaaccttcgc

SEQ ID NO: 35303 - DNA, 201 bp, Homo sapiens
tcttgttaacagaaagaatggaaatattatggggatgatcctcgagtccatagaactgtgacccgagaagacttcttggatatactatatgatattcattrcattcttatcaaagctacttatggaaatttcatgcgacaaagcaggtaaactctaatagaaaatattcaagctcttattttagagtctgtaaggaaggtt

SEQ ID NO: 35304 - DNA, 201 bp, Homo sapiens
aggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagttatt

SEQ ID NO: 35305 - DNA, 201 bp, Homo sapiens
gaggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagttat

SEQ ID NO: 35306 - DNA, 201 bp, Homo sapiens
acactgtttgaaaaaccttattttgtaaaaaaaaatctgttctattcactgtctcacagatttaggacagtttattaattaagaacactagatttcaagtyaaacagacctgaccttaaaccttgaccttgttctttgctgtataaatggttttgtatgagttacttaaccacactgagcctcaaattcccatcagttata

SEQ ID NO: 35307 - DNA, 201 bp, Homo sapiens
agaggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagtta

SEQ ID NO: 35308 - DNA, 201 bp, Homo sapiens
atattgctattttatgtgctttgaagcaattacactgtttgaaaaaccttattttgtaaaaaaaaatctgttctattcactgtctcacagatttaggacartttattaattaagaacactagatttcaagtcaaacagacctgaccttaaaccttgaccttgttctttgctgtataaatggttttgtatgagttacttaac

SEQ ID NO: 35309 - DNA, 201 bp, Homo sapiens
aagaggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagtt

SEQ ID NO: 35310 - DNA, 201 bp, Homo sapiens
tgccaggattttacccctcatatctgtcagttatcggctacaagtccaaggggcagggggaagtgcaagtgatgtatcttgctggaagtctcagggtcagraggctctcattcaaagaggcaggtctctggaatgatgcagctgcaagccattagcagccaacccttgcctcagctgagagatgggtaccaggatgaaagg

SEQ ID NO: 35311 - DNA, 201 bp, Homo sapiens
ctttacgtatcttgcctattaactcccaacaatgccccaaagcaaagagcataatttgtggctcctggtgattagatttatactttaatttgtcaagtttwaaaatttttttcaatatgcccagttacatccatttcaaatgattctggctgatgtctttcctagagacctgatcatttgtatgtgtgaaccatcatgata

SEQ ID NO: 35312 - DNA, 201 bp, Homo sapiens
catttccagtatggttttatatcactggtcatgaaggtacagttaggaaaaagaaataggaaataacctctacataataattttttaatcctttaattttwttgtgggtacacagtgggtgtatatatttatgggtgacctgagatattttgatgtaagcatgcaatgcataataatcatatcagggtaaatggggtatcc

SEQ ID NO: 35313 - DNA, 201 bp, Homo sapiens
acagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtgacaat

SEQ ID NO: 35314 - DNA, 201 bp, Homo sapiens
ttctgtaaaggttaactttttggctgaagttagaaattaagcattgaattaagttcttcatattctctaccttcaatgctaatttttaccttaatcaaaaagaaaaagtggtggccctctgtcctaacatctactcccctggcctgcttgagtctcaactaaaatattgacatttgccatcacacattttgctttagctgt

SEQ ID NO: 35315 - DNA, 201 bp, Homo sapiens
tttcaagtgatactcccacttcagcctcttcactagctgggactacaggctcttgccaccccacctggctaatttttctattttttttgtaaagatggtaytttgccatgttgctcagactgaactcctgggctcaaacaatcctccccacctcggcctcccatagtgctaggattataggcatgagccactgcacctggc

SEQ ID NO: 35316 - DNA, 201 bp, Homo sapiens
ttttttttttttgagacaggctcttactccgttgcccaggctgaagtgcagtggcaggatcatggcttattgtgcccttgacatctcagtttcaagtgatmctcccacttcagcctcttcactagctgggactacaggctcttgccaccccacctggctaatttttctattttttttgtaaagatggtactttgccatgtt

SEQ ID NO: 35317 - DNA, 201 bp, Homo sapiens
tgtttgctagctcttgtatagaatgtaagaggaaaggacatatgtcagagccctttgcttttatgtaaaagccaagggagttcaggtaaatggagtcaagrcaataaagggaaacagatttcaagggaaaaaaatcaggaaaatgaggcattaggtatgtgatgaaggaaagaatttttaggaagaaaaagtaacagtttt

SEQ ID NO: 35318 - DNA, 201 bp, Homo sapiens
agtgatccacccgcttcagcctcccaatagatatattttttgttaatattatttcatatataatatattaaaaggtagatatatattatatgtagagagakatattttacatatctatagatcgatctatagatatctatatctatagatcgatctatagatatctatatctatagatagatatatagaggccagaaagta

SEQ ID NO: 35319 - DNA, 201 bp, Homo sapiens
gctggcaaatttttaacaacttctccttaagtgatgagagaggggtcaaaagccaggactaatctcacaattgccactgaaaatgtggaaggtgtttgaayctaattgcttaatattttgaaaattcatctacagttttatcctcaagattcatactagatatcaaagaaattcctttttgtatcttaaatttcagttcca

SEQ ID NO: 35320 - DNA, 201 bp, Homo sapiens
ttttattttgtttttgaggcagaatctcactctgtcacccaggctggagtgcagtggtgcgatctcagctcactgcaaccgccatctcccgggttcaagcrattctcctgcctcagcctcccgagtagctgggattacaggcacgtgacaccatgcctggctattttttgtatttcaagtagaaatggggttttaccatgt

SEQ ID NO: 35321 - DNA, 201 bp, Homo sapiens
acacagctaaagatgtactggcacagattacagagctccaccagaacctcgatggcctgaagaagaattacaataaactagcagacagcgtcgccaaaacraatgctgtggttaaagatccttccaagaacagtaagatctcctttttcattgtgatgatgtcatttatttcctctcactgtaaaagtatcccagacctgt

SEQ ID NO: 35322 - DNA, 201 bp, Homo sapiens
ggcccaggtcagcaatgcagcaactcccatttttcttgatgaggatgtttttgctctttaggtctcgatgagcaattgcgggctttccttgggtgccatamgtttctgtgtgcaggtggcacagaccacaggcagctgaataagccaatttaagcagggctctggtgtccagcgtagcacatttcaggaagtcatagagag

SEQ ID NO: 35323 - DNA, 201 bp, Homo sapiens
ctatctccctagatagaaatatgtggaggttggatttcctgctgagtttctttatttttttcctttcttttttttttttttttttttaagatggagtctcmccctgttgcccaggctggagtgcaatggcgtgatcttggctcactgcaacctccgcctcccgggttcaagtgattctcctgcctcagcctcctgagtagc

SEQ ID NO: 35324 - DNA, 201 bp, Homo sapiens
cccatgataagcccatcttagtaatatttttattctcagatcctttactgtctggcataatatgtgctcaaaacatatttgatgaaggaatagttgtaccrttaaatgcaaaatggtgatgaatgacaaaatagaaagatatacagacaaactttatttaatcgcatatcatttattaacctagaaaataaaatgtctaag

SEQ ID NO: 35325 - DNA, 201 bp, Homo sapiens
aaatgccattgcctgatttcctggtggcttttattttccttctgaaatcatttacaaatatttcttagggtattggctactgttggtttgaaatgagatamaacttatggattataaatatgtttgtgcaaattttctctagcagtaattctaaaacctttgtggacattaagctgtaattgtagctttctcttgcaagct

SEQ ID NO: 35326 - DNA, 201 bp, Homo sapiens
agaccatacttatatgccattccctctgcctgatacgtttgttttttctttcttcattttccctaacagataaacttctatttctccttgaaaattcagcwcaagattacttcccatgataagcccatcttagtaatatttttattctcagatcctttactgtctggcataatatgtgctcaaaacatatttgatgaagga

SEQ ID NO: 35327 - DNA, 201 bp, Homo sapiens
tttaaagaaattgccattgatttacatggttgtatggaagagttttgtttaaatgccattgcctgatttcctggtggcttttattttccttctgaaatcayttacaaatatttcttagggtattggctactgttggtttgaaatgagatacaacttatggattataaatatgtttgtgcaaattttctctagcagtaattc

SEQ ID NO: 35328 - DNA, 201 bp, Homo sapiens
tcaagatgagattttgtgaggacactgagccagaccatatcactaagagaataaaaatggacacagaatgccactttcctattccctttaaatatttccasttgaaagtatttccatgacctagtgagttcttagagaattcaatcactattgatgtcccaactggtataataaaagaagaaaacacataattttgagaca

SEQ ID NO: 35329 - DNA, 201 bp, Homo sapiens
gctgttcacctgctgattgcgtgtccatcctgctgagccaagaacagctgagaaaatcctcagtgtgctttagtcagttcattgaaagacctacaatgaakctcctggaggcattttatttgatttgtccatctcagggtttacagttttgcctcaagttggcattgcctttgtgacagattaaagatgtgagtgtattaa

SEQ ID NO: 35330 - DNA, 201 bp, Homo sapiens
ctgaaggccagaatataataagcattgttaatttagttaaaggaaaaggctgctgttgaaggttagacttcttgtgtatgtgtgggagataacagaataaygtctcttttccaagatgcatatggttttcttttgcttatgtgccaattttaatcaatggagaaattaatatgttaaatgaaataattaaccattttataa

SEQ ID NO: 35331 - DNA, 201 bp, Homo sapiens
ttttttttttttttgagacggagtctcgctctgtcgcccaggctggatggagtgcagtggcgcgatctctgctcactgcaagctccgcctcccaggttcaygccattctcccgcctcagcctcccgagtagctgcaactacaggtgcttgccaccacacctggctaattttttgtatttttagtagagacagggtttcacc

SEQ ID NO: 35332 - DNA, 201 bp, Homo sapiens
cctctcatcaccattattattagaatacatggctagattgcaatattaggtaggcaaattgagagtccatgtttgttcctcatagcaatgtgatttgttcmttatgtgaggtattccttcaaatttaaaaaggattgtgttctaatctaaaaggtcattcataagccactcattcgaaacatcttcccagatacttagttt

SEQ ID NO: 35333 - DNA, 201 bp, Homo sapiens
atctccgcatgttagttaaaaatataataatatgccaagtacggacaatgaagacagctactccacaatattcatttaatttaatttttttttttttttttgagacggagtctcgctctgtcgcccaggctggatggagtgcagtggcgcgatctctgctcactgcaagctccgcctcccaggttcacgccattctcccgc

SEQ ID NO: 35334 - DNA, 201 bp, Homo sapiens
aatttttaaccaagaagtaaccttacttattactagtatgctctttccttaaaagcttttctgatttatgttattttaattatatcaatcttgttattatktacagtttttaattattttaataatttcaacctttctgcaactttccattttagatatgtctcattaatggcatatagtgaagttttgacgttttgtcta

SEQ ID NO: 35335 - DNA, 201 bp, Homo sapiens
gcactttatggacattaatatttctatggagaaagcttaaaaagtgtcacttgtgcattgaaactcttttgtaacagcttctttactcttctgttgttgtyatgatatcctccagattacttaaatttttaaccaagaagtaaccttacttattactagtatgctctttccttaaaagcttttctgatttatgttatttta

SEQ ID NO: 35336 - DNA, 201 bp, Homo sapiens
gatttaattaaatgtaggcctttagtctaagggtttttcaacatcaaaatgttcttcaaaagacattttgatagcttctctctttaagatgtgcaaaaaaagacggtgagaaaaagaaagaaaaccaattttgtgtaaaaaccctgatttaaatacagttctggcttggacagactaggtgacattttaaagatgctttca

SEQ ID NO: 35337 - DNA, 201 bp, Homo sapiens
ggccttttctctgtctttttaaatagaccttatttttagagcagtttgaggttcacagcaaaattaagaggaaagtacagaaattccccatatttcccccrccccaacacatgcgtggacttctccattaccaaaatccccctccagagtgctacatttgttacagtccatgaacctacattgacaacagcatcacccaaa

SEQ ID NO: 35338 - DNA, 201 bp, Homo sapiens
tgattcctcaatgagcagctgaatttccacctgttcttgacgtattacctatcaccatcaggctatgttatgaaactcacttttagagataaagcaaattrtccaaatgtcaccaattattgaatctaaatgtgggcatacaggttttatttgaagcagtctttcagcttttctatatgattacatttttatttaaaaatt

SEQ ID NO: 35339 - DNA, 201 bp, Homo sapiens
tgtggaggttgcagtgagccgagatcgcgccattgcactccagcctgggtgacagagggagactctgtctcaaaaaaaaaaaaaaaaaaaaaaaaaaaaaagcctggaatactgatttagcacacagaggtcagctgccctaacagtcacccaggcctgtagaggattttacatgagtaagcctttgttttctgttaagcc

SEQ ID NO: 35340 - DNA, 201 bp, Homo sapiens
gtggtctttacaaacttgactataaatgttgagacatttttcgagaaatacatacacatgtgtgtgtatgtgtgtgtataagtatctattggtatctccgyatgttagttaaaaatataataatatgccaagtacggacaatgaagacagctactccacaatattcatttaatttaatttttttttttttttttgagacgg

SEQ ID NO: 35341 - DNA, 201 bp, Homo sapiens
ccagttgatgtttcatgtggacaatggtgcgggcagattcactgctgtctatgatgctggggttccagggcatttgtgtgatggacaatggcataaagtcrctgccaacaagatcaaacaccgcattgagctcacagtcgatgggaaccaggtggaagcccaaagcccaaacccagcatctacatcagctgacacaaatga

SEQ ID NO: 35342 - DNA, 201 bp, Homo sapiens
attctaatttgtatgacttggtatctcattgtggttttaatttgcatctccctgatgattagtgatactgagcattttttcatttgctttttggccacttrtatgtctttttcttttcttttcttttcttttttttttttttagaagtgtctgttaatttcctttgcccacttttaatggagctatttgtttttttcttgt

SEQ ID NO: 35343 - DNA, 201 bp, Homo sapiens
gttactgataaaaaaaaaaaaagaaaagaatgaagtaaatgaatgtgacttttctgtttcattttgtctaagtcttttaagccagagaaaacataatgtgraacagtgtttttatgtgtgttttatcactagagataagaaattgtcaagctgtccttaaggaccagggagggcccatggggaacagcatctttcctgatg

SEQ ID NO: 35344 - DNA, 201 bp, Homo sapiens
attttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgccttat

SEQ ID NO: 35345 - DNA, 201 bp, Homo sapiens
tattttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgcctta

SEQ ID NO: 35346 - DNA, 201 bp, Homo sapiens
ttattttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgcctt

SEQ ID NO: 35347 - DNA, 201 bp, Homo sapiens
tttattttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgcct

SEQ ID NO: 35348 - DNA, 201 bp, Homo sapiens
ttttattttctgacaaaagaaagtttgccatgtctccagaacaggcacacaatttatgtactaaatcctgatatgaatttcttttcttttcttttcttttctttttttttgaaatggagtcttactctgttgcccaggctggagtacagtggcacgatctctgcaacctctacctcctgggttcaaaatgattctcctgcc

SEQ ID NO: 35349 - DNA, 201 bp, Homo sapiens
gtttccaatgtagaaatacatctcaaaaattatgcagaagttctatcatataatgttcttgcatgggtctgaagctctttgaaggcaagggtccttgactrtgttgttcattgttgtgtaattactgcctagatgagtacttggaaaggtggagtgattcaatgaatatgtgttgcatatagtttaagaagaactgggact

SEQ ID NO: 35350 - DNA, 201 bp, Homo sapiens
aaagtaaacattcaagtgtagtttgagtataaaagtcatttttcaattttattgaaaaaataaaatgtatgggtttttgcatttggttgctttattttgtkattgttctaatgtagaatacagactttggggtcaatctgtaaactaaattaatctgttaaaaaaaaacatttttttattttgagacagggatctcactct

SEQ ID NO: 35351 - DNA, 201 bp, Homo sapiens
cctggggtcctaatctttgcctaggaatttaaagtaaagattggccgaatcttatttctcttgacttgtatctacctttactttagctcaccctctgggcgtggcctctagccagtctcactttgagtatctttgaaactctctccttattgtcaaccccttactttgattattttttttaatttaatgtttccaatgtag

SEQ ID NO: 35352 - DNA, 201 bp, Homo sapiens
agggttagtatgattgttactttgagagttggttgaatgaggacaaacagatagaccagttaagagacttggcattcatccagtcattagctgtgaagtctggaccacagtgataatggtgaaaatgatcaagtgtggtttgattccagatacattttgaaggtaatgctgaaaagatatgctaatagtttggctgtggaa

SEQ ID NO: 35353 - DNA, 201 bp, Homo sapiens
atcaaaatcctaactttgtttctggtctacacaccttcatttgtccatctttttcaggtttattccctgctgtcctgaatcttgcttctaatgctcttatyacgaccaatgcaacatgtggagaaaaaggacctgaaatgtactgcaaattggtagaacatgtccctgggcagcctgtgaggaacccgcagtgtcgaatct

SEQ ID NO: 35354 - DNA, 201 bp, Homo sapiens
tcctgatggattctttactgctctcagctaatccattatatggttttagacatccaggatagacactgaaaggaataactattacaaaagtaattttaagrggagcatttgattgactgatgctcctcttatgtattcattgtgtgtatgtattgaatttgtgtattcattgtatgtattcaatattcaatgtatgtattc

SEQ ID NO: 35355 - DNA, 201 bp, Homo sapiens
tgatgaggctaaaaacatctccttcaatgccactgcagccttcaaagcttacagcaatattaaggactatattgatgaagctgagaaagttgccaaagaarccaaagatcttgcacatgaagctacaaaactggtaagaaacaaatggcacatgtgctgggaatggaagtcaacctttttgaatttttcaaatgtaagtca

SEQ ID NO: 35356 - DNA, 201 bp, Homo sapiens
ggaattaccaggagccctatctcacacccataggttgtgatgcagttggtctggggtagagtcagaccactgggatattcaagaactccccagattatacwgataaagaattactgtgatcctgtagttacctaatagctaagactctcttccctctggaaaatgccttaattggtactgccaatcttttttttttttttt

SEQ ID NO: 35357 - DNA, 201 bp, Homo sapiens
gttacctaatagctaagactctcttccctctggaaaatgccttaattggtactgccaatcttttttttttttttttaaacagagtttcacccttgttgtcsaggctggagtacaatggtgtgaactcagctcactgcaacctccacctcctaggttcaagcaattctcctgcttcagcctcccaagtagctgggattgcag

SEQ ID NO: 35358 - DNA, 201 bp, Homo sapiens
gggaaacaatgaggatcttcaacttagactgagaaaagcacactaatggacttaaaaaggcatgcggggattgggcttaattgtaaggaagcaaaaaaackaaaataaaaaaatcttatttattacattctattagccccatggactttgcaaggcctgtgtccttcaaaaatgctgacattggtcgctgtgcccatcaga

SEQ ID NO: 35359 - DNA, 201 bp, Homo sapiens
ttcttttctctgtgcccatctcataccattgtatgtgtgtcatatgatggatctggtttctttttcttatttgttgggagatgtccagagactcaaggatstatcctttgaccaaatttttcactcttcaagggcctcatactgctctgatttcagatgtatagatatattgcttatcaaacactgatgggtctgaacatg

SEQ ID NO: 35360 - DNA, 201 bp, Homo sapiens
tctgtaacttagcaaaaatacaaattggtgtttccactttgatttctctttttgaaataaattttcagcttgactttcttttgcctcgggtattctggatkatcattttgtagcatctggataattttacattaacatctggagttgagggtctttttatttgtcggatgcatatagaatacttctgtaagaaatgtattt

SEQ ID NO: 35361 - DNA, 201 bp, Homo sapiens
cagtggtgttttcagcatggacaactggagctttaacttaaaagatctagaaactgggcttgttggccacagttttagtgtgattagaggtggtcataggktagtcaaagttgccactatcctggttatggatggtaatagaactgcctatttatttgatgtcttcacttagttgtctcctaggtccttcacagcgaacat

SEQ ID NO: 35362 - DNA, 201 bp, Homo sapiens
acctggggtcctaatctttgcctaggaatttaaagtaaagattggccgaatcttatttctcttgacttgtatctacctttactttagctcaccctctgggcgtggcctctagccagtctcactttgagtatctttgaaactctctccttattgtcaaccccttactttgattattttttttaatttaatgtttccaatgta

SEQ ID NO: 35363 - DNA, 201 bp, Homo sapiens
ttttcagcatggacaactggagctttaacttaaaagatctagaaactgggcttgttggccacagttttagtgtgattagaggtggtcatagggtagtcaargttgccactatcctggttatggatggtaatagaactgcctatttatttgatgtcttcacttagttgtctcctaggtccttcacagcgaacatttgccagg

SEQ ID NO: 35364 - DNA, 201 bp, Homo sapiens
cttacctccatatttaatggattaccattctcattgattttaccttcttaatttctcttaaattgattttctttctctatacctaatgttagtacctttcygccatgtttctatctggtttacattgctggaacagcacctgatttgctatcttgttcttagtcttgccatcccaacttagtccattcctctgatgtcttt

SEQ ID NO: 35365 - DNA, 201 bp, Homo sapiens
tgtgtgtgtgtgtgtatgtgtgtgttttgtggatgtatgcgtgcatatgtatttcttagtttattctttcagaagccttgaatttacatgaagttatgtgwtaatgacctaccttatataggacctagaattttttgttgttcttctgtaaaaccatgctccctgaactgtagtctagtcatcagaatttgccagtcaact

SEQ ID NO: 35366 - DNA, 201 bp, Homo sapiens
agtctgattgtgtacttgcaaacacttccatggtatctatttcaagtgtattttgaaaagtctaacatctaggctttcaacttgatctgttgtactttctrtattctatacctgagtgtcagcaaagacgcctgggagctgtctttgagtcttccttctctcttacctccatatttaatggattaccattctcattgattt

SEQ ID NO: 35367 - DNA, 201 bp, Homo sapiens
gcaataagtgacacatacacaatttataaatgataaaatataaaatatttgtcttaaatagggagatgctgtaatgtctctttcccctcttcaacgtatcrtattacagtgattcctcaatgagcagctgaatttccacctgttcttgacgtattacctatcaccatcaggctatgttatgaaactcacttttagagataa

SEQ ID NO: 35368 - DNA, 201 bp, Homo sapiens
acctatgtctttactgtgtatacatatacacccatatccctatatattcgcgtgttcacttttgatttcaaattttatttgtgaaaaaagcagatttattyttttttttctttgagatggagtctcgctctgtcaccccctggctggagtgcagtggcttgatcttggctcactgcaacctcagcctcccaggttcaagta

SEQ ID NO: 35369 - DNA, 201 bp, Homo sapiens
catagtcctaatatgcatttttatggtcgacagtcgtggtatatgagagaaaatatgtagcctttgatgtaaaaagattgtttttaaaaaaacataaactktacaatatatgcttgtgtgtgtcagtcagagggggaggtggagagaggcagtgtttctgaaacaagagatctatgaaagaagggaacagtctgttagttc

SEQ ID NO: 35370 - DNA, 201 bp, Homo sapiens
tccttgctcctctatttttgaaaattaacatagtcctaatatgcatttttatggtcgacagtcgtggtatatgagagaaaatatgtagcctttgatgtaaraagattgtttttaaaaaaacataaactttacaatatatgcttgtgtgtgtcagtcagagggggaggtggagagaggcagtgtttctgaaacaagagatct

SEQ ID NO: 35371 - DNA, 201 bp, Homo sapiens
atttacctgtataaattattaataagtacatacaacataatccctgtcctatctgtttagggagacaataaatatctatgaaaaatgggatctcagcactrtataattaagggagaggtatgtgctacagaacatacatgcaataatcattcaaagggatgagctactgcagtggagagagatgcaaagtgtcctggagtg

SEQ ID NO: 35372 - DNA, 201 bp, Homo sapiens
ttatgtgagtttctcagtatatacatgaaagacactctgcctgtatccttgctcctctatttttgaaaattaacatagtcctaatatgcatttttatggtygacagtcgtggtatatgagagaaaatatgtagcctttgatgtaaaaagattgtttttaaaaaaacataaactttacaatatatgcttgtgtgtgtcagtc

SEQ ID NO: 35373 - DNA, 201 bp, Homo sapiens
aaaaaaatatggactgctttgattttcctttgaagtaatgtcacaagaagaaaacagcaagctggttcatttgccaaggaaggaagagcatgaaagacaaratgaaatgccagtaactaggtactagaggaaaggagtgctaagaaaatgttcaaaagggatcttgaaaagcaaagatcacttggtagatgaacttgttca

SEQ ID NO: 35374 - DNA, 201 bp, Homo sapiens
gctgtgtaggccaagaatctagttatcctttcagaaatttttttttctgaccacctactctgtgccttaagcaaaagtacctgcccttctttctttctttyttttttttttttttgagagcatggtgtggtctcggctcactgcaacattcgcctcccgggttcaagcgattcacttgcctcagcctcctgagtagctggg

SEQ ID NO: 35375 - DNA, 201 bp, Homo sapiens
ttccaacttgtaaaaggcaccatttgagcagggaaacaccctcagtcttttgctgattatgtcaaatgggaggaagtaagaacacagcattacagccacgmctctttatacagcagccaccctcttctgtgcctttgccaatacgttccctctgcctggaagattgcagccctttcactcctccacccgagactaactaat

SEQ ID NO: 35376 - DNA, 201 bp, Homo sapiens
atcgcttgaacccaggaggcggaggttgcagtgagctgagatcgtgcctctgcactccagcctggtgacagagcgagactccatctcaaaaaaaaaaaaaataataataataagggtaaatacaaggagtgtgttttgaatacaaaatatctatttttagaatctcaaacccatgagttactttcttccatatataagtcc

SEQ ID NO: 35377 - DNA, 201 bp, Homo sapiens
ggagaactttgccccagtccggcaaagtattgtcacctagttggcattgtaattatgacttcaaaagggcattccacaattctatcaatccacctgcttcrggatgatgggaaacatgataagaccagtgaattccatgagcatgagcccagtgctgcacttctttagctgtaaagtgagtgccttgttcagaggcaatgc

SEQ ID NO: 35378 - DNA, 201 bp, Homo sapiens
agaatcgcttgaacccaggaggcggaggttgcagtgagctgagatcgtgcctctgcactccagcctggtgacagagcgagactccatctcaaaaaaaaaawaaataataataataagggtaaatacaaggagtgtgttttgaatacaaaatatctatttttagaatctcaaacccatgagttactttcttccatatataag

SEQ ID NO: 35379 - DNA, 201 bp, Homo sapiens
ggatgtcctagaaaggggctgtagtgctgcagctgtccacttttgggtgctacctgcatatcttgcagaatcatctgtgaaccaggccctagtcttctctkcctctgtcaactgatcatggggaactccctgtgaggccatcagtgcaggcttggggagagaaggcagggtggcaggagtggaggccatgggcgtttgagc

SEQ ID NO: 35380 - DNA, 201 bp, Homo sapiens
ctggatttccgaaatatttttaaaagattttttctgggatcatttaaggcctcatctgttcagaaccaaggggaggaccgaaatagtatgccaaattcttktccagccctcaaattttatgagcctgagttgcattgtgtgggtaaaagtcttgtgctctgtggatcaggaggaagttagatgttttggatatttacatag

SEQ ID NO: 35381 - DNA, 201 bp, Homo sapiens
acttgaacaaagatatacagcttctccagagaccaggcagacactaggtttatgatttcctgacttccactgcagatctcttaccatttttctatgagagwcataaaaaaagaatcagctatttactttctagtcaaggtgggttaaaatcaagccacttgttttcaaacatcgatttcgggttcatgccatcaaattaaa

SEQ ID NO: 35382 - DNA, 201 bp, Homo sapiens
aaaagaatcagctatttactttctagtcaaggtgggttaaaatcaagccacttgttttcaaacatcgatttcgggttcatgccatcaaattaaaaaattcrcttaactgagtttaatttgctttcacttaggaagcagctgcctttcaagataataaaataaacagatacaataatatttggtcagctgtggcttttaatt

SEQ ID NO: 35383 - DNA, 201 bp, Homo sapiens
caaaagtggggttgaccattttcttcttcgctgtctccatgattttgctttttccaagatgtcatgtagttagaatcatacaatgtgttgtcttttcaggytggcttttttcacttagcaatatgcctgtaaggttccgccatgtcttttcttgccttgataattcatttctttttagctctgaatactattttgttgtct

SEQ ID NO: 35384 - DNA, 201 bp, Homo sapiens
tgttgtctggatataaccacagttgaattatccatttacctcctgaaaaacatcctgcttgctaccatgttctggcaatatgaatcaagctgctataaacrcttatgtgataagtcttgtgtggatataaatattcaacttatttgggtaaataccaaagagtgcaattactggatcatatggtcagagcatgctagtttt

SEQ ID NO: 35385 - DNA, 201 bp, Homo sapiens
taaccacagttgaattatccatttacctcctgaaaaacatcctgcttgctaccatgttctggcaatatgaatcaagctgctataaacacttatgtgataartcttgtgtggatataaatattcaacttatttgggtaaataccaaagagtgcaattactggatcatatggtcagagcatgctagttttgtaataaactgcc

SEQ ID NO: 35386 - DNA, 201 bp, Homo sapiens
attttgcattctcaccagcaatgaacaagagttcctgtttctccacattctcaccagcatttcatattgtcaatgttttagacatcagctattctaatagrtatgtagtggtatatcgttgttttaatttgaaattctctaatgatgtaagatgatgagcatgttttcatgtgcttattttccatctgtatataagctttg

SEQ ID NO: 35387 - DNA, 201 bp, Homo sapiens
aattccctttgctcctttgtgaaagatcagatggccatattcatgcgggtgtatttctgggctggctattctgttccattgatctaagtgacttttttctsaccagtactatattgtcttgataactatagttttatactaagtcttgaagttgggtagtgttagctttacaagtttgttcaatattatttaatgatgtgt

SEQ ID NO: 35388 - DNA, 201 bp, Homo sapiens
gcgctctaattgtctgttagacttttctaagagttttaaaacaaactcgggcctcaactctcccccagaggaattgactccacctcctctagggctggacyggaccacagactcccactatgggcgcttgtctattgtgtcaggctgcctgtcggggaaaaccacagtaataggaaaaatgtgttgtgcgttagagtagac

SEQ ID NO: 35389 - DNA, 201 bp, Homo sapiens
cattatcaattttcagcctctcttcttttttatttttaatttctttgccacctcttcttaatacataatgctctttcttccttcgttcctccccctctctstttcttccttcctcctttctttcttgctttcttctttcttttctttattctttctttttttttttttttcaaggtcttgacgtgttgcccaggctggagt

SEQ ID NO: 35390 - DNA, 201 bp, Homo sapiens
ttatcatgacaaatgctagtcaatgttgaatcacagagggctatatgagatccattttcattcttaaagaaaattattatatctttttattaatatggtgratattaactcagtaaataataaagaaaactaatatgaagtacaatttgtaatattctacttatgatgcatgatttttgttgcacaattagaaaatactta

SEQ ID NO: 35391 - DNA, 201 bp, Homo sapiens
gatttatacagtagtcttatgatccaatgcccatgtatgaacaaaggttactgttcctgtcttctaaattggggttcccagtgtaatacaggaagactacygtgtgctagtaaacagaaagcacaatccacatttgaccatattttcctcgttggatgtgtttatggatatattttattctgcttttatctttctgagatt

SEQ ID NO: 35392 - DNA, 201 bp, Homo sapiens
tgacaaatgctagtcaatgttgaatcacagagggctatatgagatccattttcattcttaaagaaaattattatatctttttattaatatggtgaatattwactcagtaaataataaagaaaactaatatgaagtacaatttgtaatattctacttatgatgcatgatttttgttgcacaattagaaaatacttaagttct

SEQ ID NO: 35393 - DNA, 201 bp, Homo sapiens
ttctttaaaatgagcaaagatgagctcagcaaataaggtacttgtaataatgaaagtactatatgcaggaatactggctttttgtttttaatctgcaattrgttaattaaatttcattgtagatgtattgcataaaatacatttgaaaggcaccattcttcctcataatacagctagtgaaggtccaaatttcagtgactc

SEQ ID NO: 35394 - DNA, 201 bp, Homo sapiens
ggttattctttaaaatgagcaaagatgagctcagcaaataaggtacttgtaataatgaaagtactatatgcaggaatactggctttttgtttttaatctgyaattagttaattaaatttcattgtagatgtattgcataaaatacatttgaaaggcaccattcttcctcataatacagctagtgaaggtccaaatttcagt

SEQ ID NO: 35395 - DNA, 201 bp, Homo sapiens
aatcatggaaatgaactagtgtccacataactgaaatccttcacatctggctatctttaggccctaaattatgtgaaattcactgagtattttccacagabttgtttactgttgtaaaatcttaaatcaaaatgttacatcaaaggaagagttgcatcaaaagaacctcagcaaaacctcaaaacaaccaaacactccact

SEQ ID NO: 35396 - DNA, 201 bp, Homo sapiens
tcgctcttgtcccccaggctggagtgcaatggcatgatcttggctcactgcagcctctgcctcccaggttccagcgattctccggccttggccccaccccscccccgccgacccccatgagtagctgggatttcaggtgcctgccaccaaacccggctaatttttgtatttttagtagagatggggtttcaccatgtgggc

SEQ ID NO: 35397 - DNA, 201 bp, Homo sapiens
tgacactcaatgtgtaagtgcccagttgaaatagtttccttatcttttctttgaaggtgagaaggctaagttccttttatatacaaaaatgtgttctgtcraacactatcactgcaaggccatttactaaaaatgtttatgggatggaatctttttcagcacttgctgtcacctcagcgggccccagagaggcttattcag

SEQ ID NO: 35398 - DNA, 201 bp, Homo sapiens
tatttatctatggaactcttctttgttagatattgaatttcatggattaatcccctagctttttgtctttggtttattttgattactctttttttttttttccttttttttttttgagacaaagtctcgctcttgtcccccaggctggagtgcaatggcatgatcttggctcactgcagcctctgcctcccaggttccagc

SEQ ID NO: 35399 - DNA, 201 bp, Homo sapiens
aaaaattcttttctcaaaatggacattttccagtattggatgaagtggtctgctctctctctttctgtctctctctttctctctctctctgtctctctctytctctctctctctctctctctctctctctctctctctatatatatatatatatatatatatatatggcaactagatgtatactttggaattcctttaagg

SEQ ID NO: 35400 - DNA, 201 bp, Homo sapiens
atcatccttacaataggctttatcttttggaaatacatataatattgatgtgctctggttttaatcatcacctgcctcttgcctcagcaagctctaggttrtattttaaaggagattaaatatattttcactgaatttaattgtatctaagtaatacctttcgaagagtcaaataatacagaaaagctcataacaaaaagt

SEQ ID NO: 35401 - DNA, 201 bp, Homo sapiens
cttcacttcgagttaactgatttaaatttaatttttctctcctcttccattgccaggctgggacctttggcctacaatcagcaaggggctgtgttccctgmaactgcaattcttttgggtctaagtcattcgactgtgaagagagtggacaatgttggtgccaacctggagtcacagggaagaaatgtgaccgctgtgccc

SEQ ID NO: 35402 - DNA, 201 bp, Homo sapiens
aatccaaacagtgttattgtaaagtctctgggcttcttagagcaaaagttttaaaaccatcatttatatgtttaatatatttttatctatttctagatttrttttaaaggcagtaaaataatctaacaggctcctgggtacccatggtgtttattatattatgaagaaataaaatattactcatacagtcgaaaccctaca

SEQ ID NO: 35403 - DNA, 201 bp, Homo sapiens
ttgaaaaaacaaaaacaaaacctatgtctgtagtatgtatatttgtgcatttaaatgtttgtgcccatggacttgtgtgtgtgtgtgtgtgtgtgtgtgtkaatgtatgtctatatatatatgtatggtgtttgtgtgagaggcaaagagaagagaaaaaagaatgacgttagcttatcaatatattataataaaattgtg

SEQ ID NO: 35404 - DNA, 201 bp, Homo sapiens
ggacctgtttttatgcttccaagatggcactttgaatgctcaggagaggaggaacattgtgccctcacatggcagaagagcaagagagagagagctctcamccctgtaagcctttttaatagtggcatcaattcattcatgaggacagagccctcatgaccgaaacacttcccaaaaggcccccctcccaacactgttgca

SEQ ID NO: 35405 - DNA, 201 bp, Homo sapiens
caaaaacaaacaaaataaaggattcaaatgggtgacatggccagtcctggttacagtatgagacagatgccggttacggtgggcaacagaacagatgctggctacagtggtcgacagagttcattttagttcaagcagaaggtagggctggtgcttgttacagtggccagtaggcctggtttctggttatagcacatggca

SEQ ID NO: 35406 - DNA, 201 bp, Homo sapiens
gtttctttctttttccctctgcattacaaatacatacgcaatactttttcaggttgttttttccaaaagcaacaataaactactagtggagtaaaaaatayggaactgaaagtccaactgtttgattaagtgtatgttataaccattgtatgactttgagtgaatttctatttttaagaaagtggtatttggaaccacaat

SEQ ID NO: 35407 - DNA, 201 bp, Homo sapiens; identical to SEQ ID NO: 7288

SEQ ID NO: 35408 - DNA, 201 bp, Homo sapiens
tatatgagatccattttcattcttaaagaaaattattatatctttttattaatatggtgaatattaactcagtaaataataaagaaaactaatatgaagtrcaatttgtaatattctacttatgatgcatgatttttgttgcacaattagaaaatacttaagttcttgagaatagttggaaagggttgtaatgatcagaaa

SEQ ID NO: 35409 - DNA, 201 bp, Homo sapiens
attcttaaagaaaattattatatctttttattaatatggtgaatattaactcagtaaataataaagaaaactaatatgaagtacaatttgtaatattctayttatgatgcatgatttttgttgcacaattagaaaatacttaagttcttgagaatagttggaaagggttgtaatgatcagaaacacatattatacctaaac

SEQ ID NO: 35410 - DNA, 201 bp, Homo sapiens
aataaacttgggcctgtagccaatagtttgtattccaggcttttaaaaaaaattcaaatacagaaacatcagattttcattgccataggggtcatgacatmttttaacataagtgcagaaactatctgtaatgaatcaaaacttaaatcagatgacattaagaccagctttgctattaccacagatggcatcacaattaac

SEQ ID NO: 35411 - DNA, 201 bp, Homo sapiens
tcataggtagaataaatgagagaattatggtgatctaaatatagaaagcatttaaattagagaacagctgaaattgtgcttctaaaacatttcagtgttgytcattttctatatgttacattgaaaaaagtaatatggaaatgtaatgttttcatttgcagatgcttaaatttagatacatgtttaatactgtaatcattt

SEQ ID NO: 35412 - DNA, 201 bp, Homo sapiens
agagaattatggtgatctaaatatagaaagcatttaaattagagaacagctgaaattgtgcttctaaaacatttcagtgttgctcattttctatatgttayattgaaaaaagtaatatggaaatgtaatgttttcatttgcagatgcttaaatttagatacatgtttaatactgtaatcattttgatcaaacagcagctat

SEQ ID NO: 35413 - DNA, 201 bp, Homo sapiens
tgctgtgtatgcccaactttatggctagatgggtcagaaagcatccagttcatgaaaggcagtttaggttgcatggtgacttgatgacctacagtcaaacrttcagtttctaccaaagcccagtaacaggccaagagttgtctctcaaatggagagtagtgatctgcagaagatggcagggccttgctccaaaatcctaga

SEQ ID NO: 35414 - DNA, 201 bp, Homo sapiens
attgaaaaaagtaatatggaaatgtaatgttttcatttgcagatgcttaaatttagatacatgtttaatactgtaatcattttgatcaaacagcagctatyatttattattcaatatttatatgtaaaacctgaaactttcatctaccttaatgatggtattgtgataaaagtacccatgtatcaccaagctttgccaatt

SEQ ID NO: 35415 - DNA, 201 bp, Homo sapiens
aacataatgttgtgggaacaggaagcaaaattttgctagtgggtcactagtggtgatggtgagtggtgccacttccgcttccaccccttgattctgggacmcgtgaacactggctatgggagaaacagtaccatattttggacactgattcaaggcatacacagccttctggagaactttgccccagtccggcaaagtatt

SEQ ID NO: 35416 - DNA, 201 bp, Homo sapiens
cagcagctatcatttattattcaatatttatatgtaaaacctgaaactttcatctaccttaatgatggtattgtgataaaagtacccatgtatcaccaagmtttgccaattctttttattccttaaagaatatccgacaatttgctggtttgtataagtttgagttaagacaccgtaataatgtcctgcagtatatatgtc

SEQ ID NO: 35417 - DNA, 201 bp, Homo sapiens
gaactttattcagtagcctccgtggtaaagtttgtatctgttctgatttccaaaagcactatctttgattgtgtaaagagaaagaaaaacaaatgaaaatrcttgtggtctctttcatctcatcgtgggatttttgcattagtatagaaatacagtgtaaatcagtctttccacacaaaagaggaaatcttctctattgtg

SEQ ID NO: 35418 - DNA, 201 bp, Homo sapiens
gacctttggcctacaatcagcaaggggctgtgttccctgcaactgcaattcttttgggtctaagtcattcgactgtgaagagagtggacaatgttggtgcyaacctggagtcacagggaagaaatgtgaccgctgtgcccacggctatttcaacttccaagaaggaggctgcacaggtctgtaaatatgacttaagtccta

SEQ ID NO: 35419 - DNA, 201 bp, Homo sapiens
ctacttatttttacgttacttaaaaaatgaaatacatgtcagtttgaaacactgccttaataactgtgtgcaagtactcagtaaaaatcagcagatgctcktttggttgtgtccctccctgtctgtgactttgattcagccagtcactcaaacactgctacggcttgaaagttaaatgttcgatttttctggtaccagtct

SEQ ID NO: 35420 - DNA, 201 bp, Homo sapiens
taaaacctgaaactttcatctaccttaatgatggtattgtgataaaagtacccatgtatcaccaagctttgccaattctttttattccttaaagaatatcygacaatttgctggtttgtataagtttgagttaagacaccgtaataatgtcctgcagtatatatgtcaaaatacatgggtcaaaaagacactctaaaatag

SEQ ID NO: 35421 - DNA, 201 bp, Homo sapiens
ctttaaatgaagtagctcaataacagaacagtgaacctaactggccccattttagtcaatctaatgcattcctgcacaggtatttatcatgacatttactytacactcaacctacatgaagatcaacatagtcacttttacgagagtagatttgcatccatccaataatctttctcaccagtgtaattagaaaggatacag

SEQ ID NO: 35422 - DNA, 201 bp, Homo sapiens
atatataaacacatacgcacaagaagactgtctctctgtttgtatatatacatacacgcacatataaatacacagagagagtgtgtgtgtatatatacacmgagagagagagagagagagagagagagagtcagtcttgctctgttaaccagctggggtgctgtggtgcaattatggctcactggagcctccacctcccag

SEQ ID NO: 35423 - DNA, 201 bp, Homo sapiens
atttataacatatataccttcacctgacttggagtttcataaggaatgcaacagcttccaattcatttactttctttttgcttaacaaagtatctgacacrtagtacaaaagttaaatattataaataaaagattaattgcacagatatttttaaaggagacagaaaagatttgaatatccaggaattccacccaacgatg

SEQ ID NO: 35424 - DNA, 201 bp, Homo sapiens
atagttcacagcatacagtatttattatttttatgattaactaatgttttatgaggtccttagagtgctagacactgtttgcatgaattattttatatgayctcaccacaaccttataaaaaagtttttattgtccgatgttttagacggcgtagttataggagttagtttcagccaccagttgtatatagagaagctgct

SEQ ID NO: 35425 - DNA, 201 bp, Homo sapiens
ctttatcaacttcttgtaggttattgtatttattggtgtataattgttcatagcagtgtctatgatccttttttatttctgttgcaatgtctcctctttartttataattttatttagttgaatcctcattccttttttcttagtttggctgaaggtttgtcaattttgtttatctttaaaaaaacaattcttacttatat

SEQ ID NO: 35426 - DNA, 201 bp, Homo sapiens
gcccaggtcagcaatgcagcaactcccatttttcttgatgaggatgtttttgctctttaggtctcgatgagcaattgcgggctttccttgggtgccatacrtttctgtgtgcaggtggcacagaccacaggcagctgaataagccaatttaagcagggctctggtgtccagcgtagcacatttcaggaagtcatagagaga

SEQ ID NO: 35427 - DNA, 201 bp, Homo sapiens
aggacccatggtgcttctggctttgtccttctttcttaagattgctttggatattttgggtcatttgtgatttcatatgaattttaattattaaaattctyattcttttttttagaactgttttttctacattttctttctttttttctttcttttttttctgaggtggaatttccctcttttcgctcaaggtggagtgca

SEQ ID NO: 35428 - DNA, 201 bp, Homo sapiens
ggccggtactgtgagctctgtgctgatggatattttggagatgcagttgatgcgaagaactgtcagcgtaagtcctgaactattgatgcccctgacagaaytgatgtattgtacctcaaagtagctgatgagttcttgagtgtggattgaagagtaggaaattatgtggaatacatggttgatagatgcatagaatataca

SEQ ID NO: 35429 - DNA, 201 bp, Homo sapiens
tagcaggatttccttctcttttatggctgaataatattcctctatctccctctctccctctctttctgtgtgtgtgtgtgtgtgtgtgtgtgtgtgtgtgkctgtgtgtctgtgtatgtgtgtatactatatttactttatccattcattcactgatggatacttaggccatttatttatcttgactgttgtgaatgatgc

SEQ ID NO: 35430 - DNA, 201 bp, Homo sapiens
cttactttccacggggactgttattgtaaaatctgttcttattcttttaatttaactccattattttgttttaaatgtaatgattgttcattatatttttytccaactgctttaaaagcaccaatccttctttgctgtatatgtatcaaagtccataaatattctttgacattatcctagccttgaataataaaaggaaaa

SEQ ID NO: 35431 - DNA, 201 bp, Homo sapiens
atactggcagtccaggcaaccctggaggctcctgccaagaatgtgagtgtgatccctatggctcactgcctgtgccctgtgaccctgtcacaggattctgmacgtgccgacctggagccacgggaaggaagtgtgacggctgcaagcactggcatgcacgcgagggctgggagtgtgtttgtacgtatactaactttgctg

SEQ ID NO: 35432 - DNA, 201 bp, Homo sapiens
actgaatgtgtataattataagaattatttcattttcttacaactttttctctttattttatactctcaccctattatctgtcctttttcttttttttttctttctttctttctttctttctttctttctttttttttttttttttgagacaggctcttactccgttgcccaggctgaagtgcagtggcaggatcatggct

SEQ ID NO: 35433 - DNA, 201 bp, Homo sapiens
tgtattctgcattctcaattaaaagtcattttatcttttactttttcttttattcctttttaagcaacaaatgaattaaatttcctttgttttatatatgrcctattaacctcaatggagaaagaggctccctttgtttgcttcaggacttacatattgttacagttagtccttaggtaaatgaaatgagaagagcttcac

SEQ ID NO: 35434 - DNA, 201 bp, Homo sapiens
ttgtgctggctttctttccttttttaaaatcccatggtatctcatcatctcttcttgtcctcccattctacaaatagaacatgaaattgaagccttttttwaaaaaaaaaaaactaattacagaattaatatatgtttactatgtacttactacaattagaaactatatataaacaaaaaagagagcttgcccatcaatcc

SEQ ID NO: 35435 - DNA, 201 bp, Homo sapiens
aatgctgacaaggagagaggttaaaaccaggaagccatgccttttagctgacaaaacattcattgaaatgctatctgggtgaagcactgagaaattaatcrtctgaatagtctaaattatagtacatgaagaatgcaacttgctagggagacataccttcagcattattcgaggttaatttaaaccaacatgtaaatgttt

SEQ ID NO: 35436 - DNA, 201 bp, Homo sapiens
tatttttgatagtctgtgattctgagccctatctatgctttcagtcaaattaccaatggtatgaaactctttaattttgtgtgtctcacgtttagagggtrgcttaagaggttctttaactgcatgactattgtgaggaggatacttatgagttgttcttcatttccatggggacaaggacaatgaaaatacagtataata

SEQ ID NO: 35437 - DNA, 201 bp, Homo sapiens
ttaaaaaaatctcataggaatcatcctgaataaaatgttcagaaccatcatttatttattttgtttcacatagaacctaccaaacacatgagaattttttkggggagaaatctgattggacatttgactgtgagtgaaatacacataagcagtggtgttaaagaaactgatcaatattttctttgcttcagtgttgggcaa

SEQ ID NO: 35438 - DNA, 201 bp, Homo sapiens
aatttttatgaatttttgaattaaaaagctcttaacctttggctacaatcattgttcgtaatacatttggaacaagtattttagagtttgggcattccaarttctatcacattatttgaatgccttcaatggtgacaaatctttatgctttagatgtaaagcaacattttgtacatgagttgtgtgatagtaagttggtag

SEQ ID NO: 35439 - DNA, 201 bp, Homo sapiens
ccctaagatatgaatgtggctggcatgttcaaagaccctcaaggatggggtaagagtggggaagagttgaaggatatggggaaggggaaaatatcgtaggyctttggcacactgtagttaatgtcttcacatttttcttgcaatgcaatgagaaacacagacatgtaatgatctgagttatgttttaatagggttagtatg

SEQ ID NO: 35440 - DNA, 201 bp, Homo sapiens
cagtaaaactagagattaaaataattgaccatggaatctaagacagtgatgagaaaccctcaagctacagcgatttcccattgtctccctaaatgctattrgtactgtagccaagacaagtctttcttttataggactatacaaggccttagaggatatttagtatccttggcctaaaggataaaggtaaagtggtacagt

SEQ ID NO: 35441 - DNA, 201 bp, Homo sapiens
atgaagtctctgcttcatgacctggtcacctccaaaggccccacttcctaatcctatcaccttgaggattaggatttcaacatatgaattttcaggggacrcagacattcaggccactgccctttacttattcaatttcccacttatgtaaaaagtgatcaacatgggatccaaagattggaataacaaaatgcttacaaa

SEQ ID NO: 35442 - DNA, 201 bp, Homo sapiens
atgatagtcctgcatttcatggcaattttcaatagcagtttaatggtcttaagtgggtagcataatagccaggtgaacaacaaaaaaaacaaaaacaaaamcaaaaaaactatttggcaaattgggatatgagaattgaggccaaaacttttagtccttgccaattttttttaaaacttcaattatcttgattcatattcc

SEQ ID NO: 35443 - DNA, 201 bp, Homo sapiens
gtgtggtctcggctcactgcaacattcgcctcccgggttcaagcgattcacttgcctcagcctcctgagtagctgggattacaggcgcctgccaccaagcygggctaatttttgtatttttagtagagacaaggtttcaccatgttggccagactggtcttgaactcttgacctcatgatctgcatgcctgagcctcccaa

SEQ ID NO: 35444 - DNA, 201 bp, Homo sapiens
atagaaaggtatatattcttattatagcagtgtctgccagggctgcagtcctgttgttagaaggctgtcagaattttaaatgtaagccttcctttcccagrtgttataatttaatcttctaactcctattaatttctgaagactgtggggccatcctatatcttagaacaaaatatagatacgtacattcctgattttttt

SEQ ID NO: 35445 - DNA, 201 bp, Homo sapiens
gtttcatagcttgggagtgagcagagctgtgatcccaaaccagaagggctgtcacttggatgtagcttttaatcactgtgccctagtacatagagaatgaytgagacaaggataggtgctattttagataggtaatcagaggagtggctattaccagaatggagggaggacacaagccaaagagtaggaagagcacatagt

SEQ ID NO: 35446 - DNA, 201 bp, Homo sapiens
gatatttttttctcactacttcttcctttctccctctttttacacaattaaaaaactaaagataaaagttggctctatagggaaaggttttattttttacrtttctggcaaatttgagatttctataaaattcttcataggtatataaaacagagtaagtatattttgtttaacttttaaagcagggtattattcatttgt

SEQ ID NO: 35447 - DNA, 201 bp, Homo sapiens
tttgtaccctcttttcagttttactcttttttatttcttttttttccccctttagggtaatgacttgagcatcagcacagcccaagatgaggtgtacctgsacccatctgaagaacatactaatgtattgttacttaaagaagaatcatttaccatacatggcacacattttccagtccgtagaaaggaatttatgacagt

SEQ ID NO: 35448 - DNA, 201 bp, Homo sapiens
cacatgagaccttaaaagtagaagagggggtcagagtgatgaaacaatggaagaagaggaaggagaagtttgaagcatgaaaaatatttcattcatcattkctggctttaaagatggagagtcccttgaaccaaggaatgtgaatgacctctagaacctggaaaagagcattggctgacaaacagcaaggaaatgggaacc

SEQ ID NO: 35449 - DNA, 201 bp, Homo sapiens
taattgagcaattatacttatgccatactttttgtagaataattctccctatacataggccttctttctgtttcttaaatactctaagtttcctatcttargtattttatatgctacatcattttctatctgtgcctctctttgtttttattgtactcatctaatctttctttaagaatatattatacattaatttactca

SEQ ID NO: 35450 - DNA, 201 bp, Homo sapiens
atgataccgtaatggatatttttttctcactacttcttcctttctccctctttttacacaattaaaaaactaaagataaaagttggctctatagggaaagrttttattttttacatttctggcaaatttgagatttctataaaattcttcataggtatataaaacagagtaagtatattttgtttaacttttaaagcaggg

SEQ ID NO: 35451 - DNA, 201 bp, Homo sapiens
gctgtgaggcaggatgctgggccactgtcctgtcacaggctccagcatgattcgccctgctcggtgacacaccagccgtgtgacttacccgaaggtgcacytgtctattttatggcaaccgtttgataaatgaaaattacctgtgtggaaagcatagtaagtatttgagaaatatttcaagaagagttatatggcacagtc

SEQ ID NO: 35452 - DNA, 201 bp, Homo sapiens
ttctcgagaagtatctttgtggccttctctgtatttcctgaatctgaacgttggcctgccttgctagattggggaagttctcctggataatatcctgcagwgtgttttccaacttggtttcattctccccgtcactttcaggtacaccaatcagacgtggatttggtcttttcacatagtcccatatttcttggaggcttt

SEQ ID NO: 35453 - DNA, 201 bp, Homo sapiens
tgtctttagtcattgcttctacatggcaataggaaatatgaccataaaaacctcagtgaaagtaacccacatttagagaaggcttgtattccttaatcccrcccctctacacaccccacccattcaacccatctgtagcctccctttcagctgttcttaaaagaccttcccttttaagggaacttacattttcccttcaat

SEQ ID NO: 35454 - DNA, 201 bp, Homo sapiens
atagtggcaggaaagagagagaatgaaaggggaagtgccacataccttcgaacaacctgatcttgtgagaatttattcactatcacaagaacagcaagggrggaggtttgctcccatgattcagtcaccacccaccaggcccctccctcaacatgtgggtattacaacttgagatgagatttgaggtggtcggtgggggga

SEQ ID NO: 35455 - DNA, 201 bp, Homo sapiens
tttctcgagaagtatctttgtggccttctctgtatttcctgaatctgaacgttggcctgccttgctagattggggaagttctcctggataatatcctgcaragtgttttccaacttggtttcattctccccgtcactttcaggtacaccaatcagacgtggatttggtcttttcacatagtcccatatttcttggaggctt

SEQ ID NO: 35456 - DNA, 201 bp, Homo sapiens
gcaataggaaatatgaccataaaaacctcagtgaaagtaacccacatttagagaaggcttgtattccttaatcccacccctctacacaccccacccattcracccatctgtagcctccctttcagctgttcttaaaagaccttcccttttaagggaacttacattttcccttcaatactaaatcccaaaagctaatagcaa

SEQ ID NO: 35457 - DNA, 201 bp, Homo sapiens
agtcttagtatgaaaacagttttgcttctcctgaggaatttttacttacctttatagatactgtatgcctcttaagaatcctatttgtattccctgctacrcgtagtctactaagatgcttagtagtggacttaggatgcactgcattgaacgttatggcatggttttctgtctactaattctttccctaatttatacaac

SEQ ID NO: 35458 - DNA, 201 bp, Homo sapiens
ttttctcgagaagtatctttgtggccttctctgtatttcctgaatctgaacgttggcctgccttgctagattggggaagttctcctggataatatcctgcmgagtgttttccaacttggtttcattctccccgtcactttcaggtacaccaatcagacgtggatttggtcttttcacatagtcccatatttcttggaggct

SEQ ID NO: 35459 - DNA, 201 bp, Homo sapiens
aatctggcctaaaatcacaagcaaacattccatgatggaatggcagatcatgctagatttgctggttattatcagttttattttacgttacctaagtagartttaagcctttcagttaaaatatgactcccaagcaaaaggaagaggattaatggattaactattgtttgtgttatcaataatattggcaataactatttg

SEQ ID NO: 35460 - DNA, 201 bp, Homo sapiens
tatctatttcagctttatgtttggatagatgtactattcatcctatctttcattatgagtcatgacctcgttatagataatcaccttctattcatctaagrcattcttatctcactataattttataatatctaccgtgctatgactcctgattagttcataaataaactgttttattccacgcattattagaattaatga

SEQ ID NO: 35461 - DNA, 201 bp, Homo sapiens
ctgccgagagatctgctgttagtctgatgggcttcccttccagggtaacccgtgctttctctctggctgcccttaacattttttccttcatttcaactttrgtgaatctgacaattatgtgtcttggagttgcttttctcgagaagtatctttgtggccttctctgtatttcctgaatctgaacgttggcctgccttgcta

SEQ ID NO: 35462 - DNA, 201 bp, Homo sapiens
attgatttttgtgaattttgctttggcagtgataccactatctatcaccactacccataggtgatagtgcatttgtcataggcttctttatgaagtctctygtgggtatttttgaccagggtgaatcttcaacttaattactgtgtaatgagacatgatttttaaaaatatatctagatgatgttctgatatgattttgaa

SEQ ID NO: 35463 - DNA, 201 bp, Homo sapiens
tcccattattaatgtgtgggagtctaagtctctttgtaggtcactcaggacttgctttatgaatctgggtgctcctgtgttgggtgcgtatatatttaggwtagttagctcttcttgttgaattgatccctttaccattatgtaatggccttctttgtctcttttgatctttgttggtttaaaatctgttttatcagagac

SEQ ID NO: 35464 - DNA, 201 bp, Homo sapiens
gtcaattttggaataggtgtggtgtggtgctgaaaaaaatgtatattctgttgatttggggtggagagttctgtagatgtctatcaggtccgcttggtgcmgagctgagttcaattcctgggtatccttgttgactttctgtctcgttgatctgtctagtgttgacagtggggtattaaagtctcccattattaatgtgtg

SEQ ID NO: 35465 - DNA, 201 bp, Homo sapiens
ttgttataatttctgttcttttacatttgctgaggagagctttacttccaagtatgtggtcaattttggaataggtgtggtgtggtgctgaaaaaaatgtrtattctgttgatttggggtggagagttctgtagatgtctatcaggtccgcttggtgcagagctgagttcaattcctgggtatccttgttgactttctgtc

SEQ ID NO: 35466 - DNA, 201 bp, Homo sapiens
acaaatgtatgtatatttataggatgcttaggcaaaatgaagccctgagctgtaaaatgtttcatgacagtctttgctgacagagaacgctgtaaatgggwgtcaggtccccacttagacagtgtaacagaaatccatgccagggtgaaataagagctggcagttaggatgatagactttgaaatcagccatcacagtata

SEQ ID NO: 35467 - DNA, 201 bp, Homo sapiens
taactagcattacagaaaaccaaacaccgcatgttcttactcgtaagtgggagttgaacaatgagaacacatgaacacagacaggggaacatcacatgccrgggcctgtcagtgggtgggggtctaggggaggaacagcattaggagaaatacctaatgtagatgacaggtcgatggctgcagcaaaccaccatggcacgt

SEQ ID NO: 35468 - DNA, 201 bp, Homo sapiens
attttgtatttcatatgtatatatgctgtattcttataataaagtgtgttagagagaaaagaaaatactaagaaaatcataaggaagataaaatatatttktgttaatcaagtgaaagttgatcatcttaaaggtcttcatctgcatcatcttcatgttgaaaaggctaaggaggaggaagaagaggaggggttggtcttg

SEQ ID NO: 35469 - DNA, 201 bp, Homo sapiens
atgttcaaagtataacaaagatgagaagtaagttgaaaaaagaattattagtgatatttcttctaccatatacatgttatcttggaattggaattttttcrtaataagaaatccattagcataaatacagtttaaattgaataagtaaatttcattaaaaacaaaatatttatttgggggtacattttataaatagctgca

SEQ ID NO: 35470 - DNA, 201 bp, Homo sapiens
caccaacgctctcatgtttctcataaaaaatgctcagctttatttggaaactttggccattgttttctttttcttctttcttcttctccttcctcttttgrgttaaaaaggccacagtctgacctacttatatgtgtgatgaaatgtgcagactctgccaaggctatttattctaatgatttatctactcaagataaaaag

SEQ ID NO: 35471 - DNA, 201 bp, Homo sapiens
aaaatccagatcatactgatttgttgccatggtatagtagtcagagaatcttgctctgggcagttacaatattttggagattgttttacataatagcaacwataacaggaacaatgataactgctaacttgtttacatttacaaaatgtcaaatactattctagattattcaattgaatcatcacaacaacgctatgaggt

SEQ ID NO: 35472 - DNA, 201 bp, Homo sapiens
aacaacgctatgaggtagttactgttatattgttttgatttccctgatggagacttgacacaaagagagactaagtaattcactcctgtcacacacagctwaaaagtggcagagctgagtgttttgccccaggtagtccagttctagaactgtactcttttccactatgctataccatcttcctaatactatctgtacaag

SEQ ID NO: 35473 - DNA, 201 bp, Homo sapiens
tcagtttccttctatggtgactctttgtaagccttatccaactctaacctgttgttatttatatggcagagtgaacattctaaattgcagatcctatcatstcattctcttccttaaattgtactatggctttccacttttttcaggatgacatacagtgctctcccaccatgatctaatctctgcttctctctcatctct

SEQ ID NO: 35474 - DNA, 201 bp, Homo sapiens
tcgccgtttcctttaatctatacactatgtgtcttcctaatacagagagtatgttgtttgcctatatatcataacaaattgaaaatgcatttataacttayaaagtatatattactaggtgctagaatttacactattatcctaatatacagaagctgggaaaagtaatgccatagagttgatttatgtgtgtaaatgtct

SEQ ID NO: 35475 - DNA, 201 bp, Homo sapiens
tagtgtgaaatgtttacagtattttaattttgaaaactatacttattaaaacagtatgacaacatttattgaatacatgttatgtgctaggtaccaagtgrggagttttatgtttattttctcatttcatcctaagagcaaacttcggaggtaggtgtgattcgtctcattttagtgaaaattcactgatgctctgaaagc

SEQ ID NO: 35476 - DNA, 201 bp, Homo sapiens
ctaagcacatcatcttcttctatgtgatgttttgcaaatctattcataggagatttatattttcaagtgtgctcaaatggatctgtgttggggaaagataygtgaaataagaaaataaaagctaatccatttgttttaaaattttgtctgcctaccacattttgttggacttcttgttatatgagaactcctaattgtctg

SEQ ID NO: 35477 - DNA, 201 bp, Homo sapiens
tgtagggatttaggggatacttttaatgttatattctatgccttaaaggaaatcttcaatacttgtgcaatacactttttctccccaaatctatttgctcstcctctttggtccctcagtttatattatcgcctctatttcaggttctgggcgacatgcatatctgttcttttgttgttgttcttatctttcctcaaccat

SEQ ID NO: 35478 - DNA, 201 bp, Homo sapiens
atctctggtggtctgttccagaactatgtccttgactctgtcacattcatacttttcatcactactttttatacttctgcaatttaggtcacccaatacasgttatcttatcaggttaaactgattgtagtggtcacattgaaaaagaaaaaaaaaatcccaaattcaggacttttcccaaccagttctaattaatgcacg

SEQ ID NO: 35479 - DNA, 201 bp, Homo sapiens
attttcgtattgctataaagaaatgcctgaagctcggcaatttgtaaagaaaagaggtataattggctcatggttccatcaggctgtacaggaagcatggytggggtggcctcagggaactttcactcatggcagaaggcaaagctggagcaggcatcttcacacaggcagagcaggaggaagtgggggctggaggtggca

SEQ ID NO: 35480 - DNA, 201 bp, Homo sapiens
ttaaactgattgtagtggtcacattgaaaaagaaaaaaaaaatcccaaattcaggacttttcccaaccagttctaattaatgcacgtgtgaaaggacatarttattgtgaaaagaaatgctatcaaaacagtctaatggctacaagaagaaaaagaaaagaagaagaaggaggaggaagaggagaaggagatgaagaagaa

SEQ ID NO: 35481 - DNA, 201 bp, Homo sapiens
aacatgtatatagcattgatacctctatctgcagaatgtaagaaattgtaactgtatacatgagagtatattataaatgcagtagttcctgctccttggcrtgcagatacacctcattactctgcaatgcaaaactaaaaatatacatgttttttaaatctgctaaaagattcaatatatgttaattttggaaattatacg

SEQ ID NO: 35482 - DNA, 201 bp, Homo sapiens
ttccttaactctgtaaaattggcaacttccaaccacttggtgaaaccggaagtctgaagttttatcctatcttgatctacagagatataatcaacattgtygtttttaatagccagttgccaccaaagatctgatcacaataatgcagagacctttatatattatcactagaacactgttgtacatttataatcaaaaatg

SEQ ID NO: 35483 - DNA, 201 bp, Homo sapiens
tggttattatcagttttattttacgttacctaagtagagtttaagcctttcagttaaaatatgactcccaagcaaaaggaagaggattaatggattaactrttgtttgtgttatcaataatattggcaataactatttgtctatggtgctgtgtcagttacaaggcactctgccatgcattcttccatctgatcctcacca

SEQ ID NO: 35484 - DNA, 201 bp, Homo sapiens
ttaagccaaaacaacaggtaataggaaattgtcctgggcaaaccagaatgtatggccctgctagcattgtgtaaagttaccaaacttccagtgtcataacmcggagtgaaatacacttaggtgaatggatgcatagatacgtggaagagtcaattaatggactgcatttagggttcatccagttggattctctttctactt

SEQ ID NO: 35485 - DNA, 201 bp, Homo sapiens
aagatctctagcacagaaaagtctggttacaagattacagagagagagagaaaaaaaaaactgtagtgacttgtctagggaactgtgtggttgccacataraaaatgtggaagggagtgatgggagacaggctatgttcctagcaattgccttgactcaccataattatttcacctactgaataactgaataaattgagta

SEQ ID NO: 35486 - DNA, 201 bp, Homo sapiens
tcagcatcaactgatttagtgaagcagcaaaaagaaaaatggtgtgtgcagcattatctttctgccacagatacatgtttttaatttccaagtttccaatrcatcattcagttttatctaacgggaatgcagctgagagaagtttgtaacaacccaaaactacatgctaatatagtttagttttcaagtcttgtggagtct

SEQ ID NO: 35487 - DNA, 201 bp, Homo sapiens
ctcacacaattccctaaaggaaaactacaaaaaggatgtttcttgagataggaatacaaataaacttttgcttgtttgtttgttttgttttaaatccagtrataagaatgaatgttttctgtatttgctttttttaaaaaaactctatattttatgtgcagacatttaacataaaatcttttcccaatgtctttcttagat

SEQ ID NO: 35488 - DNA, 201 bp, Homo sapiens
gtagccctgcagacaaaatgataattgagagaagattagggagttgtgaacagaaagaataaactcaagcttcaagtgagatggaatccctactccctccrgaagaccttttatgtgatataaggaaacagtgcaatccaccataatatcataatttgaaaaaaattgtatcaactattcaagaattactacattcctata

SEQ ID NO: 35489 - DNA, 201 bp, Homo sapiens
tatggtagaaatttaactcttatgacggagtggcagtgctcacacacccttagaagtttccagtgccttcccaaggaaagatcagactctttgagcattasaaaccctctgtaatctgactacctttccaggctccaagccctcaactccattctatataatgccaagtttggcatttcttgcacttatctagacatcatt

SEQ ID NO: 35490 - DNA, 201 bp, Homo sapiens
ggaggcatgatgagtgattactgactcatttccacggcattagttcaagtcctcattatctcttaccaaaacaaatatggtagaaatttaactcttatgayggagtggcagtgctcacacacccttagaagtttccagtgccttcccaaggaaagatcagactctttgagcattagaaaccctctgtaatctgactacctt

SEQ ID NO: 35491 - DNA, 201 bp, Homo sapiens
ctacaagaagtatacaattgctcctctgatgtgaaagcatatgaagaaaataagtgtccaaagctgcataaatatttgcacccctttgagagtatgagaargtgtgtgttttatgttgtgattgataggacaactttcatggcccactttgaactcttagcaggaactttggaatgtcctgagggtctgtctgcctttgta

SEQ ID NO: 35492 - DNA, 201 bp, Homo sapiens
ccaccacgcccagctaatttttgtatttttagtagagacaggatttcaccatgttggccatgttggtctcgatctctcgacctcgcaattcgcccgcctcrggctcccaaagtgctgggattacaggcgtgagccaccgtgccggtccctcatgctccatttttatagtttctccaagaagcactttctgacctctagact

SEQ ID NO: 35493 - DNA, 201 bp, Homo sapiens
ccacatagttacagaggtgtgtgttttcttctttgtttagcactttaaagatgtggcaccattattttctggatttcattcatccttatgacaacatagccattatttgtttctttgttctatatatatatatctttaattcactagatgatttcaaaaatttttttatatctgccttttgacacttataccatgtatgat

SEQ ID NO: 35494 - DNA, 201 bp, Homo sapiens
tgaagcttagttttatgaattaccttttagccttctccagtcatgtgggaaaactttcctgcctcattaaatctttaatgcaatgtgcaccatgcacactrtattgttatttgtgacattaggttatatattgcatagtaactataatattacttgcaaacaagctggtttttccccctgaaggtagaattaaaacaggta

SEQ ID NO: 35495 - DNA, 201 bp, Homo sapiens
ctggtttttccccctgaaggtagaattaaaacaggtactcatgggaaacagctacttgtgttcttcttttcttaatggggtgaagctgaagaacaggaaaktgaatggcttagcccagaaccatctccaggaatggaggtaaattttttcctgcagtgccttctcaatttgatatctgaatctccctgaagagaatttgcc

SEQ ID NO: 35496 - DNA, 201 bp, Homo sapiens
gaaggtagaattaaaacaggtactcatgggaaacagctacttgtgttcttcttttcttaatggggtgaagctgaagaacaggaaattgaatggcttagccyagaaccatctccaggaatggaggtaaattttttcctgcagtgccttctcaatttgatatctgaatctccctgaagagaatttgccttagtagatatggag

SEQ ID NO: 35497 - DNA, 201 bp, Homo sapiens
agcattacagccacgactctttatacagcagccaccctcttctgtgcctttgccaatacgttccctctgcctggaagattgcagccctttcactcctccayccgagactaactaatccctgttcagctcccaaaagtcagcactatcatcctgaaaatgtccttgattgggcctaatctgagttggttgcccttttgtgtg

SEQ ID NO: 35498 - DNA, 201 bp, Homo sapiens
gtcttatttacatttaaacggccctttttcaaaatattgcaatttgatttgaaaaagttaacagatgtggaaaggaacaatgcctttgttatgtcaagatrtccgtttctagcaaggcattcattcgataaactatttttaaaaatgcactcattctgccttgcatatgaaaatgagagggcttgacatttcacattacaa

SEQ ID NO: 35499 - DNA, 201 bp, Homo sapiens
gatgagcataaaagtggtgtactactgaggaaattatattctcccacattgtttttgatccccttcaattttgacacttgctgcaaaagactttatcttgrtaagatggcaaagataacagagctagcctgaccataagattcagatgccctgttctgtttctcctttggcaaatgtggcttagtataaagtgtgagcaaa

SEQ ID NO: 35500 - DNA, 201 bp, Homo sapiens
tggatgaagtggtctgctctctctctttctgtctctctctttctctctctctctgtctctctctttctctctctctctctctctctctctctctctctctmtatatatatatatatatatatatatatatggcaactagatgtatactttggaattcctttaaggtgaaaagagttctctaaatgtaaagtgttgagtgaa

SEQ ID NO: 35501 - DNA, 201 bp, Homo sapiens
gaagatacatgcaaaacctgacagttgaacagcctatcgaagttaaaaagcttttcgttgggggtgctccacctgaatttcaaccttccccactcagaaayattcctccttttgaaggctgcatatggaatcttgttattaactctgtgtaagtggatctcctcattactactactaattttttatttttatttcttgcta

SEQ ID NO: 35502 - DNA, 201 bp, Homo sapiens
gaaatagttccaatattattcatagtggcttgtataattatgtcctctctcttcatccatcatcttttctgtattttcaaggcataaaaataagagggaakagtcagctaaagcatttgacttagttgacaattctttgatagctcatgcatctctaaaatttagtactatattattgccaacattatgtatttaaatgaa

SEQ ID NO: 35503 - DNA, 201 bp, Homo sapiens
tcagaatctctctaagaatcaaagactgatgagaaacctctgaaagctgtgaaaagtgtgttattgtttttaattgcttccctaaagaatgagagaaggcraagctgggaccctagtggtattgatgggctgttgctccttatccatgatgtgtaagagtgaggaactaagtctgaaaactttttaaggggaaaatagcag

SEQ ID NO: 35504 - DNA, 201 bp, Homo sapiens
agaatgtatccttagtgctttcaaagttccctcaacattgctttcaataacctattctaataagagctgttttttttctatcaataattacacaaataatktgtatcacttaaaaacaaaacttgaatatctaccaaaagctgtggctttcaattagagtattaaccacataatttcattttgtaactctttctctctgag

SEQ ID NO: 35505 - DNA, 201 bp, Homo sapiens
aagacccagtagggtaccctatttcattaagaaatgtgtctctctcatcacaggtttagaagatgagttctagctttttgttatttaataatgataattcrttgaatcaaaaccaaatcactttctggaccaactggcagctgttaatataacctgtaaattgatctttttttaaagcaaaatttccaacagctcagtgcc

SEQ ID NO: 35506 - DNA, 201 bp, Homo sapiens
tcaagactgacaccccaaagcatccttaatctataataaacacaggagtacagggaagctcacctccactttgtttacatttctatgggcaaatgtgccgwctttctagtgagatgtgaggaatttaagtgcccttactgcagccttgggaatagaaacaggatcatcaacagcctccactcctgccatcctcacccatgc

SEQ ID NO: 35507 - DNA, 201 bp, Homo sapiens
ttgtgtaaatttaatctaattttttgatgaaacaatatattatgaaaataaattaaagatagacgagagcagaagaaaattgagccatgaataatttcaayagtggggaagagaactttggaaaagtttaaattagagtagaaatgggtaagaggagctcaggaaagtatttatttgcttttctttaattccccattgtgt

SEQ ID NO: 35508 - DNA, 201 bp, Homo sapiens
aactagtttcactagcagaaaagaaaaataaaaatataaaatagcaaataatctttaaagaaaactgattttcttattatgctgaaatttattaaagactrttgtgttgactgaagaatatgtttaaatattttgtggaaggcaaagctttcattcaggaatgacaagtgcaaggactgtaattctaaagaaattaaagaa

SEQ ID NO: 35509 - DNA, 201 bp, Homo sapiens
tagttttagggtctgacttctgtaacagtttgttcttttaaaggaagcacagattgatacaacgtatttaacataatgagtaatgtctacttatttttacrttacttaaaaaatgaaatacatgtcagtttgaaacactgccttaataactgtgtgcaagtactcagtaaaaatcagcagatgctcgtttggttgtgtccc

SEQ ID NO: 35510 - DNA, 201 bp, Homo sapiens
tcattcataagccactcattcgaaacatcttcccagatacttagttttatgaaattctcaagactgacaccccaaagcatccttaatctataataaacacmggagtacagggaagctcacctccactttgtttacatttctatgggcaaatgtgccgactttctagtgagatgtgaggaatttaagtgcccttactgcagc

SEQ ID NO: 35511 - DNA, 201 bp, Homo sapiens
ggtaagcactgcttatacagtaagcactgctctttccaatatacatatgtacacatagtgtatgggtgaaaactgagactgtgtggcacatatgaaatgartgacctttccagtgagcattgaagattttaaaatggaggacagaaagaatgtgagatttttctagacaagagatggaatttcctttatcccaggtagcgt

SEQ ID NO: 35512 - DNA, 201 bp, Homo sapiens
ttttgaaatgacatttttatgaatagaaagactaagtgattttcattttaattatgccataagtcttttaaaatgtactttgggaaaaatattgggttacmtttaaacacttcactaacatgcagtaggaaataatactcagcccaaaactgacatggaattgttttacttaccctaagaagacaaaaataagtatgtcat

SEQ ID NO: 35513 - DNA, 201 bp, Homo sapiens
ctatgtggcatgcattccttgtcttggatggctttgaagatattctcaaacattatttttgcaatctttgaaaaagtacaaaaggtagataactttgtacyctttgaatattgcatgatagcaacaaaaatgaaaaatctatagaaaaaagtcaggtggtaaataaaaatcgaaagtatctttatatataaacagtgtcca

SEQ ID NO: 35514 - DNA, 201 bp, Homo sapiens
attttttagcatataaatttaaacataatggtaactatttttcttcttaatgaaggacacatctaaaataaatcatttggcttaaaattagcaacaacagyaataaccaaaacagcaatgactaacatttatttagtgtttactcggtgtaaagtatttttctaaacaccttccacagctggtgtgtaatgctgtgagcaa

SEQ ID NO: 35515 - DNA, 201 bp, Homo sapiens
attgatttgtccaagaaaactcagcccatttatcaggcatttcatcataattaagaattttgttaatttccacatcaattgtgcttatgtgtacaacaaaygcaagaaacacattttcacacactataaatggacaaatacccaaaacggggaaagttgtttctaattacaaaagtgtggttctcatatcacaggacaaaa

SEQ ID NO: 35516 - DNA, 201 bp, Homo sapiens
aaatttataaagcttaacttgctttaaaatttgattataaattatctgaaaaatatttttggcaccagaacaaaatctaaacttctgcaatagtgtaggtstatatttaaaagacattttaactcaaagtccatttgaagtaagccaggaagtattcaatgtcacatgggaagatttcatgcttgcttcttctcatagttc

SEQ ID NO: 35517 - DNA, 201 bp, Homo sapiens
gccttaatttgtggatcagtggatttttgaaatgacatttttatgaatagaaagactaagtgattttcattttaattatgccataagtcttttaaaatgtrctttgggaaaaatattgggttacatttaaacacttcactaacatgcagtaggaaataatactcagcccaaaactgacatggaattgttttacttacccta

SEQ ID NO: 35518 - DNA, 201 bp, Homo sapiens
tttaatagttgtaaacataagtatggctttgacctctttggacttcaatcacttcatctgtaaaataaggaggaggacaattgctctgccagcttcaaaargtcaccgcaagaattgaattagagagctgcaaaagcacttggctagtggtaacccagcacacaaatatgaagcatttctatcttatctacttcatcccaa

SEQ ID NO: 35519 - DNA, 201 bp, Homo sapiens
attactaaatgagtatgtgaggacagagcagaggaaaaggccaagggttgagcactgtggtgctctattatgagaaagttaggaaggattaaagttggcastgaaggggattgagaaggagtagctgaagcggtagaaggaaaacaagaacagtgtgtcctggaagtcagtggagtaatcacttgtctcaaatgctgctaa

SEQ ID NO: 35520 - DNA, 201 bp, Homo sapiens
aaagtggcctaaagtacaagtaagcagaaacatggctcaaaatgttgagaacattcttaagtggaatatagcatgttctaaggtttcaacttgtgaaccaycttgaattagttattgcagtgcccaacagatatttagtattgctgtgtgtccttcaaatgtttacaatattccactgtgcctttgtgagttcactgcagc

SEQ ID NO: 35521 - DNA, 201 bp, Homo sapiens
gcagtttcagtggaatggaggaagaccaatggaataataggagcattgtggaggaataaaccaaaatgtacctatttaccatccagagccagactcagagyctttactctgtgctagaaacacaatgaccaattgttgcattgttccctttccttgagctttctacagctcacctcgcttcttcaaacatgtacaatcaga

SEQ ID NO: 35522 - DNA, 201 bp, Homo sapiens
cctttggggtagtatataccttctcaaacttgagtatcagattggataatgctatccttatttccttttccacattgacttttgtgcagttcttgcttttrattacagtctcttctgaaaacctttcttaataaagatataaagtggcctaaagtacaagtaagcagaaacatggctcaaaatgttgagaacattcttaag

SEQ ID NO: 35523 - DNA, 201 bp, Homo sapiens
tcatattatccatcctcctctacatcagggtccacaacccctgggccacaggaggatattggtccgtggccttttagaaaccagaccacacagcaggaggsaagcagcaggcaaaggagcaagcgcagcttcattagcatttacagctgctcctcattcctggtattactgtactgcctgagctccacctcctgtcagatc

SEQ ID NO: 35524 - DNA, 201 bp, Homo sapiens
catttcagaagaattataataaggaatatagcatctttaacccatttctcatttgcctgaagaatacttgcagacagcatttgtggcttaatgtttacccygagataacttgtggcttactgtcctaaccttatccccaaagtttgccatgaaatatctcacttttattattatttttgcataggtctagcatattgactt

SEQ ID NO: 35525 - DNA, 201 bp, Homo sapiens
acattccagagaatcaaaattgcttgggatgacatcgggtactctcttaggctaagactatatgatgagtccttttatatcagctgccttttttacagtastttttcttctactttcctgtctgtgcttttttctttgagactgtcacatttcaattctttatatctctgctttattttaccatttcagaagaaacaccaa

SEQ ID NO: 35526 - DNA, 201 bp, Homo sapiens
caaagaggagaatatttgaatgttgctcatcaagggcattcttactgttcagctgaccctgcattttagcttcttgtttatttttcatggttttaacccascattaagtagcatggtttttagcatgaaaaataaatttataaatttataaagcttaacttgctttaaaatttgattataaattatctgaaaaatattttt

SEQ ID NO: 35527 - DNA, 201 bp, Homo sapiens
tgattcaattttttaaaacccttaagtatttgaagacataattttagttgtatcagtgagataacatgcaaataattttacaaaaaaacaagcaattcttyagtaatagcttagtttagctaaacttaaaaattgaaaggaagtaaaacaaaaatcaaatcggggaaaaaatctttcttcaaatggatccatgttttgcac

SEQ ID NO: 35528 - DNA, 201 bp, Homo sapiens
gctctatgactacacacacacacacacacacacacacacacacacacgcaatatcatgtattttcttaaggaaaataaagaaaaaatgaagtaagatttgyataatgaaaaacattaaaatgaatttcaatcatctttttgtaagtatgcatatgctgaaactactgtgttgtttataagctagatattaaattaactttc

SEQ ID NO: 35529 - DNA, 201 bp, Homo sapiens
tctcctgcctcagctggactacaggctgtgttgaataaaaatcaacaatttttactcaaaagtgattataaataactatacttttaaataaaaggaaattmttttctgaagaactctcttaaaggtgagcttagtgcttaataaggttcatatcgtattgtacactttccagctatctctaggcactgtgacaacactgac

SEQ ID NO: 35530 - DNA, 201 bp, Homo sapiens
ggagagaaatgttctaaatgtgcacccaatacctggggccacagcattaccactggttgtaaggtgagtgaaccacttttttgctctgataattttttggrgagatttttgttttgtagagctctgtaattgggcatttcaaaattcaatattacatcacaaaataatgtagaagtattactataatgtgattacagatat

SEQ ID NO: 35531 - DNA, 201 bp, Homo sapiens
atttatctagcaaggttttgagaaaataagacattggtttaatgcaggggtcctcaaccatctatagcctgttaggaaccgggctgcctagcaggaagtgmgtggttggcattaccacctgagctcagcctcctaacagatcaggcaggcattagattctcatagaagctcaaaccctattgcgaactgcacctgcgaggg

SEQ ID NO: 35532 - DNA, 201 bp, Homo sapiens
ctgcacctgcgagggatctagcttgtatgctccttatgagagtctaactgatgcctgatgatctgacgtggaacagttttatcccaaactcctcccctgcrtctgtggaaaaattgtctccaacaaaacaagtacctggtgccaaaaattttggggaccactggttaatgtatgttagtgatcagaacatttccagggcct

SEQ ID NO: 35533 - DNA, 201 bp, Homo sapiens
tatgactagaggtatagctaagaaaaaagactatagggagaaattaatattgtaggacaaagcatttaattctagaatgatcccactaaggtaagaccacygtcatcggttgcaaaattgctgaatcactagggttaatagttacagatcctaaatactcctcacatgttttctttcctcgttacttaacttcccacaccc

SEQ ID NO: 35534 - DNA, 201 bp, Homo sapiens
aggaaaaacattcaatattgacaaacaccctaaaaattatttaaattgaaagaatagtgcaaaataatcaaggaaaagagagaatttctgttttttttttwaaaaaaaacagcacgttttaagtttctaatctttgcgttgtcaaatactctctctctctcttttgctacctcatagaaatttaatccatcaggatacgaa

SEQ ID NO: 35535 - DNA, 201 bp, Homo sapiens
ggtatatattcttattatagcagtgtctgccagggctgcagtcctgttgttagaaggctgtcagaattttaaatgtaagccttcctttcccaggtgttatwatttaatcttctaactcctattaatttctgaagactgtggggccatcctatatcttagaacaaaatatagatacgtacattcctgatttttttctccata

SEQ ID NO: 35536 - DNA, 201 bp, Homo sapiens
accttttagctcttattacaatgttctgcttaccttcattttatgttaacatatctgtaaagcaaggtcctttatttctcttctcttctaattaactagaygctcttacatattcttccagctgacacttttatgcactattttaatctcttccacaaattttaattacaatcaaaattactggaattttgattgtaatta

SEQ ID NO: 35537 - DNA, 201 bp, Homo sapiens
agcaccactatcaatccagcagagctggctgcccattgcatcatgtgaattccagctgaatacatattagaattatataattgattgagtatgcaaaccckatggatttaccctcaagtctgaccaacattactataaatgcagaggaaacattagggagataattttgcttggataattataggcattcatgacccattg

SEQ ID NO: 35538 - DNA, 201 bp, Homo sapiens
ccgtaggcatgggaccctccgagccaggtgtgggatataatctcctggtgtgccgtttgctaagaccattggaaaagcgtggtattagggtgggagtgacscgattttccaggtgccgtctgtcacagcttcccttggctaggaaagggaatttcctgaccccttgtgcttcccgggtgaggtgatgcctcgccctgcttt

SEQ ID NO: 35539 - DNA, 201 bp, Homo sapiens
aaaccatactttgcattatggtattttttatcttttattgcctttagccagtatccttaggaatgtgttacagaaaggaagatatagacatcttattattrtaaaactcatccttcagtattggcaggggattggttccaggacccccccccacagatatcaaaattcttgaatactcaagtcccttttataaaatggcat

SEQ ID NO: 35540 - DNA, 201 bp, Homo sapiens
gaattgctatatttacactagtcactcttctctcttcagatattttatgtcttacagtaaactgttttaaggttgtctatatcaagcacgcatttctcatwtaaaaattctttctatgtatcttacattttcattttaatggtagtaaacattacctgttttgtttcaacatagtaaatgtactaactggtcattattggt

SEQ ID NO: 35541 - DNA, 201 bp, Homo sapiens
aagtctgaccaacattactataaatgcagaggaaacattagggagataattttgcttggataattataggcattcatgacccattgttgtctctttatttrttgtgcatttacttggataatgggttctaattgttgttcctgaaaaagaaagaaagtctgcaagcattaaaacacaatccatcagtgccaaagggattgg

SEQ ID NO: 35542 - DNA, 201 bp, Homo sapiens
ttgctgccaccttgcagttcagtctcagactgctgggctagcaatgaacaaggctccgtaggcatgggaccctccgagccaggtgtgggatataatctccyggtgtgccgtttgctaagaccattggaaaagcgtggtattagggtgggagtgacccgattttccaggtgccgtctgtcacagcttcccttggctaggaaa

SEQ ID NO: 35543 - DNA, 201 bp, Homo sapiens
ctggcatttttagcacagttatatttgctttatatgattaatttagaagcatttataaataatgcagtttaatttcaattttgttaggattaaaattaccrtctttatactgtcctcttttgaccaattgactattatgactatttttgttctctaagaattctaaaagcatgtctattttctgaggaatccctagatgaa

SEQ ID NO: 35544 - DNA, 201 bp, Homo sapiens
caagcattaaaacacaatccatcagtgccaaagggattgggtttccagtgtccaataatattatttcctaaaagatgtatattctaatttggtataattaygttgatcctgatttttaaaaatgcatataacacagtgataacaataccagtaacaccaagtatttaatgattctttcattttcaaaatgttttcacttag

SEQ ID NO: 35545 - DNA, 201 bp, Homo sapiens
tccagaccctgtttgcctgggtatcagcagcggaggctgcagaacagcagatattgctgaacagcaaatgttgccgcctgatcgttcctctggaagcttcrtctcagaggggtactcggccgtgtgggatgtcagtctgcccctactgggtggtgcctcacagttaggctattcagggctcagggatccacttgaggaggc

SEQ ID NO: 35546 - DNA, 201 bp, Homo sapiens
tcttcaatcactgataccctttcttccagttgatcgaatcagctcctgaggcttgtgcatttgtcaggtacttctcgtgccatagttttcagctccatcargtcatttaaggacttctctacactggttattctaggtagccatttgtcctatcttttttcaaggtttttagcttctttgtgatgggttcgaacttcctcc

SEQ ID NO: 35547 - DNA, 201 bp, Homo sapiens
aaaggccttttctgcatttattgagataatcatgtggtttttgtttatatgctggattacgtttattgatttgtgtatgttgaaccagccttgcatcccgkggatgaagcccacttgatcgtggtggataagctttttgatgtgctgctgcattcagtttgccattattttattgaggatttttgcattgatgttcatcag

SEQ ID NO: 35548 - DNA, 201 bp, Homo sapiens
caaaggccttttctgcatttattgagataatcatgtggtttttgtttatatgctggattacgtttattgatttgtgtatgttgaaccagccttgcatcccrtggatgaagcccacttgatcgtggtggataagctttttgatgtgctgctgcattcagtttgccattattttattgaggatttttgcattgatgttcatca

SEQ ID NO: 35549 - DNA, 201 bp, Homo sapiens
gggacgcttcttctctagaaagactaaaattaatcaaggctacaatgtagtgtttttttccctaatgactttagcgttaaaagaccagcaatgtttcttargtacaattcttgttacctgctttctttataaaactgtaggattatcaatctgagcattacatgtagactaaattttgaaatattaaaaaacggatacgtt

SEQ ID NO: 35550 - DNA, 201 bp, Homo sapiens
acttgttttcaaacatcgatttcgggttcatgccatcaaattaaaaaattcacttaactgagtttaatttgctttcacttaggaagcagctgcctttcaakataataaaataaacagatacaataatatttggtcagctgtggcttttaatttaaatgtttgatttaatgttgtttagtttgctggattccaaaatattct

SEQ ID NO: 35551 - DNA, 201 bp, Homo sapiens
attgttttatagtaaagatgcttgtaatatcaaaacaagtatgtttttaaaaaattaatttcatcctattacatttcacattttatatttgatgtgggttrgaggagccccttagagattcttttttctttgtagagaagttttgtagagatcaatagtgtaagaatcatacaagtgtaaatagttttgtttccttttaat

SEQ ID NO: 35552 - DNA, 201 bp, Homo sapiens
aattgagagattatatccttccctgtttttcattatatggtcagctttcactggcctgagtccacattttaagctcaactatatacaaataatttttcagwatactgagagtaggattaatgaaaccagtctggagagcagtcacagaatgagaatagatctttcccatagtatcactatgtgactaactgattgtactga

SEQ ID NO: 35553 - DNA, 201 bp, Homo sapiens; identical to SEQ ID NO: 7273

SEQ ID NO: 35554 - DNA, 201 bp, Homo sapiens
agacacttaatgacctagggaaactatcctttttaaaaatattttataaaaaacattactgttataatgtgagctagaaactctgagatatgaattgaatmtttgcatacaatcctgaagacgagattttaatttccacaggttattcagagaaaaaaaaaaagggagctaaaggttgacgcaaccttcatgggaagtcta

SEQ ID NO: 35555 - DNA, 201 bp, Homo sapiens
gcaaataacaatgtaactatttcgaatgtttatattctttaatttctggcatcacatagcttataggttaaataaaatatgaaagagacatgtgaatctcwgcctttgaatacttaggatgtgtttgaatatataatattattgaagttgttatagattttcatcagttatataataaaatatattattggcacaaggctg

SEQ ID NO: 35556 - DNA, 201 bp, Homo sapiens
gttgacctttgggctcactcaagagatcatattgaatgcacgttgttaaaattaatatagagaaatgtattccaagacaataggtaaatttaaggaaacawtcaattcagccatattctctagaaaattgagaatgctctagatgttttagtgctctttcctacacattgttttatgtgcacatgggagattatgatgggt

SEQ ID NO: 35557 - DNA, 201 bp, Homo sapiens
aaaataattcattatgcaattattttactgcaaaagcaaaaggctgaaaattattgttgaagatcccatgtatttttggcacattcatctctataaaatawgttcttaaaacactccccagttaacacttattcatcagcatgacaccttgctgaatgacttgaaattataattcatagataattattttatcttggagcc

SEQ ID NO: 35558 - DNA, 201 bp, Homo sapiens
agctatgttaatataagggactagagcaggatgagaaaactgcagatttaattctttaactattaactaaatacctttcacgttaaatcaacatatcttawtttgtttaaaaatttgtaaaaaaaaaaaaaaggcaaagttttttaaaaaattaataagtcgtatctataatttattatggcaatatgctttcatactttt

SEQ ID NO: 35559 - DNA, 201 bp, Homo sapiens
agcttcaagtgagatggaatccctactccctccagaagaccttttatgtgatataaggaaacagtgcaatccaccataatatcataatttgaaaaaaattrtatcaactattcaagaattactacattcctatacagtaaacactttattatttttttattgacatttcattattttactataacgaaatgtaatttaatc

SEQ ID NO: 35560 - DNA, 201 bp, Homo sapiens
atggcaatatgctttcatactttttcagtataaaagggtttatcaaatcaatcatattattccattttgcagaatgggaaacaggtttagagaaatatatygttcaaagacatacttagaaaataaatcaagtctaattaagaaatgcaattgtggagattaaatcagatttcatagtacttaaaggtaattaaagaaata

SEQ ID NO: 35561 - DNA, 201 bp, Homo sapiens
agcaataagagagtgaatcttcagtttatgttgttgaaagaatatcaaagcacaaatacagatatattttatgagaaagttttatttggatgcgttatgtygagtatctatattactagaaacttaaacttacttaattcttaccagtaggtttcaatgacaattggttataggaagaagagaatatcacattaagaatct

SEQ ID NO: 35562 - DNA, 201 bp, Homo sapiens
ttcctacttcctttgctataatcctcttgagggcatttttatattccctgtgatatctcatatgtcttgtatatagtagttcagctatgagttgatgaacraataatataaagaataaagcaacgataagaaataatgagcagagcatttattaataatttgatattgataacagaggaagttaaattattcaaagagctc

SEQ ID NO: 35563 - DNA, 201 bp, Homo sapiens
atgattgggttaaacaagagatgagaaactgcaggatagaaaatcagaaatataggcctgaaaaaattacctataaattgacatagggaagtaaataaatrtgatgctaactgactcacagaattgtaaaattgaacagaagtttagcagaagttgccaaagaagagattagaagaagttgagggaaacaatattcaaaaa

SEQ ID NO: 35564 - DNA, 201 bp, Homo sapiens
agcatcccagaccagcctttatctccttgacccagcagattcatttagactttccactgagttgaaatgtttaaaatgatagacttacctggtcctaataycttgctagtatcccaaaaataggaagaactattaaatctttacagaactaccctgagttaagccagagaaatactattcagaaatagtgttcatgatctg

SEQ ID NO: 35565 - DNA, 201 bp, Homo sapiens
aagttaagaaagtatttcaaagtaattcaagtgtcaggagcaggatcaaatcaggacttggaatgtttaatttgttgttatgtctttaattcatttagccrtcaagcaagtctctattgaattgccctgtcatatataatagaaaacaaatctacttagggaaaacataataagagaaagattaattgagggcatttccct

SEQ ID NO: 35566 - DNA, 201 bp, Homo sapiens
agaaagtatgtgaggctgcatatgtgccaggcctggaggaatttctaaaaagcagctatacatttccacttgttactgatgatcactactcagagcagtcraaagtcagttaataacatgtcacagggatactgctctccactgggctatattcacgtctgcagaaatagcaatgtcatttcatcctccattggccagacc

SEQ ID NO: 35567 - DNA, 201 bp, Homo sapiens
ttattctttcagaagccttgaatttacatgaagttatgtgataatgacctaccttatataggacctagaattttttgttgttcttctgtaaaaccatgctycctgaactgtagtctagtcatcagaatttgccagtcaactccaggaaagacattgttttaaagaatgacgtaagctttctagaagtcaattttgtagttt

SEQ ID NO: 35568 - DNA, 201 bp, Homo sapiens
aaaagagcttcattaggaagtcttgggcctaattgttttttgttttataaattttaaatgactgctctgtgatgagcccatttcagttgaggctgtattayttttcctgtgggtaaaatgacatactgagctgatatggacatcacttctcccacttttgctattttaaaaatacagatatgctgcataaacatagcaaat

SEQ ID NO: 35569 - DNA, 201 bp, Homo sapiens
tttctagtttatttgcatagaggtgtttgtagtattctctgattttagtttgtatttctgtgggatccgtggtgatatcccctttatcattttttattgcwtctattagattcttctctctttttttctttattagtcttgctagcggtctatcaattttgttgaccctttcaaaaaaccagctcctggattcattaattt

SEQ ID NO: 35570 - DNA, 201 bp, Homo sapiens
cctggtttagtcttgggagagtgtatgtgtcgaggaatttatccatttcttctagattttctagtttatttgcatagaggtgtttgtagtattctctgatkttagtttgtatttctgtgggatccgtggtgatatcccctttatcattttttattgcatctattagattcttctctctttttttctttattagtcttgcta

SEQ ID NO: 35571 - DNA, 201 bp, Homo sapiens
ataggaatactattttataaaataaatggattaaactttttttgcaatccttttctttctgattcagtttcagcccctcttgtgtcgcagaaggacttgaygactaccgctgcacggcttgtccacggggatatgaaggccagtactgtgaaaggtaccaacagccatgaaacgtacagagtaatgatatgtagggactat

SEQ ID NO: 35572 - DNA, 201 bp, Homo sapiens
gtacaattcttgttacctgctttctttataaaactgtaggattatcaatctgagcattacatgtagactaaattttgaaatattaaaaaacggatacgttwtgatagtcgaatgatgaattactgagctcacttttcgttttaagccttttctctttgtgtttacaagtaaatcacaatgttgttttcattaatatcattt

SEQ ID NO: 35573 - DNA, 201 bp, Homo sapiens
gtagcaacaaatatggagcatttagaacagtgtctggcattgagaaaacctatgttttagttgttattagtattaaaagaaaggaattatattatacatayttttctttacccacaggctctaatacagaaatttccatatggtagtaattcattacagattacctagctgttaatcattcagtgccatcattgaataatt

SEQ ID NO: 35574 - DNA, 201 bp, Homo sapiens
ataccaatccttctcaaaatcctccaaataactgaagatgagggagtacttccaaacttattttatgaggccagccattagcctgataccaaagccaaagrcactgcaagaaaagtacattacagatcaatatttttgatgaacatagatgcaaaactcctcaagaaaatactaacaaaccaaattcagcagcacattaaa

SEQ ID NO: 35575 - DNA, 201 bp, Homo sapiens
gggtgggatatgccaggtcaaggaaagggccatgggagtgggtgcctgatgcggagaggaggaaaagaggtcagcgaggaggtaaagagcctgggcacagkcatgttggtagattttacagttacataaggagaggtaggaaggaagatggcgaaccagaaagtaagtcattaataatggctggaaggtggttttatgagg

SEQ ID NO: 35576 - DNA, 201 bp, Homo sapiens
agaattctttacactaaattaaagatgataaagcaatctgcttttcatactaaacagtgaagtgaaaagcattattttaaagaaatatttctgttttgttrgtgtacgaaattctgtaatagtggctaacttctttaggaacctttttaggtgaaacttatgattgactatgaaatctattctaggacaaaataaaatgag

SEQ ID NO: 35577 - DNA, 201 bp, Homo sapiens
tgaaaggagtgtgaagtgaatactgttgacattcctgagaaatgtatctggggggccttaaaatctgtaaatatcataaatatcatacgaatcctaagaarttctgggatttaaggatgagtgggagacttaggttcttggttctgtgttgtaagtcattctccaagtgtagcaggaccatagcactgatgaaaatgattt

SEQ ID NO: 35578 - DNA, 201 bp, Homo sapiens
taaaaataatatatttaaacaactataacttaatttaaacattttagacattatctcttcctttcctagtatggaagacaaagattgagcactctcatctraccctcacacatttctgcctacatcctgcaacatatacttaaaataaatatttaatgctaacattgttaaaaccatataaatattactcacagctgagct

SEQ ID NO: 35579 - DNA, 201 bp, Homo sapiens
caaaccaagttatttcatgtcttaagatgtataattctagatgttttcatatgttataactattaaaaagttgaggctggacatggtggctcatgcctgtwatcccaacactttggaattacactttgggcatagatggggagatctcttgagcccaggagttggagagcagcctgggcaacacggcgaagggaggatcgc

SEQ ID NO: 35580 - DNA, 201 bp, Homo sapiens
agagttgctgtctgtggactgccgtcttgcttcgccttcagagagtgcgctctggggcaagaggaacttgaagcaagttcaagttcaatgccatgagagcrtagtgtagggggaattacctaagtcctgcaaaaggaacggggagtgcttttcattgttctttagtttcgaagaggtcttgctatcacgatacatcccgta

SEQ ID NO: 35581 - DNA, 201 bp, Homo sapiens; identical to SEQ ID NO: 7298

SEQ ID NO: 35582 - DNA, 201 bp, Homo sapiens
aaaagtcagttaataacatgtcacagggatactgctctccactgggctatattcacgtctgcagaaatagcaatgtcatttcatcctccattggccagacmctaatctctgtctctggggtgagaatgaccagcctgtactcttttgtcagagcagtagtggagagagagaaatgagaaaatgctaatgactttgtgtatg

SEQ ID NO: 35583 - DNA, 201 bp, Homo sapiens
aaaaaaaaatgaaacaagcagcatttatttgcaatcaagaaactagatatctttaattgtgtgtgtgtgtctgtgtgtgtgtttaaagaaaggcatgtgcrtattacttactataataggagaacatatcattgccaagacagatttacatcaagtgcctaaaccccccagttcactacaggcaacctttttttagcaact

SEQ ID NO: 35584 - DNA, 201 bp, Homo sapiens
caagtttgatatattgtatttttcattatcatttattttaaaatatattctaattttcatagtaaatttttctgtggcctctgagttatatagaagtgaartgcttaatttctgaacaattgagtatttttctaatcgttttgtttttgttgttattcctttcctcactaattccactatggtcagtgtattttcaattct

SEQ ID NO: 35585 - DNA, 201 bp, Homo sapiens
gagatttgggtggggacacagagccaaaccatatcactgtctttctgaagaaaaaaaaggaattcttgtatgttgccctaaagatataaaactgcttacartgcctagtgatttgtattgattactatgtgttccctaaagtttgaaactctccattaacatagcaaaactactatattctaaatcaaatgtcagcaggtt

SEQ ID NO: 35586 - DNA, 201 bp, Homo sapiens
gatcaaaggggaagagggagcaggcacatcttacatggtacaggagagagaggagaaagtgaatggggaagagccccttataaaaccatcagatcttgtamgaactcactcactatcatgaggacagcatgggggagctgcccccttgatccagtctcctccctccctccatacgtggagattacaatttcaaatgagatt

SEQ ID NO: 35587 - DNA, 201 bp, Homo sapiens
tcttagttctaagatcagggctaaagtttggagttttaatgccctcactaggacttgacactaggatttggacccacagacggaaattgcagctgaactcmctgaagcagggacactagaaatgctttcagacagtgaaatgggggctagaaaattcttcctgcaagcctacagaggcagctagaaaatttttctcttagg

SEQ ID NO: 35588 - DNA, 201 bp, Homo sapiens
aaatagtaagttgctgatgatagagaaaaaacatggctttgtgatcagttactagccatattcttgaaggttacagacagagcggggtaggctgcagcctrcagacagaaagtggggctgtaggtgtagggtcctggctgcacagagtgtgtgatggaccgtttatttggcatcagggttttacatatagtagctcatagt

SEQ ID NO: 35589 - DNA, 201 bp, Homo sapiens
tcatttgtatctaagtatcattgctttaaaaatatatctgaggcaaatataaaatataaatattttgttacctctaggttgcatgggtaatgcatgttatrtgtgctttttgaatgtcttaatataatttctaatttaaaatttctttaattgaatgtaaaaaagaattccagatttaaaaagaggagaatgaaattttta

SEQ ID NO: 35590 - DNA, 201 bp, Homo sapiens
gctgtcttccagtgttaaacaggaatttgtgggattacaagatagatgatcaacccagattgctatgagtgataaccgtgcttcctcctgtctaccttctmccatattcactggtttatggcacctcccacatatgctgctacacaaccaaggcattattaccagggaagtcaattcagccataactctataaagtaaact

SEQ ID NO: 35591 - DNA, 201 bp, Homo sapiens
gacttgattcctgggcatttttacaaatggacttcaatgtgtacatttaatcctgaatctaaattacagatgtagaatttttggcataaaaggttcatgcrtgaatgaatttatctcttgcaacccctacagttcaaataatattatgttagtcaattttttacatggacagactctctccttgaccaaattttggaaagt

SEQ ID NO: 35592 - DNA, 201 bp, Homo sapiens
tgagcttacagggttttatcaggatcagactaagtaaaaatgtataattattttataaataaaaatgttttggggtttcagatttaaaaatcaagagtaasaagttttacaatatttactaaagattacgattagtataccacaaaacatctgaactttagatattatttatgtgaccttaaaagtcagacctttccctgc

SEQ ID NO: 35593 - DNA, 201 bp, Homo sapiens
aaaagtgtgttattgtttttaattgcttccctaaagaatgagagaaggcgaagctgggaccctagtggtattgatgggctgttgctccttatccatgatgygtaagagtgaggaactaagtctgaaaactttttaaggggaaaatagcagtatagcatactgaaagttttgttgtaatatttaaaaatgccaattaaaaaa

SEQ ID NO: 35594 - DNA, 201 bp, Homo sapiens
agtgcaagggcctttgaaatcaggcctggtttggaatcttggtccagcaatcaatagctgtgtaatcttaggtaactctttgaagtttagtttccgcatcyaagaatgaggaagtataaatacatatctgcccacgttggttgtattaaatgagatactttacataacacatccgactaaggtgcagatgtaataaatgac

SEQ ID NO: 35595 - DNA, 201 bp, Homo sapiens
aacacatacatgtgcatgcatgtacacacctacacacagacacatacccatcttcataccttaataaaaggatataaatacagctaatttgggttctaccyatacactatttttttgtgaatcttgggcaagtcgtaaacctctcaaaaagtaaaatgaagggactgatttaactgacttttaagtacccattctatccct

SEQ ID NO: 35596 - DNA, 201 bp, Homo sapiens
taaatttaagtgaggattgtaggagtttaacagctatttaaaatacgccctgctgctttccttcctaggttctccacaccttcaaagctcatcacttggayaagattgcctctttactttttccaaatcaatctggttcatccattttttgcaaaaatgaaaactcccctctttcactaaggtatttgagccatcaagaac

SEQ ID NO: 35597 - DNA, 201 bp, Homo sapiens
ccaggaagagtctgtcaaaacaagtatatcaagtaaaacaaacaaatatattttacctatatatgttaattaaactaatttgtgcatgtacatagaattcyttctgtattcagatggtgctaattcagactccagactgaattttaattcaagttctttctcaagtctataaataatattaaactgattatttcattctaa

SEQ ID NO: 35598 - DNA, 201 bp, Homo sapiens
aaggtaaaaaggatttttcccctcagatagttctgaaaaatcaattccaggataaatgcagtttaaactgtgtcagaggtatcttttcaagataaaatctrtgcaaaaagggacagaggaaacaggaagataaaatctgggtagtggttgttaaaatggccttgagaattgaggaaaatggcagtttctaccatcaagggc

SEQ ID NO: 35599 - DNA, 201 bp, Homo sapiens
ttgctcagttttaacttcattcagtgtttgttatacctgcttcattaagctaaacaaacagatggacaaaatctcattgccagacatggagttttcattgrtatgcatttgttggcataccgataaacactgcttttctagagcttattttcaacccaaacccacctttttttctagttggtggagatgatctattttcaa

SEQ ID NO: 35600 - DNA, 201 bp, Homo sapiens
gaagctattaaaataagcttcttatccttagggaaactatttcaacactagagctatcatcaaaagtccttgagacaagtaacccaggagtggaatggttrtgattacactttataagcaaacttaaaaagatatcaggagctgctttactaggcccctgctatgaagtgaaaactggagaaaaatctacagcaaagcatt

SEQ ID NO: 35601 - DNA, 201 bp, Homo sapiens
caggatccactgatatggaacagaagggtaagcttctgttaagctaggtaaggaagcttagggttgtgaaagaaggtacaaagacactgcacactgacttytggggaattacctggatttggctttcaggtagctctgccaaggattaacaatagggttcagaaagaagagtaaaccatctaatatgtgccccagccagtt

SEQ ID NO: 35602 - DNA, 201 bp, Homo sapiens
atcaacaaatgttagagaactgggttcaactactaccaagaaagagcttaaccctgaaacctagcatcctaggcctgcacccaaagggagaagagaagctyattctgagctatgagataatcgtaaggtatcaagtctcagggcctggcaaaggagggataatggaggatataggcaagataataatatgactgggtatgt

SEQ ID NO: 35603 - DNA, 201 bp, Homo sapiens
agttgacttttaaaagttgacaatcgctaaacttaaaaatggttcagaggagatacaatattgctggatctaatgtaagtagaaagaatcctaattctgakatatcatggcatagaaaaagacacaaggaattagaagacctggattctggtactggttccagttatttgtgggaccttggtcaaatgatttaatctctct

SEQ ID NO: 35604 - DNA, 201 bp, Homo sapiens
agtaacaatacctctttatttcaccccttttcttgcatgtttaccttttgtaaagagaaggtacagaaacccttcatttaatgtgtttcaggttcaatccrttgtcttcataacactggaatttctcctccattattttctatttggggatgtaaaggaatggacatttattgaggatttactgccacaatgctagaacca

SEQ ID NO: 35605 - DNA, 201 bp, Homo sapiens
catgatgtctatgatcctttctggttctgatattgtataactctcatcacttaatgaaagccaccgttcctatttggataaataagagaattgaaaaacgyactattagaactgagagtacagatgagctttccaaatatattagagatggcatcacagtacatggaaatgttaaaatccataacatgggcaagagcacat

SEQ ID NO: 35606 - DNA, 201 bp, Homo sapiens
attaactcaggacccctcttgtatcagttttcaacccatccacatcctactccacccctccagattattgggaagcaaattccatatgtattactcgcttygtaactacttcattatgtatctctgaaggataagactcttttataaaggaaaccattgtcacatctaaaaattaatactattatactgattctttaatat

SEQ ID NO: 35607 - DNA, 201 bp, Homo sapiens
ggtatttctccagggtgaataaattttagaaggcaaatttaaactgtcatatttctgattgcctgtgattcacaccattgttgtactctgtgacagtttcmttgaaaggactgtcatgttccatgaggaactcagcctacctgctcttttaccagtagctggtgggaaagccatactgtgccaatgacttattcacaggag

SEQ ID NO: 35608 - DNA, 201 bp, Homo sapiens
tcagaaaaattgggagaaaatacaaggagaagaatttgcagggtgattgttgtaagatttttatcatgtcctcttaaaaatggtagcttttcagaaacttktgttaactgctttgcattccatcttgagaaaatgtctgtatagttagatgagcatcatctcctctccttgtttttaaatcacatccaaaatgacatcagg

SEQ ID NO: 35609 - DNA, 201 bp, Homo sapiens
ttccacgggtccttttgagcttcagaaatccagctctcagcacttcataaatcatttctgacctgatgtcactgaagttgtattattatgtggttagtatmaaattcagaaaaattgggagaaaatacaaggagaagaatttgcagggtgattgttgtaagatttttatcatgtcctcttaaaaatggtagcttttcagaa

SEQ ID NO: 35610 - DNA, 201 bp, Homo sapiens
ttttgtgaaggccttttctttaccaaattagtaatatggtgaatattaaactaaacctgagtcatactacatttgtttttaaattttgtagggaagggggraatagcaaataatattttatgctagtaatcaggcattatatcagttgttgtaaggaactacatgaaagttggtggtatacaggttaccagtagtaagttt

SEQ ID NO: 35611 - DNA, 201 bp, Homo sapiens
tttctttattttcaattaaagagggacccttattaaaaatatttttattaacctgttagtcttatcttggcagctataaaatattatatagttatatttgrtacatgtgagcatatgtgtacatatacaaccattaagccataatataagtagtaaatattagttttaatgaagtgtttatgaattgggacaagaatgtct

SEQ ID NO: 35612 - DNA, 201 bp, Homo sapiens
tttctttgagctctacagggttggactacagttaagttcctcactgcctgcctcttcaccaattctacaaaatctatagccatatgaaggtaaattttgcwatcagaaaaagccaaaaccacttcagtttttacctcaggtctagtctaggagagtgataccatttctttttaagggggaagaaatccagaaaagcttctt

SEQ ID NO: 35613 - DNA, 201 bp, Homo sapiens
tagagagacacccgattacaaatgctattgatggaaagaacacttggtggcagagtcccagtattaagaatggaatcgaataccattatgtgacaattacmctggatttacagcaggtatagttcctctttttttgtcatttccacttttgaaattgcattttacatttgctatttgtttagttagtggtttgtgggtgaa

SEQ ID NO: 35614 - DNA, 201 bp, Homo sapiens
ggactttatggagggtagctgatgcatcaaaaaaaaattatatatatatatatacacacacacacacacacacacacacacacacacatatatatatatataaagttttacagaactttgttttcaacttttaaaacaggatttctaaagaagttatgtggttttttttctttcatggcaatggcgcctccagcctcacct

SEQ ID NO: 35615 - DNA, 201 bp, Homo sapiens
cagactaaatattacaatatcttggcaagaaaattaaagtaatgataatggcaatatagcaactaaattccatctcacaattacagctattaaaaggatcyagagtcagcatgaacttaaagaaaagcttaactgttccagtgacgtgtatataaaaactcaatataattgcgaacaaaaatatacaacaatttaaaggag

SEQ ID NO: 35616 - DNA, 201 bp, Homo sapiens
ttaggatatgaatcagatttgataacatgaactatcttatttaattattctaaattgaaaacatcatgaaagataattgggatttttccatttttattttmctcttgtttcttgcttatttgaatcattcgttttattcttctttctacttaggctaagctctcaaaaggaaaggagatgtaattcaatgtatgtaagttt

SEQ ID NO: 35617 - DNA, 201 bp, Homo sapiens
atctcttcctttcctagtatggaagacaaagattgagcactctcatctgaccctcacacatttctgcctacatcctgcaacatatacttaaaataaatatwtaatgctaacattgttaaaaccatataaatattactcacagctgagctctgtggtgcactgtgtctctcttttcttttttgtacatcgttgcctggcatt

SEQ ID NO: 35618 - DNA, 201 bp, Homo sapiens
ccaatcatctcccaccaggcccctcccctaacattggagattacatttcaatacgagatttgggtaggatcacacatcctatatcacttttggagaaagartggaggtagctctgaaggtttgttacatcacagcatttgaggaatggctggggtgatggcaaatatcatacagaagagcaggcgtagacaagatatacca

SEQ ID NO: 35619 - DNA, 201 bp, Homo sapiens
catgtttttaaaaaaggacttttactctgttggaaccaattaggccaatgtgaggaactttggaaggaccatgagcagccaaacttgctaacagcaaaacrtatttttctgaaggcagcatgaaaaggacggaggagttctctaaggactgtgagttccacgggtccttttgagcttcagaaatccagctctcagcacttc

SEQ ID NO: 35620 - DNA, 201 bp, Homo sapiens
taaactagacacttgattttctccaatggtaacatgtttttaaaaaaggacttttactctgttggaaccaattaggccaatgtgaggaactttggaaggamcatgagcagccaaacttgctaacagcaaaacatatttttctgaaggcagcatgaaaaggacggaggagttctctaaggactgtgagttccacgggtcctt

SEQ ID NO: 35621 - DNA, 201 bp, Homo sapiens
aatgtattctgttcatctttaaataatttcatttatgtttaagctgcaaaaattgatctgaagttagtctggtatattgtgtactttaagcatgtgatacrtttctaaaatgttcatgtcaagaatatctacaattcaaatcatgaccttcttttggcttgtattctaattttgaagtttctgacctagacacaaaaatga

SEQ ID NO: 35622 - DNA, 201 bp, Homo sapiens
atactcaagaaaattaaactagtgacaaaatagatttatttaacttataagctaattcataaattaatggcaaaatttatcacagtatacataactgagaytttgcagatttttttgtaaatagataacattctgatacaattaacagatctccatcagctgcattagatttcaagttgccctgctaccactgtatatatg

SEQ ID NO: 35623 - DNA, 201 bp, Homo sapiens
tgaaatagttactttattcattcttaagaaaatgtttatcaaacaaatgagtcttaaaaaccatagttagatcctttttgtagtacatagggtattccacraaaaaagtggctagtttagcttgcagctgaaaacaactgtacaaatgcttttcctcaaatcaaccatcatgcttcagtatacagttgatgttaaaaagat

SEQ ID NO: 35624 - DNA, 201 bp, Homo sapiens
tttgtttgttttcacaaatattttaatgtggattttgagtcaaattttctgtaggaaggtcatggtagattaatgtcaaattagctgaaacaataaacacratgaaaagaaaaatcagccttgtaagacagtacaactaaggagatcagtttaaaacactaatgaggagttgcctctcagcactgggtcattatgattata

SEQ ID NO: 35625 - DNA, 201 bp, Homo sapiens
gactattgatctcaccagaaaagtccctaaatattagaagctgttaatctcacaatggtagagacaaatttttcagaatttttattttcatttgtaagttyctgtagttattgacaaattttgttatttttcttgaaatagttactttattcattcttaagaaaatgtttatcaaacaaatgagtcttaaaaaccatagtt

SEQ ID NO: 35626 - DNA, 201 bp, Homo sapiens
tttctaaatgcaatttttttgtgcgtggagctatttgttgttgtaatcattgctttctaagcacttagaatagtgcccaacatataggaagcattcaatgygtttgtattaagttaataaatgactgaatgaataactagtacaaaccaccaatccataatttaagaatcttattgaatctgagaattaaaggattaagtg

SEQ ID NO: 35627 - DNA, 201 bp, Homo sapiens
gtaagtggtagttttcaaaagattggctgcagtgtggtatctgaaactgcatcaacgatatttttgtacgcttttatattaaaatctacggatctatcttrcacctggaaagaattttacccatgtgtgatgttatagtatcattcatagatcatttggaagatactgatttactagttatgcagatcagccacaacttga

SEQ ID NO: 35628 - DNA, 201 bp, Homo sapiens
ttactgttcagttgaatatttatctttctaaatgcaatttttttgtgcgtggagctatttgttgttgtaatcattgctttctaagcacttagaatagtgcmcaacatataggaagcattcaatgcgtttgtattaagttaataaatgactgaatgaataactagtacaaaccaccaatccataatttaagaatcttattga

SEQ ID NO: 35629 - DNA, 201 bp, Homo sapiens
gttctttacctgctttagttgtatatagatttttaagatcatttgttcagtatcacaagtagaatctgtggttaattagaaaatatattttccctttaaawgaatttgtgctgacttttaaaattattaataaaggtgacagctagctttggtgtctatattgaagaaaatgttcatcctaattggtttccgtttgtctac

SEQ ID NO: 35630 - DNA, 201 bp, Homo sapiens
gagattataatatacatgttccaaatgtagattataccttacctgagtataccttgtttaagtacaacagaatatagttaaaatcacagttctttacctgytttagttgtatatagatttttaagatcatttgttcagtatcacaagtagaatctgtggttaattagaaaatatattttccctttaaaagaatttgtgctg

SEQ ID NO: 35631 - DNA, 201 bp, Homo sapiens
aagctgcattttaaataaataactcccttataactgtgtccacaatgaaggtaacacaattaatacccaactcaaaaactttttatttattttaaggtggyatgtaattttctttttaaaaattttatcaagcctctaattcattcaggaaacgtgctagacaccaaaattgattgtgtcagtgatgagcccccttagagc

SEQ ID NO: 35632 - DNA, 201 bp, Homo sapiens
agtgccttcccaaggaaagatcagactctttgagcattagaaaccctctgtaatctgactacctttccaggctccaagccctcaactccattctatataawgccaagtttggcatttcttgcacttatctagacatcattagcagtctgctcttgctattccctcagacaatccctgtgaaatctaatttatttttaaagg

SEQ ID NO: 35633 - DNA, 201 bp, Homo sapiens
aagatgttctcactggtccgtggcaaagtaagaaaatgagaacaactttccacatttttcataaaaatagaaaggatacaatttaaataattgtcctccawtttgatattatgggttttaaaaactaatgatggtttttaaatgccctttgtttcatgaaataataatgatgctttattaaatgatagaaatatattggag

SEQ ID NO: 35634 - DNA, 201 bp, Homo sapiens
atgtaaatctgggttacctgctgaggaaagaagcaaacatttagattatgagcctctcaggggaataggaggggatcactgagccgtaatcagaataaagyggcaattccatatggagtaaaataaagaatcaaacgtgtggactgatactcttggagcattacagggaaagtagaatggaaagagaagatggcaagaaaa

SEQ ID NO: 35635 - DNA, 201 bp, Homo sapiens
aagaagaagaggggactatagaaatattctgtcaagtatccttgatgtgaaagagaatgaaggacagaggaggttgtggagttgcaaaggttttcaaagayaagagacatttgagttggtttagatgcttggggggaaaggcagggaagttgaagaccaagtggtggtgggcatggtgtctctctagaagtaaaaacatat

SEQ ID NO: 35636 - DNA, 201 bp, Homo sapiens
agggaggggaagaggagaagtcatgccaggaagagaaatcagaattagacagaaaatcctagttactcggggagctacaagtaggaatgactagaactgamagtgccaaagggcagagagtagagatgagactagagcaaaaggctggagccagattatgaaggcatttaacaaccacaggagaagtgatttagggagagg

SEQ ID NO: 35637 - DNA, 201 bp, Homo sapiens
gcttttgctctctttatttatttaattatgtgggataattggtacataatccaattctatattttctgaacatacaacataaagaaaatactttatccctsgtctcttttcttggcttcctcccatgattgctgaggcctgggaaagtacaggcctggcctgctccaatcaggtctttcagggcagaccaaagcagggcac

SEQ ID NO: 35638 - DNA, 201 bp, Homo sapiens
caaattggtcattcattagcaactaattggagacctttgctgaccaatatgcttaaccgatttttaaaaataaacagcaaaatagcaatgaaatttcatawagcaactattccctgaccataaaacaaggcaattaaattgtgcaaaggttaattttgagcacataatcagtaactgtaatagaaacaaatcaaagaaaag

SEQ ID NO: 35639 - DNA, 201 bp, Homo sapiens
catgctgaagattcaataaaagctcagatattgattcattcttcaaattggtcattcattagcaactaattggagacctttgctgaccaatatgcttaacygatttttaaaaataaacagcaaaatagcaatgaaatttcataaagcaactattccctgaccataaaacaaggcaattaaattgtgcaaaggttaattttg

SEQ ID NO: 35640 - DNA, 201 bp, Homo sapiens
aggacttgtaaagctatgatggaagttagcccatgagtgtgtttacagaaggcagagctagatggcataagactcagggatgatgcaggaggtgataaatrtttttgtttagagtagtgagaagagtgaaacacagtagatctttaataataaaattttcactcatttggaattatgaaaattgtgtttgaaaaccagctg

SEQ ID NO: 35641 - DNA, 201 bp, Homo sapiens
ccccagtgattttatgaatccattgaggagatctgcagaagtgttgtcactgctggagaaaaccaaggcttcacttgcaaaaaggagtactttcttaaaaytgagaaatttggaaatatatcataggacttgtaaagctatgatggaagttagcccatgagtgtgtttacagaaggcagagctagatggcataagactcag

SEQ ID NO: 35642 - DNA, 201 bp, Homo sapiens
tttccccagtgattttatgaatccattgaggagatctgcagaagtgttgtcactgctggagaaaaccaaggcttcacttgcaaaaaggagtactttcttayaactgagaaatttggaaatatatcataggacttgtaaagctatgatggaagttagcccatgagtgtgtttacagaaggcagagctagatggcataagact

SEQ ID NO: 35643 - DNA, 201 bp, Homo sapiens
gaccggacaggatgctgagaggaccaacacaagagcaaagtccctgggagaattcattaaggagcttgcccgggatgcagaaggtattagaaagaatcacrttttaatcatcatttctcccaacagaaaaacacagaaagggatgacacaggactggaatttctcttgttataagtgacatctgtaaaatcaaaggtagag

SEQ ID NO: 35644 - DNA, 201 bp, Homo sapiens
taatccgtacagcataaacaaattagaaatgaacttaaaataaatatacaaacaaaatagtaaactttgtagtacccgaatataaggtgttacagttaacrtggaatctgataacaccaattctttcctttcttaaacttcataggaaagctaaaaatactttaacttttgaaattaataaatgaaatacatcttatattt

SEQ ID NO: 35645 - DNA, 201 bp, Homo sapiens
aatcactgtgccctagtacatagagaatgattgagacaaggataggtgctattttagataggtaatcagaggagtggctattaccagaatggagggaggamacaagccaaagagtaggaagagcacatagtgggaatatctgcaagtgcaaaggcttagaggcaggaactagttgtatgtacctggcaacatactgaattg

SEQ ID NO: 35646 - DNA, 201 bp, Homo sapiens
tagcaatatttgtctctcactgattttactcttctaggccaggattgagtttcatgtacttttgagacaagctatatgttccaaagaaaaattataatctrttctctcatgaaacagtccattaggttgattcttccatgtgatggtttctctatttcttaaaaagtattttccctaagtttccttaaaaatctcacttca

SEQ ID NO: 35647 - DNA, 201 bp, Homo sapiens
tttccctaagtttccttaaaaatctcacttcaaatttcacagaactcccattgaatacatctgcttatgtttatgctcacaaagtactcatttgtatatarattctagaattcaatatgtagtaccaatataactattcagcacttatattttagttagaaatggatgctccatctttctttaaaagtagttttaattcct

SEQ ID NO: 35648 - DNA, 201 bp, Homo sapiens
ttaaaaatctcacttcaaatttcacagaactcccattgaatacatctgcttatgtttatgctcacaaagtactcatttgtatatagattctagaattcaayatgtagtaccaatataactattcagcacttatattttagttagaaatggatgctccatctttctttaaaagtagttttaattccttaactagtatcgcat

SEQ ID NO: 35649 - DNA, 201 bp, Homo sapiens
tgtagggaatattacaaatctgtttcctggaaagcaggatgccttcctttagaattattagttaagattaaccactctttaaattgagagattatatcctwccctgtttttcattatatggtcagctttcactggcctgagtccacattttaagctcaactatatacaaataatttttcagtatactgagagtaggattaa

SEQ ID NO: 35650 - DNA, 201 bp, Homo sapiens
gagaccctgtcttaaaaaaattaaacaaattaaaaagaaatgaagttattgagtgacagttaaagaaactgatttgcaagtggccttcaggaggcagaagraggctacttgtctttccccagtgattttatgaatccattgaggagatctgcagaagtgttgtcactgctggagaaaaccaaggcttcacttgcaaaaagg

SEQ ID NO: 35651 - DNA, 201 bp, Homo sapiens
aatagagaagctacaaatgaaatattataaaacccagttcaaatgtacatattttaaagatctgtaaatatacagtaaaacattaacatttgccagatacrgatgatgggaatagaggtgtctgtattaatttctaatcgtatctatcttatttcctacttaaatagtttaattaaaatgaacctcagaggagatagaaaa

SEQ ID NO: 35652 - DNA, 201 bp, Homo sapiens
gttagtaagtttgaagtttcattttaaaactaaacatgtgggccaggcacggtggctcatgcctgtaatcccagcactttgggaggccgaggtgggcagaytgcctgagctcgggagttcaaaaccagcctgggcaacatggcgaaaccccgtctctattaaatattcaaaaaattagctgggtgtggtggtgggcacctg

SEQ ID NO: 35653 - DNA, 201 bp, Homo sapiens
tgtgtttgtgtggcggggagcggtgtgtgtagctgaatttgaggtagagacaaaaagtaattaaactggaagcagaaatcttagaatggggaaaagtaagrcatatttgttcacaaagtatcttttaacattttctggtttctgtggagtcacattttattaatgctggttgacatttatctacctagaaaaaaatgacag

SEQ ID NO: 35654 - DNA, 201 bp, Homo sapiens
aaatagagaagctacaaatgaaatattataaaacccagttcaaatgtacatattttaaagatctgtaaatatacagtaaaacattaacatttgccagatayagatgatgggaatagaggtgtctgtattaatttctaatcgtatctatcttatttcctacttaaatagtttaattaaaatgaacctcagaggagatagaaa

SEQ ID NO: 35655 - DNA, 201 bp, Homo sapiens
tgatgtgtttgtgtggcggggagcggtgtgtgtagctgaatttgaggtagagacaaaaagtaattaaactggaagcagaaatcttagaatggggaaaagtmaggcatatttgttcacaaagtatcttttaacattttctggtttctgtggagtcacattttattaatgctggttgacatttatctacctagaaaaaaatga

SEQ ID NO: 35656 - DNA, 201 bp, Homo sapiens
aggatgctactgtaataaatgtaaagtaaggttaggatatctgaatataaatgttgatgtgtttgtgtggcggggagcggtgtgtgtagctgaatttgagrtagagacaaaaagtaattaaactggaagcagaaatcttagaatggggaaaagtaaggcatatttgttcacaaagtatcttttaacattttctggtttctg

SEQ ID NO: 35657 - DNA, 201 bp, Homo sapiens
gtactggtctgcagccctggggttggggaccccgggttaggatgctactgtaataaatgtaaagtaaggttaggatatctgaatataaatgttgatgtgtktgtgtggcggggagcggtgtgtgtagctgaatttgaggtagagacaaaaagtaattaaactggaagcagaaatcttagaatggggaaaagtaaggcatat

SEQ ID NO: 35658 - DNA, 201 bp, Homo sapiens
tgcttcaggttgtcttcataataaatgcaaacattaaaattgacaggttactatgattttcatattggattaaaatgtctaaaacaaagggattcgtctakgtatgacttacacaaatactgcaaatcttaggggaacagaaagactgaaaatgagagataagatacactatgcaaactctaaccagaagaaagctggtat

SEQ ID NO: 35659 - DNA, 201 bp, Homo sapiens
aaaagtctttaaaaaagaaagtgagttttagggaagataatttcaacaacaatggggaagattaatgggagtagagtcacgcaggaagactaggaagggcwgtggtgctcaacctgtttggcaccagggaccagttttgtggaagacaatttttccattgacagggataggggtggatggtttcaggatgaaactgttcca

SEQ ID NO: 35660 - DNA, 201 bp, Homo sapiens
attctggggaggaaagcaaaaagctaattaactttagttttcactaagaatatgtattaaacattgaaaaaaaatctggaaaaataaaattgacaatattygagttctccagagaaacagaacaaattggaagtgtatatatacacagatatattatatattttaaagaattgactcatgagattgtggggtctggctgca

SEQ ID NO: 35661 - DNA, 201 bp, Homo sapiens
tgtacaaatctaagtaagcattatggaaagcataatgataataattattaaatatgtggaattaaaaacaaagtggaactaaaacacaagagactaataamatggaaaatggggcaggtagtcagttatttaataaaagtttttaatattcttgaattctggggaggaaagcaaaaagctaattaactttagttttcacta

SEQ ID NO: 35662 - DNA, 201 bp, Homo sapiens
gtattcttgcattaattaatgtattcattaaatatgtcttcagtactttttttgggtccagcattacattaggcagatatattattcagcaagttttcaayttagttcagggaaagagggatgataaatattattatgagtgtttagaaatattaagaacccgaatccatttatcagtttcataacaatgattttcaagct

SEQ ID NO: 35663 - DNA, 201 bp, Homo sapiens
actcgaagtctattccccaatttagagtaggagaaaaatttacatagagattgattcagggaaaagagaatagcaactcttattgtcagtgtagctacgayagcacagtattagtttctcaaatcaaagagttcctttaaaaatatttatatcaaagactgagttctctgtcagtgataaagtgtgtgtgtgagtgtgtgt

SEQ ID NO: 35664 - DNA, 201 bp, Homo sapiens
aggaaagagggaaggagggagagagggagggagggagggaggaaggaaggaaggaaaggaaggaaggaagggaggaaagagggagggagggaaggagggarggagggaggaaggaaggaagagagagagagaaagaaaggaagaaagggagaaagacctggagtttgctaatagagttggcaggcacagttcagtatcacc

SEQ ID NO: 35665 - DNA, 201 bp, Homo sapiens
ggatatatgataaacaaaacagaccaagttctcacccccttagagcttaccttacagttggagaggttgtcaataaataggtgagccaattactaagtaaktctcaaatccatggtgctatgaaggaaacgtcctgctgcaggaagtgtggaaacctaggtagcaccctgggaatggccacgctaaggagaagcacttaaa

SEQ ID NO: 35666 - DNA, 201 bp, Homo sapiens
gaggaatggggacttctgtggagtttaatctatagtaatgcacatgaatctgataaattattataatctttgcttttagtagaaatggggatttagagtayatcagtacaggtggcgaaaaatgtgaatttaaaacatattttgaaaaacaaggataagaattagtgtttaaaagctaaaagagaagaatttgtgtcagct

SEQ ID NO: 35667 - DNA, 201 bp, Homo sapiens
tattgtgttaaatataattctgcttcatgaaaattttaatttgaagctatttgcacactattctgaagctattctcatttctttgtggaaaggtgttaaarggtatcaccccaatgtctcttattatgcaagcataagaaagaagatatcgatctgagattgctagttttagattgactcctctgtatttatgaagaacca

SEQ ID NO: 35668 - DNA, 201 bp, Homo sapiens
gcaggaggcagaataataactcaacaaaataaatagaatctctaatttcaaaatactattatccccaaaagtaatgggaattttaaaaattatttagtgtytccagtttagatatttaagaacaccactcacatctacatgccaaataaattgactccaccctccacccgttatatcagggccccactccatccattgtct

SEQ ID NO: 35669 - DNA, 201 bp, Homo sapiens
agcaacaaagatcttatgggtcatcctggtattatgtttaatggtgaaaccagaagcctgtttaaagggagaatgggagatgaagaagtagagaccaggartgtaaacaatgtctttttaaaagcttatcgaaaataggatagaaattgtcaagcaatttgagacctcacagattttttttttaagacaggaaaggcttga

SEQ ID NO: 35670 - DNA, 201 bp, Homo sapiens
ggaggagaaaaaagagatgaggaccaaagttagaattaagggcgtcaattatattgaacagaaagggaaggaagagtcgataaaggagaattcgagtagcygcagaagtaggagaaacatcaactggcttactcttaaagaagccatgggggctgggcacggcagctcccgcctgtaatcccaacactttgggaggccagg

SEQ ID NO: 35671 - DNA, 201 bp, Homo sapiens
tcataggaaagctaaaaatactttaacttttgaaattaataaatgaaatacatcttatatttattgaacagctcctttctgaaatacattgtactataatrtaaaagatgaatgaagtaagtttttatttccaaatatccttaagtgtagaactgaaaagaaaataagacaaaccaacacaatataaaactcaacactttg

SEQ ID NO: 35672 - DNA, 201 bp, Homo sapiens
tgattttatttatttcttttaaaatctagccattatctccgtcatgccctttgatttgtttcagaagaaagctgattggcaggcggggtaaaacagagggrggcagcttttcagtagacttttcaaacacatattgaggtgatactcactcctggctaatccaggaatgccattaattagttaagctcatgtcttaactag

SEQ ID NO: 35673 - DNA, 201 bp, Homo sapiens
ccaatattcagcttttaataaaatttttcttttaaagatgattttactttctatcagattcctattgcattgaggacttagttttgctttatttttattgktttttcaaatgttttaccaagtacaacttgtctctaagattcaaaacagtgtacattttgaatagatgtatcatttattttatgtatatgcataataatg

SEQ ID NO: 35674 - DNA, 201 bp, Homo sapiens
tatatcagggccccactccatccattgtcttttttcttagttatatcttgatatgtcaccctattagttttttccttgcagcatttcacttgcttcttgcyttttttaaacaaaaatttatgcactaccctccctgcatccatgttcctgctgcctcatattcattcattcttcagctggtggcaatcagcattcagtttc

SEQ ID NO: 35675 - DNA, 201 bp, Homo sapiens
ctccccttggccacatctcccatcacttgtgcccctggccatctgcactccagccatactgtcccccagccactttgtcccaccacaaagcattgccacayatttctttattttgccttaaaggtaatctacctctccctacattttgttaatttctgttaactccaatttacctttcaaatctcagctcgtgaaagccct

SEQ ID NO: 35676 - DNA, 201 bp, Homo sapiens
agatgacatccatgaaacatatgacagaataccttgccatagtggctactcagcatgtaagttttttgtttgtttctttgagacagagtctccctctgtcrccaggctggagtgcagtggcgagatctctgctcactgcaacctctgcctgctggattcaagtgattctcctcccaaatagctgggattacaggcatccgg

SEQ ID NO: 35677 - DNA, 201 bp, Homo sapiens
atattgcagttattctccttttgggcatatagtaggattacatttgctcacccctgaaattaggcatagacaccgtcaatgaaatgtgaacagaactgacwtgctttactcttagattgaatacgagttttacaagccagtgcataattcgccatgctatagagacagatgatcttccagatggatgcctgagtgtagaat

SEQ ID NO: 35678 - DNA, 201 bp, Homo sapiens
ggatctatcctttgaccaaatttttcactcttcaagggcctcatactgctctgatttcagatgtatagatatattgcttatcaaacactgatgggtctgarcatgagtggtagtaagatatttccagattaagtagacaaattgtgcagaactttttagtatcactatttaaatgactaaatttttgaggtttatgtgtat

SEQ ID NO: 35679 - DNA, 201 bp, Homo sapiens
cagctcaggaaagtcaggaatacaaggggtaggattttatgaaaatgcaattttgatgtcttgttcataatggtctacagaaaaagaaggaggctgttgaragcggcaaacgacaaattgagaacactttaaaagagggcaatgacatactcgatgaagccaaccgtcttgcagatgaaatcaactccatcatagacgtga

SEQ ID NO: 35680 - DNA, 201 bp, Homo sapiens
tatcaacttaaatgtaaagaaaattcaaaggcacaaaacaccacacttaatactggaagcttcaagaacatatgaaaagaaatagtagcatgtataatggrtcttaaacaattaatttcaggattttcactggtgggaatagtaggaaattatatgggcaaatgcttacaaaatacaaggcatgtgcaaaacctaataagt

SEQ ID NO: 35681 - DNA, 201 bp, Homo sapiens
ggaagggaggaaagagggaaggagggagagagggagggagggagggaggaaggaaggaaggaaaggaaggaaggaagggaggaaagagggagggagggaargagggaaggagggaggaaggaaggaagagagagagagaaagaaaggaagaaagggagaaagacctggagtttgctaatagagttggcaggcacagttcag

SEQ ID NO: 35682 - DNA, 201 bp, Homo sapiens
aggaagggaggaaagagggaaggagggagagagggagggagggagggaggaaggaaggaaggaaaggaaggaaggaagggaggaaagagggagggagggarggagggaaggagggaggaaggaaggaagagagagagagaaagaaaggaagaaagggagaaagacctggagtttgctaatagagttggcaggcacagttca

SEQ ID NO: 35683 - DNA, 201 bp, Homo sapiens
aaacaaaggaaaaaaaagagtcagagagtgaggggagaaggtattcatgatgatacctttgctaagattctagacttttatcatctggacaagaggagaayaaaaataacaaagagacagaatcttgaagggctaaaagagattaagtaagcaattggaatatcaagagcaattaaaaagactgttgagctaaaagtgagt

SEQ ID NO: 35684 - DNA, 201 bp, Homo sapiens
gggggtggcaggtaatgaagctcttccttgccatgctaatgatttgttattcatcctgactgcatttgggagctagtgtaggctttcaagcaagagaaggkcatggtttgatatgttcataggatgatcactctgattgcagtgtggagaaatcaccagataagaaaatatggagacaggatctttagctaaaaggctatt

SEQ ID NO: 35685 - DNA, 201 bp, Homo sapiens
tggtgaaaataataatggattctgaatttaaatatttgtttttatctttaccacaagtatcagagtgagaaaggctttggtctcaaaattagacttaattwgaattggtaaaattaacaaacatgcctgagcattatggactttttttttttttgctttaaggatataaaaataaaatattattttaataatgtataataa

SEQ ID NO: 35686 - DNA, 201 bp, Homo sapiens
aataacttgcttaagtcataaaacagcagaggccatatccatgtttcaaatgctggtttgtttaaatagatgtttgatgagctatttcatagtatccttgygcacaagattgaaaatatgagccagatgttagccagctgataggttgatgggcatatacgttgctaaaaaaatgtgacccagagtacactctagtgatat

SEQ ID NO: 35687 - DNA, 201 bp, Homo sapiens
tttgtttttatctttaccacaagtatcagagtgagaaaggctttggtctcaaaattagacttaatttgaattggtaaaattaacaaacatgcctgagcatwatggactttttttttttttgctttaaggatataaaaataaaatattattttaataatgtataataataaataatattatttgacaagtattatcatgaag

SEQ ID NO: 35688 - DNA, 201 bp, Homo sapiens
caggtaccagttttcaacttgatttagcacacagtgaatctattttacatgttttcttattttctcattcttttcatgttagcatctctttgtaacatggyttaataccaataaaccctaaggcagtgacatgagctcattgtctattattgggctgggggtggttacagagctgcagaagcccttctgaaaaaagtgaag

SEQ ID NO: 35689 - DNA, 201 bp, Homo sapiens
gaatggtacatttattatagtcgataaacctaagttgacacctcctcatcacccaaagtccatagtttacattagggttccctcttggtattgtacattcyatgggtttggaaaaatgcattatgacatgtgtccaccgttgttgtaaaatatagaaaagttttactgcccgaaaactcctctatgcttcacctattcata

SEQ ID NO: 35690 - DNA, 201 bp, Homo sapiens
ggaaaaatgcattatgacatgtgtccaccgttgttgtaaaatatagaaaagttttactgcccgaaaactcctctatgcttcacctattcatacctccctcytccttgacccctggcaaccactcatatttttactacatccatagttttgccttttttggaatatatagctggaatcatacagtgtggtactttttcatat

SEQ ID NO: 35691 - DNA, 201 bp, Homo sapiens
gtggaagcccaaagcccaaacccagcatctacatcagctgacacaaatgaccctgtgtttgttggaggcttcccaggtgagtgttggctaccccagcaacmatttctttgctctcttatgttactggttttgaaaacatttatatttacatgtgtctaagaatgtgtgcttatgtgtacttgcttcctagctttagaatct

SEQ ID NO: 35692 - DNA, 201 bp, Homo sapiens
tccagtgcaatctaatggagcaccacacatttagactctggagcatgttttattccctgtggacaggttcctttcgattgctcatgtagggatttaggggrtacttttaatgttatattctatgccttaaaggaaatcttcaatacttgtgcaatacactttttctccccaaatctatttgctcctcctctttggtccctc

SEQ ID NO: 35693 - DNA, 201 bp, Homo sapiens
ttcacacaggcagagcaggaggaagtgggggctggaggtggcacacacttttaaataaccaggtcttatgagaactctgtcatgagaacatcactagggcrgtggtgctaagccattaaaaccactccagtgattcaatacctcccacgaggccccatatccagtattggggatgacatttcaatatgagatttggatggg

SEQ ID NO: 35694 - DNA, 201 bp, Homo sapiens
cagtgtttactgaatgtttttttactgtttcaggatcccatgcaggatactacattacatttagccattgtgtcttcttagggttcctctagactgtgacracactgtcaaaaatactgtaacagtgtttctgatgactttgagagtttggacaggttcgtgtgtttggtaagctgtccctcaattggggtttgcctcata

SEQ ID NO: 35695 - DNA, 201 bp, Homo sapiens
tggtaagctgtccctcaattggggtttgcctcatatctttctcatgattagaatggaattatgagtttttgtgggaaaaacttcagaggtaaagtaccatkttcatcacatcaagaacccatgtgaccaatatgacttattactgtggatattgaccctgatcacctgactaacatagtgtttgccagatttttccactgt

SEQ ID NO: 35696 - DNA, 201 bp, Homo sapiens
tgagtagtagatcaatttgttcacatattttgcaaaagttagagcttattactcattcatgtactattgatgtaacgcattagaagacagttaacattagktcctaatggcacctgaccaaaaggagctgtgggcctggcctatacaccttattgcctgttttcagcatcaactgatttagtgaagcagcaaaaagaaaaa

SEQ ID NO: 35697 - DNA, 201 bp, Homo sapiens
accatatcaaggtactgttggtaaccagggtatttgaggttgaatagaaatgattcctggcctcaaagaatttacaacctcctgaaaaattcagacatgtyaacctttcactctacataatactatgataatattgactgggagattcagcaaaagtttcacaaaaataacagcatcatagcagaagtggagaggaattgg

SEQ ID NO: 35698 - DNA, 201 bp, Homo sapiens
aagctaaggaattggtttttatcctgagagccataggaagcaattgaaatattgcagtcatgggttaaaataaaatgttgcagaatttgagtggctcactkaaactgaataaatggttttttatcggaaaatagtgtgatattaggctagaaaagtaggctgggataatatttatctacatatctgtcaggtacctaccat

SEQ ID NO: 35699 - DNA, 201 bp, Homo sapiens
ttcctatatataaacacacatagacaatcaagaatcacactgaaaggaaaatatgagtgagaaggaagtggatcctttataagcaggagaaagctaatacsatttgtttgtactgcagtattattttgtaaagagtaatagctacttgtcttgcataactaatttctttaaatatcagaatgaaatgttattttaagaatt

SEQ ID NO: 35700 - DNA, 201 bp, Homo sapiens
gtcttcctatatataaacacacatagacaatcaagaatcacactgaaaggaaaatatgagtgagaaggaagtggatcctttataagcaggagaaagctaayacgatttgtttgtactgcagtattattttgtaaagagtaatagctacttgtcttgcataactaatttctttaaatatcagaatgaaatgttattttaaga

SEQ ID NO: 35701 - DNA, 201 bp, Homo sapiens
ctagccctataaagaaggaagaatgttttcaataacttaaaaggaaaaacaaagaaacaatttatacatttgcaggagaaaaggaaaaggtcaagtagtasagcaaccaacgaccactatgaagaaagtggaggtcagacaatttgagaagaaaaaaagcattgaaaataccataagaaaagaaacaaagaaatgatagaa

SEQ ID NO: 35702 - DNA, 201 bp, Homo sapiens
agcaggaaagaagaatttgcatattagatagacaccatgtatccatttttttatctcaattctaatcacttgctttaaataattttttctgcccatgatayttcagtagtagccatcagaaggtgttaatcagttatgctttcatatgttaactttacagtgtcgtattttgtaataggtataaaattctgccaatatttt

SEQ ID NO: 35703 - DNA, 201 bp, Homo sapiens
agagtcctctactcctttgagtctagccctataaagaaggaagaatgttttcaataacttaaaaggaaaaacaaagaaacaatttatacatttgcaggagraaaggaaaaggtcaagtagtagagcaaccaacgaccactatgaagaaagtggaggtcagacaatttgagaagaaaaaaagcattgaaaataccataagaa

SEQ ID NO: 35704 - DNA, 201 bp, Homo sapiens
gcctgtgacactgcatttttcattgacagggttcctcagtgaggggggaaaaaagcatttaatgattttcaaatgacacatgtaacctaaacactataggrcagtgatatttgcctaatctagaaccttctaccaggttgtccaagatgtgcccctagagaatatagcactcaattaatagtgttggatgagtttatttac

SEQ ID NO: 35705 - DNA, 201 bp, Homo sapiens
tattggataagaaaaagaagacaatctgtcccagaaattttgttggaatgtttttcatgaacagaatgaataaaattttagtttaatagatcagtataatrtagttctactttgctggaaaagaaatatatttgaaaagcattacgttgagtaattatctagataggactaacatcccataaatataagatctgatataaa

SEQ ID NO: 35706 - DNA, 201 bp, Homo sapiens
aacctgaaaaatatagctgtctatttaaagaagacattttcttgtttggcagaatattatcatcatacagcatatgtacaatatggtcctaatttgtgtcratatgtgctaggcttagaaaactcactttaagttttactaaatttattttggagtttaactcttacttttgacatgatttatattctaaggagatctcag

SEQ ID NO: 35707 - DNA, 201 bp, Homo sapiens
ttattccttctctctttccacaatcatttaaaaataattaaatgtctgaaaaattacaaaataagtgctatagagaatcagtgatttattaaatgactatyggataagaaaaagaagacaatctgtcccagaaattttgttggaatgtttttcatgaacagaatgaataaaattttagtttaatagatcagtataatatag

SEQ ID NO: 35708 - DNA, 201 bp, Homo sapiens
aacctcaaacagagagtgatggtgagttgtaatgcattacaccatgtctgctgttatcattattccttctctctttccacaatcatttaaaaataattaartgtctgaaaaattacaaaataagtgctatagagaatcagtgatttattaaatgactattggataagaaaaagaagacaatctgtcccagaaattttgttg

SEQ ID NO: 35709 - DNA, 201 bp, Homo sapiens
tttttgaagacctcttttaaaatttgcctaaaataaattctcggtatgctataattatagcagaactcttttctcagtcacccactaccactgttagggtsttaaaattatctcagaaaccaagcaagtttgtgctaccaactcacaaaataaaacaggcaaagacaacactctggatagggaattttatcaccattatct

SEQ ID NO: 35710 - DNA, 201 bp, Homo sapiens
caccttgtaactatgctcttcatcatacctaatgatacttgcaagataattgttgcttcatcctaggcattaataaatcctgtacataggcatgttattaygaatagctcagtgacattgctccttaagaaaaaaaatttttttgaagactaaaacctatgtaatactgagtccaaggggatagcgggaggtaagtgaact

SEQ ID NO: 35711 - DNA, 201 bp, Homo sapiens
tgtgcttatattagtataatctgtagtataacagaagtttaaggtgtctgcctataaaaccctttatatgaagtggagtgaatcattaattaatatgtccmgtactcttcttcacatccagacaccgatagttcagaatcctccatctatccacctttccctttgctattcttcacagatgcaggccaacaaagatgagga

SEQ ID NO: 35712 - DNA, 201 bp, Homo sapiens
ctttggaaaaaccaaatgcattttctgaagctataaataagaaaaatccctccctctgcccctcttaaatattacctcctcaaataaggtatgcacacagyaaaactcacaaatcagctccactggagccagcaggctttggcggtttctatctcattcaggttccaaagcagttatggcagctgcttagctgtcacagat

SEQ ID NO: 35713 - DNA, 201 bp, Homo sapiens
tttggaaaaaccaaatgcattttctgaagctataaataagaaaaatccctccctctgcccctcttaaatattacctcctcaaataaggtatgcacacagcraaactcacaaatcagctccactggagccagcaggctttggcggtttctatctcattcaggttccaaagcagttatggcagctgcttagctgtcacagata

SEQ ID NO: 35714 - DNA, 201 bp, Homo sapiens
accatgaaactgggtagtttataaataaacaaacatttatttctcacaattcttgaagctaagaagtctgagatcaaggtactggcagatttggtgtttastgagagccagtttttcatagaaggaggcttcttgctgttctcacatagtagaaagagtgaacaagctcctttggacctattttataagggcactaatttc

SEQ ID NO: 35715 - DNA, 201 bp, Homo sapiens
ccaaaggccccacttcctaatcctatcaccttgaggattaggatttcaacatatgaattttcaggggacacagacattcaggccactgccctttacttatycaatttcccacttatgtaaaaagtgatcaacatgggatccaaagattggaataacaaaatgcttacaaactgtctggcacatattgagatctaaatgaat

SEQ ID NO: 35716 - DNA, 201 bp, Homo sapiens
tagtacaattcttcaggctgtgtattacaggtgaaataaaactccctacacacataattctgctcagcaggtacctcttattacaatctgaagaatgactrtaagaagccaaaacctgtgttcctattggacaaatggactcaatcccgtgactttgcggtcactccttcctatctcatacccttgcccagggctgggaat

SEQ ID NO: 35717 - DNA, 201 bp, Homo sapiens
cccaccccaccagcgtggaacttcgtgtgtattcaaaggtccagtttgaattactgtgaggccagtggctagaaagcagtgtagttgggactggagattcwcatgcctggctcttctcccaagcttcaactgtagctcttgagcagcagcttcctctgagcttctaaaaaatgcccagaaaattgcccagccaaccacatt

SEQ ID NO: 35718 - DNA, 201 bp, Homo sapiens
gtggaacttcgtgtgtattcaaaggtccagtttgaattactgtgaggccagtggctagaaagcagtgtagttgggactggagattcacatgcctggctctyctcccaagcttcaactgtagctcttgagcagcagcttcctctgagcttctaaaaaatgcccagaaaattgcccagccaaccacatttcctggcaagcata

SEQ ID NO: 35719 - DNA, 201 bp, Homo sapiens
atacacacacacacacacacacacacacacacacacatatatatatatataaagttttacagaactttgttttcaacttttaaaacaggatttctaaagaagttatgtggttttttttctttcatggcaatggcgcctccagcctcacctttttcaaacccacatcttatcttcatatcctattttattgtagtgaaatcg

SEQ ID NO: 35720 - DNA, 201 bp, Homo sapiens
agttgggactggagattcacatgcctggctcttctcccaagcttcaactgtagctcttgagcagcagcttcctctgagcttctaaaaaatgcccagaaaaytgcccagccaaccacatttcctggcaagcatagcaccaggcatatggtcagtttgagtgctattagataggctttagaacttccaagggatcattggttt

SEQ ID NO: 35721 - DNA, 201 bp, Homo sapiens
acagtgcagccttcagtctgtggttaaaggcctgacagcccctggcaaacccctggtgtaagtccaggaatccaaaagctgaagaacttggagtgtgatgktcaagggcaggaagtatccagcatgggtgaaagatgaaggctggaagagtcagaagatctactctttccactttcttctgcctgcttttattctagccac

SEQ ID NO: 35722 - DNA, 201 bp, Homo sapiens
cacattgagggtgggtctgcctcttccagtccagtgactcaaattttaatctcctttggcaacaccctcacagagacacccaggaacaatactttgcatcsttcaatccaatcaagctgatactcaatattagtcatcacaagtccaccccttgtcaacttgaacccatacacatctcctgaaatcatacataatctccaa

SEQ ID NO: 35723 - DNA, 201 bp, Homo sapiens
aaaaatgaagaaagaattttattttcagccattttttttccaagagaaaaagaaatctaaagacaagcattgtaggaagggttaggagacagaaatgttcrttagtttaaatttattttttttgtagttcaggtagtacattatttaaagtaatgaaaacccacaaactactcaagtaataattcctctagaaaaccaagc

SEQ ID NO: 35724 - DNA, 201 bp, Homo sapiens
ggttatagaaaactataggacaatataataagtagatacttcactattatttggaattgtcatagatatattggccatgatcatttggaagccagatttcrtataattaggacgttcttcatttgagtaccattgagtgccctgacattccttttttgaatcatcccaccagaatccttgatgaggctaaaaacatctcct

SEQ ID NO: 35725 - DNA, 201 bp, Homo sapiens
agcattgtaggaagggttaggagacagaaatgttcattagtttaaatttattttttttgtagttcaggtagtacattatttaaagtaatgaaaacccacaractactcaagtaataattcctctagaaaaccaagccaaggctatgacggagatgggaatgttttcttgctacattatgacatttctctgatttgtggcca

SEQ ID NO: 35726 - DNA, 201 bp, Homo sapiens
tctcttctgggaagtgcacctaccccagaaagattttgtgaaattaattccagtaatgtagtacaagtgctctgaatctcacagcatgcttcacaaataargtgaagaattgtctcatatcacacacctgctagagcacctggttgcagagacttttggaggatgctatgggtatttaagatatgttggtagtatttcata

SEQ ID NO: 35727 - DNA, 201 bp, Homo sapiens
aggaagggttaggagacagaaatgttcattagtttaaatttattttttttgtagttcaggtagtacattatttaaagtaatgaaaacccacaaactactcragtaataattcctctagaaaaccaagccaaggctatgacggagatgggaatgttttcttgctacattatgacatttctctgatttgtggccaattacgga

SEQ ID NO: 35728 - DNA, 201 bp, Homo sapiens
ttgttttaaccatttttttttactttaaagaaaaagctataaactagttatatgatcttttcttcttcctttcatatgatgctgctaactcaatagagagmcacccgattacaaatgctattgatggaaagaacacttggtggcagagtcccagtattaagaatggaatcgaataccattatgtgacaattacactggatt

SEQ ID NO: 35729 - DNA, 201 bp, Homo sapiens
tttaagttttttaaaacattgaaaaacagaaatatatgcacacagaaagcaatttagccagcacaaccgggtataaaatgagaagttttagtacattgtcyctcacggcactattaactgcctcattcattcccagtttctacccactattaattactgtaaaggtttttggcatgttcttctctacccagctcccaccag

SEQ ID NO: 35730 - DNA, 201 bp, Homo sapiens
gtctgtaatatctttctacctattagaactgctggaaatttttgcatggtattagttcctgaaagcacacgttattttaaagatactacttttactatttytatattgttaaagcatgatataataacaacaaagattataaacacttattgagtacttaatatacttatgttaagtgtatgtaatcctcataccaattgg

SEQ ID NO: 35731 - DNA, 201 bp, Homo sapiens
agaaattgagtgtcatgcagttccaaagctggaatccaagtcttctagctctgccccggtgcttttttcctctgaaatttttccagttgagaagagattasgaattctcaaggtgtgcctaacattcagcagagagatgcaaaacactttttaatccgtgtgtgtaattaaaaacacagttgtacttgggtaattatatcc

SEQ ID NO: 35732 - DNA, 201 bp, Homo sapiens
atcttcttctcataccgtaataaacagtctcctaactttaactaccgaatatgtgctaataatttacaattctatatctgcagcccagagctctttcctaraggcaaactctgtgtaccaactgccttctggatccctccactccattattctatggttttagatgtatgacatttgtttttctgtccacaggcaacaggt

SEQ ID NO: 35733 - DNA, 201 bp, Homo sapiens
aaggaagcaaaaaaacgaaaataaaaaaatcttatttattacattctattagccccatggactttgcaaggcctgtgtccttcaaaaatgctgacattggwcgctgtgcccatcagaaactccgtgaagatgaagatggagcagctccagctgaaatagttatccagcctgagccagttcccaccccagcctttcctacgc

SEQ ID NO: 35734 - DNA, 201 bp, Homo sapiens
ctcttaatatttggtgcaggacatttcaaagctgagccctcttgcattgcctttttcagatgacctcaagcagtttggcctaacaaccagtattccgttcygaggttgcatcagatccctgaagctcaccaaaggcacaggcaagccactggaggttaattttgccaaggccctggaactgaggggcgttcaacctgtatc

SEQ ID NO: 35735 - DNA, 201 bp, Homo sapiens
atactaaaaatacaaaaaattagccaggcatggtagcaggtgcctataatcccagttacttgggaggctgaggcaggagaattgcttgaacctgggaggcygaggttgcagtgagccgagattgtgccattgcactccagcctgcgcgacaatgtgagactccgactcgaaaaaaaaaaaaaaagaaaaagaaaaaaaaga

SEQ ID NO: 35736 - DNA, 201 bp, Homo sapiens
aggtcaggatttcgagaccagcctggccaacatagtgaaatcctgtctaatttgtatactaaaaatacaaaaaattagccaggcatggtagcaggtgcctrtaatcccagttacttgggaggctgaggcaggagaattgcttgaacctgggaggccgaggttgcagtgagccgagattgtgccattgcactccagcctgcg

SEQ ID NO: 35737 - DNA, 201 bp, Homo sapiens
tttcctaagcctggttttgtggagctctcccctgtgccaattgatgtaggaacagaaatcaacctgtcattcagcaccaagaatgagtccggcatcattcytttgggaagtggagggacaccagcaccacctaggagaaaacgaaggcagactggacaggtaccctcacacctagctgataatgcattttccctaatgctt

SEQ ID NO: 35738 - DNA, 201 bp, Homo sapiens
aatctcctttggcaacaccctcacagagacacccaggaacaatactttgcatcgttcaatccaatcaagctgatactcaatattagtcatcacaagtccamcccttgtcaacttgaacccatacacatctcctgaaatcatacataatctccaaataaagacaataataacatcataattatacctaacataatacagcta

SEQ ID NO: 35739 - DNA, 201 bp, Homo sapiens
catacaaaatgtattttaacatgcatagcatggaagaatcacaggaggatgattacccaataacccaataggagcatagatgtagatatacccttcttcaygggggagggaagatggggaaaatatggcaatttggaaaatagtaaatgattttttaggggaattcaagaacctacaatggcctgggacaaagtctgttgg

SEQ ID NO: 35740 - DNA, 201 bp, Homo sapiens
aacggtatttctttctgcagaaggctgatgctgtacgtgtgattacattcactggctgcatgggagaaacatactttgacaacaaacctataggtttgtgraatttccgagaaaaagaaggtgactgcaaaggatgcactgtcaggttagttgagatgagaactctcccagggtctgtcctgtgcataataaaagcttcga

SEQ ID NO: 35741 - DNA, 201 bp, Homo sapiens
ataatacagctatcccttgtacaatcagaagcacactaatccttaacctaaatgctattacataaagttaacaacacttaaatgctgatatgaagtcaatraattttatgtcacatgataaaggaaaaagaaagcaaatgaagatattttcctagtacaagtgtatacatgcacaaacatattcttaacagaataaggagg

SEQ ID NO: 35742 - DNA, 201 bp, Homo sapiens
gtagcatgctaatgagccagggcagagttgctaagtggcaacgtgaaactttagtcaaaggaaggaagtaagggaaggggaggagaggggaggggaggggrgggaggcgaggggaggggaggggaggggaggggaggggaggggtggtagaaagaaagaaggaagggcagttttcttgtttgaacaagaaaggcttgaact

SEQ ID NO: 35743 - DNA, 201 bp, Homo sapiens
gactcatcatttatgaaaatatacaattttgttctgcaaaataatttaattttttaaaattccttgtgcaatgagaaaagatcagagaggcctacagtttscttttacagagctaggccaggggctgtatttagagtaattgaacacatgattttacttgaatgcggagaaacttgaccaactgtgaatatgcaatttcac

SEQ ID NO: 35744 - DNA, 201 bp, Homo sapiens
tccacttgattattaaaatcctcctcagctgaggtcacccgttggtgagcactcacataggatacaaatatcttcacagtttttgaccactcagagaggtycatccacatacctcttccccagattactttgccaccaattttttaatcatgcttcttccaagtccctgaccatccagccaaaccattggctacagcacat

SEQ ID NO: 35745 - DNA, 201 bp, Homo sapiens
agtccctgaccatccagccaaaccattggctacagcacattaattagtatataattacacatctggccatttcttcttccaagcaagtgcacaaccaggtrccctgctcaaaattctgccccctgggaagacttccctttgctactgtccttcagggatgtcctagaaaggggctgtagtgctgcagctgtccacttttgg

SEQ ID NO: 35746 - DNA, 201 bp, Homo sapiens
agcagctgctgctcgctcagctcacaagccaaggccaggggacagggcggcagcgactcctctggctcccgagaagtggatccggtcgcggccactacgaygccgggagccgccggggtcctcctccttctgctgctctccggaggcctcgggggcgtacaggcgcagcggccgcagcagcagcggcagtcacaggcacat

SEQ ID NO: 35747 - DNA, 201 bp, Homo sapiens
caccaagggcattgtttttcaacatccagagattgttgcccacatggacctgatgagagaagatctccatttggaacctttttattggaaacttccagaayaatttgaaggaaagaaggtaagcacaagaactttaatgtcaagtgagaacaagataaaatctttttagaatcacaccatttggagatttatccaattcct

SEQ ID NO: 35748 - DNA, 201 bp, Homo sapiens
ctaagtaacaaatatataggaatttattattctattatctttacttttgtgtaagcatgtaaaagaactggattttagaaattataaacatgtattaaagrtaattcttatagttttctcaataatttgctgctctgtattattaaaactactttgtctataaaagtttgctgaagtgaaaaatattgctgtttctattac

SEQ ID NO: 35749 - DNA, 201 bp, Homo sapiens
atttgcttttctttaattccccattgtgttccagaaaggattttagatgggactcaaaaagtaacttttttgcttccaattccaacataatcattctcacraacttttgtctcagttcaccaagaggaaaaacattcaatattgacaaacaccctaaaaattatttaaattgaaagaatagtgcaaaataatcaaggaaaa

SEQ ID NO: 35750 - DNA, 201 bp, Homo sapiens
attagattatgcgtgatcattattttctaggtggttttctaaagttcctgaaaggtcattcagagcattgggaagaagaaatttgggatagtagtaaattmaaagcaatttcaccagtgcctgtacgaaataattgaatggggaatgaccttgggttgtctgtttgcaagaatataaatgtctaattaattggccgtgtct

SEQ ID NO: 35751 - DNA, 201 bp, Homo sapiens
ttttcttgattttttccaaatgttttgaagaaagtttttgtattattaaatgctattcattggtcaatttaagtaatcttcttttaagaaatcattcagarattgtaggtccttgatcgtaattctttttgggtaatttcaatttcaataggttaaacactgtgctggaagatttgagaaagattatcattggtccatttt

SEQ ID NO: 35752 - DNA, 201 bp, Homo sapiens
ttatcgtcaggcatatggctgctcctctgattggccaattgacaaggcatgaaattgaaatgacagaggtaaagttagtcattgtttggtgcaaagatacyaatcaatggttttgcattcagttttgtcatagtgatttctcttcttgttaacagaaagaatggaaatattatggggatgatcctcgagtccatagaactg

SEQ ID NO: 35753 - DNA, 201 bp, Homo sapiens
atctaattttaaacacctttaacttttttgtttattttttgttagtatactttgtttatttatttatttctgttagtaaacttccatcaagaaagtatccyatttcttttctgccttttttaaatgaaagcctgctagtgataaatctctcatcttttgtttgttttttcacttttctttacttttgagacttattttcca

SEQ ID NO: 35754 - DNA, 201 bp, Homo sapiens
agttgactcagaatcagttccttcctttcagatccttatctttaattactttgtcttctaacctggggtcctaatctttgcctaggaatttaaagtaaagrttggccgaatcttatttctcttgacttgtatctacctttactttagctcaccctctgggcgtggcctctagccagtctcactttgagtatctttgaaact

SEQ ID NO: 35755 - DNA, 201 bp, Homo sapiens
aggtttttttcctgtcttcatattgatgaagtgttttttctaaagccattatttcatttattctatgaaagacaaaattggcattttaaaagtagaacacrgtcttttgatacctgtcatctgagatacctaaaggattttttttttaagttagcatcaagggtaaataataacaaatgaagttattttatgttagatctt

SEQ ID NO: 35756 - DNA, 201 bp, Homo sapiens
catttcactttgcaaaccgacttactattctttgtacctctctccttctctttttgctctgtcactaatagagctttcagctactaagacacacaggagtsctttctagagagtaactgaaattaaccacatacatcattttggtggcaaacctcacagccaccagtcatttatagtaccaagtccctgctctttgggtaa

SEQ ID NO: 35757 - DNA, 201 bp, Homo sapiens
attttccaaacgattcacacagcatcaacttaatcttctggaaaacattttagggaccacaaatacatattgtacccaggatgtagtgtacttactgcagygtggtctatgatttttcttggcatgcataattcaaagacccagatagaaatgactgattttagcacttctaacaataaaacaaaagctcttctacaagag

SEQ ID NO: 35758 - DNA, 201 bp, Homo sapiens
acccagcatctacatcagctgacacaaatgaccctgtgtttgttggaggcttcccaggtgagtgttggctaccccagcaacaatttctttgctctcttatrttactggttttgaaaacatttatatttacatgtgtctaagaatgtgtgcttatgtgtacttgcttcctagctttagaatctgcttagaatctgcacctta

SEQ ID NO: 35759 - DNA, 201 bp, Homo sapiens
cctgcagcctaagcatttaaacatttcctgctaccttgtatggtgctatgagacagctgtcattgaagaaattctgttgagaatctgaattactctccttytgtattattttaatgtttgatattcacatgatggttgttttaaccatttttttttactttaaagaaaaagctataaactagttatatgatcttttcttct

SEQ ID NO: 35760 - DNA, 201 bp, Homo sapiens
ctcaaagcagtcattttactaaatttttgatctttattaaacatagatgcaaaagtaataataatatttccacaaataaagggatgttaaccaaaattaaygttcaagaatcctttcagtgtttctctacctctttaaatattccagaaatggtgatacagtcaggagcaatatattgccaggaactttggcaggacgaga

SEQ ID NO: 35761 - DNA, 201 bp, Homo sapiens
tgcagtgactcatgccggtaatcccagcactttgggaggctgaggtgggaagattgcttgagcccaggagtttgagaccagcctggacaacatggcgaaamcccatctctactaaaaatacaaaaattagccaggcatggtgacacatgcctgtaatccaggctactcaggaggctgaggtgggaggatcccctgagcctg

SEQ ID NO: 35762 - DNA, 201 bp, Homo sapiens
ttgcaattaggatggaaagtggacaaatgccacattccatcctatttgtatgcctaaataatgtgcaggggtgatggtcaggatagttaatgacagacacyatacactgtaaaggtcatggtttttataagttatcactgtgtggggaagcccccagccagtgggccagatcagcacaagacattttcctaatggatgcca

SEQ ID NO: 35763 - DNA, 201 bp, Homo sapiens
cactttaacctccacctctcaggtcaagtgattctcctgcctcagcctcccaagtagctgagattacaggcatgcaccaccacacccagctaattttgtayttttagtagagacgaggtttcaccatgttggccaggctggtctcggactcctgacctcaggtgatccacctgccttggcctcccaaagtgctgggataac

SEQ ID NO: 35764 - DNA, 201 bp, Homo sapiens
agcatgagtacaatctccctcctccagtgtctaggttcattttggtgagggctgcatatattcaagagccacagaaagctggctggagcaaacaagctggyggattgcacggtagacctgccttccacccatatgggcctcctcgggatatgaggaactggtggcggcaggggctcagtgctgcagcttatatcaccaaat

SEQ ID NO: 35765 - DNA, 201 bp, Homo sapiens
ggctgaggcaggagaatggtgtgaacctgggaggcagagcttgcagtgagccaagattgctccactgcactccagcctgggcgacagagtgagactccgtytcagaaaaaaaaaaaaaaaaaaaaaaaaattatttaacctcttgatcatcatttctgattgagtatgctaagaagcacattttgatctttgcttttacaa

SEQ ID NO: 35766 - DNA, 201 bp, Homo sapiens
aattagaaaagatattattttattccaagtgaaacatgtattcacacttcacgtcttgaagcaccagtggccatttgggctgagttttcaagaaaaaaaawttatatagattttatgccctttttttaacctaagagatattaagtaatagctattccactatcagacaatgtgcataaattctagtcagatttttctttt

SEQ ID NO: 35767 - DNA, 201 bp, Homo sapiens
aaaccccatctctactaaaaatacaaaaaattagcctggcgtggtggtatgtgcctgtagtaccagctactcgggaaggtgaggcaggagaatccctttaytcaggaggcagaggttgcagtgagccaagatggtgccactgcactccagcctgggcgacagagctctgtctcaaaaaaaaaaaaaaaaaaaaagagaaaa

SEQ ID NO: 35768 - DNA, 201 bp, Homo sapiens
gggaggccagggcaggcagatcacggggtcaagagatggagacgatcctggccagcatggtgaaaccccgtctttactgaaaatacaaaaattaactgggyatggttacgcatgcctgtaatctcagctactcaggaggctgaggcaggagaatcgcttgaacctgggaggcagaggttgcagtgagctgagatggtgcca

SEQ ID NO: 35769 - DNA, 201 bp, Homo sapiens
aatcccaacactttgggaggccagggcaggcagatcacggggtcaagagatggagacgatcctggccagcatggtgaaaccccgtctttactgaaaatacraaaattaactgggcatggttacgcatgcctgtaatctcagctactcaggaggctgaggcaggagaatcgcttgaacctgggaggcagaggttgcagtgag

SEQ ID NO: 35770 - DNA, 201 bp, Homo sapiens
atgttgttaaatgaagaaatgtttaaaataattttttttcaaaaacaaatgcatacatttacaataaaagaaaaagataataactgattaaaatgtctccwaaatataaatttagcagaaagtcaacgttcattcaagccctacatatcttacagtactattgtatgaagcagggttttgtcccgagactattttttcctc

SEQ ID NO: 35771 - DNA, 201 bp, Homo sapiens
caggaggctgaggcaggagaatcacttgaacctggtaggcggaggttgtagtgagccaagattatgccactacactccagcctgggtgacagagtgagacwctgtctcaaataaataaataaataaataaataaataaaaagaaaaaagaaaagaaaagaataggaagagcaaatatattaagtggaagtggatcattgta

SEQ ID NO: 35772 - DNA, 201 bp, Homo sapiens
gatagatagatagatagatagatagatagataatagattagatgatagacagaaagaataagagatttattatgaagaattggcttacgtgattatggagsctgcaaagtcccagtatctgtgagctgcagatccatgatatagttcactttgagtccaaaggccagagaatcacgggagctgatggtacaaaccacagtt

SEQ ID NO: 35773 - DNA, 201 bp, Homo sapiens
atggttttgcattcagttttgtcatagtgatttctcttcttgttaacagaaagaatggaaatattatggggatgatcctcgagtccatagaactgtgaccygagaagacttcttggatatactatatgatattcattacattcttatcaaagctacttatggaaatttcatgcgacaaagcaggtaaactctaatagaaaa

SEQ ID NO: 35774 - DNA, 201 bp, Homo sapiens
accatttcagttgacaggtctaattttaagttccaccttttcataattgattattcatttgtacacaagtatttgttgagtaccagaaatagcatttagtyatttcaagctttagtttttcatcatcctattctccagatttcagcagcatcagaagccatataaacactgccttcggatggcccttagatggccaccaag

SEQ ID NO: 35775 - DNA, 201 bp, Homo sapiens
cccatggccagtcaagttgacacatacaatttacaatgacactggccttcaactccagtgcacaatgtggtcttcctctttattctccaaattcaagttctcttacttgctacagttgtccatatttcttgggaaccatcattctaaaaaatgttgaccaggcctttcttaggcatttctaggaaaaataatataaaatac

SEQ ID NO: 35776 - DNA, 201 bp, Homo sapiens
taactgtagatacattatagattgaaaaataaaaatggatatattggaggatatgcgcaattttattcaaacacatttgaatacttaggtgaagtaaacartaagtttagagcaaaatttactcaaaaagaaatagtacacctgagaactataaccgttaaataaattgcatcagtagttaatacaacaaaataacaatat

SEQ ID NO: 35777 - DNA, 201 bp, Homo sapiens
aaggcagttagagaaggaaaatcaaggatagattctagatttttgtcttgagcaactgcatggatggtgatgtcattgaatgtgatggaatagatcgggargggtgcaagatttttcatggagggaaggccagagaagaaacagttctgctatagccatactgaattttaggcaccttttagacatctaaatagaactatt

SEQ ID NO: 35778 - DNA, 201 bp, Homo sapiens
aggcagtaatttttaattctccctctcttcccacccttccttttcttccctatctcctttattttcttccttcttctttattagtttttaaatatgcatatctctttttataggagaaaggatggataatgattgcagcattctctgaccactctaatatctcaccctagaaattttaataaatgatttactaacattctc

SEQ ID NO: 35779 - DNA, 201 bp, Homo sapiens
ataacttttaaatttagcatgtcaattctttaccaaaaagcctgctaggatttggctgaaattatattgaattgatagatcaatttgggaagaattgacakcttaaaagtattagatatcccagtgtatgaacatggcataactctgcatttttttaggttgttataattttttctcagaaatgtttgtagtttttgatgt

SEQ ID NO: 35780 - DNA, 201 bp, Homo sapiens
catgtatcagcagtttgttctaaaaattgcttaataatattccatttgtgtaatgtacagtgacttgcttacctgtttaccatttaatgggtgtttgggtmatttctagtttggggttacaattttgctgtgaacattagcatacaagtcaaaagcatatttatggacaaatgttttctcttttttttcttaagaacactc

SEQ ID NO: 35781 - DNA, 201 bp, Homo sapiens
tgtgagcagtctacctaatggaagtttcagtagagaagttaatcaagatatttttaaagatgcattattttgctaaaacaaaatattcaattaaaatacarcatgttgttctcagtccctgaacataccgattgccctgctttcagtatggcaagcaacttcagattcctccatgagggtggacagatttgctctagcgct

SEQ ID NO: 35782 - DNA, 201 bp, Homo sapiens
gacctccttgagacacagttttctagtctacaaagagagtcatgaattttctgtggggactaaaggatttggcacatagagggtatccagtgagttcccargtcctggagatgctcacacatggtagctgtctttggtagcagtgctcatagtagctgtgcatatcagttgttcaccagtgaattctaaggctaagttagt

SEQ ID NO: 35783 - DNA, 201 bp, Homo sapiens
tgcactctggcctgggcgaaagagcgagactccgtctcaaaaaaaaaaaaaaaaaaaaaaaaagtacaatacctttagtcttatatctatttaaaaataargcatttttaaaagatccatgaactcctaacaatgaggttaactacatgtgccatttgagatgtgagtctaatactcagtgttcttctgttttgttttaaa

SEQ ID NO: 35784 - DNA, 201 bp, Homo sapiens
cactgcactctggcctgggcgaaagagcgagactccgtctcaaaaaaaaaaaaaaaaaaaaaaaaagtacaatacctttagtcttatatctatttaaaaakaaagcatttttaaaagatccatgaactcctaacaatgaggttaactacatgtgccatttgagatgtgagtctaatactcagtgttcttctgttttgtttt

SEQ ID NO: 35785 - DNA, 201 bp, Homo sapiens
aaattagctgggcgcggtggcgggcgcctgtagtcccatctactcggaaggctgaggccggagaatggtgtgaacctgggaggcggagcttgcagtgagcmgagatagcgccactgcactctggcctgggcgaaagagcgagactccgtctcaaaaaaaaaaaaaaaaaaaaaaaaagtacaatacctttagtcttatatc

SEQ ID NO: 35786 - DNA, 201 bp, Homo sapiens
ggactacaggcgtccgccaccacgcccggctaattttttgtgtttttaatagagacagggtttcaccatgttagccaggacggtctcaatctcctgacctygtgatccgccctcctcggcctcccaaagtgctgggattacaggcatgagccaccgcgcccggcctaatgaagaaccagaactcagcttggaagtgtggtg

SEQ ID NO: 35787 - DNA, 201 bp, Homo sapiens
ctcccaactaaaggcacacctgggattctttctgggccactgggctcccgtgctaaataatacaaaaataatgatgaagattctttttttttttttagacrgagccttgctctgtcgcctaggctggagtgcagtggcgcgatctcggctcactgcaagctgcacctcctgggttcacgccattctcctgcctcagcctca

SEQ ID NO: 35788 - DNA, 201 bp, Homo sapiens
gataacttgcatgaaaagaacattccttcttttgcttactttgagtttaattttctcttgtgttccaagtttttttgttttttgttttttgtttttgagayggagtcttgctctgacccccaggctcgagtgcagtggcagatcttggctcactgccagctccgcctcccgggttcacgccattctcctgcctcagcctcc

SEQ ID NO: 35789 - DNA, 201 bp, Homo sapiens
tcaaatttttactatttttccccttctttgttttccctcttataccggtgaagcttgtgaatgttctcatctgggtaataattgtgacccaaagactgggygatgcatttgccctcccaataccattggagagaaatgttctaaatgtgcacccaatacctggggccacagcattaccactggttgtaaggtgagtgaacc

SEQ ID NO: 35790 - DNA, 201 bp, Homo sapiens
caggctgggacctttggcctacaatcagcaaggggctgtgttccctgcaactgcaattcttttgggtctaagtcattcgactgtgaagagagtggacaatrttggtgccaacctggagtcacagggaagaaatgtgaccgctgtgcccacggctatttcaacttccaagaaggaggctgcacaggtctgtaaatatgactt

SEQ ID NO: 35791 - DNA, 201 bp, Homo sapiens
aaagtgtcaaggccaggtgcaatggctcatgcctgtaatcctagcactttgggaggccaaggcaggtggatcacttgaggtcaggagttcaagaccagccyggccaatatggtgagaccccatttctactaaaaatacaaaaatgggccaggcctggtagcacctgcctgcaatcccagctactcaggaggctgagacact

SEQ ID NO: 35792 - DNA, 201 bp, Homo sapiens
gctccttatgagagtctaactgatgcctgatgatctgacgtggaacagttttatcccaaactcctcccctgcgtctgtggaaaaattgtctccaacaaaasaagtacctggtgccaaaaattttggggaccactggttaatgtatgttagtgatcagaacatttccagggcctaaggcatgagcctgaatgggctcaaaac

SEQ ID NO: 35793 - DNA, 201 bp, Homo sapiens
ggtatcatcagatccaggctctaagtccttacttggggacatattggtcatttggcctgaaacaggccatttaaccttctgaaattcacttggtctcttcygggaagtgcacctaccccagaaagattttgtgaaattaattccagtaatgtagtacaagtgctctgaatctcacagcatgcttcacaaataaggtgaaga

SEQ ID NO: 35794 - DNA, 201 bp, Homo sapiens
tttgcttgttgtaccccctaaatgtcatcctctctctgctcgtactcactgctcaagtaagttcttatttgaaaggacagtaagtatgtcatagttttctrtagtctaagctgtgtcatgttgttcacatccaggtgttaggcaatctataaaacatcttctgttcaccttgtttgcaccttctactcatttgttttgtta

SEQ ID NO: 35795 - DNA, 201 bp, Homo sapiens
acaaaagtccagctctttggcccctaagtggaacaagttttgagatcttattttatgctccagagcactccatggaatcaggctaagactgggacatcacytgaaatcatacccttgattagagcttttcttttccatgtcctgcttcacccactcctttgctagattctcctaggaacacttaaatggtaagcttctttg

SEQ ID NO: 35796 - DNA, 201 bp, Homo sapiens
cttaccctcaaactgcctgtgtttgcataatcatgtggatactacaggatagattctttagactcatcttatgtaggaggaatagtgacatgaaccatcawaagaggagcattaactaaactttgcttgtcttacccatgaaagaacatcagtgtgactccctgccaaatatctgataatgaaaagaaatgcattgtgatc

SEQ ID NO: 35797 - DNA, 201 bp, Homo sapiens
ctgcagcctcaaactcctgagctcaagtgatcctcctgcctcagcctcctgagtagctgggactacaggtgtataccaccatgcccagctatttttttttktttgttttaatagagacaagatctcaatatgttgcacaggctgatctcgaactcctgagctcaagcaatcctcccacctcagcctcccaaagttctgggg

SEQ ID NO: 35798 - DNA, 201 bp, Homo sapiens
aaattagccagacatggtggcacgtgtcagtaatcccagctactcaggaggctgaggcagtagaatcacttgaacccgggatgtggaggttgcagtgagcygagatcgcgccattgcactccagcctgggtgacagagggagactctgtctcaaaaaaaaaaaaaaaaaaaaaaaaaaaaaagcctggaatactgatttag

SEQ ID NO: 35799 - DNA, 201 bp, Homo sapiens
tgagggtggttctgtctttcccagccctctgactcaaatgttaatctcctttggcaacaccctcacagacacactcaggtacagtactttgcatacttcartcaagtagacagtcaatattaatcaccacattctccaacgctttctcatacaggttctatttctccactatgaacagtgagattttttttctggtatact

SEQ ID NO: 35800 - DNA, 201 bp, Homo sapiens
ggaaacttctaattaaattgagggaagatgctagcaggccagaatttgggaattagatgatctggctccaaattcaatacatattgtctatgtaattagckgtgtcacctaatgtaccaataatgccttttcaagaaacactgtgcagtctgttctgattcctccattggcttaattcctataataaatatagtttccaaa

SEQ ID NO: 35801 - DNA, 201 bp, Homo sapiens
atggtgcctacccagaatgagggtggttctgtctttcccagccctctgactcaaatgttaatctcctttggcaacaccctcacagacacactcaggtacartactttgcatacttcaatcaagtagacagtcaatattaatcaccacattctccaacgctttctcatacaggttctatttctccactatgaacagtgagat

SEQ ID NO: 35802 - DNA, 201 bp, Homo sapiens
gttaattcttacacagggttttctggagggacagaactaataggattgatgtatatatgaaggggagtttgttaggagaattggctcacatgatcacaagrtgaagtcccacaataggccatctgcaagctgagtagcaagaaagccagttcgattcccagaacctcaaaattagggaagccagcggtgcagccttcagtc

SEQ ID NO: 35803 - DNA, 201 bp, Homo sapiens
gtaatatcattgtatatctactcatatcttttcctatgcaaatagtttttctacaaatgggtgatatttatataactgtttcataacttactatgggaatkaacatcacatacgtattttaaaaaatattctcaaaaatatatttttaaaatgtatattgaactagattctgagaatttacatcattattatagtaagaac

SEQ ID NO: 35804 - DNA, 201 bp, Homo sapiens
tgctttggctgacacttgatgggctgcaaccactgtcctgcacccactgtcagacaagccccagtgaggtgaccctggtacctcaattggaaatgtggaartcacccatattctgtgtcgctcatgctgggagctgtagactggagctgttcctattcgaattatactggtttctaaaaaagattgtaatatattgttgag

SEQ ID NO: 35805 - DNA, 201 bp, Homo sapiens
gcttcccgggtgaggtgatgcctcgccctgctttggctgacacttgatgggctgcaaccactgtcctgcacccactgtcagacaagccccagtgaggtgamcctggtacctcaattggaaatgtggaaatcacccatattctgtgtcgctcatgctgggagctgtagactggagctgttcctattcgaattatactggttt

SEQ ID NO: 35806 - DNA, 201 bp, Homo sapiens
cttcctcctttagctcagagaagtttgatcgtctgaagccttcttctctcaactcctcaaagtcattctccatccagctttgttccattgctggcaaggarcttcattcctttggaggaggagaggcgctctgatttttagagttttcagcttctctgctctgttttttccccatctttgtggttttatctacctttggtc

SEQ ID NO: 35807 - DNA, 201 bp, Homo sapiens
cttgagtctttatccaatttgccagtctgtgtcttttaattggagcatttagcccatttacatttaaggttaatattatgtgtgaatgtgatcctgtcatkatgatgttagctggttattttgctcgttagttgtttcagtttcttcctagcatcgatggtctttacaatttggcatgtttttgcagtggctggtactggt

SEQ ID NO: 35808 - DNA, 201 bp, Homo sapiens
tgcttcttgagaactactatcaacaataaaaaaagctttgattttaacgtgtatatcttaagatttcttttgatcaatactaatgaaaataaacctgaaamgcgaatcattggacaaatgtgagatttttcctttaatttatacattaattgatgtaagatagtatttagaaagtttcaatcctttccagttacaattgta

SEQ ID NO: 35809 - DNA, 201 bp, Homo sapiens
tgcacaaatacgcgtagtctgctgacagtaacctgccaggttctagacttccatattgattactgttagcaaaatgtgtaggtgaaatttttgtagggtaygcacgtgaccattcacagaaggcaagaggttctctttggaatttaattttctgtgtgaaaaataaatcacttttttgtgtgtgtggaacatttctcatgg

SEQ ID NO: 35810 - DNA, 201 bp, Homo sapiens
attttactctctatatcaatatcacacacactaacacttggtgtgcattttagaatatcttgctggttcccagtaaatatgtcaactttttgcactatatrccgcttgaaatgtcaatactgcacaaatacgcgtagtctgctgacagtaacctgccaggttctagacttccatattgattactgttagcaaaatgtgtag

SEQ ID NO: 35811 - DNA, 201 bp, Homo sapiens
tataatcacattttatgaataagttttatttcacttaacagatttatttattttttaaaaccacaactttaattcccaagtaactcttagaagtttctccyttttggattttcattttgatgtttagtaggcttaaattccagtgtttaacacaacccccagcttttgagtcacagtttatttcattatagtagacccctg

SEQ ID NO: 35812 - DNA, 201 bp, Homo sapiens
aaagtcaggggatgtgtttagttcttaatttgcttgacttctgtagcacgtcataatgctgctcagttatgtccttacaacaccgccagttatcatgcatygagtcacttctgcatctcttaatttccatagtgttatgctctcctaatttctccttttcctctgtggaatgccagtcaccttgccagctccactttctct

SEQ ID NO: 35813 - DNA, 201 bp, Homo sapiens
cacactgatgggtcttgagtctttatccaatttgccagtctgtgtcttttaattggagcatttagcccatttacatttaaggttaatattatgtgtgaatrtgatcctgtcattatgatgttagctggttattttgctcgttagttgtttcagtttcttcctagcatcgatggtctttacaatttggcatgtttttgcagt

SEQ ID NO: 35814 - DNA, 201 bp, Homo sapiens
acatgagatgggtctcttgaatacagcacactgatgggtcttgagtctttatccaatttgccagtctgtgtcttttaattggagcatttagcccatttacrtttaaggttaatattatgtgtgaatgtgatcctgtcattatgatgttagctggttattttgctcgttagttgtttcagtttcttcctagcatcgatggtc

SEQ ID NO: 35815 - DNA, 201 bp, Homo sapiens
agaccgaggtgggcagatcacctgaggtaaggagtttgagaccagcatggccagcgtggtgaaaccctgtctctactaaaaacgcaaaaattagctgggcwtggtggtgggtgcctgtaatcccagctactcaggaggctgaggtaggagaattgctggaacccaggatacggaggttacagtgagctgagattgcgccac

SEQ ID NO: 35816 - DNA, 201 bp, Homo sapiens
gagcctgtgtgtgtctctgcacatgagatgggtctcttgaatacagcacactgatgggtcttgagtctttatccaatttgccagtctgtgtcttttaattrgagcatttagcccatttacatttaaggttaatattatgtgtgaatgtgatcctgtcattatgatgttagctggttattttgctcgttagttgtttcagtt

SEQ ID NO: 35817 - DNA, 201 bp, Homo sapiens
tatgtaatggccttctttgtctcttttgatctttgttggtttaatgtctgttttatcagagactaggtttgcaacccctgcctttttttgttttctatttscttggtagatcttcctccatccctttattttgagcctgtgtgtgtctctgcacatgagatgggtctcttgaatacagcacactgatgggtcttgagtctt

SEQ ID NO: 35818 - DNA, 201 bp, Homo sapiens
atctcctggattcactgatttgttgaagggttttttgtgactctatctccttcagttctgctctgatcttagttatttcttgccttctgctagcttttgartgtgtttgctcttgcttctctagttcttttaattgtgatgttagggtgtcaattttggatctttcctgctttctcttgtgggcatttagtgctataaatt

SEQ ID NO: 35819 - DNA, 201 bp, Homo sapiens
taatttgcatagaggtgtttatagtattctctgatggtagtttgtatttctgtgggatcggtggtgatatcccctttatcattttttattgcatctatttsattcttctctcttttcttctttattagtcttgctagcagtctatcaattttgttgatcttttcaaaaaatcatctcctggattcactgatttgttgaagg

SEQ ID NO: 35820 - DNA, 201 bp, Homo sapiens
catgagaaaaggcgataatcatctttcatatcaaatattagaacaatgcaagagaaatatggtgattttactctctatatcaatatcacacacactaacayttggtgtgcattttagaatatcttgctggttcccagtaaatatgtcaactttttgcactatataccgcttgaaatgtcaatactgcacaaatacgcgtag

SEQ ID NO: 35821 - DNA, 201 bp, Homo sapiens
cctgttattggtctattcagagattcaacttcttccttgtttagtattgggagggtgtatgtgtccaggaatctatccatttcttcaagattttctagttwatttgcatagaggtgtttatagtattctctgatggtagtttgtatttctgtgggatcggtggtgatatcccctttatcattttttattgcatctatttga

SEQ ID NO: 35822 - DNA, 201 bp, Homo sapiens
ccatttattaaatagggaatccattccccattgcttgtttttgtcaggtttgtcaaagatcagatggttgtagatgtgtggtattatttctgagggctctwttctgttccattgatctacatctctcttttggtaccagtaccatgctgttttggttactgtagccttgtagtatagtttgaagtcaggtagcatgatgcc

SEQ ID NO: 35823 - DNA, 201 bp, Homo sapiens
ttaccccaattcctggcaaccaccattcattccaccattctactctctgcttctatgagttcaactttttagattccacatgtgagtgagatcatactgtrtttgtttttctatgtgtggcttatctcacctagcacaatgcccttcaggcttatccatgtcattgcaaatagcaggatttccttctcttttatggctgaa

SEQ ID NO: 35824 - DNA, 201 bp, Homo sapiens
tttttcttgtaagtttgtttgagttctttgtagattctggatattagccctttgtcagatgagtagattgcaaaaatcttctcccattctgtaggttgccwgttcactctgatggtagtttcttttgctgtgcagaagctctttagtttaattagatcccatttgtcaactttggcttttgttgcccttgcttttcgtgtt

SEQ ID NO: 35825 - DNA, 201 bp, Homo sapiens
cgggcatggtggcacatgcctgtaatcccagctactcgtgaggctgaggcaggagaatcgcttgaacctgggagacaagaggttgcagtgagccaagatcrcaccactgcactccagcctgggagacagagcaagactccatctcaaaaaaaaaaaataaaaattaaaaaaaaagcctgaacctagaaacggacctacaaa

SEQ ID NO: 35826 - DNA, 201 bp, Homo sapiens
tgtggatgcagatatctccttgagatactgatatcaccttttaaaatatatagctagaaatgggattgctgggtcatattgtagtactattttcatttttkgaagaatctctatgcttaatgctgttttccatagtggctatgcctatttacattcccaccaaaagtgtagaagggtttctttttctctgtttcctcacca

SEQ ID NO: 35827 - DNA, 201 bp, Homo sapiens
caagtaatttatttatgagcatgtgttttactgtttttaaaactgggatgactttaatttaaatgaacagtgatttgagatttatagcttccctttctttrtgtcatggataatttctctgtgctaaggtgtgagcatacacatcatttgggctgttattgaagtagaatacgaagcctgccttctttcactagcagggga

SEQ ID NO: 35828 - DNA, 201 bp, Homo sapiens
cttttcagctgtgaaaactattattactaagtattaaaacaaactgagggcaaggcacggtggctcatgcccgtattcccagcactgtgggaggccgaggmgggtggatcacttcagatcaggagttcaagaccagccttgccaacgcggtgaaaccctgtctctactaaaaatacaaaaattagccgggcatggtggcac

SEQ ID NO: 35829 - DNA, 201 bp, Homo sapiens
gccataaaaaatgatgagttcatgtcctttgtagggacatggatgaaattggaaatcatcattctcagtaaactatcacaaggacaaaaaaccaaacaccrcatgttctcactcataggtgggaattgaacaatgagaacacatggacacaggaaggggaacatcacactctggggactgttgtggggtgggggggagggg

SEQ ID NO: 35830 - DNA, 201 bp, Homo sapiens
tactatgcagccataaaaaatgatgagttcatgtcctttgtagggacatggatgaaattggaaatcatcattctcagtaaactatcacaaggacaaaaaamcaaacaccgcatgttctcactcataggtgggaattgaacaatgagaacacatggacacaggaaggggaacatcacactctggggactgttgtggggtggg

SEQ ID NO: 35831 - DNA, 201 bp, Homo sapiens
ataaagacacatgcacacgtatgtttattgtggcactattcacaatagcaaagacttggaaccaacccaaatgtccaacaatgatagactggattaagaamatgtggcacatatacaccatggaatactatgcagccataaaaaatgatgagttcatgtcctttgtagggacatggatgaaattggaaatcatcattctca

SEQ ID NO: 35832 - DNA, 201 bp, Homo sapiens
atcaggaggagaatatagcaacttcgtcttctggaaacaactttggtcttgacttgaaagcagatgacaaaatatattttggtggcctgccaacgctgagwaacttgaggtaatttagtttatatgtaaagctaaggattaagttttaattaaatgaccactatgctcactagagttctgaagtttaattacaataagaat

SEQ ID NO: 35833 - DNA, 201 bp, Homo sapiens
tagaatggcagtcattaaaaagtcaggaaacaacagatgctggagaggatgtggagaaataggaacacttttacactgttggtgggactgtaaactagttyaaccattgtggaagtcagtgtggtgattcctcagggatctagaacttgaaataccatttgacccagccatcccattactgggtatgtacccaaaggacta

SEQ ID NO: 35834 - DNA, 201 bp, Homo sapiens
agacatttatacagccaaaaaacacatgaaaaaatgctcaccatcactggccatcagagaaatgcaaatcaaaaccacaatgagataccatctcacaccarttagaatggcagtcattaaaaagtcaggaaacaacagatgctggagaggatgtggagaaataggaacacttttacactgttggtgggactgtaaactagt

SEQ ID NO: 35835 - DNA, 201 bp, Homo sapiens
gttttcatgtggcatgtttgtttactaatttacaaaatttgttttaccccctgcagctgtaaatgaaaaagctataaaactaaatgaaactctaggaactygagacgaggcctttgagagaaatttggaagggcttcagaaagagattgaccagatgattaaagaactgaggaggaaaaatctagagacacaaaaggaaat

SEQ ID NO: 35836 - DNA, 201 bp, Homo sapiens
gcagtctccaagaacccaggaagtatgtgatccataggagtgtacatattttattttctttaaaaaataagacagacacttctcaaaagaagacatttatrcagccaaaaaacacatgaaaaaatgctcaccatcactggccatcagagaaatgcaaatcaaaaccacaatgagataccatctcacaccaattagaatggc

SEQ ID NO: 35837 - DNA, 201 bp, Homo sapiens
ctggactggaagtgtttatattctttttaaaagaatagcagtttttattccagaaaaaaatattaaattataggattgtttttgatatctagactcttttkctaaagcacagttaattatcttataattatgctgtatagattttccatatactgctcttaagcattagtgatttccacttacttctaggaatgttttctc

SEQ ID NO: 35838 - DNA, 201 bp, Homo sapiens
aataaataaacgttttcagatttttttttctaacttttgagcaaggtttttaaaaactttttggtatatagtttgtttatgctgcctatgcaattatcttstctttggtgaaaaaaataaaacttatttcattacacatgtaaagcatcaataagaagtcagttaattcctgtacctcatgtttaaatgctgtgggtgaga

SEQ ID NO: 35839 - DNA, 201 bp, Homo sapiens
gaatcgcttgaacccaggaggcggaggttgcagtgagctgagatcgtgcctctgcactccagcctggtgacagagcgagactccatctcaaaaaaaaaaawaataataataataagggtaaatacaaggagtgtgttttgaatacaaaatatctatttttagaatctcaaacccatgagttactttcttccatatataagt

SEQ ID NO: 35840 - DNA, 201 bp, Homo sapiens
acttgtcccatgtgatattaagaaaagggccaatcctccagttacaaagctacaccagttttataattcttatttgctttattcttgccccacaaggaaaygtatttacaggggttatacatggtatttagttcagttgctggactggaagtgtttatattctttttaaaagaatagcagtttttattccagaaaaaaata

SEQ ID NO: 35841 - DNA, 201 bp, Homo sapiens
agcaaggtttttaaaaactttttggtatatagtttgtttatgctgcctatgcaattatcttgtctttggtgaaaaaaataaaacttatttcattacacatrtaaagcatcaataagaagtcagttaattcctgtacctcatgtttaaatgctgtgggtgagattattgttaaaggggagaaggactacaaaaagactcctt

SEQ ID NO: 35842 - DNA, 201 bp, Homo sapiens
tccagctctttggcccctaagtggaacaagttttgagatcttattttatgctccagagcactccatggaatcaggctaagactgggacatcacctgaaatyatacccttgattagagcttttcttttccatgtcctgcttcacccactcctttgctagattctcctaggaacacttaaatggtaagcttctttgtaaatat

SEQ ID NO: 35843 - DNA, 201 bp, Homo sapiens
gtgaaaaaaataaaacttatttcattacacatgtaaagcatcaataagaagtcagttaattcctgtacctcatgtttaaatgctgtgggtgagattattgytaaaggggagaaggactacaaaaagactccttctgcaggataacatgaacatccatttagaccaaccagtagataatggaaaccagagtttgctgggtac

SEQ ID NO: 35844 - DNA, 201 bp, Homo sapiens
tttaaatgctgtgggtgagattattgttaaaggggagaaggactacaaaaagactccttctgcaggataacatgaacatccatttagaccaaccagtagayaatggaaaccagagtttgctgggtacacgtgtgcacagtttgatagacatgtgcctgcatgtgtctgctccacaaggcttccttcccatagtcagagact

SEQ ID NO: 35845 - DNA, 201 bp, Homo sapiens
ctcttaaaatatccataagcaagagtcaatagtcaacagcaaatattagcaagaattttatagaaactcaatagtgatcagcttgtttttaaaatgaaaaygttaaatatgtcattctcatacatttttaattatcctatcataatacaattattcattttgtctgctgcttctaatcaaaattatcttaaaccactccaa

SEQ ID NO: 35846 - DNA, 201 bp, Homo sapiens
tggcaggtcaaagcaggaggatcgtttgagcccaggagtttgaaactaggctaggcagcatgataagaccctttctctacaaaaaatgtttaaaaattaamtgggcatggtcgtgcacaactgtgattccagctattcaggactgctattcagctgttcacgccaccacactctagcctggatgacagagtgagactctgt

SEQ ID NO: 35847 - DNA, 201 bp, Homo sapiens
ctggatgacagagtgagactctgtctcaaaactttttttaaaaaagagtatcaattttgcaaggacataaactttagtatctatatcccctgtccatttgrttctgttaaaagcaatccctcaactgcccagatttaagcatcatacctcttattgccttggtattctttaatatcttcaatcacattttttaaaacgtaa

SEQ ID NO: 35848 - DNA, 201 bp, Homo sapiens
ttcgagaccagcctggccaacatagtgaaatcctgtctaatttgtatactaaaaatacaaaaaattagccaggcatggtagcaggtgcctataatcccagytacttgggaggctgaggcaggagaattgcttgaacctgggaggccgaggttgcagtgagccgagattgtgccattgcactccagcctgcgcgacaatgtg

SEQ ID NO: 35849 - DNA, 201 bp, Homo sapiens
aaaattctaataaacttattaacttgctcttcaaacaatggaatcaatctgcacgtccactagcactcttgtgaacacttggcattatcatacatttaatwttccccaatctcaaaaataagaaatgacatcttactgttgcttagttttacagttctttatgataatcttgagtgctttttacgaatttcataaatgatt

SEQ ID NO: 35850 - DNA, 201 bp, Homo sapiens
accttttaaaatatatagctagaaatgggattgctgggtcatattgtagtactattttcatttttggaagaatctctatgcttaatgctgttttccatagyggctatgcctatttacattcccaccaaaagtgtagaagggtttctttttctctgtttcctcaccaacatgtgttatcttttgtcttttatataatagcca

SEQ ID NO: 35851 - DNA, 201 bp, Homo sapiens
ttatgaaaatgcaattttgatgtcttgttcataatggtctacagaaaaagaaggaggctgttgaaagcggcaaacgacaaattgagaacactttaaaagarggcaatgacatactcgatgaagccaaccgtcttgcagatgaaatcaactccatcatagacgtgagtattgggtaaaactcaaaagagagatgataatgaa

SEQ ID NO: 35852 - DNA, 201 bp, Homo sapiens
aagggtttagaattttagaattgtgctttgcaaaaaggaagcacaatatatgaatgctagttcttattaccccgagagagacacatttatgggaacctatmcagtttctcactgggtctggatagccactctctcccatatttattttacctcattaatctcaattactgaccatgaatgtctgctccttaagtttgttta

SEQ ID NO: 35853 - DNA, 201 bp, Homo sapiens
ttgactccacaattggttagctcatgaccttaggcaacttacttaacctttctgtgcctcagtttcaccactcaataaaaaagtggtgagaatgacaactstctgccagggttgtcctgaggagtaaatgagtacatatttgtaaagagtttagatttgtaaagggtttagaattttagaattgtgctttgcaaaaaggaa

SEQ ID NO: 35854 - DNA, 201 bp, Homo sapiens
aacagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtgacaa

SEQ ID NO: 35855 - DNA, 201 bp, Homo sapiens
gaacagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtgaca

SEQ ID NO: 35856 - DNA, 201 bp, Homo sapiens
agaacagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtgac

SEQ ID NO: 35857 - DNA, 201 bp, Homo sapiens
ctctctggctgcccttaacattttttccttcatttcagctttggtgaatctgacaattatgtgtcttggagttgctcttctcgaggagtatctttgtggcrttctctgtatttcctgaatctgaacgttggcctgccttgctagattggggaagttctcctggataatatcctgcagagtgttttccaacttggttccatt

SEQ ID NO: 35858 - DNA, 201 bp, Homo sapiens
aagaacagcaaaataaataattttgcaagaacactcatatgtttatactatgttgtttttctaccttccagtttctggagatgagatatgatttttttcttcttttcaattccctgcaaggctgtatttcataatctcctccccatcaacacacacccatacacacaatgcacacccatgtctgtttcttgttgatagtga

SEQ ID NO: 35859 - DNA, 201 bp, Homo sapiens
ggccagaacttccaacactatgttgaataggagcggtgagagagggcatccctgtcttgtgccagttttcaaagggaatgcttccagtttttgcccattcwgtatgatactggctgtgggtttgtcatagatagctcttaatattttgaattacgtcccatcaatacctaatttattgagagtttttagcatgaagggttg

SEQ ID NO: 35860 - DNA, 201 bp, Homo sapiens
accagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaact

SEQ ID NO: 35861 - DNA, 201 bp, Homo sapiens
aatgtttgtaacaaaagcagctggagaagatgatcatagcaattatgcagacagccatagaaatgagcaaaaccagccatcgaatgctgccatcaaaaaayggacctatgacaacagggggcatgtgggttgcaaatactggttacataaattggtccgacaacattctattgtccggcgtagctgggcttttggagaatc

SEQ ID NO: 35862 - DNA, 201 bp, Homo sapiens
caccagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaac

SEQ ID NO: 35863 - DNA, 201 bp, Homo sapiens
ccagcacttctggagccaggtagcgtttggtgcccaccctggtattcaagggcacatcaacttcatttgtgtcactgttgaatttaacagcaaggcccagrtcagcaatgcagcaactcccatttttcttgatgaggatgtttttgctctttaggtctcgatgagcaattgcgggctttccttgggtgccatacgtttctg

SEQ ID NO: 35864 - DNA, 201 bp, Homo sapiens
acaccagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaa

SEQ ID NO: 35865 - DNA, 201 bp, Homo sapiens
ctgtgacagatgccggcctggcaaattcggactcgatgccaagaatccacttggctgcagcagctgctattgcttcggcactactacccagtgctctgaarcaaaaggactgatccggacgtgggtgagtagggaactgctgagccatgtaatggtataatgttagttcctgctggtgtcttttagtcaggcactgagggg

SEQ ID NO: 35866 - DNA, 201 bp, Homo sapiens
cacctcccgggttcatgccattctcccacctcagcctcctgagtagctaggactacaggcgcccgccaccacgcctggctaattttttgtatttttagtaragacggggtttcactgtgttagccaggatggtctcgatctcctgacctcgtgatcggcccgcctcggcctcccaaagtgctgggattacaggcgtgagcc

SEQ ID NO: 35867 - DNA, 201 bp, Homo sapiens
tacaccagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtaca

SEQ ID NO: 35868 - DNA, 201 bp, Homo sapiens
aaatcttaaacccacattccaaacaaataagaaatagggtataagtaatcaggtaattatgaaactctaagaatcagccattgaaactgtaaaaaaaaaaataaagctgacctattacaatactaaagtaatacaaagtttaatgtacctttttgcacatagcaggcctcagtaaaaagctgttaaataaatactttttaa

SEQ ID NO: 35869 - DNA, 201 bp, Homo sapiens
ggcggatcacgaggtcaggagatcgagaccatcccggctaaaacggtgaaaccccgtctctactaaaaatacaaaaaattagccaggcgtagtggcgggcrcctgtagtcccagctacttgggaggctgaggcaggagaatggcgtgaacccgggaggcggagcttgcagtgagccgagatcccgccactgcactccagcc

SEQ ID NO: 35870 - DNA, 201 bp, Homo sapiens
gctgaggcaggagaattgcttgaacctgggaggccgaggttgcagtgagccgagattgtgccattgcactccagcctgcgcgacaatgtgagactccgacycgaaaaaaaaaaaaaaagaaaaagaaaaaaaagaaaatctaaaaataatataatcttgtcaatagatagtaaaaacatttggtaaaatttaacagtcatt

SEQ ID NO: 35871 - DNA, 201 bp, Homo sapiens
tgaggcaggagaattgcttgaacctgggaggccgaggttgcagtgagccgagattgtgccattgcactccagcctgcgcgacaatgtgagactccgactcsaaaaaaaaaaaaaaagaaaaagaaaaaaaagaaaatctaaaaataatataatcttgtcaatagatagtaaaaacatttggtaaaatttaacagtcattca

SEQ ID NO: 35872 - DNA, 201 bp, Homo sapiens
ggaccagaaggaataggtgagggtctcagtgctaatgtagggttaatccagggccaagtagacaaaaataataataaaaccacaacaataataataataayaaatgatggctagcatttgttgcacatttattttatggagggtgttaatctaagaaatttcccatgtataaattcatatatactaatacttgtcgcattt

SEQ ID NO: 35873 - DNA, 201 bp, Homo sapiens
aaggaataagcaaagcaaaaaaccacaagcttgctgaagttggaggaccagaaggaataggtgagggtctcagtgctaatgtagggttaatccagggccargtagacaaaaataataataaaaccacaacaataataataataataaatgatggctagcatttgttgcacatttattttatggagggtgttaatctaagaa

SEQ ID NO: 35874 - DNA, 201 bp, Homo sapiens
aatgtacagtatatataatctacagggaatacagtccttgtccccaaaaggggaaaagctcactgcagtttataatgggatatcgaaaccatactggttgytatagtattagaaagaacagtattggaaagatgtgaatcaaagagtgcccttgatcactgctggtagaaaaagtaaatttctaaagtcactttggaaaac

SEQ ID NO: 35875 - DNA, 201 bp, Homo sapiens
gtacagacccagatttttgcacatgggcataataagacatgtacaagaatgtttatagaagtattctttataatagcagagaaactagaaacaacccaagwgttcatcagctggagaacagagaggcaaactgtggcacttttgcataatgggatatcaaggaataagaaaaaggaataaattataactaaatataacaac

SEQ ID NO: 35876 - DNA, 201 bp, Homo sapiens
ctttgcagagaactgctatattaatatatccactttccagatcatctcacaagcaaaaatggtaaatgattagaaagatatttccagctgttttcaaaacsgtttgagaaaataaagtcttaatttctcaggtaagatctcagagcagacgaacctgtggttctgccagggaatctctaaagctaagccataaatgagact

SEQ ID NO: 35877 - DNA, 201 bp, Homo sapiens
attgcaaggattatttatatattctggatacatgttctttaacgtatgttaaagcttgcttttcatatagattgctttttacctagtttcatcatctaatytttataaacactagcttattatctttttcttctatagtccatactttttatgttctacccaagaaagacaaggtccaaagatttctctcccatgttttct

SEQ ID NO: 35878 - DNA, 201 bp, Homo sapiens
agacgaacctgtggttctgccagggaatctctaaagctaagccataaatgagacttctgtttaatcttcaataaccacttgctgttgcaggcctattatgyaatactcctcaacaggggccgtctggaagtgcatctctccacaggggcacgaacaatgaggaaaattgtgatcagaccagagccaaatctgtttcatgat

SEQ ID NO: 35879 - DNA, 201 bp, Homo sapiens
ataaccacttgctgttgcaggcctattatgcaatactcctcaacaggggccgtctggaagtgcatctctccacaggggcacgaacaatgaggaaaattgtsatcagaccagagccaaatctgtttcatgatggaagagaacattccgttcatgtagagcgaactagagggtaacaatagcactaaaatatttattattgta

SEQ ID NO: 35880 - DNA, 201 bp, Homo sapiens
gtgtttacaaagcttatgcccatttctattttgagttgtttgtttccttagtaatgcattgcaaggattatttatatattctggatacatgttctttaacrtatgttaaagcttgcttttcatatagattgctttttacctagtttcatcatctaatttttataaacactagcttattatctttttcttctatagtccata

SEQ ID NO: 35881 - DNA, 201 bp, Homo sapiens
taacaatagcactaaaatatttattattgtaactcaggtgaacttcctttgctagcatcggtatctatcagtatctgcctgaacctctgtgtgtgtggacmtactatgcattgcaaaaggataccgtagcttaattccctcttctttacttttcatacttcgggaacctcatttgcctcagcccttaggagttctaccctt

SEQ ID NO: 35882 - DNA, 201 bp, Homo sapiens
aatcatcccttgtgccccattgcagtgaagtccccatcaccccccatgtgcctactgttttgccttctagcattataattttccaatttctacaacttctkaaaaatagaatcgtagtctgtttttttgagggggggtttgtttgtttctttgtttggcttccttcacttggtgttacgtttttgtaattcatccatattg

SEQ ID NO: 35883 - DNA, 201 bp, Homo sapiens
gcctgaacctctgtgtgtgtggacctactatgcattgcaaaaggataccgtagcttaattccctcttctttacttttcatacttcgggaacctcatttgcytcagcccttaggagttctacccttaacatttttattcgtgcagttatctccacctttggaaaaaccaaatgcattttctgaagctataaataagaaaaat

SEQ ID NO: 35884 - DNA, 201 bp, Homo sapiens
aaggatctagtttgttaagaaacataggcatcataacaaataaatgttcttgaattcaaaaaaaattaaagcttgattgttcagaaagcaatttcatctayatttaggagatgtttacaggtgttatattttataatgcagatctgagttcactttttgtacaagtagaagagtcacacttttatattaatagtgataata

SEQ ID NO: 35885 - DNA, 201 bp, Homo sapiens
gggtttcagatttaaaaatcaagagtaagaagttttacaatatttactaaagattacgattagtataccacaaaacatctgaactttagatattatttatrtgaccttaaaagtcagacctttccctgccaatgacttaacttctgtctttagtgctattttgtttgaaggcttatttatctgctatgaagtgatttttct

SEQ ID NO: 35886 - DNA, 201 bp, Homo sapiens
tatccactcactttattgtgatatcaaaataagatagcatatgtgcatatccttggagattttaaagctatctgaaaatgtgccatatttaaacatactgwacatagttaaaagacatgcatctgattaatgtaaaaactataccaatttattgtagtccacttggaaagacaagtagcttacttaaagatctattttgtt

SEQ ID NO: 35887 - DNA, 201 bp, Homo sapiens
atgtttagcagcataaggaatagaaacatttggagttttagctttagcttatacaatgcatcctgttttataattgttttccaacaatgtttacataatgkgagggtcactctttaacatgaggggctctgtcactagaattgcagtgtgttagcccctcattttctccagtgtttttgtaaatctttccattgacaatct

SEQ ID NO: 35888 - DNA, 201 bp, Homo sapiens
attaggaatgaacatgtctatcaagattcattttaaatacagggaggaggagagaggaagatggcaaggttgtgaaagagtgaatgaatgaatgaatgaawgaattatagaaagctatatgcttctgcacagctttgagattgagatggggagctgattttctcccttttgcaccttatttacatttctacttgaaatgta

SEQ ID NO: 35889 - DNA, 201 bp, Homo sapiens
tacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttgtctttggtg

SEQ ID NO: 35890 - DNA, 201 bp, Homo sapiens
ttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttgtctttggt

SEQ ID NO: 35891 - DNA, 201 bp, Homo sapiens
tttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttgtctttgg

SEQ ID NO: 35892 - DNA, 201 bp, Homo sapiens
ttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttgtctttg

SEQ ID NO: 35893 - DNA, 201 bp, Homo sapiens
ttttattaatcattcttgggtgtttctcacagagggggatttggcagggtcacaggacaatagtggagggaaggtcagcagataaacatgtgaacaaaggyctctggttttcctaggcagaggaccctgcggccttccgcagtgtttgtgtccctgggtacttgagatcagggagtggtgatgactcttaacgagcatgct

SEQ ID NO: 35894 - DNA, 201 bp, Homo sapiens
aactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaaaca

SEQ ID NO: 35895 - DNA, 201 bp, Homo sapiens
taactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaaac

SEQ ID NO: 35896 - DNA, 201 bp, Homo sapiens
caaatcatagctctgctacttgctagctgtaatcaggggcgagttacttaacacctctctgccttcttaataaaatagagataatagtggtatgaagctcrtgtggatgttttgtgtagcaaatcattgtaggaacagtgtctgacaatagtgcttggcacattgcaaacattcaacgatgctggctattatgattataat

SEQ ID NO: 35897 - DNA, 201 bp, Homo sapiens
gtaactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaaa

SEQ ID NO: 35898 - DNA, 201 bp, Homo sapiens
tagcttaattccctcttctttacttttcatacttcgggaacctcatttgcctcagcccttaggagttctacccttaacatttttattcgtgcagttatctmcacctttggaaaaaccaaatgcattttctgaagctataaataagaaaaatccctccctctgcccctcttaaatattacctcctcaaataaggtatgcaca

SEQ ID NO: 35899 - DNA, 201 bp, Homo sapiens
agtaactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaa

SEQ ID NO: 35900 - DNA, 201 bp, Homo sapiens
aagtaactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaattttta

SEQ ID NO: 35901 - DNA, 201 bp, Homo sapiens
ttgcaacctactcatctgacaaagggctaatatccagaatctacaatgaactcaaacaaatttacaagaaaaaaacaaacaaccccatcaaaaagtgggcraaggacatgaacagacacttctcaaaagaagacatttatgcagccaaaaaacacatgaagaaatgctcatcatcactggccatcagagaaatgcaaatca

SEQ ID NO: 35902 - DNA, 201 bp, Homo sapiens
aatatcgtgaaaatggccatactgcccaaggtaatttacagattcaatgccatccccatcaagctaccaatgactttcttcacagaattggaaaaaactastttaaagttcatatggaaccaaaaaagagcctgcattgccaagtcaatcctaagccaaaagaacaaagctggaggcatcacactacctgacttcaaacta

SEQ ID NO: 35903 - DNA, 201 bp, Homo sapiens
atgataacagtttccatttatcttctatgtcaaatcaaacaagtaatttgtcttttacttttctgattttattcatctgaaatgtggctagtagtctttaytgtatcctttgccatggagtttgttagtcattgtttgtaatagaactgttttccattcatctattcatttattatttaagtatttagtcagttacttttg

SEQ ID NO: 35904 - DNA, 201 bp, Homo sapiens
aggaaataacctctacataataattttttaatcctttaatttttttgtgggtacacagtgggtgtatatatttatgggtgacctgagatattttgatgtargcatgcaatgcataataatcatatcagggtaaatggggtatccatcacctcaaacatgtatcctttatgtttcaaacaatctgattatactcttttagtt

SEQ ID NO: 35905 - DNA, 201 bp, Homo sapiens
ttatttgatacaggctcgaattgcaaaattggacacatatttgtaggtcatttttatcttcatgcttgctctgataacttatttaggaaagagtgtaagakgtggtctcatggtttgcacttcttcatcagattacataaccagatagtagaaaaggatattttagtgtattactggcattcatttgattacgagggaaat

SEQ ID NO: 35906 - DNA, 201 bp, Homo sapiens
atgactctctagtttagtagattgggtgggggggtcataagaccaacaaaaaaaagtaagttaagtaatacagatttgggagttagatgataattattttsatttggaatgtttagcttaaagtacgcaaggaaaatatagatgatggtgtctcacctgttgaatgtggacttttaggcaaaaatcaggtccaagcataca

SEQ ID NO: 35907 - DNA, 201 bp, Homo sapiens
aaaatcacaaacattcttatacaccaacaacagacaaacagagagccaaatcatgggtgaactcccattcacaattgcttcaaagagaataaaatacctargaatccaacttacaagggatgtgaaggacctcttcaaggagaactacaaaccactgctcaaggaaataaaagaggagacaaataaatggaagaacattcc

SEQ ID NO: 35908 - DNA, 201 bp, Homo sapiens
cactgtgtgggtgatgggtccactagaagcccaaacttcactcttatgcaatatatccatgaaacaaaccttcatatgcaccacctggatctaaaattgtraaataataaaaataaaaataaagacattcggaacactaagctgaattggctaatgctataaactctaaagatagtaatatgcttggtagatgtacggtat

SEQ ID NO: 35909 - DNA, 201 bp, Homo sapiens
aaagtctcaggatacaaaatcaatgtacaaaaatcacaaacattcttatacaccaacaacagacaaacagagagccaaatcatgggtgaactcccattcayaattgcttcaaagagaataaaatacctaggaatccaacttacaagggatgtgaaggacctcttcaaggagaactacaaaccactgctcaaggaaataaaa

SEQ ID NO: 35910 - DNA, 201 bp, Homo sapiens
gtcagccccaaccctattttcccataagccctgttatttgtaagaataatttttatagaactcctggtgtttgtttgtttgtttgtttgtttatttgttgytttcaggaaaacacttatcacatttgaacataaagagcaatcattcctactaaagagcaggagtgatttcatggagaagatgtaaaagtgaggctaaaag

SEQ ID NO: 35911 - DNA, 201 bp, Homo sapiens
ggccagggcaatcaggcaggagaaggaaataaagggtattcaattaggaaaagaggaagtcaaattgtccctgtttgcagacgacatgattgtttatctaraaaaccccatcgtctcagcccaaaatctccttaagctgataagcaacttcagcaaagtctcaggatacaaaatcaatgtacaaaaatcacaaacattctt

SEQ ID NO: 35912 - DNA, 201 bp, Homo sapiens
aaaataataagagctatctatgacaaacccacagccaatatcatactgaatgggcaaaaactggaagcattccctttgaaaactggcacaagacagggatrccctctctcaccgctcctattcaacatagtgttggaagttctggccagggcaatcaggcaggagaaggaaataaagggtattcaattaggaaaagaggaa

SEQ ID NO: 35913 - DNA, 201 bp, Homo sapiens
gcaccatgaaagatttaattaaatgtaggcctttagtctaagggtttttcaacatcaaaatgttcttcaaaagacattttgatagcttctctctttaagaygtgcaaaaaaagacggtgagaaaaagaaagaaaaccaattttgtgtaaaaaccctgatttaaatacagttctggcttggacagactaggtgacattttaa

SEQ ID NO: 35914 - DNA, 201 bp, Homo sapiens
cagcctgggtggcagattgagatgctgtctcaaaaaaaaaaaagggggttatcttggtatccttgttacatggtttcaccaaaggagatgcttgggtaatytgtgcttttcactttcaagagactagccctctttatatgccaacatttttgggggggtatcaaaatatttggagtataaaaacaaaagcactgtaattgg

SEQ ID NO: 35915 - DNA, 201 bp, Homo sapiens
tgttaagtgtatgtaatcctcataccaattggagcaaaaacatttgcttcatttgcttgcatcaattggtcatatatatatatatatatatatatatctawctcaattggttatatagataacataagtatagataacataggtaacattcagaatagtcacttcactactttaagagctaattaggtattcatacagata

SEQ ID NO: 35916 - DNA, 201 bp, Homo sapiens
ttatgttaagtgtatgtaatcctcataccaattggagcaaaaacatttgcttcatttgcttgcatcaattggtcatatatatatatatatatatatatatmtatctcaattggttatatagataacataagtatagataacataggtaacattcagaatagtcacttcactactttaagagctaattaggtattcatacag

SEQ ID NO: 35917 - DNA, 201 bp, Homo sapiens
agaatctctgggacgcattcaaagcagtgtgtagagggaaatttatagcactaaatgcctacaagagaaagcaggaaagatccaaaattgacaccctaacwtcacaattaaaagaactagaaaagcaagagcaaacacattcaaaagctagcagaaggcaagaaataactaaaatcagagcagaactgaaggaaatagaga

SEQ ID NO: 35918 - DNA, 201 bp, Homo sapiens
cttatgttaagtgtatgtaatcctcataccaattggagcaaaaacatttgcttcatttgcttgcatcaattggtcatatatatatatatatatatatatatctatctcaattggttatatagataacataagtatagataacataggtaacattcagaatagtcacttcactactttaagagctaattaggtattcataca

SEQ ID NO: 35919 - DNA, 201 bp, Homo sapiens
catggaaactgaacaacctgctcctgaatgactactgggtacataacgaaatgaaggcagaaataaagatgttctttgaaaccaacgagaacaaagacacsacataccagaatctctgggacgcattcaaagcagtgtgtagagggaaatttatagcactaaatgcctacaagagaaagcaggaaagatccaaaattgaca

SEQ ID NO: 35920 - DNA, 201 bp, Homo sapiens
atgtatcctttatgtttcaaacaatctgattatactcttttagttatttttaaatgtacaattatttttttttttttactgtagttacccttgtgctagcraatactaaatcttattcaaactatttttgtatcattaaccatccctactcctccctgccactaaccttcccaacctctggtaactatccttctactttct

SEQ ID NO: 35921 - DNA, 201 bp, Homo sapiens
acttatgttaagtgtatgtaatcctcataccaattggagcaaaaacatttgcttcatttgcttgcatcaattggtcatatatatatatatatatatatatatctatctcaattggttatatagataacataagtatagataacataggtaacattcagaatagtcacttcactactttaagagctaattaggtattcatac

SEQ ID NO: 35922 - DNA, 201 bp, Homo sapiens
caacagaatatacatttttttcagcaccacaccacacctattccaaaattgaccacatagttggaagtaaagctctcctcagcaaatgtaaaagaacagarattataacaaactatctctcagaccacagtgcaatcaaactagaactcaggattaagaatctcactcaaagccgctcaactacatggaaactgaacaacc

SEQ ID NO: 35923 - DNA, 201 bp, Homo sapiens
catatccagtatgtatatgtaccacactttctttatccgttcatctgctgatggacacttaggtggcttccaaatctattgtaactagtgctgcaataaaygtgggagtgcagatatctcttcaatattcttttgggtatatatctaagagtggaattgatggatcatatggtagctctatttttggtgttttgaggaacc

SEQ ID NO: 35924 - DNA, 201 bp, Homo sapiens
gagaatgaaaccaagttggaaaacactctgcaggatattatccaggagaacttccccaatctagcaaggcaggccaacgttcagattcaggaaatacagakaacgccacaaagatactcctcgagaagagcaactccaagacacataattgtcagattcaccaaagttgaaatgaaggaaaaaatgttaagggcagccaga

SEQ ID NO: 35925 - DNA, 201 bp, Homo sapiens
atgatcagtgatgttgagccccttttgatatacctgtttttcatctgaatatcttcttttgagaaatgtctatccaaatcttgtacccatttttaaatagkattattagatttttttcctatagaattgtttgaattccttttatattctggttattaatcccttctcagatgggtagtttgcaaatattttatcccattc

SEQ ID NO: 35926 - DNA, 201 bp, Homo sapiens
gggatctcctgtattccatgcatgctcttccttgccttcattgtggaatagtagactgatttcaccttgatattctgggtcaattacccagccaacactgmaacccccttcttagcctgttgacttggaggtaggagggccccaattggccaggtggtaatcttaacttccagtttaatggaatcattgttgtatcccttg

SEQ ID NO: 35927 - DNA, 201 bp, Homo sapiens
aatgtgagttataccaccttttgcatcttgtagtgacaccatacagtgtagcctccaaggcagggaagagaaaaaatgaagagacatgtaggcccctaccrtactggctcatgaagcctggaccacgtctggtctgagtcattgaccagaagtagccgtgtgccccaagctaactgtaagggaggtctggaaaagtaggag

SEQ ID NO: 35928 - DNA, 201 bp, Homo sapiens
gggctgtgttccctgcaactgcaattcttttgggtctaagtcattcgactgtgaagagagtggacaatgttggtgccaacctggagtcacagggaagaaaygtgaccgctgtgcccacggctatttcaacttccaagaaggaggctgcacaggtctgtaaatatgacttaagtcctacatattcactctgatagttttagg

SEQ ID NO: 35929 - DNA, 201 bp, Homo sapiens
acaacaaagattataaacacttattgagtacttaatatacttatgttaagtgtatgtaatcctcataccaattggagcaaaaacatttgcttcatttgctygcatcaattggtcatatatatatatatatatatatatatctatctcaattggttatatagataacataagtatagataacataggtaacattcagaatag

SEQ ID NO: 35930 - DNA, 201 bp, Homo sapiens
agtttgagaccagcatggccagcgtggtgaaaccctgtctctactaaaaacgcaaaaattagctgggcatggtggtgggtgcctgtaatcccagctactcrggaggctgaggtaggagaattgctggaacccaggatacggaggttacagtgagctgagattgcgccactgcacttcagcctgggcaacagagtgagactc

SEQ ID NO: 35931 - DNA, 201 bp, Homo sapiens
aattttattttcagccattttttttccaagagaaaaagaaatctaaagacaagcattgtaggaagggttaggagacagaaatgttcattagtttaaatttmttttttttgtagttcaggtagtacattatttaaagtaatgaaaacccacaaactactcaagtaataattcctctagaaaaccaagccaaggctatgacgg

SEQ ID NO: 35932 - DNA, 201 bp, Homo sapiens
agcaggggcacactgacacctcacacggcagggtattccaacagacctgcagctgagggtcctgtctgttagaaggaaaactaacaaccagaaaggacatmtacaccgaaaacccatctgtacatcaccatcatcaaagaccaaaagtagataaaaccacaaagatggggaaaaaacagaacagaaaaactggaaactcta

SEQ ID NO: 35933 - DNA, 201 bp, Homo sapiens
agatctgagaatgggcagactgcctcctcaagtgggtccctgactcctgacccccgagcagcctaactgggaggcaccccccagcaggggcacactgacayctcacacggcagggtattccaacagacctgcagctgagggtcctgtctgttagaaggaaaactaacaaccagaaaggacatctacaccgaaaacccatct

SEQ ID NO: 35934 - DNA, 201 bp, Homo sapiens
tcctgtctttaagattttaataataccagggccgtgccctcgcctctatttccccacaaacactggtattataaaaatgaagaaagaattttattttcagscattttttttccaagagaaaaagaaatctaaagacaagcattgtaggaagggttaggagacagaaatgttcattagtttaaatttattttttttgtagtt

SEQ ID NO: 35935 - DNA, 201 bp, Homo sapiens
gacgtgtagagtacccagatttgactattgatgactcatattggtaccgtatcgtagcatcaaggtaaccaacttaataaagattaagataattaaatgayagaattttgaagtagtttcccagtttataagaaaactcctatttccatttcaataaggtaactgtgtatgcatgtaaacacatgtgtatgaattttatac

SEQ ID NO: 35936 - DNA, 201 bp, Homo sapiens
cgggaagctcgaactgggtggagcccaccacagctcaaggaggcctgcctgcctctgtaggctccacctctgggggcagggcacagacaaacaaaaagacrgcagtaacctctgcagacttaagtgtccctgtctgacagctttgaagagagcagtggttctcccagtacgcagctggagatctgagaatgggcagactgc

SEQ ID NO: 35937 - DNA, 201 bp, Homo sapiens
tcagcaaatcaaccttttctctccactttaatcctgtgcctcactttgcacacctgaagttagctttaaaattatgacttttaaatgcttgtcagattacrttcttacaaaaaggtattcacactccaaggcactggggaaagctgttttctttttttgtctagtttcatctagtactataaatggcctatattatcttga

SEQ ID NO: 35938 - DNA, 201 bp, Homo sapiens
ggcgcaccacgagactatatcccacacctggctcggagggtcctacgcccacggaatctcgctgattgctagcacagcagtctgagatcaaactgcaaggyggcaacgaggctgggggaggggcgcccgccattgcccaggcttgcttaggtaaacaaagcagccgggaagctcgaactgggtggagcccaccacagctca

SEQ ID NO: 35939 - DNA, 201 bp, Homo sapiens
aaaatttcatctctaataaaaaagtaatttggggaacatttaggaaaaaagcaaaatatataaagcaatgtaaacaataacttttaaacttgcttgtttaraaaatcactggggtacaggttagtcagcctgataaactctaacttgccttcacacctccctcctccagcagagcctcctctgacagccaaacatctaggc

SEQ ID NO: 35940 - DNA, 201 bp, Homo sapiens
catcttttacagccaactctttcaatgagttcaaaaatttcatctctaataaaaaagtaatttggggaacatttaggaaaaaagcaaaatatataaagcaatgtaaacaataacttttaaacttgcttgtttagaaaatcactggggtacaggttagtcagcctgataaactctaacttgccttcacacctccctcctcca

SEQ ID NO: 35941 - DNA, 201 bp, Homo sapiens
ataattgtgccatggcagaatacagaagtcccttctctgaagacattttattccttaaaggactccctttgattttttttcagtgggccatttgatgcttrattgccagttgctctgtgcagaagagaaggggtattttattccataaaataacttgcagtgaattattcctttttattttcacaactgactctcattctc

SEQ ID NO: 35942 - DNA, 201 bp, Homo sapiens
gtcctaacatctactcccctggcctgcttgagtctcaactaaaatattgacatttgccatcacacattttgctttagctgttatggccatgctttgtcacrttaataagatgaaattgtttggttaagcatactgctattctaattctgtgtgtgcacgtgtgtgcatgcatatacatgcacactaattttgttctatgca

SEQ ID NO: 35943 - DNA, 201 bp, Homo sapiens
taactcaggtgaacttcctttgctagcatcggtatctatcagtatctgcctgaacctctgtgtgtgtggacctactatgcattgcaaaaggataccgtagyttaattccctcttctttacttttcatacttcgggaacctcatttgcctcagcccttaggagttctacccttaacatttttattcgtgcagttatctccac

SEQ ID NO: 35944 - DNA, 201 bp, Homo sapiens
ttagctatcttaagcaaccaacccactcacaccactagtaaaaggcagagtaagaattttattctagcgagtcagactccaaagtctgactccttatctcyggaacactctgcctttccaatttattctacttttaatagaccatggtaggctattgagagtgtttccagtttttcactattagaaactatactctgatga

SEQ ID NO: 35945 - DNA, 201 bp, Homo sapiens
cttcctccctgggacagatgccacaacctgtgattcagagactaaaaaatgctcctgtagtgatcaaactgggcagtgcacttgtaaggtatgtgctgctracatgcagctagggaaaacctccctcaattctgtttccattgctcagttttaacttcattcagtgtttgttatacctgcttcattaagctaaacaaacag

SEQ ID NO: 35946 - DNA, 201 bp, Homo sapiens
ttggcactaaaacccagatatctaaattccaactgctatttcaccttctttttgtttgtttgtttgtttgtctgttttttgagatggagtttcactcttgytacccaggctggagtgtaatgtcacaatctcgtctcactgcaacctccacctcctgggttcaagcaattctcctgcttcagcctcccgagtagctgggat

SEQ ID NO: 35947 - DNA, 201 bp, Homo sapiens
attgtagatgccattcagtagagtgattaagaggatagactctggagccagattgctttggttcaaatcatagctctgctacttgctagctgtaatcaggrgcgagttacttaacacctctctgccttcttaataaaatagagataatagtggtatgaagctcatgtggatgttttgtgtagcaaatcattgtaggaacag

SEQ ID NO: 35948 - DNA, 201 bp, Homo sapiens
gtacctgaatctgcgtaactaattgggagaatgggaagttaactttatttttccaagaaaaagaaacaaaatcaatatttaaattttggaaaacataattrttaaattatttttcatattgtgtagattcacatctctttaatcaatgggagaccaagtgccgatgatccttctccagaactgctagaatttacctccgct

SEQ ID NO: 35949 - DNA, 201 bp, Homo sapiens
gttttctcagaaatatacataaatttttagaggataatgaaactatgagttaatcaataaatatgtctgagcacattcctttagccattccagggtgtgayatgagaaaactgattcacacgcactgagcactcaataataagtacttactatgcagtagactacagagatgaataatgtagtttttattcttaaagaatt

SEQ ID NO: 35950 - DNA, 201 bp, Homo sapiens
cccctgaaatctcacatgatggacataattcaagtttatgtctcacatcacaacacaatgtgagttataccaccttttgcatcttgtagtgacaccatacrgtgtagcctccaaggcagggaagagaaaaaatgaagagacatgtaggcccctaccatactggctcatgaagcctggaccacgtctggtctgagtcattga

SEQ ID NO: 35951 - DNA, 201 bp, Homo sapiens
aatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgagctgcagatccatga

SEQ ID NO: 35952 - DNA, 201 bp, Homo sapiens
gatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgagctgcagatcc

SEQ ID NO: 35953 - DNA, 201 bp, Homo sapiens
agatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgagctgcagatc

SEQ ID NO: 35954 - DNA, 201 bp, Homo sapiens
ggatatatctatcttgtgccatttcaatgggcatgtgacaaaggaaaattacactgtcattgtgttcccagtcgacccttgctactctgctgcttccattmcctcattgtgagtcctgcttttgccaaactaattctagcacatttttcttctactctatgaggaggagatgagaaagggagagccagacttaaagacgta

SEQ ID NO: 35955 - DNA, 201 bp, Homo sapiens
tagatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgagctgcagat

SEQ ID NO: 35956 - DNA, 201 bp, Homo sapiens
ttactccaagataaatgatggcatatgttcacccaaaaatttgtacacagatgtgtacatatccctatgatgaaataattaccaataaaaaggatcaaatrtggatacacacacaacatagataaatgttgaaactatgttgagtgaaagaagccagacaaaaagagagtacatgcagaatgtttccatttgtataaaatt

SEQ ID NO: 35957 - DNA, 201 bp, Homo sapiens
ttcccaatgtctttcttagatgattaggtagttgaaagacgctactgtttacgaggcattgctaaaagcttttgggttccatgagggagagggccatgacmtactcctttgtacatttccccactcctccgtttacatcacataaacatatatgtatggtcttccatgcagtcagccaaatcagacaaatcatgcctagga

SEQ ID NO: 35958 - DNA, 201 bp, Homo sapiens
tgacagatagatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgagc

SEQ ID NO: 35959 - DNA, 201 bp, Homo sapiens
atgatggaaggctgctgtgtatgcccaactttatggctagatgggtcagaaagcatccagttcatgaaaggcagtttaggttgcatggtgacttgatgacytacagtcaaacattcagtttctaccaaagcccagtaacaggccaagagttgtctctcaaatggagagtagtgatctgcagaagatggcagggccttgctc

SEQ ID NO: 35960 - DNA, 201 bp, Homo sapiens
ctgtgtaatcttaggtaactctttgaagtttagtttccgcatctaagaatgaggaagtataaatacatatctgcccacgttggttgtattaaatgagatamtttacataacacatccgactaaggtgcagatgtaataaatgacagctgttattatcatttatttcagcacgttgcagaaagcaacttacaatttcttctt

SEQ ID NO: 35961 - DNA, 201 bp, Homo sapiens
tcactgctgtctatgatgctggggttccagggcatttgtgtgatggacaatggcataaagtcactgccaacaagatcaaacaccgcattgagctcacagtygatgggaaccaggtggaagcccaaagcccaaacccagcatctacatcagctgacacaaatgaccctgtgtttgttggaggcttcccaggtgagtgttggc

SEQ ID NO: 35962 - DNA, 201 bp, Homo sapiens
atgacagatagatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtgag

SEQ ID NO: 35963 - DNA, 201 bp, Homo sapiens
tgatcatgtatataccacttacagttgatgatggaaggctgctgtgtatgcccaactttatggctagatgggtcagaaagcatccagttcatgaaaggcartttaggttgcatggtgacttgatgacctacagtcaaacattcagtttctaccaaagcccagtaacaggccaagagttgtctctcaaatggagagtagtga

SEQ ID NO: 35964 - DNA, 201 bp, Homo sapiens
gatgacagatagatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagtatctgtga

SEQ ID NO: 35965 - DNA, 201 bp, Homo sapiens
ttattctgaaaacagtaattttcaatatactattttcttataaccactttaaagaaattaaggacttgcaggttgtctggttttttactatttttcttatscatagcaaggttggtgctcaataatactagatgagcaactgaatgaagagatgacaaaaataaatgaatttattaccactgcatgttaaagaagtgtact

SEQ ID NO: 35966 - DNA, 201 bp, Homo sapiens
taatgaaactatgagttaatcaataaatatgtctgagcacattcctttagccattccagggtgtgatatgagaaaactgattcacacgcactgagcactcrataataagtacttactatgcagtagactacagagatgaataatgtagtttttattcttaaagaattacgctaatatgtaagaaacaattagacagcatca

SEQ ID NO: 35967 - DNA, 201 bp, Homo sapiens
aattaaggacttgcaggttgtctggttttttactatttttcttatccatagcaaggttggtgctcaataatactagatgagcaactgaatgaagagatgayaaaaataaatgaatttattaccactgcatgttaaagaagtgtacttttttatgcttgtctttgagaaaagtgtcaaggtggcatacatgacaaaacacaa

SEQ ID NO: 35968 - DNA, 201 bp, Homo sapiens
attgatagatgacagatagatgaatggatggataggtggataataggctggtagatgatagatggatgatagacagattagatagatagatagatagatagatagatagatagataatagattagatgatagacagaaagaataagagatttattatgaagaattggcttacgtgattatggaggctgcaaagtcccagta

SEQ ID NO: 35969 - DNA, 201 bp, Homo sapiens
agcttatttgtgccactctttctttaattctgcacaagaagggcctgttaggcaaagggatgtagcgtatctgaaattgtgttgggagcccaggctctttsctcaatcaaactaatgcacttttaaaactgtgcatgaattttgctacccacttaatttatgaaagtgctattagtctgcagggttccttacaacattcct

SEQ ID NO: 35970 - DNA, 201 bp, Homo sapiens
gtccctgctgagcaaaagacaaagacctccttctccattgtcccgcactgatggtgggcttgggatgtattttcagaaataattatttgcagggaacttayaaaaacaaatgaatcaccctcatcactgtgcttgttccgttttgggatgtttgtctactagactttctaaattgggagatttagaaattcagtaagaaag

SEQ ID NO: 35971 - DNA, 201 bp, Homo sapiens
attggctacagcacattaattagtatataattacacatctggccatttcttcttccaagcaagtgcacaaccaggtgccctgctcaaaattctgccccctrggaagacttccctttgctactgtccttcagggatgtcctagaaaggggctgtagtgctgcagctgtccacttttgggtgctacctgcatatcttgcagaa

SEQ ID NO: 35972 - DNA, 201 bp, Homo sapiens
tcttccaagtccctgaccatccagccaaaccattggctacagcacattaattagtatataattacacatctggccatttcttcttccaagcaagtgcacarccaggtgccctgctcaaaattctgccccctgggaagacttccctttgctactgtccttcagggatgtcctagaaaggggctgtagtgctgcagctgtcca

SEQ ID NO: 35973 - DNA, 201 bp, Homo sapiens
agtagtaaattataaacaatatattttgaattcataattaaaattaacgagtcaattttctgaggcattgacctattaaagatttatgagttacctaaaaycccaaatcttccctgaggtaatagcttcagttgagataaagggaaggtatcttatttgtcgcttcactgcaggaaaaaataaaatttgtgattatgactc

SEQ ID NO: 35974 - DNA, 201 bp, Homo sapiens
tattgaaggaaataaacttttttctaaccatatttatgcaatcaatatttattaggtagtttttgagaaaatcttatatgagaacttattccttgtatacmaaatgtttcatggaacaccaccagcatagacatttttgtttactctgtgcaactggatttcgttctggggagcttcaatttgtacatgagctcattttca

SEQ ID NO: 35975 - DNA, 201 bp, Homo sapiens
gaacaaaaaggacgaggcaataccttcttaacactgataattaaataagataagcttaaattataaaatcagcacagagggaatgtaaattggttcaaccrttatggaaggaaaaaagtaggaaggttcctcaaaaaattcaaaatgggactgcgaggccgggtgtggtggctcaagcctgtaatctcagcactttgggag

SEQ ID NO: 35976 - DNA, 201 bp, Homo sapiens
acacttcattcactgaactataataaaattcacttcaaaaggaatgtgaacaaaatgaaagaacttggatataaaggggcaaaagtgaacaaaaagatagraaatgtgtacaaatctaagtaagcattatggaaagcataatgataataattattaaatatgtggaattaaaaacaaagtggaactaaaacacaagagact

SEQ ID NO: 35977 - DNA, 201 bp, Homo sapiens
cttctctgcctctgtcaactgatcatggggaactccctgtgaggccatcagtgcaggcttggggagagaaggcagggtggcaggagtggaggccatgggcrtttgagccacttcctcatgcaactgacttgtgcctttaggactggctcgagcctgatcatgtatataccacttacagttgatgatggaaggctgctgtgt

SEQ ID NO: 35978 - DNA, 201 bp, Homo sapiens
aaagaaatcaatattattagattatgcgtgatcattattttctaggtggttttctaaagttcctgaaaggtcattcagagcattgggaagaagaaatttgsgatagtagtaaattaaaagcaatttcaccagtgcctgtacgaaataattgaatggggaatgaccttgggttgtctgtttgcaagaatataaatgtctaat

SEQ ID NO: 35979 - DNA, 201 bp, Homo sapiens
acacgtgaacactggctatgggagaaacagtaccatattttggacactgattcaaggcatacacagccttctggagaactttgccccagtccggcaaagtwttgtcacctagttggcattgtaattatgacttcaaaagggcattccacaattctatcaatccacctgcttcaggatgatgggaaacatgataagaccagt

SEQ ID NO: 35980 - DNA, 201 bp, Homo sapiens
ccttggtgacagcattcttccctctggaactaagatgtctaggccagcagaacataatgttgtgggaacaggaagcaaaattttgctagtgggtcactagyggtgatggtgagtggtgccacttccgcttccaccccttgattctgggacacgtgaacactggctatgggagaaacagtaccatattttggacactgattc

SEQ ID NO: 35981 - DNA, 201 bp, Homo sapiens
tgtgacaaataccataaactgattagcttataaacaatagaaatatatctctcacagttctgaggctgggaagcccaagatcaaggtaccagcaatgttcratgtctagtgaaggcctgttcctcacagagggtgacttcttgctatgaccccacatttaattcatttaatatctggatactgaggaaaaggatagctagc

SEQ ID NO: 35982 - DNA, 201 bp, Homo sapiens
agagaatcattttcaaatcctgatttctgttaattatgaacacactagctatatggcctttctgtggataggcttaattaggagggtctgggcaaagcttygctacagcagcatcaaaagtctgatttacaagtagactcaaatatggcttagtaggaagtgaacatagccctaggctacacttagaaaaaattattttct

SEQ ID NO: 35983 - DNA, 201 bp, Homo sapiens
ccatgtgtttaccttataacttcatgagctagacttgtacagaagctttgaaaaaatccccatggctgtcatattcataagtctctctgacccattcagasagatgttagtatattgcttggagcgtactataaaacttacctttcacttatggaaatgtgcttgtactttgttccccaaaaagcaaatacagataccata

SEQ ID NO: 35984 - DNA, 201 bp, Homo sapiens
aatcaatatcttacagtttacttgtaggaaagatgatgaagtaaatatacatttatgcagctgaacacttgaaatctacaagaggggtaaaaagaacaaarattctgtaataataccagaaaagagctataacctcatacctaggcacaaggacatacatgtgcaaagtatgaggatatgaggaactaattaattttccaa

SEQ ID NO: 35985 - DNA, 201 bp, Homo sapiens
gtgagaccctgtctgtatcactccgttttcacactgctgtaaagatactacccgagactgggtaatttataaaggaaagaggtttagttgactcacccttbtgcatggctaggaggcctcaggaaacttatgatcaaaggggaagagggagcaggcacatcttacatggtacaggagagagaggagaaagtgaatggggaa

SEQ ID NO: 35986 - DNA, 201 bp, Homo sapiens
gcctaagagatcctaatgacatgtatacctatgaagtggcattgtttaaatagataggcttttcttggtctaagttggtttcttaaatttcctagtctatwccattaaataatgactttaattctctattctttttgctatgttagtaagtttgaagtttcattttaaaactaaacatgtgggccaggcacggtggctcat

SEQ ID NO: 35987 - DNA, 201 bp, Homo sapiens
catgctcctataatcccagctactggaaagaagctatggtgggaggatctcttgagcccaggagtttgaggccagcctgggccacatagtgagaccctgtstgtatcactccgttttcacactgctgtaaagatactacccgagactgggtaatttataaaggaaagaggtttagttgactcacccttctgcatggctagg

SEQ ID NO: 35988 - DNA, 201 bp, Homo sapiens
tagccactgctatgactatcttatcagcaatgcagagcttgcgtttccagcctccaagtgttatgctacaggtcactgttttttttaaactcttacctgartatgcttcgacctacttctttattttaattctttctttcttttgaggttagaaacaccatgctttaattgctgtaacccccaaaagaaatataatattga

SEQ ID NO: 35989 - DNA, 201 bp, Homo sapiens
gaacagtatttactacctgctgttccttttcactatttgcagtaccattcttagactcactgcaggcataaaccctgggataaggaaaagttaagcctccrttcttcatacctctaataaggctttgccaatggctgcaatcattttacaaccatccacttatgtttaggtttaacagagtcttggcttcataatgaaata

SEQ ID NO: 35990 - DNA, 201 bp, Homo sapiens
ttcctctatactgcctaggcccagaatctaaattagatcaaatttcaaaagatatttcttatgaaagctgatttatacacgcacacacacacacgcgcgcrcacacacatattcatttaacaaagaaaaaacatacagctttagcaggttgggaagtggcatttattaatatcatcttcattttaaaaagtgagtacaaat

SEQ ID NO: 35991 - DNA, 201 bp, Homo sapiens
acaattatacttagatgggccatctaaaatgtccttccagcttgtggagtaggttgtgtttgtttttcaatgaacatctgtttgacaaattgaaatgctarttatgatttatcatttccatgacatcaaatatccagatagtaataaacgttgatgactaactatatttttcagtttcagccagatgtttggcatcacgta

SEQ ID NO: 35992 - DNA, 201 bp, Homo sapiens
gaatgaaattagtactggatgattggattaaaagccagtagaaattatatattatcctatttaaatgtaggactatataagttattggtaatcctttttcrtaattttattactttttccagtacctaagtggatactggtgactggtatataataagtaaccaatgaatagatattgaataatgcattgctttgctcaat

SEQ ID NO: 35993 - DNA, 201 bp, Homo sapiens
ttcagtaatatgtgaaagtaagagtggtaccataaagttcagtcaagtctagactagaaaaatatccaaagcagtttagactacgaacatcttttttttttcttttcttttctttttttttgagacagaggctcgctctgtcgccaggctggagtgcagtggcgtgatctcggctcactgccaagctgttgaccttagtta

SEQ ID NO: 35994 - DNA, 201 bp, Homo sapiens
ttgctgaacacactaagatgtagctttctctataacctcctattcaactgtcagcaaatcagtaaaagtaccctgagaggaaaatggctagcttaccttawtttgcttccctttacttaagtctggctgccttggttgcttgctgatgccttcaaactgctgtttttagtattttatccagcttttatggttgttgtcttt

SEQ ID NO: 35995 - DNA, 201 bp, Homo sapiens
aaaacagcaaatttataaaagtagtgtgtcagtttgataataattgataatcaaattctaaacacctctttcagccctgcagtaagacaactttgcactayaggcagcaggtaaacagagaagggaaaacaagaaatttcacaagttttctatttggttattaaataggaatcgtacttcaactcagttcacgtttccacc

SEQ ID NO: 35996 - DNA, 201 bp, Homo sapiens
caccagtttgataaacactgttctaaattgtggttaaagcttttggtagttaacgaggtaggagaaaacattaaagaaattggggttgtttcacctgatgraaaaagatgaaaggtgtcaacttactatcagtcaattatcagatatttattaagaaattatagaatacctcagcattgcacttggttccctggggatttc

SEQ ID NO: 35997 - DNA, 201 bp, Homo sapiens
aaagatttaacagtggtgtctgcatttgataaaatgtaaatgagaagctcccaaaagagattgagaagctctattttgacaactcttcttttatctgtgtwattattatatactttaactgaagaaagaaaaacacaaagataaatacaatatttcaacttcgagtactttttaaaaattatttgaaagcatttaaaaata

SEQ ID NO: 35998 - DNA, 201 bp, Homo sapiens
atttgaattacccgtgcattactgtttcatatattcatggtactttcatattttataacatttaaaaatatttcaatattccattgatttgaataagattytttaaattacagtgaaagctttctgataaggtatggtaagattatttttcagtaattatgctgatacatataataaagctactgacaattcataaagatg

SEQ ID NO: 35999 - DNA, 201 bp, Homo sapiens
ctggcctaaatcagttttattatgtcacttaaatatgtgcaaacataaaatcaggtataaactctttatacttatagctctataaaattaaaacaaattartccttacaaaaccaataaaattcaaattaaaaacattaatataaagtaacatgattttggctgaatggaaattgctgcttgcaacaagaataggatattg

SEQ ID NO: 36000 - DNA, 201 bp, Homo sapiens
ttatttttcagtaattatgctgatacatataataaagctactgacaattcataaagatgataatacacttagtacaaactgagcttcaatgggattactaratgagtatgtgaggacagagcagaggaaaaggccaagggttgagcactgtggtgctctattatgagaaagttaggaaggattaaagttggcactgaaggg

SEQ ID NO: 36001 - DNA, 201 bp, Homo sapiens
tcagttgatctccagatgctgattactgatctaacactttgcttgttgtaccccctaaatgtcatcctctctctgctcgtactcactgctcaagtaagttyttatttgaaaggacagtaagtatgtcatagttttctatagtctaagctgtgtcatgttgttcacatccaggtgttaggcaatctataaaacatcttctgt

SEQ ID NO: 36002 - DNA, 201 bp, Homo sapiens
ttaacaattttggtttggttcaatttgttgcataggtaataataatccatttacagaatacaaaaatagtgtaagtatgtgcttcttcctatctgtatgtygagagattcctcattcttttttatggttgcagataattcattatgcagatatacaatttatttaaccagtcccatattgatggatattaggttatttcca

SEQ ID NO: 36003 - DNA, 201 bp, Homo sapiens
tttagccagtatattcaacattaatgaattcagccctttattcatttactgcttccatgtttagagcccattctacctcgattaaaaataaatataaaackagctaaaattacaaaatgagaaattttaagtgtatgtaatctcagtaatgacatttattttctgctaatcattgagactcctctaagatttaaaacatta

SEQ ID NO: 36004 - DNA, 201 bp, Homo sapiens
tttacagaatacaaaaatagtgtaagtatgtgcttcttcctatctgtatgttgagagattcctcattcttttttatggttgcagataattcattatgcagwtatacaatttatttaaccagtcccatattgatggatattaggttatttccagtcctttgatgtgaccaaaaaagattataataaaaaatgctgaaagaat

SEQ ID NO: 36005 - DNA, 201 bp, Homo sapiens
tgcacccctagaggcctaggaatcaactccctccttcttgccatatccaaaaatattaacaacattttgaggggagccttaaaacaagctaatcgaccccmaaaaaacacatagatcccaggcatcagagaaggagaattcagtcttcaagaccactcccagctgggccttcctgctttcttctgagcctaaacccagtga

SEQ ID NO: 36006 - DNA, 201 bp, Homo sapiens
gtagatcctctaagaatctgtatatctctaagccaatatctgtataacttaaaaattataaagctgtattttaaaatatactctgttctttaaatccaaarctcactgacatttttacttaatatgaattaatgaggtagtattatacatttaaatacatatagtaacaaattataaatgagaccaagaatattattttaa

SEQ ID NO: 36007 - DNA, 201 bp, Homo sapiens
tcctgctgtctcttgtgggcatttagtgctataaatttccctctacacactgctttgaatgtgtcccagagattctggtatgttgtgtctttgttcttgtyggtttcaaagaacatctttatttctgccttcatttcgttatgtacccagtagtcattcaggagcaggttgttcagtttccatgtagttgagcagttttga

SEQ ID NO: 36008 - DNA, 201 bp, Homo sapiens
ccaacactatattgaataggagtggtgagagagggcatccctgtcttgtgccagttttcaaagggaatgcttccagtttttgccaattcagtatgatattygctgtgggtttgtcatagatagctcttattattttgaaatatgtcccatcaatacctaatttattgagagtttttagcatgaagtgtggttgaattttgt

SEQ ID NO: 36009 - DNA, 201 bp, Homo sapiens
cattttaaaggtataatttcttttttgtttgtttttttcgtttttttattttttatttttatttttttcttttattattatactttaagttttagggtacrtgtgcacattgtgcaggttagttacatatgtatacatgtgccatgctggtgcgctgcacccactaactcgtcatctagcattaggtatatctcccaatgc

SEQ ID NO: 36010 - DNA, 201 bp, Homo sapiens
tttttcctttgtctctatctccctagatagaaatatgtggaggttggatttcctgctgagtttctttatttttttcctttcttttttttttttttttttttaagatggagtctcaccctgttgcccaggctggagtgcaatggcgtgatcttggctcactgcaacctccgcctcccgggttcaagtgattctcctgcctca

SEQ ID NO: 36011 - DNA, 201 bp, Homo sapiens
ttttttcctttgtctctatctccctagatagaaatatgtggaggttggatttcctgctgagtttctttatttttttcctttcttttttttttttttttttttaagatggagtctcaccctgttgcccaggctggagtgcaatggcgtgatcttggctcactgcaacctccgcctcccgggttcaagtgattctcctgcctc

SEQ ID NO: 36012 - DNA, 201 bp, Homo sapiens
caagagaagcatacacattctaaagcatttcaaatgtttattatgatgtcctagaggtggctgtctttctgttgctgtgcataccctgagcagacttgacwttgctttggaagcacatattttctgatagacatattactctcataatctaaaatttttcagaagtgacaaaagtggggttgaccattttcttcttcgctg

SEQ ID NO: 36013 - DNA, 201 bp, Homo sapiens
aggaggctgagatgggaagattacttgaacccgggaggtcgaggctgcagtgacccatgatcacaccactgcactttagcctgggcaacagagcaagaccytatctaggaacaataaaaaattcattattcattatttgatccaaaacaaaaacatgttatagactatctatagattcaattttcaaaaatcctatgcttc

SEQ ID NO: 36014 - DNA, 201 bp, Homo sapiens
cacagctataatcccagctctttggaaggccaaggcaggaggatggcttgaggccaggagttcaagaccagcttaggcaaaatagtgagatccctgcctcyacaaaaataaaatgaaaaaattagctgcgtgtggtggcacatgccagtggtcccagctactcaggaggctgagatgggaagattacttgaacccgggagg

SEQ ID NO: 36015 - DNA, 201 bp, Homo sapiens
ttgcaatggaagtcctatcggccagtttactagttaacaggagctgtagtactagagctatgactgcatcagaagtccagcagtgtgggcacaaagcagcrcagcacttttgaagttagacatcgagagtttgagtcctagattcacaccttgctggctgagtgctgttgcaatagtgctgttgagtgagttatttaactt

SEQ ID NO: 36016 - DNA, 201 bp, Homo sapiens
tctttggcccctaagtggaacaagttttgagatcttattttatgctccagagcactccatggaatcaggctaagactgggacatcacctgaaatcataccyttgattagagcttttcttttccatgtcctgcttcacccactcctttgctagattctcctaggaacacttaaatggtaagcttctttgtaaatataaacta

SEQ ID NO: 36017 - DNA, 201 bp, Homo sapiens
tgatttcagatgtatagatatattgcttatcaaacactgatgggtctgaacatgagtggtagtaagatatttccagattaagtagacaaattgtgcagaaytttttagtatcactatttaaatgactaaatttttgaggtttatgtgtatccagcccaatatgtcctctccttatctagtataatttatctttaaaaatta

SEQ ID NO: 36018 - DNA, 201 bp, Homo sapiens
catccagctaccatttcaaaaaacagcaaatttataaaagtagtgtgtcagtttgataataattgataatcaaattctaaacacctctttcagccctgcaktaagacaactttgcactacaggcagcaggtaaacagagaagggaaaacaagaaatttcacaagttttctatttggttattaaataggaatcgtacttcaa

SEQ ID NO: 36019 - DNA, 201 bp, Homo sapiens
tgggaggccggggcgggtggatcacgaggtcaggagatcgagaccatcctggctaacatggtgaaaccctgtctctactaaaaaaaaaaaaaaaaaaaaaagcaaaaattagccgggcgtggtggcgggcgcttgtagtgccaggtactctggaggctgaggcaggagaatggcgtgaatccgggaggaggagcttgcagt

SEQ ID NO: 36020 - DNA, 201 bp, Homo sapiens
ttttttgtgtgtgtttctatacaattttagaatcaacttgtcaattacagaaaatattaggattattgcttagactctatatacaaatatggaaaatggakcttgaggagatgttggtcaaagaatataaaatttcagttagatagtaggaatacattgaagatatttattgtacagcatggtgactgtagttaataacaa

SEQ ID NO: 36021 - DNA, 201 bp, Homo sapiens
agtgagccaagatggtgccactgcactccagcctgggcgacagagctctgtctcaaaaaaaaaaaaaaaaaaaaagagaaaaagaaaagaaaagaaaagamaagacttgtaccttgtcatattggaaaaccagattcatttcacattgttataaaatctgtaaatgtcacaatataatttcaaatataacaccaaaaatgt

SEQ ID NO: 36022 - DNA, 201 bp, Homo sapiens
cgtgaatgtccttggatgtgtatggtctcttgcttgaagttatcagccagcaaaatggtgaaatacttagaattaatcaaacatctggaggtcaagaaacrcagtacctatattcttctccttactttaagaatgaaactaataaaaaataaggcggagctggcccttcagcaaaggagggatttttattatatgagtgaa

SEQ ID NO: 36023 - DNA, 201 bp, Homo sapiens
gcgggaggtaagtgaactaacagtaactagtacacacacataggtagtaagtaggtagatagatagatagatagatagatagatagatagatagatagatacagaaggaagatattttcatttaatcattgctacaccctgtagtcagattatttctcctattttttttttcacatgggaatattgaagacttagctagct

SEQ ID NO: 36024 - DNA, 201 bp, Homo sapiens
tggatgaacaagataagtctatttatgtcccagaagcttcccatcaacattgtacttacagtttctctctttattaataaaatgtgtggcaacttttgaamcctttcagatgattgtggcaccatttagtgtgccccactaaaactttactgaaaaataactgaaatgtttttctttacccaacagagagacttctaagat

SEQ ID NO: 36025 - DNA, 201 bp, Homo sapiens
agcgggaggtaagtgaactaacagtaactagtacacacacataggtagtaagtaggtagatagatagatagatagatagatagatagatagatagatagatacagaaggaagatattttcatttaatcattgctacaccctgtagtcagattatttctcctattttttttttcacatgggaatattgaagacttagctagc

SEQ ID NO: 36026 - DNA, 201 bp, Homo sapiens
tgcaggcctattatgcaatactcctcaacaggggccgtctggaagtgcatctctccacaggggcacgaacaatgaggaaaattgtgatcagaccagagccraatctgtttcatgatggaagagaacattccgttcatgtagagcgaactagagggtaacaatagcactaaaatatttattattgtaactcaggtgaacttc

SEQ ID NO: 36027 - DNA, 201 bp, Homo sapiens
ttctattgacacttagaagatgctatgttcacgtaatcatagaaagcttttaattaaaccctctactctttggttttaacttttctttattgatatatatmaaaaatctatttttgtgtcaaaatagcattttaaaggttactgtcattaaaactttaacaactaaattatgtacttgttttagaaatgttgatatgtggc

SEQ ID NO: 36028 - DNA, 201 bp, Homo sapiens
atgtacttactatgatgaaaatgagaaaaataaatagcaaaaataaattgtagtgtttcctttaatctgataaaagaaacagttaaagtggttgaaatagwtcttcatgtataaaccatgataaatttcagaaacttcaggtggaaaaaacaatgtcattatggtattatttatatcaagttgtaaaacataaaacaatgc

SEQ ID NO: 36029 - DNA, 201 bp, Homo sapiens
tagcgggaggtaagtgaactaacagtaactagtacacacacataggtagtaagtaggtagatagatagatagatagatagatagatagatagatagatagatacagaaggaagatattttcatttaatcattgctacaccctgtagtcagattatttctcctattttttttttcacatgggaatattgaagacttagctag

SEQ ID NO: 36030 - DNA, 201 bp, Homo sapiens
gttacctctagagaaacaggaaagggaataaaacagaagtgaaatgagattcatttgtatctaagtatcattgctttaaaaatatatctgaggcaaatatraaatataaatattttgttacctctaggttgcatgggtaatgcatgttatatgtgctttttgaatgtcttaatataatttctaatttaaaatttctttaat

SEQ ID NO: 36031 - DNA, 201 bp, Homo sapiens
atagcgggaggtaagtgaactaacagtaactagtacacacacataggtagtaagtaggtagatagatagatagatagatagatagatagatagatagatagatacagaaggaagatattttcatttaatcattgctacaccctgtagtcagattatttctcctattttttttttcacatgggaatattgaagacttagcta

SEQ ID NO: 36032 - DNA, 201 bp, Homo sapiens
ataatttgatattgataacagaggaagttaaattattcaaagagctcaaccataaagcagatggcttcactttcaagctgggaatcaaaaaactttaagtsctagaatattcatgtcaagaggatcttccaagaataagccaggaatgcaattaggggctgactcatggatgacaatggtcgatgagtcacaaagaaattt

SEQ ID NO: 36033 - DNA, 201 bp, Homo sapiens
attatacagtgcaatgccctctaccttggtatagtggcaagcatgaactctgcagtcagagtgccttgattcaaatcctggcttcaccccttactggtagygtgagcctactcaatttatttaacctgaatgaggtcttagtttcttcatttatataatgaaaacaataatagtggctactcacagagtttttgtaaggat

SEQ ID NO: 36034 - DNA, 201 bp, Homo sapiens
tctcattctatctatgtccacaagttgaatttttaaaccatgcttcaaggatcaggtcaaactccactcctgtcataaagcttccttaagccttatagcaraaattagtgcttcctctatgttcccgtaattatttatttctcagatgcacttaccatattccaccttgcattatagttgattgtgagtatatctttttac

SEQ ID NO: 36035 - DNA, 201 bp, Homo sapiens
atagcaggatttccttctcttttatggctgaataatattcctctatctccctctctccctctctttctgtgtgtgtgtgtgtgtgtgtgtgtgtgtgtgtgtctgtgtgtctgtgtatgtgtgtatactatatttactttatccattcattcactgatggatacttaggccatttatttatcttgactgttgtgaatgatg

SEQ ID NO: 36036 - DNA, 201 bp, Homo sapiens
ggctggttgaaacacttttaacttatggccagtttcttatatttaacagaactctgaatgctattacaaaaaatgtgtaaatgtctaaaagacattttcartgaacatgtattttaagagacagagtatgttgcataaaattcaatagctgtaaaataaaaatcgaattaaacttttatttgcaaggccctttacagcaag

SEQ ID NO: 36037 - DNA, 201 bp, Homo sapiens
aacactgaatataaaacatgaaacatctagtaaggcctcaataaatgttcattttcaaaatgcctcaaaaaatgaattaaacctaacaacctaacatgacwttctctggctgaaagaaacactcttctccaacatcatgtggtataccaaattcagttgagactgtttgtgaaggaaggaatttgcttatatacttaaaca

SEQ ID NO: 36038 - DNA, 201 bp, Homo sapiens
caaaagcctgagtcaacggagttaaattttctattcgtaagataggtttaggttagataataaatgtgaaaatacttgccagctaatcagtaaatactagytcttttcttctttattttatgagcataaaactaaaaaaaaagatttgctttgcatatagcatatcctttttgcttaagaacagcaaaatattctaaaaat

SEQ ID NO: 36039 - DNA, 201 bp, Homo sapiens
tcatgtgtactttaaggccacagtgactagatatacactttggaggactttggaagatggctgtatttaatgtaacttaaataacttattctcctcagagmctcttagtgtttatgtatatatagctctcatttctgaaactttggggagtctttgaagagttattttattatcatgaattttacaggaagcacatgtgca

SEQ ID NO: 36040 - DNA, 201 bp, Homo sapiens
ccaagtaccagtgaaaatctgtgaaatttgaaatgtttaccatttctattaatagagttaattagtaccacaatttaggagggcaatatggtattatctastatctttgaaggtgataaaaccctgtcaaccagcaattccacatccaaacatttaccccaaaaaactcttacaatgtatagagaaaaaccatctaaaatg

SEQ ID NO: 36041 - DNA, 201 bp, Homo sapiens
gactttatggagggtagctgatgcatcaaaaaaaaattatatatatatatatacacacacacacacacacacacacacacacacacatatatatatatataaagttttacagaactttgttttcaacttttaaaacaggatttctaaagaagttatgtggttttttttctttcatggcaatggcgcctccagcctcacctt

SEQ ID NO: 36042 - DNA, 201 bp, Homo sapiens
tttaattgtaaattaaatcaaattaaataacaataaatattcagtttctcattgagacaagctacatttcaagtcctaatagccacatgtggctagtaackactgatttggacagtgcagaacagacaatatccatcatcacaggaagttctgtggaatagcactgttataattaaagaagtatcatcatcactgacattc

SEQ ID NO: 36043 - DNA, 201 bp, Homo sapiens
aggaacttggcatcatgggacaatgaggagagaattaatcatcaccctatcaactacaatatattgatgccgactggacagtttttaccgatgctgattamcaccacataaagaattatctttttcacttctatataccttcactattcaaaatagtagccacaagtcacagtagctatttaattgtaaattaaatcaaat

SEQ ID NO: 36044 - DNA, 201 bp, Homo sapiens
acaaggaaaaattatcaatgaaaataaagaagttccagaaaggagtgcgggggtggaaacagacagacacctgacatgaaataaatcacctgatatacacygccaaggtctaatttgtttttccacctgtttttcctcatgccatgtgtttttcattaagataaaaaaaggaacttggcatcatgggacaatgaggagaga

SEQ ID NO: 36045 - DNA, 201 bp, Homo sapiens
gaaagtacatctttacacccattgacaaatgggtgtaaaatccaaaaacacaaagtaaattatcttctcaatgtatatagtagatgcatcctagaaaaaarcaaacaaacaaacaaaaaacacacacaaaaatttgatgtggaaacaaacttaaattaggtttcaaatataaggcaaggttttgttgttttgtttgtttgt

SEQ ID NO: 36046 - DNA, 201 bp, Homo sapiens
ctattgcaaaaagtttcagctttgcatgtactatattttggttttgctttaaacattgcgtagctattctttccactgttacagtattaatggtagatgcrtaaaaggaatcttcctttataaaaaggtcatatgtggataaaggtgatataaaatgtttttaatagtgttataaaaagtttggtcaggcgaagtggctca

SEQ ID NO: 36047 - DNA, 201 bp, Homo sapiens
tgtccacacaaaaaccttcacatgtgaaatatgagaatagttataatctatagtgacaaaattagatcagcagttgcctttttctgggaatggaggttggrggatttattgcaaaaggtcagatgctgatagcagttgtatcaataattgtcaaaacttggaaccaaccaaggtgtttttcattagatgaatggatgagta

SEQ ID NO: 36048 - DNA, 201 bp, Homo sapiens
tgtccatgaacttaactcttccatactcttcactttcagtttcttgtgcctctctggtctccatttgaagcgtttttttgttgttgtttggtttttgtttktttttttttttttttcccactgtgtcgtttctctctagttcacttcttctaaatacttccacttcaatgtgtgtaatctcacaattgatgcacacacttt

SEQ ID NO: 36049 - DNA, 201 bp, Homo sapiens
atggaaggacaaaaatctttaaaattcttagaagaaaatataccaggattaaattttgaccttcgggaaaagaacacttgattgaacaaaacaagattatragtggaactgcattaaaattaaactctttggtcatcaaacaacacaaaacacaagcctcagtctggaaatgtacagtatatataatctacagggaataca

SEQ ID NO: 36050 - DNA, 201 bp, Homo sapiens
gcttccaaaagcaattctctttgcatctgtaaagttctgggagaagctagcttggcttgtctgctgttcctgcattaccattaaggtttgaaattctctcyctgaatattattaaattaatcttatgtgatttgttctttaccaaaacctgcttattttctacagcattatgctatctttctgtttctagcttagagaagc

SEQ ID NO: 36051 - DNA, 201 bp, Homo sapiens
ttaatgtccatgaacttaactcttccatactcttcactttcagtttcttgtgcctctctggtctccatttgaagcgtttttttgttgttgtttggtttttktttgtttttttttttttttcccactgtgtcgtttctctctagttcacttcttctaaatacttccacttcaatgtgtgtaatctcacaattgatgcacaca

SEQ ID NO: 36052 - DNA, 201 bp, Homo sapiens
aaagtaatctctggtaaactcttttgttttgttgttcttgcttgactttccattctacttcacggatctcaaattaaagctatagatttgaagaaggaaaytgatatttgagatttgtaggacagggtagatctcatcatataaaagaagctcaacaaataccttgtaattgatgctacatgcttaacacaaacaaacaaa

SEQ ID NO: 36053 - DNA, 201 bp, Homo sapiens
gtgattttaatgtccatgaacttaactcttccatactcttcactttcagtttcttgtgcctctctggtctccatttgaagcgtttttttgttgttgtttgktttttgtttgtttttttttttttttcccactgtgtcgtttctctctagttcacttcttctaaatacttccacttcaatgtgtgtaatctcacaattgatg

SEQ ID NO: 36054 - DNA, 201 bp, Homo sapiens
atttatatcaaagatgaaattcctagaatagaagaatagcgtagttggggctgttccaccagatatcagcacattagaaggtaaagttttgtattgtggarctatcatgttaattcatgtataactgtgcaaataggaaagaattgagaaccctgaaaatacacaagcatagatggaaacagcatttgacaataagtggca

SEQ ID NO: 36055 - DNA, 201 bp, Homo sapiens
tttctctgatggccagtgatggtgagcattttttcatgtgtcttttggctgcataaatgtcttcttttgagaagtgtctgttcatgtccttcgcccacttkttgatggggttgtttgtttttttcttgtaaatttgtttgagttcattgtagattctggatattagccctttgtcagatgagcaggttgcgaaaattttct

SEQ ID NO: 36056 - DNA, 201 bp, Homo sapiens
aacaaaattagaaccccagcctaggttttatctcttacaggatttttttttaattgacacataggatcctacaagtgcttcaactggaaacctatgggatytaatgattctgcttcaagagagaaggagaacaaggggccgagatagtccaggaggaaagttcctaatacatgacctcaattataagatagagggtagaat

SEQ ID NO: 36057 - DNA, 201 bp, Homo sapiens
attgtcaaatttcttaggatctaatttctataattgtgaaatattaataggaacagtacgacttaagggaggtggaatgaatagatgagaaactggcctgrgtttgaatctcgacttcaccatacagtaagcctgagaccctgcactgggtgctacacctctttaggctttagcaggtaaacaccaagtccctgagtaact

SEQ ID NO: 36058 - DNA, 201 bp, Homo sapiens
tacttttgtatttttagtttcgtatcatttatttctgctctcatcttggctagcaaggactgaacattccatatttccatgctggcctcctatttcactcrcatcatctccccaggacaattgtcttctctaggatgttcctgttgatcaattgtaggtgcaaagtcaccctcatatttgcacctatatttcctatgggtt

SEQ ID NO: 36059 - DNA, 201 bp, Homo sapiens
tcctaattaaatttataaagcattagttctaatgttaaaaattgttatataaaaagcattttaatattcacatgcatctgtctacagtgttttacattttrtttataattcgtcaactgaatgaatactagataggagaatgttccatttaataaaaactcttgagaaaaataaaatagcttacttaacagtaatttcaat

SEQ ID NO: 36060 - DNA, 201 bp, Homo sapiens
tgggaggcggagcttgcagtgagcagagatagcgccactgcactctggcctgggcgaaagagcgagactccgtctcaaaaaaaaaaaaaaaaaaaaaaaaagtacaatacctttagtcttatatctatttaaaaataaagcatttttaaaagatccatgaactcctaacaatgaggttaactacatgtgccatttgagatg

SEQ ID NO: 36061 - DNA, 201 bp, Homo sapiens
ctgggaggcggagcttgcagtgagcagagatagcgccactgcactctggcctgggcgaaagagcgagactccgtctcaaaaaaaaaaaaaaaaaaaaaaaaagtacaatacctttagtcttatatctatttaaaaataaagcatttttaaaagatccatgaactcctaacaatgaggttaactacatgtgccatttgagat

SEQ ID NO: 36062 - DNA, 201 bp, Homo sapiens
cctgggaggcggagcttgcagtgagcagagatagcgccactgcactctggcctgggcgaaagagcgagactccgtctcaaaaaaaaaaaaaaaaaaaaaaaaagtacaatacctttagtcttatatctatttaaaaataaagcatttttaaaagatccatgaactcctaacaatgaggttaactacatgtgccatttgaga

SEQ ID NO: 36063 - DNA, 201 bp, Homo sapiens
ctctctggctgcccttaacattttttccttcatttcaactttggtgaatctgacaattatgtgtcttggagttgcttttctcgagaagtatctttgtggcsttctctgtatttcctgaatctgaacgttggcctgccttgctagattggggaagttctcctggataatatcctgcagagtgttttccaacttggtttcatt

SEQ ID NO: 36064 - DNA, 201 bp, Homo sapiens
acctgggaggcggagcttgcagtgagcagagatagcgccactgcactctggcctgggcgaaagagcgagactccgtctcaaaaaaaaaaaaaaaaaaaaaaaaagtacaatacctttagtcttatatctatttaaaaataaagcatttttaaaagatccatgaactcctaacaatgaggttaactacatgtgccatttgag

SEQ ID NO: 36065 - DNA, 201 bp, Homo sapiens
aacctgggaggcggagcttgcagtgagcagagatagcgccactgcactctggcctgggcgaaagagcgagactccgtctcaaaaaaaaaaaaaaaaaaaaaaaaagtacaatacctttagtcttatatctatttaaaaataaagcatttttaaaagatccatgaactcctaacaatgaggttaactacatgtgccatttga

SEQ ID NO: 36066 - DNA, 201 bp, Homo sapiens
tggttattttgctcgttagttgatgcagtttcttcctagtctcgatggtctttacattttggcatgattttgcagtggcttgtactggttgttcctttccrtgtttagtgcttccttcaggagctcttttagggcaggcctggtggtgacaaaatctctcagcatttgcttgtctgtaaagtattttatttctccttcgct

SEQ ID NO: 36067 - DNA, 201 bp, Homo sapiens
gaagttaactccaagcctattgatttgcaagtaatatcaatcaaaattcaaaaatttttaaaaatgcaaaattatacaaactttccagagaatagaacaaytgggacgtactcctcacataattttatgtggcttgatataaaatcttgacaagaggactatgaagaagaaaacccctacccaaagtcactcatgaacgta

SEQ ID NO: 36068 - DNA, 201 bp, Homo sapiens
attcttaatcctgagttctagtttgattgcactgtggtctgagagatagtttgttataatttctgttcttttacatttgctgaggagagctttacttccawgtatgtggtcaattttggaataggtgtggtgtggtgctgaaaaaaatgtatattctgttgatttggggtggagagttctgtagatgtctatcaggtccgc

SEQ ID NO: 36069 - DNA, 201 bp, Homo sapiens
tcttatttggaacagttattcagcttaccctaagtccagagtgaatttccaaaaaatcaaaggttctgcaacttttcatttctcttcaattccaactcagkttcacacgtttatcacctagtgtagaagggctttcctccacagttttgcttggcaaactccttttcatccttcaagactcaacaaaattgttgccttttc

SEQ ID NO: 36070 - DNA, 201 bp, Homo sapiens
tatcatgaaaatgtaaacattttggagacccagatcctatttcaaatagagtcaagatgactgccctagaaaatgcttcttgaagtcatggaataaattakatgattgtttatttaaaaaaaaagaacaataatacataggagatctgttaaaaaatctgtgaggaaagagctgttaaaatgttgaaaccacatgaattct

SEQ ID NO: 36071 - DNA, 201 bp, Homo sapiens
ggctccaatttggaattggccatagacacccactctgagaagtttgggaataagaaaagagaaaacacattaagaactaaaactgtaaggacccatactgkcttcttaaaggaagttttactgagaattttaatcttcaaagcctaactctcattcacattcaaaagatatatacatgaggatggaaactgtccggaaaat

SEQ ID NO: 36072 - DNA, 201 bp, Homo sapiens
actcctacaaaatctaggactttaaaaatgaatattttaagcactttaaattcctaactacatgggcttgcttaaataaatactagcaaattcataaagtrgaaagtcctcctgccattaaaagtgactatctacatttactgagagagtgatatcttccacatatgtaagaaaaaaaagtcattaggaatgaacatgtct

SEQ ID NO: 36073 - DNA, 201 bp, Homo sapiens
tatggaaatttcatgcgacaaagcaggtaaactctaatagaaaatattcaagctcttattttagagtctgtaaggaaggttattgacctacagatatcagrtaagaaagattggaaagtgattggttttgcagtataatgatagaagataaaccatggaggcttccctgtgacctggaagaagctactaccattcatcaga

SEQ ID NO: 36074 - DNA, 201 bp, Homo sapiens
aagtgactatctacatttactgagagagtgatatcttccacatatgtaagaaaaaaaagtcattaggaatgaacatgtctatcaagattcattttaaatayagggaggaggagagaggaagatggcaaggttgtgaaagagtgaatgaatgaatgaatgaatgaattatagaaagctatatgcttctgcacagctttgaga

SEQ ID NO: 36075 - DNA, 201 bp, Homo sapiens
agttcactttgagtccaaaggccagagaatcacgggagctgatggtacaaaccacagttcaagaactagagagaaaatgagatgagatgtcccagctcaayctgtaaggcagaaaagaagggaaggaattcctcctttctttgctttttgttctattcagccctcaagagattgggtgatgcacagcaatattgaggaggg

SEQ ID NO: 36076 - DNA, 201 bp, Homo sapiens
tcttttactgtcatccagaaacaccctcacagacacacccggaaataatgtttaatttaggtgcccatggccagtcaagttgacacatacaatttacaatsacactggccttcaactccagtgcacaatgtggtcttcctctttattctccaaattcaagttctcttacttgctacagttgtccatatttcttgggaacca

SEQ ID NO: 36077 - DNA, 201 bp, Homo sapiens
tgggctcccgtgctaaataatacaaaaataatgatgaagattctttttttttttttagacagagccttgctctgtcgcctaggctggagtgcagtggcgcratctcggctcactgcaagctgcacctcctgggttcacgccattctcctgcctcagcctcaggagtagctgggactacaggcgtccgccaccacgcccggc

SEQ ID NO: 36078 - DNA, 201 bp, Homo sapiens
tgcagagtatgtaatcctaaatactggtttgcagcaatttaattatgctttttgttttctttttgtgtgtttaataattattttttcatgggattagttaratctgttggccctgtaggattatagttttcatcaaatttggaaatgaaagttgtcagccattatatctttaaatatttttttgttcttcattcttattgt

SEQ ID NO: 36079 - DNA, 201 bp, Homo sapiens
tccagtgcacaatgtggtcttcctctttattctccaaattcaagttctcttacttgctacagttgtccatatttcttgggaaccatcattctaaaaaatgytgaccaggcctttcttaggcatttctaggaaaaataatataaaatacagaataaagtgaggggagttcagatataatgcatttctcatagaaaaaatgat

SEQ ID NO: 36080 - DNA, 201 bp, Homo sapiens
ttatcattttattcctgttgtttcaggtctgctgacaataattttttccttttttttttttttttttttgttccagaaaggttttttttttttttccgaaratgtttttgcagagtatgtaatcctaaatactggtttgcagcaatttaattatgctttttgttttctttttgtgtgtttaataattattttttcatggga

SEQ ID NO: 36081 - DNA, 201 bp, Homo sapiens
gttgaccaggcctttcttaggcatttctaggaaaaataatataaaatacagaataaagtgaggggagttcagatataatgcatttctcatagaaaaaatgwtagtgggatggttagtaaagaactgtgctgtgtaagcaagatgtaagctttaaacaaagtgaagaaaaggggagaagcctagaaaaaataacattataca

SEQ ID NO: 36082 - DNA, 201 bp, Homo sapiens
atgtaagctttaaacaaagtgaagaaaaggggagaagcctagaaaaaataacattatacagaaagagaatattcttaaatatgtcaacttctcttatagcraatttcccagtgttcattcctaatacaaggagagtaaaaactccatagaaacctcaaaaagagctttttcttgcaatggggttaggtgtctaaggaataa

SEQ ID NO: 36083 - DNA, 201 bp, Homo sapiens
cctggattcattaattttttgaagggttttttgtgtctctatttccttcagttctgctctgattttagttatttcttgccttctgctagcttttgaatgtrtttgctcttgcttttctagttcttttaattgtgatgttagggtgtcaattttggatctttcctgctgtctcttgtgggcatttagtgctataaatttccc

SEQ ID NO: 36084 - DNA, 201 bp, Homo sapiens
tgtatttgtgataaagacagctaagcagaagcaagcatttctccgatgtcaaactggccttactgtaggaagtttgaaaatatcatctgcttctgtctctkgaataatatcattgctctgttttgtttttattttattttatggttggtttttaaagcccaatatgtggcgggatccagagaagcgattctgtgtgctatg

SEQ ID NO: 36085 - DNA, 201 bp, Homo sapiens
catacattatggagaaggcatttcaaaaaggcaggcaagttcatctggtggattctataggacaacatgaaacttaatgggatacatagacttcttaagcyctccccgctccccagctggcaaatttttaacaacttctccttaagtgatgagagaggggtcaaaagccaggactaatctcacaattgccactgaaaatgt

SEQ ID NO: 36086 - DNA, 201 bp, Homo sapiens
ccccagtgaggtgaccctggtacctcaattggaaatgtggaaatcacccatattctgtgtcgctcatgctgggagctgtagactggagctgttcctattcsaattatactggtttctaaaaaagattgtaatatattgttgagagtgaagggagttttatatcaataattaaattattttaaaatattgtttatttcattt

SEQ ID NO: 36087 - DNA, 201 bp, Homo sapiens
atttgtctattcagagattcaacttcttcctggtttagtcttgggagagtgtatgtgtcgaggaatttatccatttcttctagattttctagtttatttgygtagaggtgtttatagtattctctgatggtagtttgtatttctgtgggatcggtggtgatatcccctttatcattttttattgcgtctatttgattcttc

SEQ ID NO: 36088 - DNA, 201 bp, Homo sapiens
atattgaaccagccttgcatcccagggatgaagcccacttgatcatggtggataagctttttgatgtgctgctggatttgttttgccagtattttattgakgatttttgcatcaatgttcatcaaggatattggtctaaaattctcttttttggttgtgtctctgcctggctttggtatcagaatgatgctggcctcataa

SEQ ID NO: 36089 - DNA, 201 bp, Homo sapiens
aaagtagagcatggagggcctaggaaggatgatagtggttgaatagactttaattttatatagaatattaggtcagagatctgaaggtgactaggaaaaarttatgtgggtatctggagcaagagcatcttaggacaaagagaaagtaagtgaaaaggccctaagatatgaatgtggctggcatgttcaaagaccctcaag

SEQ ID NO: 36090 - DNA, 201 bp, Homo sapiens
taaggcaactattcatagtgaagctgaccttaatgctatcttttaaaaagttttgttaaaaataaatttgagaaagaattttaaataacttagagaaaagmctgttttcaaatatcaccagttactacagaaatacatatccacatttagttgatgaaattggcacgtgatgtttaaaatttttcaattttctccatgttt

SEQ ID NO: 36091 - DNA, 201 bp, Homo sapiens
tgttgcagcctagaaattgcctctgtacactgcttcatgtttttttccttctctcagaaatcacagtcctgtgcttcctataattcaatatctaaaaacarttgtttcttggtttgtatttttattttagttggttgtgtactttaacagcttaacaaagaagaataaatactgtaaaaactaagaagaggctgttcaaaa

SEQ ID NO: 36092 - DNA, 201 bp, Homo sapiens
atggaaaacttaattaaggatgatggggaacttagagcaggcactgacacagggaatctaagactaaaataccctgttttaatcagaattcagtttttatrtaataaagtgtttcacattttaaacaaggaatgaaaaatacaagcaaagttacagaagaatgccataaaataagctatcaagaatgtgagaaataaatca

SEQ ID NO: 36093 - DNA, 201 bp, Homo sapiens
aagaggagttgaggattatttcccaactatggacctgagcaactaaaagacttgtcattgatttagatggggaagactgtggtaaaaacaaattttttacrggagatcatgaactcagcttagctaattatataaagttagagatgcctattatatatcgaggtgtaaatgttaaagtgatagctagtatacaagtctgaa

SEQ ID NO: 36094 - DNA, 201 bp, Homo sapiens
attctaagtgcccactgaatataaaattacttgaatattacaattgcttaattggctatgcttttagtctcttccttctctccttcaaaaatattttcaayacattctagatatgtttgataaattctgtaaatttacctgtataaattattaataagtacatacaacataatccctgtcctatctgtttagggagacaat

SEQ ID NO: 36095 - DNA, 201 bp, Homo sapiens
actttttaatgactgccattctaactggtgtgagatggtatctcattgtggttttgatttgcatttctctgatggccagtgatgatgagcattttttcatstgttttttggctgcataaatgtcttcttttgagaagtgtctgttcatgtccttcgcccactttttgatggggttgtttgtttttttcttgtaaatttgtt

SEQ ID NO: 36096 - DNA, 201 bp, Homo sapiens
atgaactcagcttagctaattatataaagttagagatgcctattatatatcgaggtgtaaatgttaaagtgatagctagtatacaagtctgaagttcattkggtcaggaacatctgaactgaagatgtaaaatgtttgaatcatcaatccatatgtcatttaaaccagaagactagatgtgataaccaagaaaatgaataa

SEQ ID NO: 36097 - DNA, 201 bp, Homo sapiens
gaactagtttacagtcccaccaacagtgtaaaagtgttcctatttctccacatcctctccagcacctgttgtttcctgactttttaatgactgccattctractggtgtgagatggtatctcattgtggttttgatttgcatttctctgatggccagtgatgatgagcattttttcatgtgttttttggctgcataaatgt

SEQ ID NO: 36098 - DNA, 201 bp, Homo sapiens
catctgaactgaagatgtaaaatgtttgaatcatcaatccatatgtcatttaaaccagaagactagatgtgataaccaagaaaatgaataacgagacaaartatgagatctaaggattgggccctatagcaccccaacatttagaggttaggaaactgaggacgaactagaaaggagactaagaatcagtgaccaaaaaag

SEQ ID NO: 36099 - DNA, 201 bp, Homo sapiens
tgcctctactgagaggaagttaagactcatcaactgtctagccatttgtcagttctaagattctaatattatagtctattgcttttagagtgcatacttgyatttaaatttctgaattcttaaaatgtcaagaaaatgttaaatatataaaaatgtgtttttaaatcccttctgggatttaaaataaaaacatgtttgaga

SEQ ID NO: 36100 - DNA, 201 bp, Homo sapiens
gtggatccatagaagaacatgacaaacaaccaggtttgaattttataatatggagaaaatagctcctctcctcacttcctccccatgccattttgagttgytcagaaatagctgaattgtgtttgagcaacttgcttctggaaatgaccatgcagtgatcagatgtacagttagtgagggatgctttatgagggaatgcct

SEQ ID NO: 36101 - DNA, 201 bp, Homo sapiens
ccttctctagcacattaaatatagcatgtgaactgtagagatttacctaaagtgcccataaacaagagtggccaacttgatgagaagtaagccaagtgccycttaataagtactgtaataacatagcctcctggaatggtctttcatcattttgtcaagaggaacttttatccctgtttatataaagctcctttgctaaat

SEQ ID NO: 36102 - DNA, 201 bp, Homo sapiens
tgtaaatgctcgagttggaaagaccctcatggtggtgtagtctgccttccttctttcatagattggcctcagaaattgagtgtcatgcagttccaaagctrgaatccaagtcttctagctctgccccggtgcttttttcctctgaaatttttccagttgagaagagattaggaattctcaaggtgtgcctaacattcagca

SEQ ID NO: 36103 - DNA, 201 bp, Homo sapiens
gtgggattgaaaatgtttaaagaaaatatcttgctatatatatataaaaaacaaattatatagcatatatatatatatatatatatatatatatatatatwgtgggtagaaaaaagacaattgtaacatcaagggtatttttgttgttttaaagtgtcatgttttgtgctggttgttttagtgtaatatagcatatcttac

SEQ ID NO: 36104 - DNA, 201 bp, Homo sapiens
agtatcagtttctgtcagttactgctcttactcgatgtgggattgaaaatgtttaaagaaaatatcttgctatatatatataaaaaacaaattatatagcatatatatatatatatatatatatatatatatatatagtgggtagaaaaaagacaattgtaacatcaagggtatttttgttgttttaaagtgtcatgtttt

SEQ ID NO: 36105 - DNA, 201 bp, Homo sapiens
cattcagttcaaagaaggcattgtacagtagagaagacagatatacatatacatactgtacatttatgataatataaatagtgcagaagaagtgtgcacartgcatataaatagtgcagaagaagtgtgcgcagtgcatactggtagaactaagaaggaagcaatgaattcttgtgttagcatttaatacacttttaataa

SEQ ID NO: 36106 - DNA, 201 bp, Homo sapiens
agagttttctgaatttaagttccttatagagccccatgtaatgagctcttagaagacattgcagagctgcaatttaaaatcctgtttaatcagccgtagcragctatgtgccattctctgtggaacactaagaggaatcagggttcttcctcctccatccagtacattcccaaccaggaattgctgtctggtcagggttgg

SEQ ID NO: 36107 - DNA, 201 bp, Homo sapiens
tgaagtggtctgctctctctctttctgtctctctctttctctctctctctgtctctctctttctctctctctctctctctctctctctctctctctctatmtatatatatatatatatatatatatggcaactagatgtatactttggaattcctttaaggtgaaaagagttctctaaatgtaaagtgttgagtgaaatta

SEQ ID NO: 36108 - DNA, 201 bp, Homo sapiens
aaactaagcctatttaattgcacagaggaaagtataccttctttgcctgttttgtttgaattttaatataaaataaaatttgctgctaaccttttgttttwctttgaccaataacatttctcagcttagtgtatgggctatgtaaagtgcctgtcaaatggagggatgtctttgttgaaagaatccagactcacagaaagt

SEQ ID NO: 36109 - DNA, 201 bp, Homo sapiens
agttattgcagtgcccaacagatatttagtattgctgtgtgtccttcaaatgtttacaatattccactgtgcctttgtgagttcactgcagcaccctgggrcacctctacacacagtttgtgaacacaggggtagatagatcctagaggcattgaaactacacggaaacttgaatgacgttagggatcccagagccactgg

SEQ ID NO: 36110 - DNA, 201 bp, Homo sapiens
gcaaaaaattagccaggcttggtggcaggcgcctgtaatctcagctattatggaggctgaggcatgagaatcgcttgaacctgggaggcacaggtggcagygagccgagatcgcgccgttgcactccagcctgggggatagagcgagactctgtctccaaaaaaaaataaataaataaaaaataaacataaatttttaaag

SEQ ID NO: 36111 - DNA, 201 bp, Homo sapiens
ttttatatagagttctccctgtttggaatcttttagttcccttatttactgtggttgccactgactctgcatcaggctttggaaatatcactaaaaaactgttttttctttagtcttcttactagtcaaatatcagctaaacaaacaaagaaaataagtgtttgaatggtcagagaactataagaatgagaattctggcag

SEQ ID NO: 36112 - DNA, 201 bp, Homo sapiens
aggaacttccttctaaatcaggttaagttagacattcaaatgtgaccccagcctgacaacccggtatacctttaatgaaagcaatgtctccaatattggaktttttattgctgacaccaccacctctcacctccctgtccctcatcatttccctgtgctgcctagtttgcctttcactggtaatatttcaacttagtctaa

SEQ ID NO: 36113 - DNA, 201 bp, Homo sapiens
gttctaattaatgcacgtgtgaaaggacataattattgtgaaaagaaatgctatcaaaacagtctaatggctacaagaagaaaaagaaaagaagaagaaggaggaggaagaggagaaggagatgaagaagaaagctaaggagaagatgggtaacaggaaaaaaagagggcaggaaaagcagataggaaggaaaaaaaaggt

SEQ ID NO: 36114 - DNA, 201 bp, Homo sapiens
acttagttgacaattctttgatagctcatgcatctctaaaatttagtactatattattgccaacattatgtatttaaatgaatgcagcttgatatcaagaraatgaccatactgaaggggaaaaaaaaataaactgcagccttcttcatgagtaacacttgaaactgttaaacacattaaaatcccatttaacaaatagca

SEQ ID NO: 36115 - DNA, 201 bp, Homo sapiens
tatgtgttcatgaatatgaatagcaatattatttatgatagctcgaaggtagaaacaatccaaatattcatcaactgatgaatgaataaacaaaatgtggyatgtacatgcagtgaacattagtcattaaaaggaatgaaatactgatacatgctgcaatgaagttatctagaataggtaacttcatagcaacaaaagcag

SEQ ID NO: 36116 - DNA, 201 bp, Homo sapiens
aggaaagatttagggaaggcaatcataaggactgtcctcaaattttcagaagagtcgttatgttaaagagggactattctaaaggctgaaggtggatccayagaagaacatgacaaacaaccaggtttgaattttataatatggagaaaatagctcctctcctcacttcctccccatgccattttgagttgttcagaaata

SEQ ID NO: 36117 - DNA, 201 bp, Homo sapiens
agaatgatgcaatcaaaatgattctgcatttcagcaaggcagtgtctaaaatgttttctgatattcttgtgaataatatgtggaaactgaagcataatggyaggtaaattgcaactgattgaaaaatagttcacaaagaatattgcatagtggattaaggtcaatccggaaagaagtctctagcagtgcaacagaggtttt

SEQ ID NO: 36118 - DNA, 201 bp, Homo sapiens
gacccctcatttctgaaggagttccaatgtccaggttttgattttgtccctgtcttgttggttcaaggggaggaatagttggttcctggtgttgttagagktcaaaatttttctattgaacatgcctgggctacatgacttgcagcttttggctctgttatacctaaaaggtaacttgacattttgttatcaacagggtag

SEQ ID NO: 36119 - DNA, 201 bp, Homo sapiens
caaatttgatcacttacagtaaggtatattgaggcagattttagccctggatcttctgggccaatggacccctcatttctgaaggagttccaatgtccagrttttgattttgtccctgtcttgttggttcaaggggaggaatagttggttcctggtgttgttagagttcaaaatttttctattgaacatgcctgggctaca

SEQ ID NO: 36120 - DNA, 201 bp, Homo sapiens
gctaatttttatataagaaaaaatactatgtacactatttcaaagcagacagaaaagtcatatgaaaagggtatgtcaaaaaagtttcaaaaagaggctcytgatttatgtgttgtgtgtttgtggacctaaccaggacatttgattcaattaaccaagtttagtatgtcagcaaccctctgaaagattgagaagattgac

SEQ ID NO: 36121 - DNA, 201 bp, Homo sapiens
aatcttcttggctgtgaacagaaatttaaaaatttacagcagcactaccatagagtgatttatacaagtgcttttaaaaaatctcttctatgtcatcagcrtgtcccctttcttctgatctcaggggaaaaagctttgtgtatgcatggcccaaatttgcccaaagaaaattatgtaggagcactagcatttattgaacac

SEQ ID NO: 36122 - DNA, 201 bp, Homo sapiens
gttggccatttcttaaaagactaaatatacatctaccatacaaaccaatcatttcactcctaattattcacccaggacacaagaaagcatattttttatasaaagacttgtaccaaaatgctcacattacttttatctgtgttactcaaaaactgaaaacaaatcacatatccatcgacaggtaaatagatatacataaat

SEQ ID NO: 36123 - DNA, 201 bp, Homo sapiens
tgaaaggtaaaagaagccagagagcttgacattatggaagccagaagaaatttcctatagggaaggaaatgctaacagcattaaatattgcacaaacatgrattcagataaagtttaaaagaactccactgagtttgggtataggcaggtccctgaggactttagcaagaccagagatgacagagtagtgggagaggaatt

SEQ ID NO: 36124 - DNA, 201 bp, Homo sapiens
tttccctctgcgtgctaataccatactatcttcattgctttagtaagtctagaatttaggtaatataatgtaccaactttattttttattttcaagattgtctatagtaggggcttttttgtgtgtgtttctatacaattttagaatcaacttgtcaattacagaaaatattaggattattgcttagactctatatacaaa

SEQ ID NO: 36125 - DNA, 201 bp, Homo sapiens
atttggaattgtcatagatatattggccatgatcatttggaagccagatttcatataattaggacgttcttcatttgagtaccattgagtgccctgacatwccttttttgaatcatcccaccagaatccttgatgaggctaaaaacatctccttcaatgccactgcagccttcaaagcttacagcaatattaaggactata

SEQ ID NO: 36126 - DNA, 201 bp, Homo sapiens
ctgtatttagagtaattgaacacatgattttacttgaatgcggagaaacttgaccaactgtgaatatgcaatttcactctacagatgaaataaaattaaayggggcaaaagtaaagaagaatggagactaggtaaagtgatggaaagagacaccaaaaaattagtcatgtgaaagcaaaactaagaggagagggaaaggtg

SEQ ID NO: 36127 - DNA, 201 bp, Homo sapiens
gtttgacaaattgaaatgctaattatgatttatcatttccatgacatcaaatatccagatagtaataaacgttgatgactaactatatttttcagtttcasccagatgtttggcatcacgtaagataccaccttagttttacataaaaataaaatgtttcttgagtctggcttatcataatggggaggaaactaatatgaa

SEQ ID NO: 36128 - DNA, 201 bp, Homo sapiens
agaagaaaaaattcacccaaaatgcaacataacattttaatgttttaagtatttcccaccaatttttacatgtgtttatgaataagatttatataacaccatggatgcagttttatgtcttgtcctttacatttttacctatcatgaggttgtattatgttgttagatattatttaaaatctttacgatctttgtttggat

SEQ ID NO: 36129 - DNA, 201 bp, Homo sapiens
catgggatttgaaaaactgactcctaccttttattcataaatcaagcaatgtctgcagctatgcatgaggagaggactgagcctgaaacacaagacggttytcatcttcgtgccagagctgtggactaccttccagaaagccagagatgtttgttgatacattttcataataaacccaaatgaagatggaagtcttgattt

SEQ ID NO: 36130 - DNA, 201 bp, Homo sapiens
gctgaacttgtgaaaattgagaactaatgtttatgtatttccttctccctccctaacccatcaactattatctagccttggaaaagtgtgttttaggagtwagtcctcaacaaatactgctaattaactaattatccttcttttgttaacttattttaatactaggatgcattagtctaaaggtcataacagaagaaaacc

SEQ ID NO: 36131 - DNA, 201 bp, Homo sapiens
agaaaagcagctgatagatattttttaaaaattaatgatgactgtgtgttttctctaagatacaagatatgagtggctggtatctgactgaccttcctggycgcattcgagtggctccccagcaggacgacttggactcacctcagcagatcagcatcagtaacgcggaggcccggcaagccctgccgcacagctactact

SEQ ID NO: 36132 - DNA, 201 bp, Homo sapiens
aatgtcccttcagtacgggatttctttctaccattttcctgagtaattaccttctagtcatcattcaaaaagcatttaagcattgaattctataggaaatrtttctaatcaccctatcccccagctctggctgagttaggccttctctgcacaattcccatgaaagcacctaccacccagcaggcagaaatatccctcttt

SEQ ID NO: 36133 - DNA, 201 bp, Homo sapiens
tgtttatgggatggaatctttttcagcacttgctgtcacctcagcgggccccagagaggcttattcagctggcagagggcaatctgaatacactcgtgacmgaaatgaacgagctgctgaccagggtaaggtggcaaaattatgaatcttctgaaagcagatagattatgtcaatgaaggaaaattacttcaaagttctga

SEQ ID NO: 36134 - DNA, 201 bp, Homo sapiens
ttggaattgtcatagatatattggccatgatcatttggaagccagatttcatataattaggacgttcttcatttgagtaccattgagtgccctgacattcyttttttgaatcatcccaccagaatccttgatgaggctaaaaacatctccttcaatgccactgcagccttcaaagcttacagcaatattaaggactatatt

SEQ ID NO: 36135 - DNA, 201 bp, Homo sapiens
cctcttgcctcagcaagctctaggttgtattttaaaggagattaaatatattttcactgaatttaattgtatctaagtaatacctttcgaagagtcaaatratacagaaaagctcataacaaaaagttgcaattcttccatccctccttcactctcagagacatgactgatctatctcagctgtttcttctagcatttacc

SEQ ID NO: 36136 - DNA, 201 bp, Homo sapiens
caatgggcataagatttttaagtgaaaaaaaaaaattctacttaaccaaggtggtaaaatagtccccttgtaattctccatgggatttgaaaaactgactyctaccttttattcataaatcaagcaatgtctgcagctatgcatgaggagaggactgagcctgaaacacaagacggttctcatcttcgtgccagagctgtg

SEQ ID NO: 36137 - DNA, 201 bp, Homo sapiens
ggaggtactagaaagttcttaatctgatattttttctggcttagtcagcaatcacttttctttcatcaatgggcataagatttttaagtgaaaaaaaaaaattctacttaaccaaggtggtaaaatagtccccttgtaattctccatgggatttgaaaaactgactcctaccttttattcataaatcaagcaatgtctgca

SEQ ID NO: 36138 - DNA, 201 bp, Homo sapiens
gttgctcctaggctacagacctgcacagcatgttattggtactgaatacagtaggcaattgtaacataatggtaagtatttgcatatctaaacatatttawacatagcaaaggtacattaaaaatatagttttataatcttatgggaccactgtcgtacacatggtcctatcattgaccaaaatgtcattatgcagcagca

SEQ ID NO: 36139 - DNA, 201 bp, Homo sapiens
tccatgctaggggcaggaggtaggatggagcagatagggagtctcttttcctcttaaaccggatgttttttttaaaatcagttttatatgttgagagtccrtggaatggaatgtggaaactgagaccctgaaagattaagtcacttgaacaaagatatacagcttctccagagaccaggcagacactaggtttatgatttc

SEQ ID NO: 36140 - DNA, 201 bp, Homo sapiens
gattatatatttttttcgggctgaaatctaattactagtgggctggcaggatatcatcttgtatctacactgcagttgtagaaaaacatttttttaatcaygttgcgtttgagaaaaggaacacttaaaaggaaaatccatcatcctgggagaaggggagaatgaaaaatatgtaaacattgccccaactgaggtcccccc

SEQ ID NO: 36141 - DNA, 201 bp, Homo sapiens
tttttttctatcaataattacacaaataatgtgtatcacttaaaaacaaaacttgaatatctaccaaaagctgtggctttcaattagagtattaaccacayaatttcattttgtaactctttctctctgagatattttgcctataactgaaaatctgatgtttctgtctttgctacatatttgatctattgtatgctggat

SEQ ID NO: 36142 - DNA, 201 bp, Homo sapiens
aactaaacagccagttttctcttaaattcttaaaaacaagtctctgcattttatatcttttaaatctggaattaccagaaatgtgatgcatatttcatttyctgtatgttcctccccttcacttcaacacgtacccttgaagaactgggagaaatggaactatttctgtgagagccctggatggacccaaagccagcattg

SEQ ID NO: 36143 - DNA, 201 bp, Homo sapiens
tggaattgtcatagatatattggccatgatcatttggaagccagatttcatataattaggacgttcttcatttgagtaccattgagtgccctgacattccktttttgaatcatcccaccagaatccttgatgaggctaaaaacatctccttcaatgccactgcagccttcaaagcttacagcaatattaaggactatattg

SEQ ID NO: 36144 - DNA, 201 bp, Homo sapiens
gaaaaaacagatacattcagtgatttaaaaatggggtaattctttctgtttttatttcacaagtcttttgtaacttattttagagttttaaaactttgtakacatatttaaaatgttcaattttcactaaaacaatcacatttttaaacataagggcatatatttggtgtgacaacctaacatttgccaccaagtgttaaa

SEQ ID NO: 36145 - DNA, 201 bp, Homo sapiens
agtgttgactcttactgtataatctaccataaatagaagcgaagttgcacatgcatttaattttttttattttggaattatgttaagtttacacacatgtrtgaagattatagagaatcctcacattccctcatccagctatccctaggaataatatcttaaataatgacaatgcacatgttaaaactaagaagttagcat

SEQ ID NO: 36146 - DNA, 201 bp, Homo sapiens
ttaaatgaacagtgatttgagatttatagcttccctttctttgtgtcatggataatttctctgtgctaaggtgtgagcatacacatcatttgggctgttaytgaagtagaatacgaagcctgccttctttcactagcaggggaatagtgagtaaattctctattgctaaacaaatattacctctatttatgatttaaattt

SEQ ID NO: 36147 - DNA, 201 bp, Homo sapiens
tcaaccattttaaagtatttgcaaaattggattattctgttgtgtgcgtttctaactatatacatgatgtaccgaatttaagaagcttattaagcttattrgtttttactgcagatcgggctcatcaaggaaaaactaatccgtacagcataaacaaattagaaatgaacttaaaataaatatacaaacaaaatagtaaac

SEQ ID NO: 36148 - DNA, 201 bp, Homo sapiens
gcatgtaagtgctatggaagcatttatcattattattattatctttattagttttattaattgtgttatacattgtgctttggcacaggaaaactagctarttactcaggttttctttctatttagtgttatgattccgctgaagaactacttaagataatttctatttgcaagtaatgatttgcactgtcccatgacatt

SEQ ID NO: 36149 - DNA, 201 bp, Homo sapiens
agtggttattatcaaatttttattttagaattgtagattattattattattattatttgaaatttgacagactttcctttgttcagatccaagctgtgccrcttattacatgtgtaacatttatcaaacattttagccttctcaaactttaatttcttcttttgtaaaatgagaatcacaatgtctacttaataatcttat

SEQ ID NO: 36150 - DNA, 201 bp, Homo sapiens
gatggcttcttcagacccaaaggggtaaagtatgctttttctttcataaagagttatttttttgctttttcatacaaaaatgttttatacaaaaaaataakaattttgaaagcttctgtaaacagttgaacttcaaattaaaaggtaagtaggaacatttcgtagttgaaactgacctaaatctttgaggatgtaagataa

SEQ ID NO: 36151 - DNA, 201 bp, Homo sapiens
ctcccagactcaagcaattctcatgcctcagccttctgagtggctgggactcccagcattcaccaccacacccagttagttattgtactttttttttttttgaagagacagggttttgctgtgttgcccaagctgatcttgaactcctggacctccagcaattctcctggcttggcttctcaatatgctgaaattataggc

SEQ ID NO: 36152 - DNA, 201 bp, Homo sapiens
cagtccaggcaaccctggaggctcctgccaagaatgtgagtgtgatccctatggctcactgcctgtgccctgtgaccctgtcacaggattctgcacgtgcygacctggagccacgggaaggaagtgtgacggctgcaagcactggcatgcacgcgagggctgggagtgtgtttgtacgtatactaactttgctgttagttt

SEQ ID NO: 36153 - DNA, 201 bp, Homo sapiens
agccctgaattctaatgtttatcttcttatcctgtgagattgctgaacacactaagatgtagctttctctataacctcctattcaactgtcagcaaatcartaaaagtaccctgagaggaaaatggctagcttaccttattttgcttccctttacttaagtctggctgccttggttgcttgctgatgccttcaaactgctg

SEQ ID NO: 36154 - DNA, 201 bp, Homo sapiens
tgatgaagaaattactctgtgtgcaagtgtggagaaaaatagcttgtgataccatagtgatcttagagctcattatacatcagcaatgaagagctttaacwaccatgcaattaaaatactagagagtataaataagattgtaccatgtgtatgtggcagcatataaaaactcagaagtggaaggaattttagtcaagtgtt

SEQ ID NO: 36155 - DNA, 201 bp, Homo sapiens
ccatttatcagtttcataacaatgattttcaagcttgtttcatttctcacagggtagacaaagacaaaatatatatctcataaaagtaataatctaccagkcatgtttgttgtagccaagcaaatatatagaattctaaaaatattgtttatagctcttgtttcaacatgcttgggacaagttaatgtttacagttttgtg

SEQ ID NO: 36156 - DNA, 201 bp, Homo sapiens
gataaggaaataatttgaccagagcatgggattttaattgagaatattaagagataaaattataataaatgtagggaaggtgtatcagagtgagattatgrtatactatacttgaaatatctaaatgaagtatttatgtttactctaaaagtcaagtgagagagattctggagtgagacaagaatgtgaggaatggggact

SEQ ID NO: 36157 - DNA, 201 bp, Homo sapiens
atgtgcccctgacatctgtacatgtgtttaatttccagtgagctcaaaatacttcaagtgatctcatttgagtattaactagggaaatacattcacagtcyagcaattttcttttatgtctacattattttaaatcatagcatagattttccactgtgctttatgaccagaacacatttatttgcaaagtattttcactta

SEQ ID NO: 36158 - DNA, 201 bp, Homo sapiens
ttatcaaatttttattttagaattgtagattattattattattattatttgaaatttgacagactttcctttgttcagatccaagctgtgccgcttattayatgtgtaacatttatcaaacattttagccttctcaaactttaatttcttcttttgtaaaatgagaatcacaatgtctacttaataatcttatttttcaga

SEQ ID NO: 36159 - DNA, 201 bp, Homo sapiens
ctcatcttgaattgcagttcccacaattcccaagggtcatgggagggacctggagggaggcaattcaatcataggggcaggtctttcccatgcttttctcrtgatagtgaataagtctcacgagatctgatgattttataaaggagagttcccctgcacatgccctcttgcctgccaccatgtaagacgtgactttgctct

SEQ ID NO: 36160 - DNA, 201 bp, Homo sapiens
ttcctttacaaaaaaagaccaaaaatgttctgccattcttgctcatcatgattttgcctcagtttttcaagttatgttttgttcataatggatttttttttgtttgttttctgaatgtgttctgttccttctactgccttaaaaagccctcatcactgagtcttcctactacttccctcacctccacttaccctactgaat

SEQ ID NO: 36161 - DNA, 201 bp, Homo sapiens
taaaattcgtatacaacagtaagtaaaatatgatttaatagcccatctcctatcccgtaatgattatgcatcttctgtcttgtagctcccagcagtaggargacagttgacatttaccatatcatatgaccttgaagaagaggaagaagatacagaacgtgttctccagcttatgattatcttagaggtagagtactgaga

SEQ ID NO: 36162 - DNA, 201 bp, Homo sapiens
ttgggcctgactcatcccatcctctctggacacaaagaagggcagaaaatggatctgggagaaagcaagtagaacacaaccaacacagacagggacaattwtatcccaatagcattcaaggatgttaaagcctaaagaatgtcaaccagccgggtgtagtggcccatgtctgtaatcccagcactttggcaggtcaaagca

SEQ ID NO: 36163 - DNA, 201 bp, Homo sapiens
aaaagctttttctaacataactcacagctgtagacttttcctttcaataataagcaaaaacaattttcatagctacaaaccgccgacacaactttctattyaaagaggacttctttgcaggaggcagaataataactcaacaaaataaatagaatctctaatttcaaaatactattatccccaaaagtaatgggaatttta

SEQ ID NO: 36164 - DNA, 201 bp, Homo sapiens
aagtccgactccttaccaaatctgtagacagtcagcttcggtcccttaaatttaaatgtaaattcctctaagatcattttcccagttgcacaagctgaagwaatagtcttttgggcctgactcatcccatcctctctggacacaaagaagggcagaaaatggatctgggagaaagcaagtagaacacaaccaacacagaca

SEQ ID NO: 36165 - DNA, 201 bp, Homo sapiens
atctgtaaaacataaacaattaagtgatagagtttattcaagagatattcgttacagtgttttcaaaggaaacttagggacaatctccctagacatgtacytgcttgtgtgtcagtttgacttaaatctttggtttaaacaacaacaacaaaaaaaggtacctaacagtgataatcttctatatttaaaatcaaaagctct

SEQ ID NO: 36166 - DNA, 201 bp, Homo sapiens
tttctttgtcaggaacagtgtggcaacaataataaatcagatttagactggctactgaaggggtttgtttaaaagatttaaaaatctcttcagagtcaaakatgttaattctacctggtgaaccagaatgatcctgcatatatcttgggacagacttatattttctaaatctgggtaatgatcatacatgcactgaaaaga

SEQ ID NO: 36167 - DNA, 201 bp, Homo sapiens
tttacatttctacttgaaatgtaactgttttaattttatactgagcaaggacaatggtattactttaatattgagaaaaaactagactatgcgatgtttgktttatttatttttaaggtttggtcttatcactggggaaaaatgcagacacagataatggtcatacccatctgtaaaacataaacaattaagtgatagagt

SEQ ID NO: 36168 - DNA, 201 bp, Homo sapiens
tcaatgttattctgcagcacttgtttgccagcagctgttagggattattgcaggtttctttgtcaggaacagtgtggcaacaataataaatcagatttagwctggctactgaaggggtttgtttaaaagatttaaaaatctcttcagagtcaaagatgttaattctacctggtgaaccagaatgatcctgcatatatcttg

SEQ ID NO: 36169 - DNA, 201 bp, Homo sapiens
taccaggtccaccctacttaaaatgggaagtaactgagaactgattcagttattctatctttggagctttaatgcaattatcaacatctagtaccatatakattacttatagaactatccctgtcttcagcacttccctcccattttctcttcttgttttcccaattctcaactccctgttaaacccaaagcagctaacag

SEQ ID NO: 36170 - DNA, 201 bp, Homo sapiens
ccaagctataaagcatttattaaataaaaatgaagtaaactacatacagtcgctttgactactaattcagccccattcagaattggatatgattgtctgcyagggataacgcactatgctattcagttctactcatgaattccagtcagatcttgatttcttgttcactttgatcctcttatgatgtcaatggtacgtata

SEQ ID NO: 36171 - DNA, 201 bp, Homo sapiens
tgtaggttcagggccagaggacaaaaactgttgaaattgccttgatatagattcatagattgcaaatgagcactttttaaaatttaaacccttgaatatgrtatctcaggcacagagtgagttctttatatatacaaaatgtgattcttaccgcctaccagctgtcttccgatttcaccagatgaccttccctataagttt

SEQ ID NO: 36172 - DNA, 201 bp, Homo sapiens
tgactctttagtcaaactgaggatcagtattttaaaagtctataaaatacttaagccatcttgtagaaataaatagtcttcccacccagaccataatctcygaaataattattaggaattttctttttctttcaaacactttggaattataatttagattctttaaaaactgagttttatgactgttttttcaaaaaagct

SEQ ID NO: 36173 - DNA, 201 bp, Homo sapiens
ataaggctgctgaacttaaaaaaaaaatgctcaaagtgagtgaaggtaagagatgttcattttcttccagtactgaaaattaagagtacagacccacatgytattatacaagagaaagtagtcctatgactgctggataatttacatacattatctaatttatcataaccctgggagagtggaaatattgctattcttatt

SEQ ID NO: 36174 - DNA, 201 bp, Homo sapiens
ccaggaaggagagagtgaaatcaaggagaaggtgatggataggagaaaggaccctgagttattataacagagtccaagagtcagagagctgcacagatggkgtgggatatgccaggtcaaggaaagggccatgggagtgggtgcctgatgcggagaggaggaaaagaggtcagcgaggaggtaaagagcctgggcacaggc

SEQ ID NO: 36175 - DNA, 201 bp, Homo sapiens
ttggaatagatcatggggtgggagttaattgaaggggtagtcaagaaaggccctgctaaagaagtgttgggttggttagagcccagcaagggacttttcakctctggagatgcttgtagagaaatgcagaggtcctaatatgggaatgaacatctcatgtagggtatagcttctcatgtttgaggaacagaaacaaggccc

SEQ ID NO: 36176 - DNA, 201 bp, Homo sapiens
gtcctttttccttatactgttgatctcagaactgttctgcagtcctgaagtatgaaacactattgccattttttggtacagccagtgctctaaaaaatgtraatggatgaaagcgattcaatctattatggaagcagaaacatcttcctatttgctttacaaatttttccgagtaaaatgcagtcaggtttgtaacattgc

SEQ ID NO: 36177 - DNA, 201 bp, Homo sapiens
gattgctcagtgagtactaatgtggaatattactgggaaagatgtttgagtgttgaagtttctcatagctcagaatggttacacagattaaggagaggaaygtctgttgttcaaaagacaaatgaaatttgtcagttcactgaaaatatttttgtttttgtatcttttttaaaactgtttcttaaagtagtcaactgctca

SEQ ID NO: 36178 - DNA, 201 bp, Homo sapiens
gcatatacttgatgatttgattggtggtttgattccagttatattaacttgccagaaactttctagtttccaaacagtgaatacaacttagacctcatgamgcttacattctagttagaagagagaatattaattagataagcacataaaatatacatgtgttagatagtgataaatgacaagaaaaaaagtagagcatgg

SEQ ID NO: 36179 - DNA, 201 bp, Homo sapiens
acttatggattataaatatgtttgtgcaaattttctctagcagtaattctaaaacctttgtggacattaagctgtaattgtagctttctcttgcaagcttytttatcctctgctttattattcccttgtaggaaattaagtattttatataataatgcttagaacatctttctcttttaaagagggaaattaagataaaga

SEQ ID NO: 36180 - DNA, 201 bp, Homo sapiens
atgaagtcacatggctgcagttgccatttattggagaaactgaatttcagggatttggatcaggtcaaggtatgttatgcacataaaccaaatattaatgrtatttatttagtgtgcaccagtgatatttgttttttccttcgctaaactgaagattaaggcaatcagaacctagtaaacattgctgaattcaccattgta

SEQ ID NO: 36181 - DNA, 201 bp, Homo sapiens
gtggaagagagaaatgaatgcaggcaggcaggatgttttcctcgaggttttttatttatatcccctggactgcataactcagtttattcccttctaaaccracttttctagaatgtgttgtctctgttcgacacctacaactctggttcattttctatgcattaaggatgatgtaactttaaaacctctcatgtaaattct

SEQ ID NO: 36182 - DNA, 201 bp, Homo sapiens
agaacacccaaaaacaaacaaaataaaggattcaaatgggtgacatggccagtcctggttacagtatgagacagatgccggttacggtgggcaacagaacwgatgctggctacagtggtcgacagagttcattttagttcaagcagaaggtagggctggtgcttgttacagtggccagtaggcctggtttctggttatagc

SEQ ID NO: 36183 - DNA, 201 bp, Homo sapiens
acatctagcatttgcatcaaggtgagtttgtctcaaaagctctgttctagtgccccactcaagaacagatattgtcaaatttgtaaaagatattttaactrgaatagacttgatttttattgctgatttaatctattacaaactattgcttttctattctaagctgttgtaaaaattattgctttaatatgatcacttaat

SEQ ID NO: 36184 - DNA, 201 bp, Homo sapiens
ttcagcacttgctgtcacctcagcgggccccagagaggcttattcagctggcagagggcaatctgaatacactcgtgaccgaaatgaacgagctgctgacsagggtaaggtggcaaaattatgaatcttctgaaagcagatagattatgtcaatgaaggaaaattacttcaaagttctgaaatgcaaatcaccttcttcct

SEQ ID NO: 36185 - DNA, 201 bp, Homo sapiens
aatagtattcttttgataacacatagtatttatgtagtatactgaattgtcaggtatttatcattaattatctcatgttgggttactttaatgctccgaaraatattttatctcaattgcttttaaaatgtatcaaaatcctaactttgtttctggtctacacaccttcatttgtccatctttttcaggtttattccctgc

SEQ ID NO: 36186 - DNA, 201 bp, Homo sapiens
agacaaaaaaagcacagttctgtagatacttagaaaaaaagattaattttgtttgggggatatcaggaaacgtttcatggaggaatcagcatttgagcaargcttcaggtgattttaacactcccatacaaagtagtgggtgatagaagagtaggaccctccaccaaaatataggtaggaaaccccacctacagggaagca

SEQ ID NO: 36187 - DNA, 201 bp, Homo sapiens
aatacgtgtatgttcattagaaataaactaataagcacataatatgtggagattatgatgggaaacagaaataagtaacatagttctttctatcaagaatrtattatcaactggtaagaaattgaaagaaggcaagtaaaaatgattaaagacaaaaaaagcacagttctgtagatacttagaaaaaaagattaattttgt

SEQ ID NO: 36188 - DNA, 201 bp, Homo sapiens
atggctgtggttttcaaacatctacccataaactgaggccaggtggctgaagacatttccactgctctaagtgagaaacgtagaacagagtgtgttcaccmtcaagctcgatgtattcaattttaaggaataatatttattctgagattatattatagcatttttatggtggctaaaaggcctttctattatgaaatagta

SEQ ID NO: 36189 - DNA, 201 bp, Homo sapiens
tgatggacccatttcctttctccctgacagacccctctgtgcccctggatccaatctcagtgtctaactcatcatcccagattattctgaagtggaaaccmccctccgaccccaatggcaacatcacccactacctggttttctgggagaggcaggcggaagacagtgagctgttcgagctggattattgcctcaaaggtg

SEQ ID NO: 36190 - DNA, 201 bp, Homo sapiens
gaattgcttgaacccaggaggcagaggttgcagtgagctgagatcacgccattgcacgttagcccccaggcaagtgtgacaagagtgaaactgcatctccaaaaaaaaaaaaaaaaaggtctcaccatctactgtcgttccaaagtacctgctgggatgtaatagcacagtgctgcttcctgagatgagaaggaccagata

SEQ ID NO: 36191 - DNA, 201 bp, Homo sapiens
tcctccaagggtacaggctggaatttttgctaaatttgctgtttgggctgcattgtgagtagagtttggcatgcataaaatgaacattccctcttagtccyggttgtccatcctaatttctgggatggactccatctcagtatattccagtatattccaaccttctccttgaggtcctagaaactctattagcaaaacagc

SEQ ID NO: 36192 - DNA, 201 bp, Homo sapiens
aaggggcgccaggagagaaacgacattgccctgaagaccaatggggaccaggcatcctgtaagtcactggtccccaacctttttggcatgagggaccggtktagtggaagatggtttttccatggactggtggtgggtggggatggtttcagcatgattcaagtgcattacatttactatgcactttattcctattatgat

SEQ ID NO: 36193 - DNA, 201 bp, Homo sapiens
tgagcttgtgttcctgcaactagatggtcccagctgggggtgatgggagacagtgacagatcatcaggcattagattttcataaggagtgtgcagtctagrtacctcatgtacacagttcacaatagggttcacacccctgtgagaatctaatgccgccgctaatctgacaggaggcagaactcaggtggtcatgcaagcg

SEQ ID NO: 36194 - DNA, 201 bp, Homo sapiens
agtcttggccaaacccagaaagagatcaaggccacggttgtctgcagggaagttctgcattgcaaagggacggccaggcatctaccaagctcagtcatagktgggggctgtccagggagagtcaggttttggctggaatgctacagcaggtcctgcagtttctgcagctgcaggctgcctgctgactgcacttccctgaca

SEQ ID NO: 36195 - DNA, 201 bp, Homo sapiens
ttaagaagtattttccagtctctcataggcttttaaagctgtgtaaatacttgggtttccgagtggatactcaccattcacaggaaggtacttgatacacratttagagcttattgtctatcctcgaggcattaaggggaggagagaaaatggaatttcctttgctcagcagtcaccaggcaccaagcagggtggcagcag

SEQ ID NO: 36196 - DNA, 201 bp, Homo sapiens
cgagtggatactcaccattcacaggaaggtacttgatacacgatttagagcttattgtctatcctcgaggcattaaggggaggagagaaaatggaatttcytttgctcagcagtcaccaggcaccaagcagggtggcagcaggggaggtggctctccagggactgttgcagattttgcttgtaaagagctgtgtccgtcca

SEQ ID NO: 36197 - DNA, 201 bp, Homo sapiens
gtttgggaaagtaggtacatagaaataagcaaaaagactgtagatacacaagcaataattagaatataaaataagggaaaagatccctttcaaaattgccrtaaaaccttagcacaactcataataaccccatctagaatgacttataaaggaacacgttttaaagtgttactgatatattaaattgtacaaataaacatg

SEQ ID NO: 36198 - DNA, 201 bp, Homo sapiens
ataaaataagggaaaagatccctttcaaaattgccgtaaaaccttagcacaactcataataaccccatctagaatgacttataaaggaacacgttttaaartgttactgatatattaaattgtacaaataaacatgaaagcctgtttcaaatcatttaaagaaagcttactggcaaatggaaaagagtaagttgtatagca

SEQ ID NO: 36199 - DNA, 201 bp, Homo sapiens
gactccgtggccagatgatttctgttacaactactcaattccaccattctactgagaaagctgccatgggtgatatgtaaatgaatggatgtggttgtgtrccaataaaactttatttacaaaaacacgtggtggaccaggtttagttggtgggccagagtttgccaacaactaacagagattacagcaaaatgtctgatt

SEQ ID NO: 36200 - DNA, 201 bp, Homo sapiens
ggcggatcacctgaggtcaggagtttgagaccagcctggccaatatggtgaaaccccttctctactaaaaatacaaaaattagccagatgtggtaacgtgygcctgtagtcccagctactcaggagactgaggcagaagaatcacttgaacctgggaggtggaggttgcagtgagccgagatcacgccactgccctccagc

SEQ ID NO: 36201 - DNA, 201 bp, Homo sapiens
gcagaaattggtttctgcaaaacctattcctcagtccatcacagactcaccacccctcttcaagactgagctgagcctccttcctggccatgaaaacttcytcaacttcctctgttatccacattcaacaaatatgtgttgagtatgtgccaagcaagtggagaggattaggcacgtagcactgaacaagatcaactccga

SEQ ID NO: 36202 - DNA, 201 bp, Homo sapiens
catatctgtttcaataaccttaatttaaaattcctaacttagagaaaggggaggaaaaaaagaggcttcataaaactcataatagaatatttcttctacargataaatattacctaggttaaaccaacagccaagctaacatcattcttaaaattattcttagcagagttaggaacaaaacaaggaagccccatctcatca

SEQ ID NO: 36203 - DNA, 201 bp, Homo sapiens
ctcaaaggtgagtgcaggcagctgtgctaggatcggtggggtttgcacacgtgtgtctgatgcactttgcttcacctctagggaagcagctatctcttccygtgtctcagtgtcggaaggcacacacacacacactccattctatctcatatgaaaacacacatacatgtttttatctatttatttatttattttattttt

SEQ ID NO: 36204 - DNA, 201 bp, Homo sapiens
aaactatggcccatgggctagctgcctgtttttgtaaatgaactcttattggaatgcaaccccacccacttgtttacacatcatgtagggctgctttaagstacaatgacagagtagttgtgacagaggtcatttggcttgcaaaacccaaaatatttattatctagccctttacgggaaaattttgttgacccctcttct

SEQ ID NO: 36205 - DNA, 201 bp, Homo sapiens
cagtgtctaactcatcatcccagattattctgaagtggaaaccaccctccgaccccaatggcaacatcacccactacctggttttctgggagaggcaggcrgaagacagtgagctgttcgagctggattattgcctcaaaggtgagtgcaggcagctgtgctaggatcggtggggtttgcacacgtgtgtctgatgcactt

SEQ ID NO: 36206 - DNA, 201 bp, Homo sapiens
ttataggcatgagccacctcgcccagcctacattttcttctttatccttttttctttgtattttaaaatttgttagctatcaacctttgttgtttaatatrtcttcttaagggatggggagaagtgtgccaattgcatagatgtttcttggagttaatcttcctgacctgagtgatgtgattccttttctaagaattgcag

SEQ ID NO: 36207 - DNA, 201 bp, Homo sapiens
aagatcaccctccttcgagagctggggcagggctccttcggcatggtgtatgagggcaatgccagggacatcatcaagggtgaggcagagacccgcgtggyggtgaagacggtcaacgagtcagccagtctccgagagcggattgagttcctcaatgaggcctcggtcatgaagggcttcacctgccatcacgtggtgagt

SEQ ID NO: 36208 - DNA, 201 bp, Homo sapiens
ttgcagagcattgtaaagaatgtgcaacagggttgaggtcaggagttcaagaccagcctggccaacatggcgaaactccgtctctgctaaaaatacagaamttagctggacgtaatggtgggcgcctataatcccagctgctcctcgggaggctgaagcagggagaattgcttgaacccgggaggcaaaggttgcagtgag

SEQ ID NO: 36209 - DNA, 201 bp, Homo sapiens
aagttaggattcgagttaaatccagtgccaacagggtgaccagttgtctaggtttagccaggactgagggctccctgggatgtgagattttcaatgtccayactcagaaagttctgggcaaatggggacaagttggacacagaagcagaaaaaaaatcaaggagggtctgcagtggaaacgggcattgttcactctgcaga

SEQ ID NO: 36210 - DNA, 201 bp, Homo sapiens; identical to SEQ ID NO: 7449

SEQ ID NO: 36211 - DNA, 201 bp, Homo sapiens
cggcattaccaggtgttgaattcgtgagaatacaaggagaaggcgtgtagcccgtgacccagtcctgccccagacaaaccgatattccctccaaagctctrtttggcagaagaagtgttttcgttccctcttgcctgtggtatctcccctgataagcgttgtggattgttccagaccgtgttgacggggacagcttccttc

SEQ ID NO: 36212 - DNA, 201 bp, Homo sapiens; identical to SEQ ID NO: 7451

SEQ ID NO: 36213 - DNA, 201 bp, Homo sapiens
gtgccctcatgatgtctttaacttgtgtgtcccccgccatcctcccaccagctttctttgcacactgtttctcatgatggacccatttcctttctccctgrcagacccctctgtgcccctggatccaatctcagtgtctaactcatcatcccagattattctgaagtggaaaccaccctccgaccccaatggcaacatcac

SEQ ID NO: 36214 - DNA, 201 bp, Homo sapiens
caaaatgctgggatgggtgccctcatgatgtctttaacttgtgtgtcccccgccatcctcccaccagctttctttgcacactgtttctcatgatggacccrtttcctttctccctgacagacccctctgtgcccctggatccaatctcagtgtctaactcatcatcccagattattctgaagtggaaaccaccctccgacc

SEQ ID NO: 36215 - DNA, 201 bp, Homo sapiens
gtttcaggaaccaaggggcgccaggagagaaacgacattgccctgaagaccaatggggaccaggcatcctgtaagtcactggtccccaacctttttggcaygagggaccggtgtagtggaagatggtttttccatggactggtggtgggtggggatggtttcagcatgattcaagtgcattacatttactatgcactttat

SEQ ID NO: 36216 - DNA, 201 bp, Homo sapiens; identical to SEQ ID NO: 7455

SEQ ID NO: 36217 - DNA, 201 bp, Homo sapiens
cctaatagtgacccttgggtcccaggaacaggagacacgggccagtcaaaggcatgggaagaagctaggagaagttaggattcgagttaaatccagtgccracagggtgaccagttgtctaggtttagccaggactgagggctccctgggatgtgagattttcaatgtccacactcagaaagttctgggcaaatggggaca

SEQ ID NO: 36218 - DNA, 201 bp, Homo sapiens
aagagcgtgtgaaccttttgtgttgtcagactttggaatgaccagagacatctatgaaacggattactaccggaaagggggcaagggtctgctccctgtayggtggatggcaccggagtccctgaaggatggggtcttcaccacttcttctgacatgtggtgagttgtgtgtggatgggtggatggacgctgggcttgaat

SEQ ID NO: 36219 - DNA, 201 bp, Homo sapiens
ctgcatgacatatgctctgttagtcccagtttttcgaatgggcataacaagaccgaacctacctagagttggcacaagttgtaaaaataggatccgtggckgggcacagtggctcacacttgtaattccagcactttaggaggccaaggcgggaggatcacctgaggtcaggagttcgagaccagcctggccaacatggcg

SEQ ID NO: 36220 - DNA, 201 bp, Homo sapiens
cttaacctgttagtagccgtggggctctgggcaagtccactggagttctccgggatctgtttcctcttttgtaaaatgggaaccaaaaggtatcacaggcygggcatggtggctcacgcctgtaatcccagcactttgggaggccgaggtgggtggatcacctgaggtcaggagtccaagaccagcctggccaacatggtg

SEQ ID NO: 36221 - DNA, 201 bp, Homo sapiens
tcagccctcccgcgtagctgagattgcaggcgtgcaccaccacgcctggctaattttttgtatctttactagagatggggtttcaccatgttggtcaggcyggtctcgaactcctgacttcgtgactcaccagcctcagcctcccaaagggctgggatgacaggcgtgagccactgtgcccagccagttctgactttttaa

SEQ ID NO: 36222 - DNA, 201 bp, Homo sapiens
tcagcaaatcttggacagatgaatgggcattcgattcaacatgtgtctgctaggtgggagctgagcgggaatcgcagggcttgggtcccggggatgatggrgaatggcagtgtgactgtggggaagccaggggaatggggtgctggagcccccaaagctataaatcagggcctgatgaacagacagacagatggaccaact

SEQ ID NO: 36223 - DNA, 201 bp, Homo sapiens
gcttgggtcccggggatgatggggaatggcagtgtgactgtggggaagccaggggaatggggtgctggagcccccaaagctataaatcagggcctgatgarcagacagacagatggaccaacttaaccatttcagccccatcggctttgatgatttccctctggctctggcaagagtctcgctcaccaagtggttctcacc

SEQ ID NO: 36224 - DNA, 201 bp, Homo sapiens
gggaagccaggggaatggggtgctggagcccccaaagctataaatcagggcctgatgaacagacagacagatggaccaacttaaccatttcagccccatcsgctttgatgatttccctctggctctggcaagagtctcgctcaccaagtggttctcaccctagggtgggtctggatatttctggggacatctgtggttgtc

SEQ ID NO: 36225 - DNA, 201 bp, Homo sapiens
tttttctaaagcaaagtttctatttgggtatctgctgtttaatttttcagggattttttttttccggttgctaaggaaagtacattaaattttatctttgyatcctgtagaactctttgtgaataatacacggccagagggaagataggctgaggaaacagataggaaggaagttcaagggggggatttctatgtgagaac

SEQ ID NO: 36226 - DNA, 201 bp, Homo sapiens
accatgcccggctaattttttttgtatatttagtagaaatgaggttttgccatgttggccaggctggtctcgagttcctgacctcaagtgctctgcccgcstcggcctcccaaagtgctgggattacaggcgtgagccactgcgcccggctctacccatctttcttacatgatgatgttcagcagccagcctgatagggga

SEQ ID NO: 36227 - DNA, 201 bp, Homo sapiens
ataggtgccagggctcagtagcataaatccaggtagaactgggaagttccaggtatctgggctgtttgctctggtggacaaagagcagctgcaaggtgggkcttgattagccagtgaagtctgaggatccagagggaaacttattcctttcttttgttgaaatcaacatgagcaggaaatggatctttcccccaatcagag

SEQ ID NO: 36228 - DNA, 201 bp, Homo sapiens
tcagatcctgaaggagctggaggagtcctcgtttaggaagacgtttgaggattacctgcacaacgtggttttcgtccccaggtcaggacttggcgctgggmtctcttagtgggtgccaattggcttggtgttggtggaaggtcattacttagggaccgagaggtagtgggacccagagacggcagaagggtgggtggagtc

SEQ ID NO: 36229 - DNA, 201 bp, Homo sapiens
ctgccttacagaggaagggaacttttgtactgggttttgaagggtgaataggagttcaatgaagaagcagcacattctgtgctaaatttggcttcctgatmctcctagaattggccagaagccaatatctggaggccaaaattgggtcactagggtgaccaactcatcacagggccctggattatctctgcaaaagcccac

SEQ ID NO: 36230 - DNA, 201 bp, Homo sapiens
gagtggaatgttattttgttgcttctggccaagtgtcgatattcattttagggcaggtcttcatggaaagtctgctggactataggtctggatacttgccrgaccctgtgtcatcactaaagttagggtgcgtttcagaaccaccctgtaccacagtgaagagggacaaatggccttagggagcaggacccatgggggccc

SEQ ID NO: 36231 - DNA, 201 bp, Homo sapiens
ccgggccacctcccttgcgggcaacggctcttggacggaacccacctatttctacgtgacagactattgtaagtctccatggcagcctcagctgactgggrctgtgcttagcactgagcatggtgggacattgcaggggatgacttggagaggccgcaggtgctggccctggccttgactctcaggcctatcagctgctgc

SEQ ID NO: 36232 - DNA, 201 bp, Homo sapiens
cgtcatttctgagcaggatcctggctgtgagctccctgcgaggggtggacactcccagatgtgcaaagctcagccaccctccttctcctcctctcttcctyccaggagctgcatctctgcgtctcccgcaagcacttcgctctggaacggggctgcaggctgcgtgggctgtcaccggggaactacagcgtgcgaatccgg

SEQ ID NO: 36233 - DNA, 201 bp, Homo sapiens; identical to SEQ ID NO: 7477

SEQ ID NO: 36234 - DNA, 201 bp, Homo sapiens
tagtagagatgggatttcaccatgttggccaggatggtctcagtctcttgacctgcaatctgcccaccttggcctcccaaagtgctgggattacaggcatragccaccatgccagccttttttttttttttttttttttttgagatggagtttcgctcttgttgcctaggctggagtgcaatggccctatctcagctcact

SEQ ID NO: 36235 - DNA, 201 bp, Homo sapiens
caattcagaccttccacggagatcgattccaaactctcatcccgttcccacttcctcgttcccatggaggctgcggttctctctctctgtgccgcttacarattgtcatacctatttccaaaaatgacacagaaaacttcaacgtgtggctaaatttgaacagagaaaaataagcaaagaattcaaggcgcgaggcgtttt

SEQ ID NO: 36236 - DNA, 201 bp, Homo sapiens
ggtgcactggcccggcgagttcggagatgcggaccctccccccctgcaatgtgaggaattttgctgtgtgaccctagtgagccgctgcacctttctggacycctcccgagggaggcctggggtcagggggcccctcggcagtcccgggagctgccacgcggtgacccgatctcctcccgggcacacgcccagcgccgcgcg

SEQ ID NO: 36237 - DNA, 201 bp, Homo sapiens
ctgggtgacaagagtgaaactccatctgaaataaaataaaatataaaagttaaagcagtcatcctggcttttaggaacccgcagaatcaggaggtaagctaaaagtcgtctcccttttgtcacgatggaatgtgaaataggtgcattttccttctgacttatgattctgtttcacggtgcctctgcagaaattcagtacgt

SEQ ID NO: 36238 - DNA, 201 bp, Homo sapiens
ctacttgttttattacctttctaatatatttatgcacacacattatatacatttttttcccctgaactatttgagagttagttgcaggcatgatacatackccttaattcttcagtggatatttcctaagaacaagaaagttctgaggccaggcgtggtggctcatgcctgtaatcccagcactttgggaagctgaggcgg

SEQ ID NO: 36239 - DNA, 201 bp, Homo sapiens
ccgcgcccagccgctaatttttttttaatttattttttgtacagatggagtctcactatattgcccaggctggtcttgaactccagggctcaagcagttcyggcacactagcctcccccaattcaatgggattacaagtgtacccattttttaaaaatgggccagactaaatatttgtctagagatccatacttgagtgat

SEQ ID NO: 36240 - DNA, 201 bp, Homo sapiens; identical to SEQ ID NO: 7479

SEQ ID NO: 36241 - DNA, 201 bp, Homo sapiens
ccctacatacacagcagcacttgtgtgcaggtgtgagggagtgacagcccccggacggtttggcattttcctgcaagtctgccatcttgtctggcagacayagcctgggctgctgactgtccctaccccaaaccagaatttgggcaggaacggacacttgggctcattacgtgtcaatgagggggatcaggtcaggggcac

SEQ ID NO: 36242 - DNA, 201 bp, Homo sapiens
gagacaaggtttctccatgttggtcaggctggtctcgaactccgagcctcaggtgatccgcctgcctcggcttcccaaagtgctgggattacaggcatgarccaccgcgcccagccatttttgtatttttaatagagatggggcttcaccatgttggccaggctgctctggaactcctgacctcaaatgatccgcccacct

SEQ ID NO: 36243 - DNA, 201 bp, Homo sapiens
ttaccatgagtagctttctggagcaagccggagtggttagagctgtgactcggcaaccacaaacacaaccatttttgtgtggaagtgtggctcttcagtcttttttttttttttttttttttgagataaggtctcactctgttacccaggctggagtgcagtggcgtgatcctagctcactgcagcctcaacttcctggac

SEQ ID NO: 36244 - DNA, 201 bp, Homo sapiens; identical to SEQ ID NO: 7557

SEQ ID NO: 36245 - DNA, 201 bp, Homo sapiens; identical to SEQ ID NO: 7559

SEQ ID NO: 36246 - DNA, 201 bp, Homo sapiens
tgaccttcctgtctttagcctcactgagtaaatggggtgtgatcatgaaatcttgattgtctcatagatgcaagagacataaacgacatttgtctgtgtayaatgacagcagatttattttgctaagctgttaagctgttaaaataagcctttaagcccccgcctcaattttccagcagagtggaatgttattttgttgct

SEQ ID NO: 36247 - DNA, 201 bp, Homo sapiens
ataggttagctcccacttatgagtgaaaacatagatgtttggttttccattcctgatttacttcacttaggataagagtgagactaagtaatttataaagygctgggattagaggcgtgagccatggtgcctggccaatgtctggcatcttttctttggtgtaatgttttgagattcatccatggttttgcatttatcaat

SEQ ID NO: 36248 - DNA, 201 bp, Homo sapiens
tcttgaccttcctgtctttagcctcactgagtaaatggggtgtgatcatgaaatcttgattgtctcatagatgcaagagacataaacgacatttgtctgtrtataatgacagcagatttattttgctaagctgttaagctgttaaaataagcctttaagcccccgcctcaattttccagcagagtggaatgttattttgtt

SEQ ID NO: 36249 - DNA, 201 bp, Homo sapiens
aaagcagctgatttttcacagggtgttgtaattaatttaattagctccacactgtggctttgaaaatcttccgtaagctctagcgccagacacatggatakttgcagaatcttattttctagagtcctggaaattttctttcctgtgagagagttgagagcgataattttagggtggttattcatcttcagacacaaggag

SEQ ID NO: 36250 - DNA, 201 bp, Homo sapiens
ttctcccattttcattttctcctggatagattgtacacttgtgccttggtatcctcaatgattccaaaacccccctggggatccagtccctgacataaaayggcgtagtgtttgtacataacctacatacatcctcctgtatactttaaatcatcttggtctggcagtgtggctcacacttgtaatcccagcacgttggga

SEQ ID NO: 36251 - DNA, 201 bp, Homo sapiens
ggacagggattgtgttttctttacttactgctaccttattaaatgcttactagttctaaaagccctgcaattgattcccttcaattttccaactctataaytgcagcatctgcagataatgatgacttcttgccttttgccaataattagaccagttattgctgttaaccttgttatggcaggaacttccagaacagtgtt

SEQ ID NO: 36252 - DNA, 201 bp, Homo sapiens
ctggtttctgtgttgaaatatgaccctagtgtgaaggtcgcggtctcagaccatcttgtttctggtatgttaagaaacagaaaaacaccttttaggacacmatgttaaccattgaggatacatatcagtgttctggaaaaacaaaaacaaaaacaaaacaatctgtaccgcgactgtggttttcatcagggtgggctgcct

SEQ ID NO: 36253 - DNA, 201 bp, Homo sapiens
caaaaaaaaaaaaaaaaaaaaaaaagacagaaaaagaaaaaacaaaagacgtttagctttcctgggtgacccagtgttgcagggattggccatccttggtrtaaggcataggatgtgcagggtagcaggacagcagagtgggcagtgtgtggggtttctttcattgatagggtggttcccagcactcggggtcagggcttg

SEQ ID NO: 36254 - DNA, 201 bp, Homo sapiens
atgttgaccgggtgcagtggctcatgcctgtatttgcagcatttggggagactgaggcaagcggatcgcttgagtccagaagtttgagaccagcctgggcracttggtgaaaccccatctctacaaaaaatacaaaaattaaccaggtgtggtagtgcatgcctgtagtcccagctacttgagaggctgagttgagaggat

SEQ ID NO: 36255 - DNA, 201 bp, Homo sapiens
ctcagctctgggcattttgaggggaccagaagccacagggcttgcctgaccagctgctttagccaaacccactggcattttctttctgggaggtcaccccrgctgctcactgccggccagaggggtgggtgaggccgggacatgctgggtgccaggggaaaccaacccgagatgccacatatggacgtcggcaccaaagca

SEQ ID NO: 36256 - DNA, 201 bp, Homo sapiens
gcctgtaatcccagcactttgggaggccaaggcgggcagatcgttcgagctcaggagtttgagatcagcctggccaacacagcaaaactctgtctctaccaaaaaaaaaaaaaaaaaaatacaaaaatcggctgggcgcagtggctcacgcctgtaatcccagcactttgggaggccaaggcgggtggatcacctgaggtc

SEQ ID NO: 36257 - DNA, 201 bp, Homo sapiens; identical to SEQ ID NO: 7571

SEQ ID NO: 36258 - DNA, 201 bp, Homo sapiens
gcagtgagccaagatcacgccactgcactccagcctgggcgacagagcaagactgtctcaaaaaaaaaaaaaaaaaaaaaaaaaaaagaattccatatggmattctactctgccctcccatcttatttgtgtggttgattaattgattgattgatattttcatgcagctgtgacctggctccttctcctcctccttcttct

SEQ ID NO: 36259 - DNA, 201 bp, Homo sapiens
cagcctaggcaacagagtaagatcccgatgcaggagaaaataataaatgtatgtcgttttacatttgtgggcgtttgtgacagcagcaatgggaaatggawacggtgagaaacccagcacctgggcctggaaaccccctctgggcgggtctctagccaggggccaacaggagtcagagcagggccttggtgagaggtggat

SEQ ID NO: 36260 - DNA, 201 bp, Homo sapiens
ttgtacagatggagtctcactatattgcccaggctggtcttgaactccagggctcaagcagttctggcacactagcctcccccaattcaatgggattacargtgtacccattttttaaaaatgggccagactaaatatttgtctagagatccatacttgagtgataaagctatatggggttccatctgggaattcggttct

SEQ ID NO: 36261 - DNA, 201 bp, Homo sapiens
gaaaatcttccgtaagctctagcgccagacacatggatatttgcagaatcttattttctagagtcctggaaattttctttcctgtgagagagttgagagcrataattttagggtggttattcatcttcagacacaaggagtaagaatgtagggagttcgtgactgtgtttggagaggggagagcatagcagtggtctaatg

SEQ ID NO: 36262 - DNA, 201 bp, Homo sapiens
tcttttgttgaaatcaacatgagcaggaaatggatctttcccccaatcagagaacttcacatgtttttctaatagaatagcagtgtctgaggtatatacayggggagtggccccccgggaaaacgaggccatgaggctcctggcatggagatgacacacgaagactctcgtaacttctagaggggaaaataaagcagtcat

SEQ ID NO: 36263 - DNA, 201 bp, Homo sapiens
gactgacaggcatggctggctgtccatccgttccttagtttgattgcatggcagacatgaggaaggaaggtgagaactgagctagaaagttggcatttggygctctggtttctcaatgcaagaaagtaacactttggcttttatagaataaccttctgaggaaattaacaacccgggcgtttcagccccctgtgaacttga

SEQ ID NO: 36264 - DNA, 201 bp, Homo sapiens
cccgcgtggcggtgaagacggtcaacgagtcagccagtctccgagagcggattgagttcctcaatgaggcctcggtcatgaagggcttcacctgccatcaygtggtgagtccagtgggggtgggacatgggctggctttcctgacccttccctttctctgcctcctcctcctgcacagagcgacagaggacacagggtgta

SEQ ID NO: 36265 - DNA, 201 bp, Homo sapiens
atagcagtgtctgaggtatatacacggggagtggccccccgggaaaacgaggccatgaggctcctggcatggagatgacacacgaagactctcgtaacttmtagaggggaaaataaagcagtcattccaggctgggcatggtggctcacgtctgtaatcccagcactttgggaggccgaggcaggtggatcacctgaggtc

SEQ ID NO: 36266 - DNA, 201 bp, Homo sapiens
ttgggtgagggcttgggtggaaggtggctgcagacccccaagggatcctccaaggatgctgtgtagataagtaagaagtagtgtttccatgctctgtgtaygtgccggacgagtgggaggtgtctcgagagaagatcaccctccttcgagagctggggcagggctccttcggcatggtgtatgagggcaatgccagggaca

SEQ ID NO: 36267 - DNA, 201 bp, Homo sapiens
gagggacatatgtcccatgtgtcctcccccctcctgcccctaatttttttgtttgtttttttatgagatggagtctcactctgtcgccaggctggagtgcrgtagcgtgatctcagctcactgcaacttccgctccccaggttcaggtgattttcctgcctcagcctcccatgtagctgagactacaggtgcgcgacacca

SEQ ID NO: 36268 - DNA, 201 bp, Homo sapiens
aagttactcctgtacttaattgcataaaatgtgtattgcctacatgaatgagaataaaaacttccaaaatgcccccaacaaacaggggtttttgcaccttrccatgagtagctttctggagcaagccggagtggttagagctgtgactcggcaaccacaaacacaaccatttttgtgtggaagtgtggctcttcagtcttt

SEQ ID NO: 36269 - DNA, 201 bp, Homo sapiens
ccttaccatgagtagctttctggagcaagccggagtggttagagctgtgactcggcaaccacaaacacaaccatttttgtgtggaagtgtggctcttcagycttttttttttttttttttttttgagataaggtctcactctgttacccaggctggagtgcagtggcgtgatcctagctcactgcagcctcaacttcctgg

SEQ ID NO: 36270 - DNA, 201 bp, Homo sapiens
agatggagtctcactctgtcgccaggctggagtgcagtagcgtgatctcagctcactgcaacttccgctccccaggttcaggtgattttcctgcctcagcytcccatgtagctgagactacaggtgcgcgacaccatgctcagctaatttttatatttttcgtggagacggagtctcaccatgttggtcaggatggtttgg

SEQ ID NO: 36271 - DNA, 201 bp, Homo sapiens
ggagtgcagtagcgtgatctcagctcactgcaacttccgctccccaggttcaggtgattttcctgcctcagcctcccatgtagctgagactacaggtgcgygacaccatgctcagctaatttttatatttttcgtggagacggagtctcaccatgttggtcaggatggtttggctctcctgacctcgtgatccgctcacct

SEQ ID NO: 36272 - DNA, 201 bp, Homo sapiens
ttgagaccagcctaggcaacatagagagacccgctctcaaaaaaaaaaaaaaaaaaaaaaaaagctgtcgcagtggcactctcctgtagtcctagctcctygggaggctgaagcggaaggatcacttgagcccaggagtcctagactgcagtgagctatgatggctccattgcactccagcctgggccacagagtaagacc

SEQ ID NO: 36273 - DNA, 201 bp, Homo sapiens
cgagttctggcagagctggttattggcaaagtagcccctctatgcctcggtttctccaattctaatggtgatgattgcttgaataattgagttaatatgayctcattgatggattggaccgtgtgtgctgcaaacagattacacactttaaagtgtattcatgcctgtaatcccaacactttggtagactgaggcaagagg

SEQ ID NO: 36274 - DNA, 201 bp, Homo sapiens
tttctgtattttctgttttgttttttatcacataccttcttaattaagaaaaacccaaactaatttgaactttaaaagggaggcaaacaaaaaagtgtcaragtgactggatttttgtgcgcaagtcatttaacaatgcagcgctgcgtctcctatttctctggcttttaaccttgctttggacaaattggtcgctttttg

SEQ ID NO: 36275 - DNA, 201 bp, Homo sapiens
atgctgctgggggctgaggacaatgctaaacctggatgtctcgaggacaggggatggggtttctgtgtcatctatgttctgatgctttttcatttaatacragaacaggtttcctatgatttggcacactgggacattcgacatgtgtttgttgaatgaaaaaaagaaaaaagagaaatgctaacaatttgttgaatagtc

SEQ ID NO: 36276 - DNA, 201 bp, Homo sapiens
ttggtgtccatctcctcctacccatttgtgaatggttttctaggattgatgttcagaattgaagtcacagggaatggagtatgtgcatttttagatctagyatatactccccgaatggtctccaaggtggctgtgacagtttcaccagtgatgcattaaggtatatgtcaaatgtgggcaaggctgcaggaaaattatgtt

SEQ ID NO: 36277 - DNA, 201 bp, Homo sapiens
ggcctcaagtcatctgcccacttcggcctcccaaagtgctgggatgacaggcatgagccactgcgcccagccaatttgttcaaatcttttatattgtcctktcttcatctttatcctgtattatttttgtgacgatggttcctgatttctgtatcacagagttttgttgtgttagttatggctactatgaatagcatattt

SEQ ID NO: 36278 - DNA, 201 bp, Homo sapiens
aaaaacaaaaaaaccgaaaagggctgggcaccatggctcacgcctgtaatcccagcactttgggaggccgaggtgagcggatcacctgaggtcaggagttygagaccagcctggccaacatggtgaaaccccgtctctactaaaagtacaaaaattagctgagggtggtggcgcatacctgtaatcctagctacttgggag

SEQ ID NO: 36279 - DNA, 201 bp, Homo sapiens
cagtctattctggtggcttagaggagggaagatgggaaattttgggtttaatagagtaatatccatcaggttgagggctttgaagcacctgggaatatccmtaagtcactactgagcaccagctgtatacagttattgagcatgtattgtctcccaggcacatggtcctcacaacaatcttttcacagagctaggatttga

SEQ ID NO: 36280 - DNA, 201 bp, Homo sapiens
catcaggttgagggctttgaagcacctgggaatatccataagtcactactgagcaccagctgtatacagttattgagcatgtattgtctcccaggcacatrgtcctcacaacaatcttttcacagagctaggatttgaacccacagtctctctggcttcagaaccctagcttttcttgctatactctgccttacagaggaa

SEQ ID NO: 36281 - DNA, 201 bp, Homo sapiens
caggttcagagtcaggattaaagaccaagacagcttgaggtcatcagaggccaggaatttccatacaggctgcggtccaaagtgccaagctgggctagatrgatgttggggaagagtctctgtcgccctctttccttccccgttaatgctatcagctgagcatgggtcactcctgatttttttttttttttttttaccgag

SEQ ID NO: 36282 - DNA, 201 bp, Homo sapiens
ctcttcctcccaggagctgcatctctgcgtctcccgcaagcacttcgctctggaacggggctgcaggctgcgtgggctgtcaccggggaactacagcgtgygaatccgggccacctcccttgcgggcaacggctcttggacggaacccacctatttctacgtgacagactattgtaagtctccatggcagcctcagctgac

SEQ ID NO: 36283 - DNA, 201 bp, Homo sapiens
ggggtttcaccatgttggccaggctggtctcgaattcctggcctcaagtcatctgcccacttcggcctcccaaagtgctgggatgacaggcatgagccacygcgcccagccaatttgttcaaatcttttatattgtcctttcttcatctttatcctgtattatttttgtgacgatggttcctgatttctgtatcacagagt

SEQ ID NO: 36284 - DNA, 201 bp, Homo sapiens
cagcctggccaacatggcgaaaccccgtctctacttaaaatacaaaaattagccaggcgtggtggcgcgcctgtagccccagctcctcgggaaactgaggyaggagactcgtttgaacccgggaggcggaggttgcagtgagccaagatcgcaccactgcactccaggctgggcgacagagcgagactccatctcaaaaat

SEQ ID NO: 36285 - DNA, 201 bp, Homo sapiens
tgggtgagggcttgggtggaaggtggctgcagacccccaagggatcctccaaggatgctgtgtagataagtaagaagtagtgtttccatgctctgtgtacrtgccggacgagtgggaggtgtctcgagagaagatcaccctccttcgagagctggggcagggctccttcggcatggtgtatgagggcaatgccagggacat

SEQ ID NO: 36286 - DNA, 201 bp, Homo sapiens
gataccttcatggggagttagttacttatgtcaaaatgtagtgcaagggctgggcatggtggctcacgcctggaatcccagcactctgggaggccgaggcrggcagatcacttgaggtcaggagttcgagaccagcctggccaatgtggtgaaactccatctctactaaaaaaaaaaaatacaaaaactagctggacgtgg

SEQ ID NO: 36287 - DNA, 201 bp, Homo sapiens
ctacttgggaggctgaggcaggagaatggcgtgaacctgggaggcggagcttgcggtgagccaagatcgtgcccactgcactccagcctggcagacagagygagactccgtctcaaaaaagaaaaaaagaaaaaagatatcactcgatgactgctaccgaaacattctgtggctgggagaggaaaataccagaaagggtga

SEQ ID NO: 36288 - DNA, 201 bp, Homo sapiens
cttgaagtttctcttgccttccatcatgggtttatttgttcagcaaatgtttatggagggccagcacaggggggaataagaactagagttctgggaggacrtgtgaagaaacaagttccgagccccagggaggaaagaggtcattgcctccctctggggaaaatgtctcttctcatacctggttcacttcttaaatggaat

SEQ ID NO: 36289 - DNA, 201 bp, Homo sapiens
ggagtgcagtggcaccatcttggctcactgcaacctctgcctcccgggttcaagcgattctcctgcctcagcctcccgagcagctggggattacaggtgcmtgccaccatgcctggctaatttttctatttttagcagagacaaggtttcaccatgttggccaggctggtctcgaactcccgacctcaggtgatctgcttg

SEQ ID NO: 36290 - DNA, 201 bp, Homo sapiens
cctccaaggatgctgtgtagataagtaagaagtagtgtttccatgctctgtgtacgtgccggacgagtgggaggtgtctcgagagaagatcaccctccttygagagctggggcagggctccttcggcatggtgtatgagggcaatgccagggacatcatcaagggtgaggcagagacccgcgtggcggtgaagacggtcaa

SEQ ID NO: 36291 - DNA, 201 bp, Homo sapiens
taagaagtagtgtttccatgctctgtgtacgtgccggacgagtgggaggtgtctcgagagaagatcaccctccttcgagagctggggcagggctccttcgkcatggtgtatgagggcaatgccagggacatcatcaagggtgaggcagagacccgcgtggcggtgaagacggtcaacgagtcagccagtctccgagagcgg

SEQ ID NO: 36292 - DNA, 201 bp, Homo sapiens
tttttaagttttttttaaacttcggaaagttttaagctttggaaagaatgtaacaaaatgttattaacatatgtggagctatcgaatcatttaatggtggkttctgtattttctgttttgttttttatcacataccttcttaattaagaaaaacccaaactaatttgaactttaaaagggaggcaaacaaaaaagtgtcag

SEQ ID NO: 36293 - DNA, 201 bp, Homo sapiens
cacggcactcagtgtgacggtcttgtaagggtaactgccttctgctgttttgtcttgaaagcccttatcagaatgtgacggagttcgacgggcaggatgcrtgtggttccaacagttggacggtggtagacattgacccacccctgaggtccaacgaccccaaatcacagaaccacccagggtggctgatgcggggtctca

SEQ ID NO: 36294 - DNA, 201 bp, Homo sapiens
ctgaggcagagaattgcttgaacccgggaggcggaggttgcagtgagctgagttctcaccattgcacttcagcctggacaacagagtgagactctgtctcaaaaaaaaaaaaaaaaaaaccaccaaagaacacaggtcagcatgtttatttaacccattagtgagggaacagcaggattataaagccaaaacatgtatagt

SEQ ID NO: 36295 - DNA, 201 bp, Homo sapiens
tctatcaaagaatctgatgtgttaccgacgtcatcctgtttatttcttgcaacagccttaagaaggaaggaagggactcttattaacaatcccccctccctttttttttttttttttttttttgagatagagtctcgctctgtcacctaggctggagttcagtggcacaatcttgactcactgcaaactcctcttgcgttc

SEQ ID NO: 36296 - DNA, 201 bp, Homo sapiens
agattaagccattgcgctccagcctgggcaacaagagtgaaactccgtctggaaaaaaaaaaaaaaggaaaagaaaagaaaccatcagggtttaatgctcrgcttctggcttaggaagtctggctcttaccgataatgataacctctgcatatatctttatccatagcactatggttataaaattctgcaattctcaaagt

SEQ ID NO: 36297 - DNA, 201 bp, Homo sapiens
atggggccaagagtgacatcatttatgtccagacagatgccaccagtgagtgtgtcttgggaatgtgaatttgtatgtgaatcagacctcttgcttttaayaggctgatgcagtgaggttgtataaaatgctccttgatatggttattggctttttttttttttttagacagggtcttactttgtcacccaggctagagtg

SEQ ID NO: 36298 - DNA, 201 bp, Homo sapiens
gttggcttttattctgtatgcctgaactgtctcgtctgggagacggtagtcatctgtggctagtaaacattggaattgtgtcaggcacagtggctcatacytgtaatctcagcactttgggaggctgaggtgggaggatcgcttgagccaggagttcgagaccagcctgggcaacatagtgagaccccatttctacaaaaa

SEQ ID NO: 36299 - DNA, 201 bp, Homo sapiens
gtaggtcctaaggaaataattcaaatttggggcagggaacaaagctctatgcataagattttcatcagtagcaaaatatgcaaaccactaagatgtccatycattggagaatggacacatggaagacggtgcatccatagaattggtggatgaagagccattgaaaatgatgtttgggggccaagcatggtggctcatgcc

SEQ ID NO: 36300 - DNA, 201 bp, Homo sapiens
cacactgtttctcatgatggacccatttcctttctccctgacagacccctctgtgcccctggatccaatctcagtgtctaactcatcatcccagattattytgaagtggaaaccaccctccgaccccaatggcaacatcacccactacctggttttctgggagaggcaggcggaagacagtgagctgttcgagctggatta

SEQ ID NO: 36301 - DNA, 201 bp, Homo sapiens
cccagattattctgaagtggaaaccaccctccgaccccaatggcaacatcacccactacctggttttctgggagaggcaggcggaagacagtgagctgttygagctggattattgcctcaaaggtgagtgcaggcagctgtgctaggatcggtggggtttgcacacgtgtgtctgatgcactttgcttcacctctagggaa

SEQ ID NO: 36302 - DNA, 201 bp, Homo sapiens
agtcgctggtcatctccggcttgcgacacttcacgggctatcgcatcgagctgcaggcttgcaaccaggacacccctgaggaacggtgcagtgtggcagcytacgtcagtgcgaggaccatgcctgaaggtagggctgctgctccggggtccgagtgtcatgggtgggacatcaaggctgaccaaggacagattctccacc

SEQ ID NO: 36303 - DNA, 201 bp, Homo sapiens
agtagagacagggtttcaccatgttgaccaggctggtctcaaactcctgacctcaggtgatccacccgcctcgacctcccaaattgctaggattacaggcrtgagccaccacaccaagccacatttgcatgtttaagtaactaacatgtctcctccattagaccttgtgctcccaaaggcaggatctacagccactttttc

SEQ ID NO: 36304 - DNA, 201 bp, Homo sapiens; identical to SEQ ID NO: 7447

SEQ ID NO: 36305 - DNA, 201 bp, Homo sapiens; identical to SEQ ID NO: 7448

SEQ ID NO: 36306 - DNA, 201 bp, Homo sapiens
ggtcaccttttcggatgaacgccggacctatggggccaagagtgacatcatttatgtccagacagatgccaccagtgagtgtgtcttgggaatgtgaattygtatgtgaatcagacctcttgcttttaacaggctgatgcagtgaggttgtataaaatgctccttgatatggttattggctttttttttttttttagacag

SEQ ID NO: 36307 - DNA, 201 bp, Homo sapiens
aggcctcatctgcacggcactcagtgtgacggtcttgtaagggtaactgccttctgctgttttgtcttgaaagcccttatcagaatgtgacggagttcgaygggcaggatgcatgtggttccaacagttggacggtggtagacattgacccacccctgaggtccaacgaccccaaatcacagaaccacccagggtggctga

SEQ ID NO: 36308 - DNA, 201 bp, Homo sapiens
ggcctcccaaagtgctgggattgcaggcatgagccacggtgcctggcctgtttcttacagttctatgtgttggttgggtggttcttccgggaacagcctcwctcctgtgctgaggcctctgctgggagagccaggattgcttgtcttctaggaggttcactcaggcttgttcatatggtggtggttgcagggatacccagt

SEQ ID NO: 36309 - DNA, 201 bp, Homo sapiens
aatcctggccgccctccccctacccttcaagagatgattcagatggcggcagagattgctgacgggatggcctacctgaacgccaagaagtttgtgcatcrggacctggcagcgagaaactgcatggtcgcccatgattttactgtcaaaattggaggttcgtctggctttctgctttgaaaacataacgacccaggccag

SEQ ID NO: 36310 - DNA, 201 bp, Homo sapiens
ccgccctccccctacccttcaagagatgattcagatggcggcagagattgctgacgggatggcctacctgaacgccaagaagtttgtgcatcgggacctgrcagcgagaaactgcatggtcgcccatgattttactgtcaaaattggaggttcgtctggctttctgctttgaaaacataacgacccaggccaggtttgatt

SEQ ID NO: 36311 - DNA, 201 bp, Homo sapiens; identical to SEQ ID NO: 7529

SEQ ID NO: 36312 - DNA, 201 bp, Homo sapiens
agagcgtgtgaaccttttgtgttgtcagactttggaatgaccagagacatctatgaaacggattactaccggaaagggggcaagggtctgctccctgtacrgtggatggcaccggagtccctgaaggatggggtcttcaccacttcttctgacatgtggtgagttgtgtgtggatgggtggatggacgctgggcttgaatt

SEQ ID NO: 36313 - DNA, 201 bp, Homo sapiens
ccctgtacctcagtttccccatttgtaaaacaaaaaaataaaggagctaacagtgtatctacttcacatgtggggtgcagcagcatgctggagttggcttsctggagccagtggtgaaattttcaggcaatttgtgagccatttgttaaacatagatattcataaaaattacataaacctacagttaaacaaattacatta

SEQ ID NO: 36314 - DNA, 201 bp, Homo sapiens
ctcagtttccccatttgtaaaacaaaaaaataaaggagctaacagtgtatctacttcacatgtggggtgcagcagcatgctggagttggcttgctggagcyagtggtgaaattttcaggcaatttgtgagccatttgttaaacatagatattcataaaaattacataaacctacagttaaacaaattacattaaaaacaaa

SEQ ID NO: 36315 - DNA, 201 bp, Homo sapiens
caaaaaaataaaggagctaacagtgtatctacttcacatgtggggtgcagcagcatgctggagttggcttgctggagccagtggtgaaattttcaggcaatttgtgagccatttgttaaacatagatattcataaaaattacataaacctacagttaaacaaattacattaaaaacaaaagtttttaaattaacaaagctt

SEQ ID NO: 36316 - DNA, 201 bp, Homo sapiens
atctcatccaagagttacatccctgcctctcacttcctctccttacagccaaggctgatgacattgttggccctgtgacgcatgaaatctttgagaacaaygtcgtccacttgatgtggcaggagccgaaggagcccaatggtctgatcgtgctgtatgaagtgagttatcggcgatatggtgatgaggtaaggcccttga

SEQ ID NO: 36317 - DNA, 201 bp, Homo sapiens
gtggcacaatctcggctcactgcaacccccgcctcccgggttcaagcaattctgctgtctcagcctcccaagtagctgggattacaggcacctgccaccaygcctgtataatttttgtatttttagtagagatggggtttcaccatgtcggccaggctggtctcgaactcctgacctcaggtgatccacctgccatggcct

SEQ ID NO: 36318 - DNA, 201 bp, Homo sapiens
tcactgtctcatcactttctggaatgtttcattgctttccagaatctttcatcactttctggaatcttccatcattttctggaatcttccaccactttccrgaatcttccatcattttccacaatcttccattgctttttagactcttccatttcttgctttttcctggcacctttgtaacccaggaccacatagaggtcc

SEQ ID NO: 36319 - DNA, 201 bp, Homo sapiens
tggtgatggagctgatggctcacggagacctgaagagctacctccgttctctgcggccagaggctgaggtaagctgcttcgggggacccagcggggtactyggtggagcacccgctcctggcctcctcggatcccagtgctgctgaaacaccaaccccgtgtttctgttttagaataatcctggccgccctccccctaccc

SEQ ID NO: 36320 - DNA, 201 bp, Homo sapiens
ggtgatggagctgatggctcacggagacctgaagagctacctccgttctctgcggccagaggctgaggtaagctgcttcgggggacccagcggggtactcrgtggagcacccgctcctggcctcctcggatcccagtgctgctgaaacaccaaccccgtgtttctgttttagaataatcctggccgccctccccctaccct

SEQ ID NO: 36321 - DNA, 201 bp, Homo sapiens; identical to SEQ ID NO: 7553

SEQ ID NO: 36322 - DNA, 201 bp, Homo sapiens
agacttgagccccccttttctgtttctttctccagggctgaagctgccctcgaggacctggtctccaccattcgagtctgaagattctcagaagcacaacyagagtgagtatgaggattcggccggcgaatgctgctcctgtccaaagacagactctcagatcctgaaggagctggaggagtcctcgtttaggaagacgtt

SEQ ID NO: 36323 - DNA, 201 bp, Homo sapiens
aagtgttttgaataagggatgcccaagctgtgttttttcattgagatgtcagggttgacagttcctttctctttggctgttcccgagttattttttcttgyggcattagattgttgggtgagtaacatgtgaccctatgggatgtaacttcccaggcctcatctgcacggcactcagtgtgacggtcttgtaagggtaact

SEQ ID NO: 36324 - DNA, 201 bp, Homo sapiens; identical to SEQ ID NO: 7478

SEQ ID NO: 36325 - DNA, 201 bp, Homo sapiens
agtcgtgggccggattttgctcgagggcagcagtttgccaccgcctgtgctagtcagtgaatgttcttcttgcttgggagaggaaaaggagtggaaaactrtagattcggtttttttaaaaaaatagtttagttcttatctgattatagaagtgatattgcttataatagacatttggaaaaagacacttgtaaacgaaaa

SEQ ID NO: 36326 - DNA, 201 bp, Homo sapiens
ttcttgcttgggagaggaaaaggagtggaaaactgtagattcggtttttttaaaaaaatagtttagttcttatctgattatagaagtgatattgcttatartagacatttggaaaaagacacttgtaaacgaaaaaaaagcaaaacattcatcttattccacaacgcatgtcgccgagagtagtttattgggggttgttcc

SEQ ID NO: 36327 - DNA, 201 bp, Homo sapiens
tctgattatagaagtgatattgcttataatagacatttggaaaaagacacttgtaaacgaaaaaaaagcaaaacattcatcttattccacaacgcatgtcrccgagagtagtttattgggggttgttccttctagtgatcttcaggaatctgtcgtgtctactgaaggtttccttaaccattcctgttattgggcattaag

SEQ ID NO: 36328 - DNA, 201 bp, Homo sapiens
ctggactctaaggaatccccccacctcagcctctcaaagtgctgagatttcacatgtgagccaccacgctggacttgacttgattttgttttctttttcttttttttttttttgagacagagtctcgctctgttgtccaggctggagtgcagtggcatgatctgagctcactgcaacctccgcctcctgggttcaagcgat

SEQ ID NO: 36329 - DNA, 201 bp, Homo sapiens
actcttatgtcctgactaatcctgtaggcattgtgaaccccgaaaatctgagacaggtctcagttaatttaggaagtttattttgccaaggttgaggacgygtgcccgtggcacagcctcaggtggtcctgaggacaggtgcccaaggtggtcagagcacagtttggttttatacattttagggagacatgagacatcagt

SEQ ID NO: 36330 - DNA, 201 bp, Homo sapiens
tatgtgcgtgtgtgtttgcatgtgtgtgtttgcatgtatgtgttggcatgtgtgtttgcgtgtgtgtgtgcgtttgcgtgtgtgtgtttgcgcgcgcgcgygtgtgtgtgtgtctaaatggcttctttgttactactatcaactgtcatcggcaggtcctttggcgtggtcctttgggaaatcaccagcttggcagaacag

SEQ ID NO: 36331 - DNA, 201 bp, Homo sapiens
gagtgcagtggtgcgagctcggctgacttcaagctccgcctcccgggttcacaccattctcttgcctcagcctcccgagtagctaggactacaggcacccrccaccgcgcctggctaatttttttttttttttgtatttttagtagaaatggggtttcaccgtggtctcgatctcctgacctcgtgatccacccaccttgg

SEQ ID NO: 36332 - DNA, 201 bp, Homo sapiens
cccaacaatcttatttattgttgagaccactaaggcttcgagaggttaagcaacttctacttccaacactgccccgcccaccccttccgccgcgcaccccmcacacatgggtagtaagtagtggagatgggatttgaagctggggattctggctcagaatccaagctctttacctttgtgtcttatagatgtcattgcggg

SEQ ID NO: 36333 - DNA, 201 bp, Homo sapiens
ctccctcaggcagctgttaaacatttacaagctcaccaatggtttggaggcttaaaccagttaatagatgtgtctgacatgtgggtaatgatgtagacgtrccgcttttactgttagtgtttggttggctttcactgtccgatccagaattgctgcatatgcagacaggaattggacaaagccatttatttatttatttat

SEQ ID NO: 36334 - DNA, 201 bp, Homo sapiens
gtgaccatgggttagaccatgggattgaaagccttttgaatagtctttcttgagtggcttaaaacagcaactgtttatttattttctttttttgtttgttkgtttttgtttttgttagtttgttttttgaaatggagtctcactctgtcacccaggctggaggacagtggtgcaatctcagctcactgcaacgctgtctcc

SEQ ID NO: 36335 - DNA, 201 bp, Homo sapiens
gtgacagactattgtaagtctccatggcagcctcagctgactggggctgtgcttagcactgagcatggtgggacattgcaggggatgacttggagaggccrcaggtgctggccctggccttgactctcaggcctatcagctgctgcggtgcttgccctctttgatcctgcactttttttttttttgagatggaggcttgct

SEQ ID NO: 36336 - DNA, 201 bp, Homo sapiens
ggggtttgcacacgtgtgtctgatgcactttgcttcacctctagggaagcagctatctcttcctgtgtctcagtgtcggaaggcacacacacacacactcmattctatctcatatgaaaacacacatacatgtttttatctatttatttatttattttattttttatttatttacttttttgagatggagtttcactcttg

SEQ ID NO: 36337 - DNA, 201 bp, Homo sapiens
agaatactgacctctgagcccactgcctggtcccactgcacctacgggactgtttcgggactgctggaaaatcaggatgtggaagagcagcagagaggttyatggacaagggagggaaggaacagggtggcccacccattccaggagtggatgtgatttttgatgtgaactttgttggaaacacattgatatgaaacatat

SEQ ID NO: 36338 - DNA, 201 bp, Homo sapiens
ttatctgagcccaacgctctggggaagccacccagagtgagtgagtccttaaatagacctaaatagaatccttggaattgtctgtgaggactcccttggarcccccagcatgagtccttccatgggacatgttggatggttggaaatcgggagtgggatagttgaaaaaggaagatgggttagtgaagggtggtgggagag

SEQ ID NO: 36339 - DNA, 201 bp, Homo sapiens
tgatgagttttgaacatgtattgtctttgcttttaggataatttatttaattgtaagcctctataatttatattttttgttctatttggaaggcattgtamaatttaatctttaatgatgcttgtatttaacaactggctcactagtttcctgaaaatttaataattgtttctcatcagtcgggatgagctcgctctagaa

SEQ ID NO: 36340 - DNA, 201 bp, Homo sapiens
gacctgtgggccaaatccagtccgccagctgctatttttgtatgacctatgagctaagaattttttattttatttttatttttagagatggggtctcactstgtcgcctgggctggagtgcagtggggtgatcataggccactgccacctcagtcagcctcctcagtagctggaaccacaggcaggcaccaccacgcccag

SEQ ID NO: 36341 - DNA, 201 bp, Homo sapiens; identical to SEQ ID NO: 7482

SEQ ID NO: 36342 - DNA, 201 bp, Homo sapiens
tgcccgcccccgtactaccacttccaggactggcgctgtgtgaacttcagcttctgccaggacctgcaccacaaatgcaagaactcgcggaggcagggctrccaccagtacgtcattcacaacaacaagtgcatccctgagtgtccctccgggtacacgatgaattccagcaagtgagttctggatgtgggtctggggggc

SEQ ID NO: 36343 - DNA, 201 bp, Homo sapiens
cactataaccccaaactctgcttgtcagaaatccacaagatggaagaagtttcaggaaccaaggggcgccaggagagaaacgacattgccctgaagaccartggggaccaggcatcctgtaagtcactggtccccaacctttttggcatgagggaccggtgtagtggaagatggtttttccatggactggtggtgggtggg

SEQ ID NO: 36344 - DNA, 201 bp, Homo sapiens
gcaggtgcgcctcctgggagtggtgtccaagggccagcccacgctggtggtgatggagctgatggctcacggagacctgaagagctacctccgttctctgyggccagaggctgaggtaagctgcttcgggggacccagcggggtactcggtggagcacccgctcctggcctcctcggatcccagtgctgctgaaacaccaa

SEQ ID NO: 36345 - DNA, 201 bp, Homo sapiens
tagggctctgtgagaggtggggcagtcaaggtggcagatgctaggaccaaggctgaaggttaagagcgtgtgaaccttttgtgttgtcagactttggaatraccagagacatctatgaaacggattactaccggaaagggggcaagggtctgctccctgtacggtggatggcaccggagtccctgaaggatggggtcttca

SEQ ID NO: 36346 - DNA, 201 bp, Homo sapiens
gctgcagacccccaagggatcctccaaggatgctgtgtagataagtaagaagtagtgtttccatgctctgtgtacgtgccggacgagtgggaggtgtctcragagaagatcaccctccttcgagagctggggcagggctccttcggcatggtgtatgagggcaatgccagggacatcatcaagggtgaggcagagacccgc

SEQ ID NO: 36347 - DNA, 201 bp, Homo sapiens
acggattactaccggaaagggggcaagggtctgctccctgtacggtggatggcaccggagtccctgaaggatggggtcttcaccacttcttctgacatgtkgtgagttgtgtgtggatgggtggatggacgctgggcttgaattccaggtgctagtgagagccaagagcgggggaaggaagcctgccatcctcctggacgc

SEQ ID NO: 36348 - DNA, 201 bp, Homo sapiens
tttgccccagagaatgggtatgccattctctctcataagctgtactctcttattatcagtaatttctaaatagcctgtaaaatttatatggactcaaaatrcaggaaacatcgataggttgaaactcaacaacttgtaaaaagttactcctgtacttaattgcataaaatgtgtattgcctacatgaatgagaataaaaac

SEQ ID NO: 36349 - DNA, 201 bp, Homo sapiens
cctccgcctcctggattcaaatgattctcctgcctcagccttccgagtgactgggacttataggcaccagccaccatgcccggctaagttttgtattttcrggacagagggggctttgccatgttggccaggatggtctcaaacccctggcctcgagcaatacacccacctcagcctcgcaaagtgctgggattacaggtg

SEQ ID NO: 36350 - DNA, 201 bp, Homo sapiens
atcatgttccattgtatggagggagcacattttgcctgtgtattcatccatctacgggcacttggtcgctttcacatttctgccattgtgaatcagggccrctgctgttgacgcatctagcttttcaatgcctgcattaaccttgttgctgaggctttaggaaacttatttatttatttattttttgagacggagttttgc

SEQ ID NO: 36351 - DNA, 201 bp, Homo sapiens
atggttaggggaattaaaagaaaaacaaaaaaacatggcatgtgctaatgatccatagcctggacaccctctctccattatcctgcaatggatttggggcraagataccaggagaggtccaatgcacgaagccttacatgggaagagtggagacggggtctatgcagttcgtttattgactgcctactaggtgtcatgttc

SEQ ID NO: 36352 - DNA, 201 bp, Homo sapiens
ccactggcattttctttctgggaggtcaccccagctgctcactgccggccagaggggtgggtgaggccgggacatgctgggtgccaggggaaaccaacccragatgccacatatggacgtcggcaccaaagcaggagggggaggctgaaagcagcaaatccctcctccctgggtctgagattacagctccgagtcaaagtc

SEQ ID NO: 36353 - DNA, 201 bp, Homo sapiens
agctgggattacaggcacgtgccaccatgcctggctaatgtttgtatttttagtagagatggggtttcgccatgttgcctaggctggtcttgaactcctgrcctcaagtgatccgcctgccttggcctaccaaagtgctgggattacaggtgtgaaccactactctgggcttgccttggtattttaacaatcggaattgtc

SEQ ID NO: 36354 - DNA, 201 bp, Homo sapiens
ccaggattggaattatttatttatttatttagtgagatggagtcttgctctgttgcccaggctgaagtgcagtggcgcaatctcggctcactgcaaccccygcctcccgggttcaagtgattctcctgcctcagcctcccaagtagctgggactacaggcgcccaccaccacacccggctaattgttgtgttttttttgta

SEQ ID NO: 36355 - DNA, 201 bp, Homo sapiens
tttttctttttcttttgttttaaagaaaaacacaccgttttttaaacacggttgcccgaactctcatcttcttcctccctgccctccctccctccctcctytccttccttccttccctccctccttccttcctttttctttatttcctcccttccttccttctctccctccctctcccttcctccctttatccttctctct

SEQ ID NO: 36356 - DNA, 201 bp, Homo sapiens
cttccttcctttttctttatttcctcccttccttccttctctccctccctctcccttcctccctttatccttctctctttccttccttccttctctttctyttcttttcttctttcttccttgctttctttttatttcttacctcccttcctctctcccttcctctctccctcctccttcctctttccctttctccctcct

SEQ ID NO: 36357 - DNA, 201 bp, Homo sapiens
tcctgacctcgtgatccgccctccttggcctcccaaagtgctgggattacaggcgtgagccaccgcgcccagccgctaatttttttttaatttattttttrtacagatggagtctcactatattgcccaggctggtcttgaactccagggctcaagcagttctggcacactagcctcccccaattcaatgggattacaagt

SEQ ID NO: 36358 - DNA, 201 bp, Homo sapiens; identical to SEQ ID NO: 7496

SEQ ID NO: 36359 - DNA, 201 bp, Homo sapiens
tttagtagagacggggtttcaccatattggccaggctggtctggaactcctgacctcatgatccacctgccttggcctcctaatgtgctgggattacaggygtgagccaccgcgtctggcctgtttttttgtttatttccataggttttgggggaacaggtggtatttggttatatgagtaaattatttcgtggtgatttg

SEQ ID NO: 36360 - DNA, 201 bp, Homo sapiens
ggaataataattgccgatgtgtggcagacttaccaaatactagaccctgtgctaagtgttttatatctattattttatttaattttcttggtcactgcatracatatgctctgttagtcccagtttttcgaatgggcataacaagaccgaacctacctagagttggcacaagttgtaaaaataggatccgtggccgggcac

SEQ ID NO: 36361 - DNA, 201 bp, Homo sapiens
tgaaatatgtctatagaaacccactggatattctctcctttccttagacaatctggcagctgagctagaagccaacctcggcctcattgaagaaatttcarggtatctaaaaatccgccgatcctacgctctggtgtcactttccttcttccggaagttacgtctgattcgaggagagaccttggaaattgggtacgtggg

SEQ ID NO: 36362 - DNA, 201 bp, Homo sapiens
gcctgggcaatacagaaagagcctatttctactacaaatataaaaattagctgggcatggtgacatgcacctgtagtcgcagctacatgggaggctgaggygggagaatcgcttaagcccaggaagtcgaggctgcagtgagctgtgacttgctactgcactccagcccatgcagctgagcgagatcctctttcaaacaaa

SEQ ID NO: 36363 - DNA, 201 bp, Homo sapiens
cctgccaccatgcctggctaatttttttgtatttttagtagagacagggtttcaccgtgttagccaggatggtctcgatctcctgacctcatgatccgccygcctcggcctcccaaagtgttgagattacaggcatgagccaccgtgccgggccttgtatcattcttaagactttgcatcctcataggttagctcccactt

SEQ ID NO: 36364 - DNA, 201 bp, Homo sapiens; identical to SEQ ID NO: 7578

SEQ ID NO: 36365 - DNA, 201 bp, Homo sapiens
ctcctgtatactttaaatcatcttggtctggcagtgtggctcacacttgtaatcccagcacgttgggaagcagaggtgggaggattacttgagcccaggasttcaagaccagcctgggcaacatggcgagacccccatctctacaaaaaatttaaaaattaattgggtgtagtggcatgtgcctgtagtcccagctactca

SEQ ID NO: 36366 - DNA, 201 bp, Homo sapiens
actcacagtgagtaagggaaagtccttaccttgatggatttttgcgcataagtaaatcgacagatattgtaaggtcaggttgtggtctgtgctgtgaaggsaagtgcagcagggtaataggtggaatggaaatgggcaacttttccctataaagggctctttcatgaatatattcagcctggcaggccgggcagtctctgc

SEQ ID NO: 36367 - DNA, 201 bp, Homo sapiens; identical to SEQ ID NO: 7499

SEQ ID NO: 36368 - DNA, 201 bp, Homo sapiens
acatagtgaaaccccatctctactaaaaataaaaaaaattagctggacaccatagcgcgcctgtggtcccagctactagggaggctgaggcaggagaatcrcttgaacctgggaggtggaggttgcagtgagccgagattgcgccactgcaccactccagcctgtgtgacagaatgtgacagaatgcgggcacatcacgag

SEQ ID NO: 36369 - DNA, 201 bp, Homo sapiens
gcaggtggatcacgtgaggtgagaagtttaagaccagcctggccaacatggtgaaaccctgtctctactaaaaatacaaaaaaattagccaggcttggtgrtgcgtgcctgtaatcccagctacgcaggaggctgaggcaggagaatcgtttgaactcaggaagtggaggttgcaatgagctgggatcgcgccactgcact

SEQ ID NO: 36370 - DNA, 201 bp, Homo sapiens
cctccccctacccttcaagagatgattcagatggcggcagagattgctgacgggatggcctacctgaacgccaagaagtttgtgcatcgggacctggcagmgagaaactgcatggtcgcccatgattttactgtcaaaattggaggttcgtctggctttctgctttgaaaacataacgacccaggccaggtttgatttcag

SEQ ID NO: 36371 - DNA, 201 bp, Homo sapiens
gttctccgggatctgtttcctcttttgtaaaatgggaaccaaaaggtatcacaggctgggcatggtggctcacgcctgtaatcccagcactttgggaggcygaggtgggtggatcacctgaggtcaggagtccaagaccagcctggccaacatggtgaaaccccatctctattaaaaatacaaaaattagccaggtgtggt

SEQ ID NO: 36372 - DNA, 201 bp, Homo sapiens
ttttgttatcaggcagcttctccctcacccttcaccccatgctagcaagatggcaaaacccttagatactccagaaggaagacaatttccccttccagcaygttctagcaaaaccctcactgcactgacttaagttctgtacccaccacctctgagcccccacaggaatagaaggtggtgctcagcttggcttggatcttg

SEQ ID NO: 36373 - DNA, 201 bp, Homo sapiens
gtggctcacgcctgtaatcccagcactttgggaggccgaggtgggtggatcacctgaggtcaggagtccaagaccagcctggccaacatggtgaaaccccrtctctattaaaaatacaaaaattagccaggtgtggtggctggtgcctgtaatcccagctactcaggaggctgaggcaggagaatcacttgaacccaggaa

SEQ ID NO: 36374 - DNA, 201 bp, Homo sapiens
gcgtgtgtgtgtttgcgcgcgcgcgtgtgtgtgtgtgtctaaatggcttctttgttactactatcaactgtcatcggcaggtcctttggcgtggtcctttsggaaatcaccagcttggcagaacagccttaccaaggcctgtctaatgaacaggtgttgaaatttgtcatggatggagggtatctggatcaacccgacaac

SEQ ID NO: 36375 - DNA, 201 bp, Homo sapiens
ccaggcttggtggtgcgtgcctgtaatcccagctacgcaggaggctgaggcaggagaatcgtttgaactcaggaagtggaggttgcaatgagctgggatcrcgccactgcactctagcctgggcgacagagtgagactccatctcaaaaaaaaaaaaaaaaaaaaaaaaagccaggcgctgtggctcatgcctgtaatccc

SEQ ID NO: 36376 - DNA, 201 bp, Homo sapiens
ggatcacgtgaggtgagaagtttaagaccagcctggccaacatggtgaaaccctgtctctactaaaaatacaaaaaaattagccaggcttggtggtgcgtrcctgtaatcccagctacgcaggaggctgaggcaggagaatcgtttgaactcaggaagtggaggttgcaatgagctgggatcgcgccactgcactctagcc

SEQ ID NO: 36377 - DNA, 201 bp, Homo sapiens
agatgaattgccgttggcctttgtaaaagaggagagattgttccagattggagtggcagagatgtgctttggtttgggtggcaaggatcacaaagaaagargatgaggttgggtgtggtgggtcatacctgtaaacccagcactttgggaggccgaggcaggaggatcacttgaacctagaattcgagctcagcctgggca

SEQ ID NO: 36378 - DNA, 201 bp, Homo sapiens
acaaacaaaaacagaaggaaggaaggaaggaaagaaagaaagaaagaaagagaaaagacaagacaagaaaaaaaaaaaaaaagaaaagacagggtgagagrgaagggtattcgggtggatgaaatggcaaagagaaggccaagaggcgttttgtgggcaagagtgaagagggtgcctcatgccgggaagggaggcttggac

SEQ ID NO: 36379 - DNA, 201 bp, Homo sapiens
actccagcctgggtgacaagagtgaaactccatctgaaataaaataaaatataaaagttaaagcagtcatcctggcttttaggaacccgcagaatcaggargtaagctaaaagtcgtctcccttttgtcacgatggaatgtgaaataggtgcattttccttctgacttatgattctgtttcacggtgcctctgcagaaatt

SEQ ID NO: 36380 - DNA, 201 bp, Homo sapiens
caaacaaaaacagaaggaaggaaggaaggaaagaaagaaagaaagaaagagaaaagacaagacaagaaaaaaaaaaaaaaagaaaagacagggtgagaggraagggtattcgggtggatgaaatggcaaagagaaggccaagaggcgttttgtgggcaagagtgaagagggtgcctcatgccgggaagggaggcttggacc

SEQ ID NO: 36381 - DNA, 201 bp, Homo sapiens
gcggggaccggggaggggggccgggggaggctgagggctatcagttgaaactgaccttttggcccaatccttttgggaagaaggcgggtagagttaaaatscatcgtaatggaaaggcggctttccctttggctgtctgctaacttggtgactggcctgacaagtttttcttttccttcctcctacctgatactcactgac

SEQ ID NO: 36382 - DNA, 201 bp, Homo sapiens
gttacttcccatgtcacccgaccctttgtcagaattaaaatctgttctttgtgactgaacacctgaaatgccccggggaggacccaaggaagtcagcgagygcctgtgcgtcaggctggcagcccaggtccttcagtgatctgtttctctcaatgcgcctgtgtcagatagaaccgtgcatttcccagtaaaaggaggtga

SEQ ID NO: 36383 - DNA, 201 bp, Homo sapiens
ttgtgttgtcagactttggaatgaccagagacatctatgaaacggattactaccggaaagggggcaagggtctgctccctgtacggtggatggcaccggastccctgaaggatggggtcttcaccacttcttctgacatgtggtgagttgtgtgtggatgggtggatggacgctgggcttgaattccaggtgctagtgaga

SEQ ID NO: 36384 - DNA, 201 bp, Homo sapiens
tttcttatctccctgaacctagtaatattttcctctaggaatctactttggggaagtaataagacaatcagacaatgatcaaaggaatatttataacagcaaaaaaaaaaaaaaagagccatgtgcggtggctcatgcctgtaatcctggcactttgggaggctgaggtgggcagatcacctgaggtcaggagtttgagac

SEQ ID NO: 36385 - DNA, 201 bp, Homo sapiens
ttaaaatctgttctttgtgactgaacacctgaaatgccccggggaggacccaaggaagtcagcgagcgcctgtgcgtcaggctggcagcccaggtccttcwgtgatctgtttctctcaatgcgcctgtgtcagatagaaccgtgcatttcccagtaaaaggaggtgatgtgtgtgctggagtttcaagattgtacccctta

SEQ ID NO: 36386 - DNA, 201 bp, Homo sapiens
ccaaacacattcagcacgttacacagagtatctcattgatcacattttattacctctaggaaattttgagaggccccattatttttatggacagctaggcaaaaaaaaaaaaagggccgttaattctaattttatttttttcgtagaatatagatcctgagtactgttaagtgtttgtaaaatgcattgcttgtaagatgc

SEQ ID NO: 36387 - DNA, 201 bp, Homo sapiens
tgcagcctcagccttttgggctcaagcaatcctccagcctcagcctggccagtagctggaactatgggtgcatgccaccacgcccagctaattttatttayttatttacttatttattaaagagatggagtcttgctatgtttcccaggcagctcacaaattcctgtcctcaagtgaccctctcgcttcagcctcccccat

SEQ ID NO: 36388 - DNA, 201 bp, Homo sapiens
aaagcaaaacctcgtatcaaataattaaataaataaataaacaaataaataaataaaaaattacactgtagggcatgtggtaggtgaagcccaccattgtyaagtacctacctagagggtttggggtagagggtcctgtggcttcttctattttttttttttggcggagtctcactctgtcaccaggctggagtgctgtgg

SEQ ID NO: 36389 - DNA, 201 bp, Homo sapiens
ccgcgcctggctgtggcttctttatcctagaagtttctttgcctctcgttttgtcccaggcgaggagggtcttggatctttaatgactccatggcttattragtgtagcccagaaagaatggttgtttaataggctttattaccgagtgtttccaagggcttacctggggaaggaaaacatttttactcggaggtctgata

SEQ ID NO: 36390 - DNA, 201 bp, Homo sapiens
cagggtttcgccatgttggccaggctggtcttgaactccggacctcaggtgatccacccacctcagccacccaaagtgctacaattacaggcgtgagccaycgcacctgggctattttcacttctttcgaagttatacctaggagtggaatcgctgggtcagttggtaattctatatttaattaatggaatcaagatttct

SEQ ID NO: 36391 - DNA, 201 bp, Homo sapiens
ctgaggtgggagaacggcttgaacccaagagggagaggttgcagtgagccgagatcatgccactgcactccagcctgggtggcagagcgagactggtctcaaaaaaaaaaaaaatttttttttgttccagtctattctggtggcttagaggagggaagatgggaaattttgggtttaatagagtaatatccatcaggttga

SEQ ID NO: 36392 - DNA, 201 bp, Homo sapiens
tgaggtgggagaacggcttgaacccaagagggagaggttgcagtgagccgagatcatgccactgcactccagcctgggtggcagagcgagactggtctcaaaaaaaaaaaaaatttttttttgttccagtctattctggtggcttagaggagggaagatgggaaattttgggtttaatagagtaatatccatcaggttgag

SEQ ID NO: 36393 - DNA, 201 bp, Homo sapiens
gaggtgggagaacggcttgaacccaagagggagaggttgcagtgagccgagatcatgccactgcactccagcctgggtggcagagcgagactggtctcaaaaaaaaaaaaaatttttttttgttccagtctattctggtggcttagaggagggaagatgggaaattttgggtttaatagagtaatatccatcaggttgagg

SEQ ID NO: 36394 - DNA, 201 bp, Homo sapiens; identical to SEQ ID NO: 7445

SEQ ID NO: 36395 - DNA, 201 bp, Homo sapiens
ctccaaagttagcatcagacgccacaagtttaaggctcagccctccatgagatttcccttgcttcagacactggcagcatcttggggatcccccagccacmcacacttctgactaactggctctaaattgggggattcccacaaactgtttgggtttcataatttactagaaggaactcacagaatgaaaataaacctggc

SEQ ID NO: 36396 - DNA, 201 bp, Homo sapiens
cgccctccttagtctcccaaagtgctggcattacaggcatgagccacagtgcccagacagttttagccagtttttcactggcctccctctttgcctttttkgcaagggagctggcctccctgtccctggagtaagcaaacttccttatacctatagcttcctctaaggaagcgtagttacctacagcctggccctccccaa

SEQ ID NO: 36397 - DNA, 201 bp, Homo sapiens
gggtctctctccataagtctcttaccccagcagccaggaagggcagacctcaatgttcaagtgcttttcaagcctcagcttgtatcacgtttgcaaatatwccattggccaaagcaagccatatggccaagcccagattcaacaggtgggaacatagactccacttcttggtgggagaggctgcaaagaactcatggtcat

SEQ ID NO: 36398 - DNA, 201 bp, Homo sapiens
tagtctcccaaagtgctggcattacaggcatgagccacagtgcccagacagttttagccagtttttcactggcctccctctttgccttttttgcaagggakctggcctccctgtccctggagtaagcaaacttccttatacctatagcttcctctaaggaagcgtagttacctacagcctggccctccccaaggacacagc

SEQ ID NO: 36399 - DNA, 201 bp, Homo sapiens
aaaccacctcagtgcttagtggcttaaaacactcctttaggagctctgatgatttcatgtgttgactgaaggtttgtctggcctgggcctgtttagctacrgctgatggtttaggggagcctcttgtgtctttgatggtcagtgggggtctctctccataagtctcttaccccagcagccaggaagggcagacctcaatgt

SEQ ID NO: 36400 - DNA, 201 bp, Homo sapiens
catgagccacagtgcccagacagttttagccagtttttcactggcctccctctttgccttttttgcaagggagctggcctccctgtccctggagtaagcaracttccttatacctatagcttcctctaaggaagcgtagttacctacagcctggccctccccaaggacacagctgtttcctccaccaagagcaaggagtgg

SEQ ID NO: 36401 - DNA, 201 bp, Homo sapiens
tggataagtactggtctgtggcccaggggctggggacccctgctgtaagtggtccacaaaccagataatgtggctgtcctctctcatccatcacagtcacycccagggggtattacttccctctaacaactcactgtgtgataggctttcttactgagggcagattctgcacatttattaatattatcactatgcttactg

SEQ ID NO: 36402 - DNA, 201 bp, Homo sapiens
tttaccgaggacataggctcagagtgtcttctagctttcaacccaccccagactctgacttagcctttcccaaatggtgctgtgcagaaaaatgaaaaaattgctaggaggatcatgtgcctggtggatagtacatgcttgatagctgtaaacagttggtgctcaatatatcgtggcttgtggatcttcccagctgcttca

SEQ ID NO: 36403 - DNA, 201 bp, Homo sapiens
cgctaatctgacaggaggcagaactcaggtggtcatgcaagcgatggggagtgactgtaaatacagatgaagcttcacttgctcacctatcactcacctcstgctgtacagccctgttcgtaacaggccatggataagtactggtctgtggcccaggggctggggacccctgctgtaagtggtccacaaaccagataatgt

SEQ ID NO: 36404 - DNA, 201 bp, Homo sapiens
ggcaggagaatcacttgaacccgggaggcgaaggttgcagtgagccaagatcatgccactgcactccagcctgggtgacagagcaagactccatctcaaawaaataaataaataaataaataaataaatacaggaaaaggaagctcggtagttttcaggggctgctggcgtttccaagctttaggcattttgctttgagtc

SEQ ID NO: 36405 - DNA, 201 bp, Homo sapiens
taattagctgggcatggtggtgggtggctgtaatcccagctacttgggaggcagaggcaggagaattgcttgaaaccgcgaggcagaggctgcagtgagcygagactgtaccactgcactccagcctgggccacagagtaagactctgtctctctctgtctctctgtctctgtctctctctctccatatatacatatatat

SEQ ID NO: 36406 - DNA, 201 bp, Homo sapiens
ctaatgaagttccctctgtcctcaaaggcgttggttttgtttccacagaaaaacctcttcaggcactggtgccgaggaccctaggtatgactcacctgtgygacccctggtgcctgctccgcgcagggccggcggcgtgccaggcagatgcctcggagaacccaggggtttctctggctttttgcatgcggcgggcagctg

SEQ ID NO: 36407 - DNA, 201 bp, Homo sapiens
atcacaattgaaataaaaaaaatgggttaatatcttctggcaagatgtttgtttaaaagacattggccttaaataaaaggcatttttccctcaccttaacwatggcctgagaaatatagcaacctcctttgattttctcactgatgatgcgggagatgctaaaacagaaaccctgagaaattgaccgcacatccttggtat

SEQ ID NO: 36408 - DNA, 201 bp, Homo sapiens
ctgccttctgtttgcagccactgtttgctcactaaacatctctgcacctcccgcgtgcatttgcagaggtgggtgggggtccccggagtctgagctccccscggctgggtgccccgacccagcagctcctacaccatgaatggaggttgatctggaaacagaatattttcatgaaagggcgacagggtatgaacaaaagaa

SEQ ID NO: 36409 - DNA, 201 bp, Homo sapiens
acctgcaagtacaatatgttttgttttgctcgttgttgataaaaacctaccaaaaaaaccttttggctttattgaccaaaagggtctataaatcacctttkcataccagacagacttttgttttaggtttttttttttttttttggccagtgtattcccaagattgaggaaatgaccatattccttttgattcatttcttt

SEQ ID NO: 36410 - DNA, 201 bp, Homo sapiens
gggtttcgccatgttggtcaggctggtctcgaactcccaacctcaggtggtccacctgccttggcctctcaaagtgctgtgattgcaggtgtgagccaccrcacccagtctggcattgtggacctcagttctaagctttctgtggttggcttcagaacaagaaaatataataaggacagagtccttggttttccctaaaat

SEQ ID NO: 36411 - DNA, 201 bp, Homo sapiens
acgaacctggctcactgcaacctctgcctcctgggttcaagcgattttcctgcctcagcctcccaagcagctgggactgcaggtgcctgccaccatgcccrgctaatttttgtatttttaatagagacagggtttcgccatgttggtcaggctggtctcgaactcccaacctcaggtggtccacctgccttggcctctcaa

SEQ ID NO: 36412 - DNA, 201 bp, Homo sapiens
tatatttaattaatggaatcaagatttctttttcttttctttttttggttttactttaaaaaattctatcttattacataaaaaaaccacaggttcagaamagccacaccaaacaaatgaatagcctaatggttcactctaacgtcaacactcatataatccctaactctggttgagaaatagtactttgccagaacaccc

SEQ ID NO: 36413 - DNA, 201 bp, Homo sapiens
agtagtcactgtcctgtcttttgtagacatcacttccttctttctgtatagttttatcacccaagtgtgaatctgtagacaaatatttagctttgcccatwaaaaaaaaaaattgatggccgggcatggtggctcatgcctgtaatctcagcactttgggaggctgaggcgggaggatcacttgaagccaagagttggaga

SEQ ID NO: 36414 - DNA, 201 bp, Homo sapiens; identical to SEQ ID NO: 7458

SEQ ID NO: 36415 - DNA, 201 bp, Homo sapiens
gtgtttgtttgggtctctagcagtggttttgaactgagggtgattttttttgtctcccaggggacatttggcaatgtctggagatattttttggttgtcayaactccagggaatgtgtgtgtactgctttcattgagcagatggaggccagggatgctgttcaacgtcctgcaatgcagagacagcccagccacaaagaat

SEQ ID NO: 36416 - DNA, 201 bp, Homo sapiens; identical to SEQ ID NO: 7460

SEQ ID NO: 36417 - DNA, 201 bp, Homo sapiens
caggggacatttggcaatgtctggagatattttttggttgtcacaactccagggaatgtgtgtgtactgctttcattgagcagatggaggccagggatgcygttcaacgtcctgcaatgcagagacagcccagccacaaagaatgatccagccccaaatgtcaatagtgctgaggggcagaaagcctggtccacaggttct

SEQ ID NO: 36418 - DNA, 201 bp, Homo sapiens
tcctcccaggagctgcatctctgcgtctcccgcaagcacttcgctctggaacggggctgcaggctgcgtgggctgtcaccggggaactacagcgtgcgaayccgggccacctcccttgcgggcaacggctcttggacggaacccacctatttctacgtgacagactattgtaagtctccatggcagcctcagctgactggg

SEQ ID NO: 36419 - DNA, 201 bp, Homo sapiens
atttggcaatgtctggagatattttttggttgtcacaactccagggaatgtgtgtgtactgctttcattgagcagatggaggccagggatgctgttcaacrtcctgcaatgcagagacagcccagccacaaagaatgatccagccccaaatgtcaatagtgctgaggggcagaaagcctggtccacaggttctccctccat

SEQ ID NO: 36420 - DNA, 201 bp, Homo sapiens
ctcccaggagctgcatctctgcgtctcccgcaagcacttcgctctggaacggggctgcaggctgcgtgggctgtcaccggggaactacagcgtgcgaatcygggccacctcccttgcgggcaacggctcttggacggaacccacctatttctacgtgacagactattgtaagtctccatggcagcctcagctgactggggc

SEQ ID NO: 36421 - DNA, 201 bp, Homo sapiens
ataataacagaaccacttcaggaggtggagggacattttaatgacacaaatgttaagtgcctggcacctgttgctagtgtctccatctttgttactagagtttttttggctagatgaggtggctcacacctgtaatcccagaactttgggaggctgaggcaacaggattgcttgaggacaggcattagagaccagcctgag

SEQ ID NO: 36422 - DNA, 201 bp, Homo sapiens
cagacttttagttttgaaaggatggcttcaaaagatactgggggacatgggcgcagtaactcacgcctgtaatcccagcattttgggaggccgaggtgggyggatcatctgaggtggggagttcgagaccagcctgatcaacatggagaaaccctgtctctactaaaagtacttaattagctgggcgtggtggcgcatgcc

SEQ ID NO: 36423 - DNA, 201 bp, Homo sapiens
tcccagtgctgctgaaacaccaaccccgtgtttctgttttagaataatcctggccgccctccccctacccttcaagagatgattcagatggcggcagagaytgctgacgggatggcctacctgaacgccaagaagtttgtgcatcgggacctggcagcgagaaactgcatggtcgcccatgattttactgtcaaaattgga

SEQ ID NO: 36424 - DNA, 201 bp, Homo sapiens
gtaatcccagcattttgggaggccgaggtgggcggatcatctgaggtggggagttcgagaccagcctgatcaacatggagaaaccctgtctctactaaaartacttaattagctgggcgtggtggcgcatgcctgtagtcccagctacgtgggaggctgaggcaggagaccatcgcttgaacctgggaggcagagtttgca

SEQ ID NO: 36425 - DNA, 201 bp, Homo sapiens
taatcctggccgccctccccctacccttcaagagatgattcagatggcggcagagattgctgacgggatggcctacctgaacgccaagaagtttgtgcatygggacctggcagcgagaaactgcatggtcgcccatgattttactgtcaaaattggaggttcgtctggctttctgctttgaaaacataacgacccaggcca

SEQ ID NO: 36426 - DNA, 201 bp, Homo sapiens
gagtgcagtggtgtgatctcagctcactgcaacatccacctcccaggttcaagtgattcacctgcctcagccttccaagtagctgggactacaggtgtgcrccaccatgcctggctaatttttgtatttttagtggagatggggtttcatccatgttggccaggatagtcttgatctcctgacctcgtgatcctcctgcct

SEQ ID NO: 36427 - DNA, 201 bp, Homo sapiens
ggctggagagcagtggtgcgatcttggctcactgtaacctccacctcccgggttcaagcaattctcttgtctcagcctcctgagtagctgggattacaggygcccacaccacacctggctaatttttgtgtttttagtagagacggggtttcaccatgttggccaggctggtctcgaactcctgacctcaagtgatctgcc

SEQ ID NO: 36428 - DNA, 201 bp, Homo sapiens
aaaatggacaaaactcagcatttgcctttcttacctctcctgagctggtctccacgtgagttccaaaacaaactccgttagacgattaacatttttttttytctctctctctctctttttttttttgacagagtctcactctatcgtccaggctggagtgcggtggtgcgatttcagctcaccctttccgggttcgagtga

SEQ ID NO: 36429 - DNA, 201 bp, Homo sapiens
tgggcatggtggtgggtggctgtaatcccagctacttgggaggcagaggcaggagaattgcttgaaaccgcgaggcagaggctgcagtgagctgagactgyaccactgcactccagcctgggccacagagtaagactctgtctctctctgtctctctgtctctgtctctctctctccatatatacatatatatttatatat

SEQ ID NO: 36430 - DNA, 201 bp, Homo sapiens
agcatgtaagagagactcctaccacttgataattaaaaagaaaatgaaaaccaaaaaaacaaaaacaaaaaaaccgaaaagggctgggcaccatggctcaygcctgtaatcccagcactttgggaggccgaggtgagcggatcacctgaggtcaggagttcgagaccagcctggccaacatggtgaaaccccgtctctact

SEQ ID NO: 36431 - DNA, 201 bp, Homo sapiens
tcagcatttgcctttcttacctctcctgagctggtctccacgtgagttccaaaacaaactccgttagacgattaacatttttttttctctctctctctctytttttttttttgacagagtctcactctatcgtccaggctggagtgcggtggtgcgatttcagctcaccctttccgggttcgagtgattcttgtgcctcag

SEQ ID NO: 36432 - DNA, 201 bp, Homo sapiens; identical to SEQ ID NO: 7465

SEQ ID NO: 36433 - DNA, 201 bp, Homo sapiens
atggctcacgcctgtaatcccagcactttgggaggccgaggtgagcggatcacctgaggtcaggagttcgagaccagcctggccaacatggtgaaaccccktctctactaaaagtacaaaaattagctgagggtggtggcgcatacctgtaatcctagctacttgggaggctgaggcaggagaaccgcttgaaccccgggg

SEQ ID NO: 36434 - DNA, 201 bp, Homo sapiens
gcttaggggccatgtatggttagtgactactgaaatggatagaacagatacagaacttttccatagctgctgaacgtttgttggacagtgctgttttagarggaggaatcaataaaacagaaaaactaagacaaaggagggggagagaacaaatattgtagataaaattaagaatgaaggcctagcgcggtggctcacgcc

SEQ ID NO: 36435 - DNA, 201 bp, Homo sapiens
caccatgcctgtataatttttgtatttttagtagagatggggtttcaccatgtcggccaggctggtctcgaactcctgacctcaggtgatccacctgccayggcctcccaaagtgctgggattacaggcgtgagccaccgttcccagcctctatttttttaaaattgacaaataataattgtatatgttacatatttatgg

SEQ ID NO: 36436 - DNA, 201 bp, Homo sapiens
ccttttgagaaggtggtgaacaaggagtcgctggtcatctccggcttgcgacacttcacgggctatcgcatcgagctgcaggcttgcaaccaggacacccytgaggaacggtgcagtgtggcagcctacgtcagtgcgaggaccatgcctgaaggtagggctgctgctccggggtccgagtgtcatgggtgggacatcaag

SEQ ID NO: 36437 - DNA, 201 bp, Homo sapiens
actagatgtgtgtgttttttccataggaactactccttctatgccttggacaaccagaacctaaggcagctctgggactggagcaaacacaacctcaccaycactcaggggaaactcttcttccactataaccccaaactctgcttgtcagaaatccacaagatggaagaagtttcaggaaccaaggggcgccaggagaga

SEQ ID NO: 36438 - DNA, 201 bp, Homo sapiens
tgaggcaggagaattgcttgaacctgggacacagagtttacagtgagcggagatggcaccgctgtacttcagcctggacaacagagcaagactcggtttcaaaaaaaaaaaaaaaaagtaatagtaaaatcaattacaggtacatttaactagtgcaggttgataaactatctggcccatcacttgcttttataaataaag

SEQ ID NO: 36439 - DNA, 201 bp, Homo sapiens; identical to SEQ ID NO: 7469

SEQ ID NO: 36440 - DNA, 201 bp, Homo sapiens
tggtttggaggcttaaaccagttaatagatgtgtctgacatgtgggtaatgatgtagacgtgccgcttttactgttagtgtttggttggctttcactgtcygatccagaattgctgcatatgcagacaggaattggacaaagccatttatttatttatttatttatttatttatttatttatttattccctctctctctct

SEQ ID NO: 36441 - DNA, 201 bp, Homo sapiens
aggagttcaagaccagcccggccaacatggtgaaaccccatctctactaaaaatacaaaaattagctgggtgtggtggtgggcgtctgtaatcccagctaytctggaggctgaggcaggagaatcacttgaacccgggaggcagaggttacagtgagctgagatcgcgccactgcaccccagcctgggcaacaaagcaaga

SEQ ID NO: 36442 - DNA, 201 bp, Homo sapiens
tcaccatgttgaccaggctggtctcaaactcctgacctcaggtgatccacccgcctcgacctcccaaattgctaggattacaggcgtgagccaccacaccragccacatttgcatgtttaagtaactaacatgtctcctccattagaccttgtgctcccaaaggcaggatctacagccactttttccccacagtggccaca

SEQ ID NO: 36443 - DNA, 201 bp, Homo sapiens
taggattacaggcgtgagccaccacaccaagccacatttgcatgtttaagtaactaacatgtctcctccattagaccttgtgctcccaaaggcaggatctrcagccactttttccccacagtggccacagtatctagattagtgcaagcaaatgtctgttgaagcaatcagtggtttgggggcaagttacttaacctccct

SEQ ID NO: 36444 - DNA, 201 bp, Homo sapiens
caggcgtgagccaccacaccaagccacatttgcatgtttaagtaactaacatgtctcctccattagaccttgtgctcccaaaggcaggatctacagccactttttccccacagtggccacagtatctagattagtgcaagcaaatgtctgttgaagcaatcagtggtttgggggcaagttacttaacctccctgtacctca

SEQ ID NO: 36445 - DNA, 201 bp, Homo sapiens; identical to SEQ ID NO: 7470

SEQ ID NO: 36446 - DNA, 201 bp, Homo sapiens; identical to SEQ ID NO: 7471

SEQ ID NO: 36447 - DNA, 201 bp, Homo sapiens
acccactggatattctctcctttccttagacaatctggcagctgagctagaagccaacctcggcctcattgaagaaatttcagggtatctaaaaatccgcygatcctacgctctggtgtcactttccttcttccggaagttacgtctgattcgaggagagaccttggaaattgggtacgtgggcctgattgtgtgtatggc

SEQ ID NO: 36448 - DNA, 201 bp, Homo sapiens
gagacagagtcatggtgtgtcacccaggcccgccatccgccaccatgcccagataatttttttttttttttcaaacagagtcttgctttgttgcccaggcyggagtctcgctttgtggcacacgcctataatcccagttactcaggaggctgaggcaggagaatcgcttgaactcgggaggcggaggtcgcagtgagccaa

SEQ ID NO: 36449 - DNA, 201 bp, Homo sapiens
cccccaagggatcctccaaggatgctgtgtagataagtaagaagtagtgtttccatgctctgtgtacgtgccggacgagtgggaggtgtctcgagagaagwtcaccctccttcgagagctggggcagggctccttcggcatggtgtatgagggcaatgccagggacatcatcaagggtgaggcagagacccgcgtggcggt

SEQ ID NO: 36450 - DNA, 201 bp, Homo sapiens
ggcagatgctaggaccaaggctgaaggttaagagcgtgtgaaccttttgtgttgtcagactttggaatgaccagagacatctatgaaacggattactaccrgaaagggggcaagggtctgctccctgtacggtggatggcaccggagtccctgaaggatggggtcttcaccacttcttctgacatgtggtgagttgtgtgt

SEQ ID NO: 36451 - DNA, 201 bp, Homo sapiens
tgacagaggctgggagttgcagggaaaggcaggaaatctggcataggccctgcagatccttcatttccactcttttctaattttgctggatacatggcaawaatattctgcagtggtcttaaggagaagttctagagccagacagttctctttttttagtttctttctttttatttatttattttttttgagatggagtct

SEQ ID NO: 36452 - DNA, 201 bp, Homo sapiens
ccttttgtgttgtcagactttggaatgaccagagacatctatgaaacggattactaccggaaagggggcaagggtctgctccctgtacggtggatggcacyggagtccctgaaggatggggtcttcaccacttcttctgacatgtggtgagttgtgtgtggatgggtggatggacgctgggcttgaattccaggtgctagt

SEQ ID NO: 36453 - DNA, 201 bp, Homo sapiens
ggagttgcagggaaaggcaggaaatctggcataggccctgcagatccttcatttccactcttttctaattttgctggatacatggcaaaaatattctgcartggtcttaaggagaagttctagagccagacagttctctttttttagtttctttctttttatttatttattttttttgagatggagtcttgctctgtcacc

SEQ ID NO: 36454 - DNA, 201 bp, Homo sapiens
gtgggtaatgatgtagacgtgccgcttttactgttagtgtttggttggctttcactgtccgatccagaattgctgcatatgcagacaggaattggacaaarccatttatttatttatttatttatttatttatttatttatttattccctctctctctctctctctctccagtttgcccgaccatctgtaagtcacacggc

SEQ ID NO: 36455 - DNA, 201 bp, Homo sapiens
gaagttctagagccagacagttctctttttttagtttctttctttttatttatttattttttttgagatggagtcttgctctgtcacccaggctggacttmagtggcgcgatctcggctcactacaagctccgcctcccgggttcacgccattctcctgcctcagcctcccaagtagctgtagagccagacagttctgagt

SEQ ID NO: 36456 - DNA, 201 bp, Homo sapiens
ggttcacgccattctcctgcctcagcctcccaagtagctgtagagccagacagttctgagttcaagagctggccctgccactttgcagctatgagatctcrgacaaaccatataatctcttaaaccaggggtcagtcagtaagctatatcccataggctaaatgtggcctgctgcctgatttctaatgatttgtgagctag

SEQ ID NO: 36457 - DNA, 201 bp, Homo sapiens
gatcgcatgggccccgggggcggaggtcgcagtgagctgagatcacaccactgcactccagcctgggcgacagagtgagactcggtgagactctgtctttaaaaaaaaaaaaaagaagttctttgaggcaagcagcaccggcttccagtctcgttttaccattgactggtcacaagctggttcaagcctcagtttctccat

SEQ ID NO: 36458 - DNA, 201 bp, Homo sapiens
cactttgcagctatgagatctcggacaaaccatataatctcttaaaccaggggtcagtcagtaagctatatcccataggctaaatgtggcctgctgcctgrtttctaatgatttgtgagctaggagtcacttttgcattttatttatttatgtatttatttttgagatggagtcttgctctgtcacccaggctggagtgca

SEQ ID NO: 36459 - DNA, 201 bp, Homo sapiens
attttagagacagggtctagctctgtcacccaggctggagtacggtggagccttcatagctcactgcacccttgacctcctgggctcaagtgattcttccrccttagcctcctgagtagctgggactacaggtgcgaaccatcgtgcccggctaattgttctattttctgtggaaatggggtctggctatgttgcccaggt

SEQ ID NO: 36460 - DNA, 201 bp, Homo sapiens
ggtggtgcatgcttgtaatcccaggtacttgggaggctgagacagggggatcacttgggcccaggaatttgaggttgcggtgaactgtgattgtgccactrtactccagcctgggtgacagagtaagaccctgtctctaaaaaataaaaattaaaagaagtttacatctgtcaaaagtcatgctgggatcgggactagcta

SEQ ID NO: 36461 - DNA, 201 bp, Homo sapiens
aatgggtatgccattctctctcataagctgtactctcttattatcagtaatttctaaatagcctgtaaaatttatatggactcaaaatgcaggaaacatcrataggttgaaactcaacaacttgtaaaaagttactcctgtacttaattgcataaaatgtgtattgcctacatgaatgagaataaaaacttccaaaatgcc

SEQ ID NO: 36462 - DNA, 201 bp, Homo sapiens
aggcacacaccaccatgcccggctaatttttgtatttttagtagagacggggtttcaccatgttggccaggctggtctcgaattcctggcctcaagtcatstgcccacttcggcctcccaaagtgctgggatgacaggcatgagccactgcgcccagccaatttgttcaaatcttttatattgtcctttcttcatctttat

SEQ ID NO: 36463 - DNA, 201 bp, Homo sapiens
gggggagagagacctgtttgcctgttaatttttttttttttttttttttttttgagacggaatcttgctctgtcacccaggctggagtgcagtggtgcgakctcggctgacttcaagctccgcctcccgggttcacaccattctcttgcctcagcctcccgagtagctaggactacaggcacccaccaccgcgcctggcta

SEQ ID NO: 36464 - DNA, 201 bp, Homo sapiens; identical to SEQ ID NO: 7481

SEQ ID NO: 36465 - DNA, 201 bp, Homo sapiens
tctgtcacccaggctggagtgcagtggtgcgagctcggctgacttcaagctccgcctcccgggttcacaccattctcttgcctcagcctcccgagtagctrggactacaggcacccaccaccgcgcctggctaatttttttttttttttgtatttttagtagaaatggggtttcaccgtggtctcgatctcctgacctcgt

SEQ ID NO: 36466 - DNA, 201 bp, Homo sapiens
ggtaatgatgtagacgtgccgcttttactgttagtgtttggttggctttcactgtccgatccagaattgctgcatatgcagacaggaattggacaaagccwtttatttatttatttatttatttatttatttatttatttattccctctctctctctctctctctccagtttgcccgaccatctgtaagtcacacggctgc

SEQ ID NO: 36467 - DNA, 201 bp, Homo sapiens
agtgttaatgatgttgataattatgataattatagataccctctgtagttaatttctatcaagcctaaaaatgtctctatcaaagaatctgatgtgttacygacgtcatcctgtttatttcttgcaacagccttaagaaggaaggaagggactcttattaacaatcccccctccctttttttttttttttttttttttgag

SEQ ID NO: 36468 - DNA, 201 bp, Homo sapiens
ttggttggctttcactgtccgatccagaattgctgcatatgcagacaggaattggacaaagccatttatttatttatttatttatttatttatttatttatttattccctctctctctctctctctctccagtttgcccgaccatctgtaagtcacacggctgcaccgccgaaggcctctgttgccacagcgagtgcctgg

SEQ ID NO: 36469 - DNA, 201 bp, Homo sapiens
tggctctgggatgctgtaataagcaagacagacaccatctttcccttcacggggcgtatgtgtctcgtgcatactgggagggcagggacagggtctccatycatttctgcattccaatgccaagagggtgtcagatctgggtgggtcgaggtagggaacaggtaaacataactcacagtgtgatgccgtgttacagccagg

SEQ ID NO: 36470 - DNA, 201 bp, Homo sapiens
gttggctttcactgtccgatccagaattgctgcatatgcagacaggaattggacaaagccatttatttatttatttatttatttatttatttatttatttattccctctctctctctctctctctccagtttgcccgaccatctgtaagtcacacggctgcaccgccgaaggcctctgttgccacagcgagtgcctgggca

SEQ ID NO: 36471 - DNA, 201 bp, Homo sapiens
tgaacatagcccgagtgattcacacatttgcatgtactgttcctctcctgctgtgataaagcgacagtcacctaatccccgcccctccgttgcattttttytttcctacaagatttattatgcacctactgtgtgtatggctctgggatgctgtaataagcaagacagacaccatctttcccttcacggggcgtatgtgtc

SEQ ID NO: 36472 - DNA, 201 bp, Homo sapiens
tttgcttgtggccctttacagaaaaagttgaccaactcctgtgctgacaaatgaaatagctcagataggcctgtcagctagggctccaacacaggattgcraagtctcgcagcctctggccttgtttgcaatggttggataatttttcttcccattgtctaggccggaaggacttatgtgtttgagaggtttgtgttaggc

SEQ ID NO: 36473 - DNA, 201 bp, Homo sapiens
tggctttcactgtccgatccagaattgctgcatatgcagacaggaattggacaaagccatttatttatttatttatttatttatttatttatttatttatyccctctctctctctctctctctccagtttgcccgaccatctgtaagtcacacggctgcaccgccgaaggcctctgttgccacagcgagtgcctgggcaac

SEQ ID NO: 36474 - DNA, 201 bp, Homo sapiens
ggctttcactgtccgatccagaattgctgcatatgcagacaggaattggacaaagccatttatttatttatttatttatttatttatttatttatttattycctctctctctctctctctctccagtttgcccgaccatctgtaagtcacacggctgcaccgccgaaggcctctgttgccacagcgagtgcctgggcaact

SEQ ID NO: 36475 - DNA, 201 bp, Homo sapiens
tttcactgtccgatccagaattgctgcatatgcagacaggaattggacaaagccatttatttatttatttatttatttatttatttatttatttattccctctctctctctctctctctccagtttgcccgaccatctgtaagtcacacggctgcaccgccgaaggcctctgttgccacagcgagtgcctgggcaactgtt

SEQ ID NO: 36476 - DNA, 201 bp, Homo sapiens
acaagtgcatccctgagtgtccctccgggtacacgatgaattccagcaagtgagttctggatgtgggtctggggggcagccgagaggagaaggaacgtggrgttggttgtgacgatgccgcttgttaaaactgtgtgcaaacccagggttaattggctatgagtgaggtctctgctctcagatgctacttttgcaccctgt

SEQ ID NO: 36477 - DNA, 201 bp, Homo sapiens
gtactgtgagcttcttccatgagctattttggggccgtaactgagttgcaaaaatctgtttcctggtttttgtattgaggttttatgttttgttttaaaamacacacacacacacacacacacacacacacacaccacaaaacaacacaaaaacaaatcagaaacagacacacatcaagaggccttgagctgacctgctta

SEQ ID NO: 36478 - DNA, 201 bp, Homo sapiens
gctcgttgttgataaaaacctaccaaaaaaaccttttggctttattgaccaaaagggtctataaatcaccttttcataccagacagacttttgttttaggtttttttttttttttttggccagtgtattcccaagattgaggaaatgaccatattccttttgattcatttctttctttttaaaatcacaattgaaataaaa

SEQ ID NO: 36479 - DNA, 201 bp, Homo sapiens
ctttcctgaacggaagaaaacaaaggagaggggggtgcattgtcaccgtattttattgcgtaggtttaaaaaaattaatatttttatttctgaagcttttwattaattaatttatttattttgagacagagcctcactctgtcacccaggctggagtgcagtggcatgatctcagctcactgcaacctctgccttccaggt

SEQ ID NO: 36480 - DNA, 201 bp, Homo sapiens
actttgcccttcatcaactctgaactgtttatagttctctgaacatagcccgagtgattcacacatttgcatgtactgttcctctcctgctgtgataaagsgacagtcacctaatccccgcccctccgttgcattttttctttcctacaagatttattatgcacctactgtgtgtatggctctgggatgctgtaataagca

SEQ ID NO: 36481 - DNA, 201 bp, Homo sapiens
tgcagctgcaggctgcctgctgactgcacttccctgacagattctaaacagtgagctgccaagggcttctgggataccttcatggggagttagttacttaygtcaaaatgtagtgcaagggctgggcatggtggctcacgcctggaatcccagcactctgggaggccgaggcaggcagatcacttgaggtcaggagttcga

SEQ ID NO: 36482 - DNA, 201 bp, Homo sapiens
cttcctcgaccagcgtgcccacgagtccggaggagcacaggccttttgagaaggtggtgaacaaggagtcgctggtcatctccggcttgcgacacttcacrggctatcgcatcgagctgcaggcttgcaaccaggacacccctgaggaacggtgcagtgtggcagcctacgtcagtgcgaggaccatgcctgaaggtaggg

SEQ ID NO: 36483 - DNA, 201 bp, Homo sapiens
ctatttggaaggcattgtacaatttaatctttaatgatgcttgtatttaacaactggctcactagtttcctgaaaatttaataattgtttctcatcagtcrggatgagctcgctctagaacagtactgggtgagtggcttttaagtgttacatggatggccataaattatttaaaaagccagccagagccctgcatggtcg

SEQ ID NO: 36484 - DNA, 201 bp, Homo sapiens
tctccggcttgcgacacttcacgggctatcgcatcgagctgcaggcttgcaaccaggacacccctgaggaacggtgcagtgtggcagcctacgtcagtgcsaggaccatgcctgaaggtagggctgctgctccggggtccgagtgtcatgggtgggacatcaaggctgaccaaggacagattctccaccctctaagcagtg

SEQ ID NO: 36485 - DNA, 201 bp, Homo sapiens
catctggacacatggtatttggcacctgcctgaatgggctcatctagccggtctgggacccttgggcagggtcgaccacttgggctgggctcagctgggcrgttcttctggtcttgcctggcttcacccatgtagctacattttgctggtgtgtcagctagcactcggtagtcttagatgatttcactcacatgtctggtg

SEQ ID NO: 36486 - DNA, 201 bp, Homo sapiens
tctggtcttgcctggcttcacccatgtagctacattttgctggtgtgtcagctagcactcggtagtcttagatgatttcactcacatgtctggtggtcagyaggctgggtggtcccaaggtgggggccctaagctgggggaggctgagcctcactctgtccatctagcctcttaggctccagcaggctggctcaggcttca

SEQ ID NO: 36487 - DNA, 201 bp, Homo sapiens
acaaggccatgcccagggccaaggggtggtgagatagactccaccttttcatgggaagagctccaagtatcctggctttttttttccccaacctattacarcctgtcttccatccccttggcactttgcagaaacagtagtctcaggtgggaagtagcatcattccatagcaagggtctgaaatcagacaagaaggatggg

SEQ ID NO: 36488 - DNA, 201 bp, Homo sapiens
tcatctttgtctttctcttcagtgttgtgattggaagtatttatctattcctgagaaagaggtgagttcagtgagttcagtggtgtgctgggaacagttgrttctctgggggaaaacatgccttgatataggtataggcatatttaagtttattatgaattttgctgatataggatgtgtaacatgcaatttacagataat

SEQ ID NO: 36489 - DNA, 201 bp, Homo sapiens
ccaaggctgatgacattgttggccctgtgacgcatgaaatctttgagaacaacgtcgtccacttgatgtggcaggagccgaaggagcccaatggtctgatygtgctgtatgaagtgagttatcggcgatatggtgatgaggtaaggcccttgactcttgggcatgcccctgcacacttcagcatgccccttcagagttgca

SEQ ID NO: 36490 - DNA, 201 bp, Homo sapiens
aggggtggacactcccagatgtgcaaagctcagccaccctccttctcctcctctcttcctcccaggagctgcatctctgcgtctcccgcaagcacttcgcyctggaacggggctgcaggctgcgtgggctgtcaccggggaactacagcgtgcgaatccgggccacctcccttgcgggcaacggctcttggacggaaccca

SEQ ID NO: 36491 - DNA, 201 bp, Homo sapiens
tcaccatgctggccaggctggtcttgaactcctgacctcgtgatccacccgccttggcctcccaaagtgctgggattacaggcgtgagccaccacgcccastgcctggctaatttttttgtattttcagtagagacggggtttcactgtgttagccaggatggtctcgatctcctgacctcatgatccgcctgccttggcc

SEQ ID NO: 36492 - DNA, 201 bp, Homo sapiens
caggagaattgcttgaacccgggaggcaaaggttgcagtgagccgagatcacgccactgcactctagcctgggtaacagcaagattccgtctcgaaaattwaaaaaaaaaaaatacaaaggcctatctgtctgctgtccgggcaggtatgtctgctctcctagaccagggctgagcacgctgcatccaggccacagggtgc

SEQ ID NO: 36493 - DNA, 201 bp, Homo sapiens
cttgtcaccctggctggagtgcaatggcgcaatcttggcttactgcaacctccgccttgcctcaagcgattctgctctctagtggctcagattacaggtgygcaccaccacgcctggctaatttatgtatttttgtagagatggggtttcaccatgttggccaggctggtctcaaactcccgacttcaggtaatccacctg

SEQ ID NO: 36494 - DNA, 201 bp, Homo sapiens
ttctgctttgaaaacataacgacccaggccaggtttgatttcagaaggaagttgtctataatgagccgttaagtcttttctgataatataaaggggcaagatacttcttttttttttgtggggttttttttgttttgttttgtctttttgtttttgagacggagtcttactctgtctgttgcccaggctggagtgcagtgg

SEQ ID NO: 36495 - DNA, 201 bp, Homo sapiens; identical to SEQ ID NO: 7493

SEQ ID NO: 36496 - DNA, 201 bp, Homo sapiens
tattttgcacgtaaagcacatttcagttctgactggccacacgtggctggtcctgctgtaatggatctagtctttaaaaatactccgcgagagcttgcagygagctgagatggcgccactgcactccagcctgggcgacagagtgagactccgtctcaaaaaaaaccaaaaaacaaaaaactctgcgatcttcctcaccat

SEQ ID NO: 36497 - DNA, 201 bp, Homo sapiens
tagagatggggtttcaccatgttggccaggctggtcttgaactcatgacctcaagtgatctacgcacctcagcctctcaaagtactgggattacaggcgtragccactgagcctggcctctttttccattttctgttgcatcaatggaaagtccatctcctgcccgtggacgttttctatgttgatgtggaatgtggcatt

SEQ ID NO: 36498 - DNA, 201 bp, Homo sapiens; identical to SEQ ID NO: 7494

SEQ ID NO: 36499 - DNA, 201 bp, Homo sapiens
tttactctgtccctgtgtcaatgggattgtgcatgttttggttcctgaggggtcattgatggtgcacttttcttttgttgttagtcaatttaatttgttamtaataataaaatctggaacttacctgaccccaaaggcccaggtcgttaagaatgcttggtggaatgcacgtccttttcaaataccggctcctttggaaaa

SEQ ID NO: 36500 - DNA, 201 bp, Homo sapiens
agctggaggagtcctcgtttaggaagacgtttgaggattacctgcacaacgtggttttcgtccccaggtcaggacttggcgctgggctctcttagtgggtrccaattggcttggtgttggtggaaggtcattacttagggaccgagaggtagtgggacccagagacggcagaagggtgggtggagtctgaatggagccctt

SEQ ID NO: 36501 - DNA, 201 bp, Homo sapiens
tgtttggttggctttcactgtccgatccagaattgctgcatatgcagacaggaattggacaaagccatttatttatttatttatttatttatttatttatwtatttattccctctctctctctctctctctccagtttgcccgaccatctgtaagtcacacggctgcaccgccgaaggcctctgttgccacagcgagtgcc

SEQ ID NO: 36502 - DNA, 201 bp, Homo sapiens
aacggaagaaaacaaaggagaggggggtgcattgtcaccgtattttattgcgtaggtttaaaaaaattaatatttttatttctgaagcttttaattaattwatttatttattttgagacagagcctcactctgtcacccaggctggagtgcagtggcatgatctcagctcactgcaacctctgccttccaggttcaagcca

SEQ ID NO: 36503 - DNA, 201 bp, Homo sapiens
agttcagagctggatttcagtgtgccacttctgtactttacacttagaaagtcttcttctacccatgaaaggttttttttctctacattttatattttaattttttttttttttttgagatggagtttcactcttgttgttaagactggagtgcgatggtgcaatctcggctcactgcaacctctgcctcccgggttcaag

SEQ ID NO: 36504 - DNA, 201 bp, Homo sapiens
gttcagagctggatttcagtgtgccacttctgtactttacacttagaaagtcttcttctacccatgaaaggttttttttctctacattttatattttaattttttttttttttttgagatggagtttcactcttgttgttaagactggagtgcgatggtgcaatctcggctcactgcaacctctgcctcccgggttcaagc

SEQ ID NO: 36505 - DNA, 201 bp, Homo sapiens
ttcagagctggatttcagtgtgccacttctgtactttacacttagaaagtcttcttctacccatgaaaggttttttttctctacattttatattttaattttttttttttttttgagatggagtttcactcttgttgttaagactggagtgcgatggtgcaatctcggctcactgcaacctctgcctcccgggttcaagcg

SEQ ID NO: 36506 - DNA, 201 bp, Homo sapiens
tgtgtatgtctcatcagacatccttagtagtcaggagctcagtctactaagtggatgttatcaaatgtattgcttatctatttttcttttttatccccaattttttttttttttttgagacagagtcttgctctgttgcccagggtacagtgcagtggcagatcttggctcactgcaacctctgcctcccgggttcaagca

SEQ ID NO: 36507 - DNA, 201 bp, Homo sapiens
cccccgagtagctgggactacaggcatgcaccatcacgcacggctaatttttgtatttttagtagagacagggtttcaccatgttggccaggctggtctcraactcctgacttcgtgattcacctgcctcagcctcccaaagtgctaggattacaggcgtgaggcactgcacccggcccagtatccagagttttaattgga

SEQ ID NO: 36508 - DNA, 201 bp, Homo sapiens
caccatgttggccaggatggtctcagtctcttgacctgcaatctgcccaccttggcctcccaaagtgctgggattacaggcataagccaccatgccagccttttttttttttttttttttttttgagatggagtttcgctcttgttgcctaggctggagtgcaatggccctatctcagctcactgcaacctctgcctcccg

SEQ ID NO: 36509 - DNA, 201 bp, Homo sapiens
gctgggactacaggcatgcaccatcacgcacggctaatttttgtatttttagtagagacagggtttcaccatgttggccaggctggtctcaaactcctgamttcgtgattcacctgcctcagcctcccaaagtgctaggattacaggcgtgaggcactgcacccggcccagtatccagagttttaattggagtctcattcc

SEQ ID NO: 36510 - DNA, 201 bp, Homo sapiens
accatgttggccaggatggtctcagtctcttgacctgcaatctgcccaccttggcctcccaaagtgctgggattacaggcataagccaccatgccagccttttttttttttttttttttttttgagatggagtttcgctcttgttgcctaggctggagtgcaatggccctatctcagctcactgcaacctctgcctcccgg

SEQ ID NO: 36511 - DNA, 201 bp, Homo sapiens
gagaatcacttgaacctgggaggcggagcttgcagtgagccgagatcgtgccattgtactccagcctgggcaacaagagtgagactccatcttaaaaaaarcaaaaacaaaaacaaaacaaaaaaaccattgacttaaccaagattaaaggagtttgttggtacccataaccaaaaagttcagggagttggttcaggtata

SEQ ID NO: 36512 - DNA, 201 bp, Homo sapiens
acttctagctcccaggtgtttggactccctccccatccccagctccctcggccacctccgttactttgggttttttgggttttgtttggttggttggtggkggttttttttttcttttttgttttgttttgttttgagacggactcttgctctgtcacccaggctggagtgcagtggcgcaatctcggctcactgcaagct

SEQ ID NO: 36513 - DNA, 201 bp, Homo sapiens
gctaattttttgtatttttagtagagacggggtttcactgtgttaaccaggatggtctcgatctcctgacctcgtgatccgcctgccttggccgcccaaartgctgggatgggtgccctcatgatgtctttaacttgtgtgtcccccgccatcctcccaccagctttctttgcacactgtttctcatgatggacccatttc

SEQ ID NO: 36514 - DNA, 201 bp, Homo sapiens
agcgctgggattacaggcgtgagccactatgaccggctcatacatacacatttttaaacatcgtaacacaagcacgcactgaagacttgtgtcaaaaccasatttttcccatgtcttggcaccatttccctctgggattttctcctcttgtctctccttctttctccctccctgccttccttgttctcttcatccctcctc

SEQ ID NO: 36515 - DNA, 201 bp, Homo sapiens
cccgagtagctgggactacaggcgcccgccaccacgcccggctaattttttgtattttttagtagagacggggtttcaccatgttagccaggatggtctcratctcctgacctcgtgatctgcccaccttggcctcccaacgtgctgggattacaggcgtgagtcaccgcgcctggcccattatgcttcatttttctaatc

SEQ ID NO: 36516 - DNA, 201 bp, Homo sapiens
gaaaaccacagtgtaccatgtttcatgcagtggattctaggaagaggtagcaggtatcaggaatgatacctgtgcctgaacaaatatcccttcctctccaaataataataataataataataatagtaataataataataataccaggagcttcccttattcaggcagttctacatttttttttccatctgtaatgctgta

SEQ ID NO: 36517 - DNA, 201 bp, Homo sapiens
aaaaccacagtgtaccatgtttcatgcagtggattctaggaagaggtagcaggtatcaggaatgatacctgtgcctgaacaaatatcccttcctctccaaataataataataataataataatagtaataataataataataccaggagcttcccttattcaggcagttctacatttttttttccatctgtaatgctgtaa

SEQ ID NO: 36518 - DNA, 201 bp, Homo sapiens
agaccagcctgggcaacatagtgagactccatctccttgaaaagattttttaaaaagtggggtgtggtggtgcacacctgtggtcccagctactcaggagkctggggtgggaggattgcttgagcccaggaggtggaggctgcagtgagctgtgacagcatcactgcactccagcctgggtgacagtgagacgctatttca

SEQ ID NO: 36519 - DNA, 201 bp, Homo sapiens
cacccctgtaatcccagcactttgggaggctgaggtgggtagattacctgagatcaggagttcgagaccagcctggtcaacacggtgaaaccctgtctctrctcaaaatacaaaacattagctagacatggtggcagacagctgtaatcctagctactcaggaggctgaggcaagagaattgcttgaatcagggaggtaga

SEQ ID NO: 36520 - DNA, 201 bp, Homo sapiens
caacacggtgaaaccctgtctctactcaaaatacaaaacattagctagacatggtggcagacagctgtaatcctagctactcaggaggctgaggcaagagwattgcttgaatcagggaggtagaggttgcagtgagccaagattgcaccactgcactccagcctggaggacagagtgaggctccatatcaaagaaaaaaaa

SEQ ID NO: 36521 - DNA, 201 bp, Homo sapiens
tgcactggagttgcacctccttccaggtcagtcttacaagtccatatgcgagacaacgttgtgtcaggacaaacatcacccttggaaatcccttcctccartaactattggccggttgtccttcttgcgcgggtacagactgcgcttattcagttgactgtctggctgagtcaagtcattggcttacgtgagtgtgagtgg

SEQ ID NO: 36522 - DNA, 201 bp, Homo sapiens
aagtgggaggatcatttgagcccaggagttggaggctgcagtgagctacgatcacaccactgcactccagcctggacaacagggcaaggcctcatctcttaaaaaaaaaaaaacaaaataaaataaaaagtgaataagtgaaagtaataaaatgtaagatacagttggagttctctttgtcatcttcccttgctatattct

SEQ ID NO: 36523 - DNA, 201 bp, Homo sapiens
catggtggcagacagctgtaatcctagctactcaggaggctgaggcaagagaattgcttgaatcagggaggtagaggttgcagtgagccaagattgcaccrctgcactccagcctggaggacagagtgaggctccatatcaaagaaaaaaaaaaagaaaaatgtagcttctttgtgatttggtaccttcttttccctccct

SEQ ID NO: 36524 - DNA, 201 bp, Homo sapiens
ttttgtgttgtcagactttggaatgaccagagacatctatgaaacggattactaccggaaagggggcaagggtctgctccctgtacggtggatggcaccgragtccctgaaggatggggtcttcaccacttcttctgacatgtggtgagttgtgtgtggatgggtggatggacgctgggcttgaattccaggtgctagtga

SEQ ID NO: 36525 - DNA, 201 bp, Homo sapiens
agtcttacaagtccatatgcgagacaacgttgtgtcaggacaaacatcacccttggaaatcccttcctccaataactattggccggttgtccttcttgcgygggtacagactgcgcttattcagttgactgtctggctgagtcaagtcattggcttacgtgagtgtgagtggccaagttgcaaaactggctcttacctttg

SEQ ID NO: 36526 - DNA, 201 bp, Homo sapiens
ctgcctggtcccactgcacctacgggactgtttcgggactgctggaaaatcaggatgtggaagagcagcagagaggttcatggacaagggagggaaggaamagggtggcccacccattccaggagtggatgtgatttttgatgtgaactttgttggaaacacattgatatgaaacatatattttcttattctatttcagta

SEQ ID NO: 36527 - DNA, 201 bp, Homo sapiens; identical to SEQ ID NO: 7434

SEQ ID NO: 36528 - DNA, 201 bp, Homo sapiens
gagttgtagaagaccagccgttgaatgactagatgtgtgtgttttttccataggaactactccttctatgccttggacaaccagaacctaaggcagctctsggactggagcaaacacaacctcaccatcactcaggggaaactcttcttccactataaccccaaactctgcttgtcagaaatccacaagatggaagaagtt

SEQ ID NO: 36529 - DNA, 201 bp, Homo sapiens
caatctggcagctgagctagaagccaacctcggcctcattgaagaaatttcagggtatctaaaaatccgccgatcctacgctctggtgtcactttccttcktccggaagttacgtctgattcgaggagagaccttggaaattgggtacgtgggcctgattgtgtgtatggcctgagtgctaactaggaagttcgtgtatta

SEQ ID NO: 36530 - DNA, 201 bp, Homo sapiens
gtaccgcgaagggcaagaccaactgccccgccaccgtcatcaacgggcagtttgtcgaacgatgttggactcatagtcactgccagaaaggtacgccgggsatacagggttctaagcagtgtctcgtgccttgttctagaaagcttaaaatgttttatggcttaaaaatgttaaatggtcattaggtaggggccggggaat

SEQ ID NO: 36531 - DNA, 201 bp, Homo sapiens
caaaaaactctgcgatcttcctcaccatgcacacatatgatatttttgtgattgtgattccaattgctacacctgctgcatgagttcttaagccaaatgcttttttttttctctcagccactatgttctttaagtttatgcctcttgattcagtattgctagttcattcttttaagtgctacatagtatcttgtatgaata

SEQ ID NO: 36532 - DNA, 201 bp, Homo sapiens
atcaacgggcagtttgtcgaacgatgttggactcatagtcactgccagaaaggtacgccggggatacagggttctaagcagtgtctcgtgccttgttctakaaagcttaaaatgttttatggcttaaaaatgttaaatggtcattaggtaggggccggggaatagtgggtggtggcattcactagcccagggagtggcaga

SEQ ID NO: 36533 - DNA, 201 bp, Homo sapiens
tctctctctctctgctccgtccttagcttgctgtgcaccccatgcctgggtccctgtcccaaggtgtgccacctcctagaaggcgagaagaccatcgactyggtgacgtctgcccaggagctccgaggatgcaccgtcatcaacgggagtctgatcatcaacattcgaggaggcagtgagtgtctctgtgtgggcgtcggg

SEQ ID NO: 36534 - DNA, 201 bp, Homo sapiens
gatgaatattggaaataataagcacagacgaactgattagaaaacaaatagaactgacaaaatcaaaaagctggatcttttagagagatgctgctcagtarggtggccacaacccacgtgaaaattaaattaaaaattcattttctcagtcgcacgagccaagtttccactgcttaggggccatgtatggttagtgactac

SEQ ID NO: 36535 - DNA, 201 bp, Homo sapiens; identical to SEQ ID NO: 7439

SEQ ID NO: 36536 - DNA, 201 bp, Homo sapiens
tatttatttatttatttattccctctctctctctctctctctccagtttgcccgaccatctgtaagtcacacggctgcaccgccgaaggcctctgttgccrcagcgagtgcctgggcaactgttctcagcccgacgaccccaccaagtgcgtggcctgccgcaacttctacctggacggcaggtgtgtggagacctgcccg

SEQ ID NO: 36537 - DNA, 201 bp, Homo sapiens
actgttagtgtttggttggctttcactgtccgatccagaattgctgcatatgcagacaggaattggacaaagccatttatttatttatttatttatttatwtatttatttatttattccctctctctctctctctctctccagtttgcccgaccatctgtaagtcacacggctgcaccgccgaaggcctctgttgccacag

SEQ ID NO: 36538 - DNA, 201 bp, Homo sapiens
aaaccacagtgtaccatgtttcatgcagtggattctaggaagaggtagcaggtatcaggaatgatacctgtgcctgaacaaatatcccttcctctccaaataataataataataataataatagtaataataataataataccaggagcttcccttattcaggcagttctacatttttttttccatctgtaatgctgtaac

SEQ ID NO: 36539 - DNA, 201 bp, Homo sapiens
catgcagtggattctaggaagaggtagcaggtatcaggaatgatacctgtgcctgaacaaatatcccttcctctccaaataataataataataataataatagtaataataataataataccaggagcttcccttattcaggcagttctacatttttttttccatctgtaatgctgtaactagctcccatcagagttaacc

SEQ ID NO: 36540 - DNA, 201 bp, Homo sapiens
atgcagtggattctaggaagaggtagcaggtatcaggaatgatacctgtgcctgaacaaatatcccttcctctccaaataataataataataataataatagtaataataataataataccaggagcttcccttattcaggcagttctacatttttttttccatctgtaatgctgtaactagctcccatcagagttaaccc

SEQ ID NO: 36541 - DNA, 201 bp, Homo sapiens
tgcggtgagccgagatctcgccactgcattccagcctgggtgacagagcgagactctgtctcaaaaaaaaaaaaaaaaaaaaaagaataaatacataatastaataataataataaataatatttggggtcagattattctagggcactgtccaacaacactgagaagcatccctggcttccactcatctgatgccagtag

SEQ ID NO: 36542 - DNA, 201 bp, Homo sapiens
atcatgccactgcactccagcctgggtgacaagagcgaaactccgtctccaaaaaaaaaaaaaaaaaaaaaaaaaaagaagatgcatttcccctttgtccyggatagcagctaccttgggtttctatatttgcttatttgtccctctctactcggtgactcattccacttggaagaaactttggactggagttccctgccc

SEQ ID NO: 36543 - DNA, 201 bp, Homo sapiens
ggaagaaactttggactggagttccctgcccccacccctgccaccagactgatttgttttcttgctgttattgtcacacgataagcatggggttgttggcttttttttttttttttttttttaacatttctttctcttctccactctccacccccctcctaaatgttccagcccggttctctgcatgcactattagcttgg

SEQ ID NO: 36544 - DNA, 201 bp, Homo sapiens
aagaaagaaaaagaaagaagagaagagagagaggaagaggaagaggtctgagactgggactcagtaatttataaagaaaagaggtttaattggctcccagwtctgcaggcagtacaggaaccatgatgctggcatctgctcagcttctgaggaagcctcaagaaactttcaatcatggtggaaggtgaagtgggagcaagg

SEQ ID NO: 36545 - DNA, 201 bp, Homo sapiens
gatcttgctgagatgggagccgtactggccccccgacttccgagacctcttggggttcatgctgttctacaaagaggcgtaagtagaagagttagagagaygctgaggaggcgagggctggctggctctgtgcttgctacgtttgtgctccaatctgcccctcttgggttcctgtctatctccctcctcctcctggaataa

SEQ ID NO: 36546 - DNA, 201 bp, Homo sapiens
tgaccaaaataactcacaaggccatgcccagggccaaggggtggtgagatagactccaccttttcatgggaagagctccaagtatcctggctttttttttycccaacctattacaacctgtcttccatccccttggcactttgcagaaacagtagtctcaggtgggaagtagcatcattccatagcaagggtctgaaatca

SEQ ID NO: 36547 - DNA, 201 bp, Homo sapiens
tttattagagacggggtttcaccatgctggccaggctggtcttgaactcctgacctcgtgatccacccgccttggcctcccaaagtgctgggattacaggygtgagccaccacgcccagtgcctggctaatttttttgtattttcagtagagacggggtttcactgtgttagccaggatggtctcgatctcctgacctcat

SEQ ID NO: 36548 - DNA, 201 bp, Homo sapiens
cctggactctaaggaatccccccacctcagcctctcaaagtgctgagatttcacatgtgagccaccacgctggacttgacttgattttgttttctttttcttttttttttttttgagacagagtctcgctctgttgtccaggctggagtgcagtggcatgatctgagctcactgcaacctccgcctcctgggttcaagcga

SEQ ID NO: 36549 - DNA, 201 bp, Homo sapiens
aacaccatctctcagcacctctagcaatgctatttctgccttgacaattgtccacacacacagccagcatctgatgtgagcacatgtggtccgtgggtgtyggctgcagggacaagagtgggggtttgggaggatgcgtggcagggcccccagactcacccaggacgtgtccttctgccccgcagcactgacctcatgcgc

SEQ ID NO: 36550 - DNA, 201 bp, Homo sapiens
tctagcaatgctatttctgccttgacaattgtccacacacacagccagcatctgatgtgagcacatgtggtccgtgggtgtcggctgcagggacaagagtrggggtttgggaggatgcgtggcagggcccccagactcacccaggacgtgtccttctgccccgcagcactgacctcatgcgcatgtgctggcaattcaacc

SEQ ID NO: 36551 - DNA, 201 bp, Homo sapiens; identical to SEQ ID NO: 7533

SEQ ID NO: 36552 - DNA, 201 bp, Homo sapiens; identical to SEQ ID NO: 7459

SEQ ID NO: 36553 - DNA, 201 bp, Homo sapiens; identical to SEQ ID NO: 7541

SEQ ID NO: 36554 - DNA, 201 bp, Homo sapiens
tgtgagtggccaagttgcaaaactggctcttacctttgaatcttcccccattcatactcagccaggcacatggggaggagacccttaagggaatagcagcstcacctctgccttctcacggtccctccaggaagtgtgggggtcccaggctttggtctgaaactacactgaaatagctcatttttgccttttgttttaact

SEQ ID NO: 36555 - DNA, 201 bp, Homo sapiens
tgctgagatgggagccgtactggccccccgacttccgagacctcttggggttcatgctgttctacaaagaggcgtaagtagaagagttagagagacgctgmggaggcgagggctggctggctctgtgcttgctacgtttgtgctccaatctgcccctcttgggttcctgtctatctccctcctcctcctggaataaatatc

SEQ ID NO: 36556 - DNA, 201 bp, Homo sapiens
cgtttgtgctccaatctgcccctcttgggttcctgtctatctccctcctcctcctggaataaatatcttaggttcctttttacaatctcaccagtcgatgkcatgcaaagtcaatagtgtctgcttttatcaaatgcctaaaatggaagcagacagctttcccatagaagcccggactggccagtttcctggggcaatatt

SEQ ID NO: 36557 - DNA, 201 bp, Homo sapiens
atgcaaagtcaatagtgtctgcttttatcaaatgcctaaaatggaagcagacagctttcccatagaagcccggactggccagtttcctggggcaatattcyattttgccttgcctgtgtatgtctcatcagacatccttagtagtcaggagctcagtctactaagtggatgttatcaaatgtattgcttatctatttttct

SEQ ID NO: 36558 - DNA, 201 bp, Homo sapiens
cctacttctctgacatgggacccttggctggagctcactggctgccttcctgccacctgtaagcctcggcacttgctgttccctctacctacatgcttttycctgtgatccttcctcatacgatttcctcagattatctttgctcaaacaacaggcaagggctgggccttaatctcacacctgtaatctcagcactttggg

SEQ ID NO: 36559 - DNA, 201 bp, Homo sapiens
ataaaggatataccaaggtctttcgtgtcttccctgacctgtagcctggtggtgtgccaagattagcccagaacatactgtctccaggaggaagagactcrcttctgcattattctcagggctttgctgttctctgaaggacagtataatcaaaccatttcctgccgtttgggtgagaaatagcagggttttctctcttcg

SEQ ID NO: 36560 - DNA, 201 bp, Homo sapiens
tttttttttttctttgagatgaagtctcactctgtcacccggactggagtgcaatggcatgatctcggctcactgcaacctccgcctcccaggttcaagtrattctcccacctcagcctcctgagtagctgggactacaggcatgcaccactatacccagctaatttttgtatttcttgtagagacagaacgttgctgtgt

SEQ ID NO: 36561 - DNA, 201 bp, Homo sapiens
ctcccacctcagcctcctgagtagctgggactacaggcatgcaccactatacccagctaatttttgtatttcttgtagagacagaacgttgctgtgttacycaggctggtcttgaacccctggcctcaagtgatcctcctgcctcggcctcccaaagtcctgggattagaagtgtgagccaccttgcccagtcagttattg

SEQ ID NO: 36562 - DNA, 201 bp, Homo sapiens
tctcccaagtagctgcaactacaggcgtgccaccacgcccagctaatttttgtatttttagtagagatgggatttcaccatgttggccaggatggtctcartctcttgacctgcaatctgcccaccttggcctcccaaagtgctgggattacaggcataagccaccatgccagccttttttttttttttttttttttttga

SEQ ID NO: 36563 - DNA, 201 bp, Homo sapiens
actccgagcctcaggtgatccgcctgcctcggcttcccaaagtgctgggattacaggcatgagccaccgcgcccagccatttttgtatttttaatagagayggggcttcaccatgttggccaggctgctctggaactcctgacctcaaatgatccgcccaccttggcctcccaaagtgctgggattacaggcatgagccac

SEQ ID NO: 36564 - DNA, 201 bp, Homo sapiens
ggcatgagccaccgcgcccagccatttttgtatttttaatagagatggggcttcaccatgttggccaggctgctctggaactcctgacctcaaatgatccrcccaccttggcctcccaaagtgctgggattacaggcatgagccactgggcccggcctaattatatttttgtaaaacctaagtgcttctcttatagcagta

SEQ ID NO: 36565 - DNA, 201 bp, Homo sapiens
cgactcggtgacgtctgcccaggagctccgaggatgcaccgtcatcaacgggagtctgatcatcaacattcgaggaggcagtgagtgtctctgtgtgggcrtcgggggtgcctgttgggctccatgtccctctgagctgtgagcggggaagaaaagcagtgcagaccctgctgcgtgctcctacagcacttttaggatggt

SEQ ID NO: 36566 - DNA, 201 bp, Homo sapiens
ccctcttcaagactgagctgagcctccttcctggccatgaaaacttcctcaacttcctctgttatccacattcaacaaatatgtgttgagtatgtgccaarcaagtggagaggattaggcacgtagcactgaacaagatcaactccgagcatggccacaccatcttggagttgtagaagaccagccgttgaatgactagat

SEQ ID NO: 36567 - DNA, 201 bp, Homo sapiens
gcctccttcctggccatgaaaacttcctcaacttcctctgttatccacattcaacaaatatgtgttgagtatgtgccaagcaagtggagaggattaggcaygtagcactgaacaagatcaactccgagcatggccacaccatcttggagttgtagaagaccagccgttgaatgactagatgtgtgtgttttttccatagga

SEQ ID NO: 36568 - DNA, 201 bp, Homo sapiens
aaattcatttatgtttcatgtacatcttatacacatagcctggaggtaattctatacaatattttcagtaatattgtgcgggaaacaaggttttcaccgcmctgactgtgacctgtcacaagaggtcaggaatggaattttcttccactgctatcatgtcggcgctcaaaaagttgaattttggagcatttaggattttgg

SEQ ID NO: 36569 - DNA, 201 bp, Homo sapiens
aataccaggagcttcccttattcaggcagttctacatttttttttccatctgtaatgctgtaactagctcccatcagagttaacccaggcagggtattctmtgtctatttataaacttaagaagtattttccagtctctcataggcttttaaagctgtgtaaatacttgggtttccgagtggatactcaccattcacagga

SEQ ID NO: 36570 - DNA, 201 bp, Homo sapiens
gagaatacaaggagaaggcgtgtagcccgtgacccagtcctgccccagacaaaccgatattccctccaaagctctatttggcagaagaagtgttttcgttscctcttgcctgtggtatctcccctgataagcgttgtggattgttccagaccgtgttgacggggacagcttccttctccgcggctgccggccctgaccctg

SEQ ID NO: 36571 - DNA, 201 bp, Homo sapiens
gaggggacaaatattcaaatcatactattatgttaccagtaaaatttaaaatataggaataataattgccgatgtgtggcagacttaccaaatactagacmctgtgctaagtgttttatatctattattttatttaattttcttggtcactgcatgacatatgctctgttagtcccagtttttcgaatgggcataacaaga

SEQ ID NO: 36572 - DNA, 201 bp, Homo sapiens
gaggaccctaggtatgactcacctgtgcgacccctggtgcctgctccgcgcagggccggcggcgtgccaggcagatgcctcggagaacccaggggtttctstggctttttgcatgcggcgggcagctgtgctggagagcagatgcttcaccaattcagaaatccaatgccttcactctgaaatgaaatctgggcatgaatg

SEQ ID NO: 36573 - DNA, 201 bp, Homo sapiens
gttactacaagaaacataaaaattagccgggcgtggtgacacacgcctgtagtcccagctactcgggaggctgaggcaggagaatggcgtgaacctgggasgcggagcttgcagtgagccaagatcgtgccactgcactccagcctgggccacagagcgagactccgtctcaaaaaaaataaaaataaaataatatttggg

SEQ ID NO: 36574 - DNA, 201 bp, Homo sapiens
cagcctgggcaacagagcaagactctgtctcaaaaaaaaaaatcagttgatgctttgtcttttgccacttcatggtctttttggttataatctttttggtrtataaactcatttggcctgtttgatgagcccattttacatctctggttgttgagataccaatttctcagtagttattcatgaagcaccaacgtcttggtt

SEQ ID NO: 36575 - DNA, 201 bp, Homo sapiens
aatgcccccaaagtaggatttgttttctgaccacacattttctgatgacgctgcaatagaaactaaaagttaatttcaaaagattaaacagaaaacttcasttcttggtggttaaaagttaaacacttacaggctgggcgcagtgactcacacctgtaatcgcagcactttgggaggcccaggcaggcggatcacctgagg

SEQ ID NO: 36576 - DNA, 201 bp, Homo sapiens
accctgtgtatactaaaaatacaaaattagccaggcgtggtggcacatgcctgtaatctcagctactagggaggctgaggcaggagaatcgcttgaacctyggaggtggaggttgcagtgagcggagattgcaccattgcaccctagcctgggcaacaagagcgaaactctatctcaaaaacaaaacaaaacaaaaaacaa

SEQ ID NO: 36577 - DNA, 201 bp, Homo sapiens
aaggatcctaattctagttcagagatgcattctaaagggtcttctttttcttcttgtcagctaatagtcttaaatttgcatattaaaggaaacaactcacrtaaaagtcagacagcaaaatttacctcgtaaggtacaaagtgaaagtctggtgagctggagggaaattaaaatgaatttaattaacaattggacataaaa

SEQ ID NO: 36578 - DNA, 201 bp, Homo sapiens
ggccgcaggagtgctggtggaggggcttccagaaagaccctgcggcagcgccccccctcggctctccccgcaggagagcgggcacctgcgcggcgccgggygaaggcgagagcctcggcgagccctctgcagcggagccccctgcccatttggttttgggtaagaggaggggtccgcgtctctgcagctcgggcgggattc

SEQ ID NO: 36579 - DNA, 201 bp, Homo sapiens
ataacctttataacctttacttaggagttggttaatatttcataaaaaccttgttaatttgacatgggctcatatgctggtcttgcatcagtgtgcctttracattaatgattaatttatagagaaactgaacttattttatctctcaacattggctcttacaatctcacatgcccctttcctgagaaagttgaatgactt

SEQ ID NO: 36580 - DNA, 201 bp, Homo sapiens
gtaataaccttaacttaaaaaaaaaatttaatctcagttttttccctaagcaaaccaaaacttaataataatatgacaacttgatcatataggtttttttaaaataaatcctcttattgtgacttacacagactgttcatgacatgcttggactttctggtttgtcctgaacatccctctttcttaagcaaccagtcattt

SEQ ID NO: 36581 - DNA, 201 bp, Homo sapiens
cgccctctactcggtttggttcggcctcacgtgttcctttagctccgaagccgggatacgggtggggaaggggggctcgcgccctacaggccgagccctgmggccgcagcggggtaagggtaggatggccgatcgcgcccagaccccagggagtctccctctcggcttttctgccggcgtctccagcagcatgatctggca

SEQ ID NO: 36582 - DNA, 201 bp, Homo sapiens
tactctaggactaaatttaccatacaagattctttcttatatgaaattatttatctttaagctttcttaccaaaaaaaacctctttatttttataactgtytttttttttttttttttttagatgaagtctggctgtcacccaggctagagtgcagtggcaagatctcagctcactgcaacctccgcttcctgggttcaag

SEQ ID NO: 36583 - DNA, 201 bp, Homo sapiens
gtagggcagtggtattgaaccttggttgtgggttagaatcacctagagaacagtgagggaaaaagtgtctgtgcctcacctctgggtcaggagtgaggctrggcaaaggaatactttaaagaacttccctgtgattaaaaagaaaaaaaaaatcattctatggagaatctcaaacatacgcaaaagtagaaagctgtatat

SEQ ID NO: 36584 - DNA, 201 bp, Homo sapiens
cctgtagggcagtggtattgaaccttggttgtgggttagaatcacctagagaacagtgagggaaaaagtgtctgtgcctcacctctgggtcaggagtgagsctaggcaaaggaatactttaaagaacttccctgtgattaaaaagaaaaaaaaaatcattctatggagaatctcaaacatacgcaaaagtagaaagctgta

SEQ ID NO: 36585 - DNA, 201 bp, Homo sapiens
ccagtgtatgagctgggattgcctcacactaagaatagcaggaacccctagaagtctagggccattgtggctttggggagcccaggctccttgtttttttytgctgtgttattctgaaggcagctcaggatcccaggatactgtgatagtccttcacctccagcctcagtccaggcagggacaagcaacgcacctgcatcg

SEQ ID NO: 36586 - DNA, 201 bp, Homo sapiens
tggtggtaggatgggggcttgtgaatgtttataaacagaaatccctcgaatacgaccctggctaggtaggtgcagttacagaggcacagaagggaggagaytgggcgaaagatttttgaattaggggattagaaaaggctgctcgggagagttatctgaaccagctaggacttggtcagatgcagtcagtttggtatagga

SEQ ID NO: 36587 - DNA, 201 bp, Homo sapiens
ggttcagaaatcctgcccctgcccctgcctgctgctctgtttgccaggcggtcctggtctccacccaggctccaccctaccagggtggaatggagttgggsagttgggcctaacagcacgggtcctgtcctctttcagggctgtcccggggctccctcccagctgcagccccaggtacttcctcgtctgcactccaacccc

SEQ ID NO: 36588 - DNA, 201 bp, Homo sapiens
agttttcagcatggctaaactagaaaatagtgacaccaccaaatgccgacaaggctgtggggaaactgggttgttcagacactgccactggggctgtagcrtactatagccactttcataaacagtttgtcagtttcttaaaaaactaaacctgcaactaccatatgacccagcaattacacccctgggcacctacccaag

SEQ ID NO: 36589 - DNA, 201 bp, Homo sapiens
catgactgctcctgattaaagcccggaaggcaacaaagtaatgctgagggtgcatttatgtttcagaaccaccgggaggaactgggccattctaacacccrttgctaccatgctggccacccgcctctccagacccctgtcacggctcccaggaaaaaccctaagtgcctgtgatagagaaaatggagcaaggtaagcaac

SEQ ID NO: 36590 - DNA, 201 bp, Homo sapiens
gatcgatgtgagctgcttgtgggcaggactccacagtgtgtcatcactgagttgtttccagcctcttatgcatctcagcttctctctccagaggtctatgwcctctgagagggctcaaaatgccaggtgatcagcccttatatgcatttcctggatgacccatttttaaaattaaatttttctggggatttccctgcaggg

SEQ ID NO: 36591 - DNA, 201 bp, Homo sapiens
catcccagccaaaactataaaacttttagaaaagaacatagaagaaaatctttgggtcctgggggcaaagagctctgagacttgacatcaaaagcatgccrcataataggaaaatactagactttatttaggggttaagagtttagactctggactctctcagccttggtttcactagttagctctatcactaactacatt

SEQ ID NO: 36592 - DNA, 201 bp, Homo sapiens
gaacacgttttcacatctcactgcagtggtgcaatatacaaccctcatgactgcacatggtggccctggattactgccacagatcctaatgggtctccctkcttctgctctagtccatcctcaacttattaacccagtgagagttacctttttaaaaatgtaagtctgataatggcactcctcttcttaaaactcttcttt

SEQ ID NO: 36593 - DNA, 201 bp, Homo sapiens
caagtaggtgagagacaaatggttacattcttttgagtttctgattagcctttccaaagaaggcaatcagatacacatttatctcagtgagcagggggatractgaatagaatgggaggctgggttgccctaagctgttcccagcttgactttccctttagcttagtgatgtgggggccccaagatattttcctttcacac

SEQ ID NO: 36594 - DNA, 201 bp, Homo sapiens
taaacatgaaaagatgttcaacatcattagccattagggaaatgcagattaaaaccacagcgaaatatcatgatacagttttcagcatggctaaactagaraatagtgacaccaccaaatgccgacaaggctgtggggaaactgggttgttcagacactgccactggggctgtagcgtactatagccactttcataaacag

SEQ ID NO: 36595 - DNA, 201 bp, Homo sapiens
ttaaaattaaatttttctggggatttccctgcagggccactgcatgttgcagggggtcaactccccagacgctcccacgaggcccctggtcacccagggaygcctttcgctggaaagagcaaatgtcctttctctttggagctcagaaaactcagtttctcatttgcctatgaaaacaacagttcagttcctcagacaaat

SEQ ID NO: 36596 - DNA, 201 bp, Homo sapiens
gaaaaataacagcagacttaaagcatggcagaaaggaaaatagagaaaaacggactaggaactctagaatttgcaggttgaccttagggctctttttcctyaatgtaaatttgcacaaagactgtattacttccattttactctggcaaatagaggtgccataaaaccaataaggtgctctaaagggggtcattctccttg

SEQ ID NO: 36597 - DNA, 201 bp, Homo sapiens
ttattagaactctgatgacatttatttgtccctcttttagaagacttacaggacttctaatgattcatttagcttacatacatgcttcatttccctccatraacccccaaaatctcaggtgcctcatttccctccatgaacccccaaaatctcagacaggtctctcagttaattcagaaagtttattttgcgaaggttgag

SEQ ID NO: 36598 - DNA, 201 bp, Homo sapiens
agcctcccaagtagctgggactacaggcatgtgccaccacacccggctaattttttgtatttttagtagagatggggttttgccatgttggccaggctggycttgaactcctgacttcaactgatccgcctgcctcggcctcccaaagtgctgggattcaccacgcccggcccggcttttagcagcatttgcttgaattta

SEQ ID NO: 36599 - DNA, 201 bp, Homo sapiens
aacaacagttcagttcctcagacaaatgcacacagacaaacacaattgagattaattatgggagaaaaagcaatagataagaccctttagaatgcatctcygaactagaattaggatccttaaacaacaatttcctaggagagaagagaaaagaaaagaaaccagccaagaccacttcctgtaaactgtgctcagccaccc

SEQ ID NO: 36600 - DNA, 201 bp, Homo sapiens
gtggtgcaatatacaaccctcatgactgcacatggtggccctggattactgccacagatcctaatgggtctccctgcttctgctctagtccatcctcaacwtattaacccagtgagagttacctttttaaaaatgtaagtctgataatggcactcctcttcttaaaactcttctttttttttttttttttttgagacagag

SEQ ID NO: 36601 - DNA, 201 bp, Homo sapiens
agaacgagattccatctcaatgaatcaatcaatcaatattgtgtgtctgttgtgtgcagggcactgctgtacatgttggagatacaacagtgaacaaaacagacaaaaattcctgttctcaaagagcttatattctaatgagactgaacaacaacaaacaagataaatatgtacaacatgtagaatgctataatgtaataa

SEQ ID NO: 36602 - DNA, 201 bp, Homo sapiens
cttcctagatacaatggaggtacaggcattggataaatatacccattccaaatgggagaaatgggtcaaaacgaaggggccaaaggttccatgaaagtccraaatccagcagggcagccaaatcttaaagctcctttgactccatgtctcacatccaggtcatgctgatgcaagaggtgggttcccatggtcttgggcagc

SEQ ID NO: 36603 - DNA, 201 bp, Homo sapiens
ttgaatctgccttcagattcaaactgtaactcctccctgagtctccagcctcttcttggaaatggccctatctaaaaaccacttggccattttgaaatctytctcaggtcctgattctgggttatgctcagggcagtctctgaagatttctcatcctgttcaggccggttccttgctaatttatgcccacacatacctggc

SEQ ID NO: 36604 - DNA, 201 bp, Homo sapiens
aaaaagtaatatgtattcattgggaaaataattggaaaaagaattaggcaaaataagcatgtggttttgtatcttgttttttaaaacagcttgttgtaatrcattagatattctttgaaaaaaatagaatttgaagttcagaaaatcaaatcagttttagggattgagaatctcactacatattttgtctttcaaaattgt

SEQ ID NO: 36605 - DNA, 201 bp, Homo sapiens
gaacgagattccatctcaatgaatcaatcaatcaatattgtgtgtctgttgtgtgcagggcactgctgtacatgttggagatacaacagtgaacaaaacagacaaaaattcctgttctcaaagagcttatattctaatgagactgaacaacaacaaacaagataaatatgtacaacatgtagaatgctataatgtaataaa

SEQ ID NO: 36606 - DNA, 201 bp, Homo sapiens
atattctttgaaaaaaatagaatttgaagttcagaaaatcaaatcagttttagggattgagaatctcactacatattttgtctttcaaaattgtttgtttrtttatttatttagaaatggggtcttgctatgttgtccgggctggagtgtagtggtacaatcatacctcactgcagcctcaaactcgtgggctcaagggat

SEQ ID NO: 36607 - DNA, 201 bp, Homo sapiens
gggtcaaaactgagaattaatacacctcatatgctgttggtgggaatgtaaattagtacaaccactacagagaatagtttgtaggttcctccaaaaacaamaaatagagctaccataggatccagcagtgccactgctgggtatatacccaaaaggaaggaaatcagtatattgaagagatatctgcactcccatgttggt

SEQ ID NO: 36608 - DNA, 201 bp, Homo sapiens
tccagcccagagctggtgatgcggaaaatcagggcagatggcagcaggatctaaaatagggagggaagaagtcctcagttacgtaacagcgaggagactcycagcctacgcacagtagcaaccatggggtcctgccactcgagccagaccctccttcccttcccgttttgggctctaagtgctgccgcctgtgagagaatg

SEQ ID NO: 36609 - DNA, 201 bp, Homo sapiens
tatgtgtacgtgtgcattcatctaaagacataagtaagtgattaacttcttctaatctataactaagatctgagtcctgaaggccttcctttggagccttygtaaattcatttaatctaaatgggtgaaggtgctggggtgattacccttatcttgtgtcctgctaaatcacagggttttggggagttcctttagtcccca

SEQ ID NO: 36610 - DNA, 201 bp, Homo sapiens
ccaaaatctcagacaggtctctcagttaattcagaaagtttattttgcgaaggttgaggatgtgcacctgtaacactgcctcaagcggtcctgacgacatrtgcccaaggtggtcagagcacagcttggttttatacattttagagagacatgagaagcaatcaacatatgtaaaatgaacattggtttggcccagaaagg

SEQ ID NO: 36611 - DNA, 201 bp, Homo sapiens
gcctattggccagaggcaggtcacgtgaccactaggtgggtggtaatctggaaagcgttgggcgcactgctgtccctggacaaaatccagattcttgttartgaggcagatgagaagaacggatgctggcaggcaaagagcagtgtctgtcacagctcagctgggctgtggcctccagctgttcacagggatattggggct

SEQ ID NO: 36612 - DNA, 201 bp, Homo sapiens
tctttatcgctgtattatttatttgaaatataatgccatttatttgtgatctgttttccttgttgttgattcttgttgatgtaatttaatttctgaatatrtaaactgttaacaaggctgtaaaggcaaaaattatacaaattggtaaaatcaaagtagcgttattccctcacccctatctgttccactccattccttcat

SEQ ID NO: 36613 - DNA, 201 bp, Homo sapiens
aaaaaaaaaaccccacaaaactttaataaaattcaattgcatcaaaacaaacagaagactgtggggtttggggcagtagacagtgtttttattccctatcrcccagcagaactcagcaaagcaggctgcacgctggctctgtgaggacttggaggtggctgcctaagggcaggatttaacctgcactgtcctgaattaaca

SEQ ID NO: 36614 - DNA, 201 bp, Homo sapiens
ccccctggggataggtctttgtttttcttttcctgtagggcagtggtattgaaccttggttgtgggttagaatcacctagagaacagtgagggaaaaagtrtctgtgcctcacctctgggtcaggagtgaggctaggcaaaggaatactttaaagaacttccctgtgattaaaaagaaaaaaaaaatcattctatggagaa

SEQ ID NO: 36615 - DNA, 201 bp, Homo sapiens
tggtcacttgcctggagaggatcctgcatgctgatagtgctgaggcacctgccagctaaggtgagagacagctgaacttgaacatgtgggctgtcactgaragcggtcagcagaagaaaatttgagccatgggtaaggcctggtagaaagggaggaggttggggaggcgtgaataggcctttggaaagaggtgctgttaac

SEQ ID NO: 36616 - DNA, 201 bp, Homo sapiens
taattttttaaaagcttaatatgttgaataggtaatatatttacatggtacaaaatttgaatggcaggccgggcgccgtggctcatgcctgtgatcccagyactttgggaggccgaggcaggcggatcacctgaggtcaggagttcgagaccagtgtggccaacatggtgaacccccgtctctactaaaaatacaaaaatt

SEQ ID NO: 36617 - DNA, 201 bp, Homo sapiens
tccctggtagcaatagggataaataaaaagtaatatgtattcattgggaaaataattggaaaaagaattaggcaaaataagcatgtggttttgtatcttgttttttaaaacagcttgttgtaatacattagatattctttgaaaaaaatagaatttgaagttcagaaaatcaaatcagttttagggattgagaatctcact

SEQ ID NO: 36618 - DNA, 201 bp, Homo sapiens
aaatctcaggaaaaatagacatagagggggattttcctgaacttgataaagggtaaacaccataagccttcagctaacatacttaagggtgagactgaatkctttgtccctaagatggggaacaaaccaaggatattagttctcaccgcttatccaacatagtgctgtaatttctagccagtgcaataaggtaagaaatgg

SEQ ID NO: 36619 - DNA, 201 bp, Homo sapiens
gtcctggtcagtgtccttctttctacaagaggcgttggagccgggctctgcatagggcgtatatatccctggccgccaaggaagctgacccttgaaatttktgaagctttcatattcactcaatacacatttacagagcctctacttcctgtcaggcgtcacacaataaatattcggaggagcaagaagagagtgattcaa

SEQ ID NO: 36620 - DNA, 201 bp, Homo sapiens
cccaaaaaactattagacccaaacagtggttttatctcagtggaaaaataacagcagacttaaagcatggcagaaaggaaaatagagaaaaacggactagraactctagaatttgcaggttgaccttagggctctttttcctcaatgtaaatttgcacaaagactgtattacttccattttactctggcaaatagaggtgc

SEQ ID NO: 36621 - DNA, 201 bp, Homo sapiens
cctcatggatgggattagtgtctttataaaagagacctttgccatgtgaggttacagtgagaagacatctgtctatgaagaaagtgggccctcaccaaacrcagtctgctggcactttgcacttcaactccccagcttccagaactgtaaggaatataagtctgttgttggtaagccacccggtctatgatattttgttat

SEQ ID NO: 36622 - DNA, 201 bp, Homo sapiens
tttgcattctcctcaaattcctgtgttgaaatcctaacccccaaggtattggtattaggaggcaggggccctgggaagtgattaggtcataaaggtggagycctcatggatgggattagtgtctttataaaagagacctttgccatgtgaggttacagtgagaagacatctgtctatgaagaaagtgggccctcaccaaac

SEQ ID NO: 36623 - DNA, 201 bp, Homo sapiens
gtcggcctgaggggggatggagaccatagagcaggaagtgactgatgggtctgcctgaggggtggggtgaagacggaggtggaggagtgagtgagacaaasagacccaggaggcttctccagcagcccaggagacaggcagcgaggacccaagggaatgctagtggaaacaggaaggaagaactgacccagcagaggaaac

SEQ ID NO: 36624 - DNA, 201 bp, Homo sapiens
tcagggaagttaatgaatgtaaagggcttgattaggggtctgccagctgtcatgttgatcttgagctgtaatattagcagtactgggtgactcagtaggtrggggaggggtggaggagctggaggagtcacagacaaaagtaaaatcattaacaaagaggaggagcaggcttgggcagcttggaaacttgacgtgttggtt

SEQ ID NO: 36625 - DNA, 201 bp, Homo sapiens
aaactgtgttgatataggagccgacatgagcaagcagaggctcccctggctcaggcagccccaggttgggttggccagacagcaaccaggcacaggggccragtgcaggtcctgctacccagccaccacagcttcctctcacctgattctcacagcaacccaggcaggataggcagggtggggttatcttattttgcagaa

SEQ ID NO: 36626 - DNA, 201 bp, Homo sapiens
gtgaatgaagctttaatttgggtaacacggaaggaaagcagctagagaccaattactctgtcatttacacaaactcatttccatgattaacttggaaaatraagcagcgccgagttcccacaggcaggggagggccccaggatgggagctctgctctgaggctgtgccttgggaaggagcacggggctatcggcccgggag

SEQ ID NO: 36627 - DNA, 201 bp, Homo sapiens
cctatggtctggtgactccagccagcacaaacccatcccctgatggttggaggctgggcgagggcttcttgcaagatgcgcctgacagtgccttgttacasagcacctgctgtgcttagcattccacccggggccaagaggctgtgtgagcaggtgacagccagcctggccccgcctgtcacaagctgctaggtctgcacc

SEQ ID NO: 36628 - DNA, 201 bp, Homo sapiens
cagcgccgagttcccacaggcaggggagggccccaggatgggagctctgctctgaggctgtgccttgggaaggagcacggggctatcggcccgggagaccraacactgagggtttccacaacaaagaggcagggcccagctctgtcctgaggctctgacccatccagcctttgcaccccaacaaactgaactcagagaggt

SEQ ID NO: 36629 - DNA, 201 bp, Homo sapiens
atcgcgccactgcactctagcctgggtgacaagagtggaactttatctcaaaaaaatataactcatctcaaatataactccatctcaaaaaaacacaactrtaaactaagttcctcccaaagctagctcagcccacagccaggaatgaaaaaggacggcttggaggttagaagcaagatggagttggttaggtcagctctc

SEQ ID NO: 36630 - DNA, 201 bp, Homo sapiens; identical to SEQ ID NO: 7827

SEQ ID NO: 36631 - DNA, 201 bp, Homo sapiens; identical to SEQ ID NO: 7816

SEQ ID NO: 36632 - DNA, 201 bp, Homo sapiens
cctattgactgagaaggctcctgggtggctcagaagtggttccagccaagcctctagagacatgccagacttctgcccgctgtgtcatagggcagtaacgscttagcaggtacctctgtctccctctgtaggccgcgtcgtcaatatcagcagcatgctgggccgcatggccaacccggcccgctccccgtactgcatcac

SEQ ID NO: 36633 - DNA, 201 bp, Homo sapiens
tgcccctgcctgctgctctgtttgccaggcggtcctggtctccacccaggctccaccctaccagggtggaatggagttggggagttgggcctaacagcacrggtcctgtcctctttcagggctgtcccggggctccctcccagctgcagccccaggtacttcctcgtctgcactccaacccccatcgccagggctgctgtc

SEQ ID NO: 36634 - DNA, 201 bp, Homo sapiens
ctatcactagctacattgagcgttttaaaaagacctctgtttctcacatgtagcatgggggattgtagatgagatcctgaaggcagaagtaattttcccargcaacattgctggttggtagccgagtctgggttagaacctggcctttccactataccatggtgcttctccagacaacaagaacaaggtagggagggccag

SEQ ID NO: 36635 - DNA, 201 bp, Homo sapiens
agtcaggttcagaaatcctgcccctgcccctgcctgctgctctgtttgccaggcggtcctggtctccacccaggctccaccctaccagggtggaatggagytggggagttgggcctaacagcacgggtcctgtcctctttcagggctgtcccggggctccctcccagctgcagccccaggtacttcctcgtctgcactcca

SEQ ID NO: 36636 - DNA, 201 bp, Homo sapiens
cccctggtttcctgattccgagtccaagtgaaatacttttgcccctgcagtagaccctgctacagaggataaaaaggcacgtcataggctaggagaaaaawtttgcctaccacatatgtaaccaaggactagcagctaggacatctgaagaattctcaacattcaacggggtagaagaatgaacgattcaatagaatatgg

SEQ ID NO: 36637 - DNA, 201 bp, Homo sapiens
ttaatctccacatatacctctagccctgagcagccactgatttctatttctttaggtttgcattttctggacttttcatctacatgaaatcatacaatacrtggccttttgtgccacacttcttgaacacttagtgtgatgtttttgagagtcatccatgttgcagaatgcatcagtagctcattcctttgtattgctgag

SEQ ID NO: 36638 - DNA, 201 bp, Homo sapiens
taccaccctggagaccctggagactgcgtggtcaggacagctgagggctgggacccagtgtggtatggaagggagatggagaggatagagcgcgcgcgcgygtgtgtgtgtgtgtgtgtgtgtgcgtgctctgtcacccaggctggagtgccgtggcatgatccggctcattgcaacctctgcctcctgggttcaagagat

SEQ ID NO: 36639 - DNA, 201 bp, Homo sapiens
ttgagattacaggcatgaactactatgcttggccatctttcaaagtttatatgtgtattcatccatttccttattgctgataaaggcatacccaagaatgrgtaatttataaagaaaaagaggtttaatggactcacagttccacatggctggagaggcctcacaattatggcagaaggcaaaaggcacatcttacatggt

SEQ ID NO: 36640 - DNA, 201 bp, Homo sapiens
gcaacagcagacattagccagcctcagacgactacagtcttgcccctaatttgctgccccggatccaaccttggaagggtcagaagttaagaataggaggsgagaggagctagaaaacagtgagaaagacaacctccaccagcacctacttcccacagccctcagggctgggcaggggaaagctttacctcgcatacaagt

SEQ ID NO: 36641 - DNA, 201 bp, Homo sapiens
tgacataccctggagacattttctctatcatcttggcaatctggctcttcattacttatgcaaatttctgcagccagcttgaatttctcctcagaaaatgygtttttcttttgtattgcgtcaggctgcaaattttccaaacttttatgttctgtttcccttttaaaactgaatgcttttaacagcacccaagtcacactt

SEQ ID NO: 36642 - DNA, 201 bp, Homo sapiens
gcaggtgaaagaaaggtgtcagggaagatgcaggagatgcctgggtatcactaatgctgagggagaggtgagcctcaaggagtactggcagtactcatatygtagcgagcctgaggagagtgaagactgggggtgaggtccttggtgtaccaccctggagaccctggagactgcgtggtcaggacagctgagggctgggac

SEQ ID NO: 36643 - DNA, 201 bp, Homo sapiens
tctaagaccacctcagcctggatttcattgtccatatcattgtcagaattttggccaaagccatttaacaagtctctaggaagttccaaactttttcacatttttcctgtcttcttctgagccctccaaactgttctaacctctgcctgttacccagttccaaagttgcttccacattttcaggtaccctgacagcagtgc

SEQ ID NO: 36644 - DNA, 201 bp, Homo sapiens
agccattccagcttctgttggattatccacatgaatgatgcccagctgattataaaaaattctgtactccatgctgagttcctgtaactctagaaaaaggaaaaaaaaaactgtactccaaatagctacagaaactgggattttaaaaatccctttcttcaaagaaagaacctcagaacaattggtggtgtgcttaaccca

SEQ ID NO: 36645 - DNA, 201 bp, Homo sapiens
atactgggcttctttcctttgctgtcaattccagaaaaagctactcaatacctataaaattctacagattaagggtatgatttccagccaaaaaaaaaaamcccacaaaactttaataaaattcaattgcatcaaaacaaacagaagactgtggggtttggggcagtagacagtgtttttattccctatcgcccagcagaa

SEQ ID NO: 36646 - DNA, 201 bp, Homo sapiens
ttttttttgtttttttttgttatttttgtttttgagacggagccttgctctgtcacccaggctggagtgcagtggcgtgatctcagctcactgcaacctcygcctcctgggttcaagcgattctcctgccccagcctcccgagtagctgggactgtgggcgcccgccaccacgcctggctattttttgtatttttagtaga

SEQ ID NO: 36647 - DNA, 201 bp, Homo sapiens
ctggcctgcaggctgatgggcaatgtctgggccaagcccatgtggtaaatgcacatctatccctctcctgtccaggcatgtggggcctcgttaacaatgcyggcatctcaacgttcggggaggtggagttcaccagcctggagacctacaagcaggtggcagaagtgaacctttggggcacagtgcggatgacgaaatcct

SEQ ID NO: 36648 - DNA, 201 bp, Homo sapiens
gtgccctcccgggggcacacctggatgggctgagtgccctcccgggggcacacctggatgggctgagggccctcccgggggcacacctggatgggctgagkgccctcccgggggcacacctggatgggctgagtgccctcccggggacacacctggatgggctgagtgccctccccgggacacacctggatgggctgagtt

SEQ ID NO: 36649 - DNA, 201 bp, Homo sapiens
gcctggagacctacaagcaggtggcagaagtgaacctttggggcacagtgcggatgacgaaatcctttctccccctcatccgaagggccaaaggtgagtgrgaaagggagctccctcctgcccctgaacctgccccacgtgttcatctttgctcagaatggaaatacctgtcccagcagctccaatgtccacaactcagca

SEQ ID NO: 36650 - DNA, 201 bp, Homo sapiens
cacaggaaagaagcagagaggaggctggcctgcaggctgatgggcaatgtctgggccaagcccatgtggtaaatgcacatctatccctctcctgtccaggsatgtggggcctcgttaacaatgccggcatctcaacgttcggggaggtggagttcaccagcctggagacctacaagcaggtggcagaagtgaacctttggg

SEQ ID NO: 36651 - DNA, 201 bp, Homo sapiens
atgcagtggcgtgtcccccatctcctgctctcgctttcttcccgtctccctctcctccctctccctgcttcccctccacactctgccactctgccatgtcytggccttgccttggcaattccccctcaggcaatgccggctgtgaactccagggagcaccctcccagagcgttccgacccgcagtggccgccaccgaccca

SEQ ID NO: 36652 - DNA, 201 bp, Homo sapiens
gccactgaaggggtcatcctgagggaatggcctggtcattgtgagacttgtgaatctccctctgaggatggcagtggcaatgtgaaggtggattcaaagcrggagttaaacatgggttctggactccggaactagggtggtaggtgttgggaaacaggaagggtcaggtgcgaggagtgttgagaaggcgaagctgcctgg

SEQ ID NO: 36653 - DNA, 201 bp, Homo sapiens
attttcacatcgagtgtagctcatccctattgtgaaagaaaccatgtttcatagaataggatgaaatgtgacaatgcagcctgcctggtgacacgagggtkcacgtgacaaagcacatcagcacttagcacagtgctcaggacagtggacactcgggaaatgctgtctacttagaggaaagccccccagcagctcggcagt

SEQ ID NO: 36654 - DNA, 201 bp, Homo sapiens
ccggggtgactacgtccagcacctccggccccattgggcagtcccttcaccatttcctcctgtgccctctgaaattgcatgatgtgatttctccattcccrgggttggggttcttctggttgaaagcattcagaaggctcagcctaaccagcggaggactttccacccctgacaagtgctgaccgtcctgggctttccacc

SEQ ID NO: 36655 - DNA, 201 bp, Homo sapiens
tggtcctggctctgttctctgtggctgcatggaacaagctggctccctcagtcatgttccactcaagtcttctctccggggtgactacgtccagcacctcyggccccattgggcagtcccttcaccatttcctcctgtgccctctgaaattgcatgatgtgatttctccattcccggggttggggttcttctggttgaaag

SEQ ID NO: 36656 - DNA, 201 bp, Homo sapiens
gtcacagaaaccaaggaggtgcgggagggagtgtcacagaaatccaggggaagaggggacagtgcagtacagagctccaggagggagtgtgcagggtgcayctgagaaacagcatgaagcctctgtggctgaagcagaatgaggggggagtagagtgaagtgaggggcacgggagcagatcttgtatcagcatagggaagg

SEQ ID NO: 36657 - DNA, 201 bp, Homo sapiens; identical to SEQ ID NO: 7821

SEQ ID NO: 36658 - DNA, 201 bp, Homo sapiens
cagcttcctctcacctgattctcacagcaacccaggcaggataggcagggtggggttatcttattttgcagaaacaggctttcccaagtctgtcaccaagygaggggtagagctgggtgtccagccagatctaacctccagcccagagctggtgatgcggaaaatcagggcagatggcagcaggatctaaaatagggaggg

SEQ ID NO: 36659 - DNA, 201 bp, Homo sapiens
cctacctacatcgtgttctggataaaggttttggctcataatgtccgaccagaggtggacaaagtggtgtgggacctgccgtaagaaacagggagcatggygcggggagagaagcctgtgccttatggagactcggggcaccttcaggaagcagggtcaacagcagcaggccactagggagtcgggagagctcggtgatgt

SEQ ID NO: 36660 - DNA, 201 bp, Homo sapiens
atcccagcactttgggaggccgaggtgggtggatcaactaaggtagggagttcaagaccagcctggccaacatggagaaaccccatctctactaaaaatasaaaattagccgggcgtggaggtgcatgcctgtaatcccagctacttgggaggctgaggcaggagaactgcttgaacctggaaggtgaaggttttgcggtg

SEQ ID NO: 36661 - DNA, 201 bp, Homo sapiens
agtagctgggactgtgggcgcccgccaccacgcctggctattttttgtatttttagtagagacagggtttcaccatgtcagccaggctggtctcgaactcrtgacctcaggtgatccacctgcctcagcctcccaaagtgctgggattacaggcgtgagccaccacgcctggccaagggactgagtttttatgcactttta

SEQ ID NO: 36662 - DNA, 201 bp, Homo sapiens
ggcacacctggatgggctgagggccctcccgggggcacacctggatgggctgagtgccctcccgggggcacacctggatgggctgagtgccctcccggggrcacacctggatgggctgagtgccctccccgggacacacctggatgggctgagttccctcccaggaaaactggtcccagatccgcctcggcttcccgggct

SEQ ID NO: 36663 - DNA, 201 bp, Homo sapiens
tactcggtttggttcggcctcacgtgttcctttagctccgaagccgggatacgggtggggaaggggggctcgcgccctacaggccgagccctgcggccgcrgcggggtaagggtaggatggccgatcgcgcccagaccccagggagtctccctctcggcttttctgccggcgtctccagcagcatgatctggcatttatta

SEQ ID NO: 36664 - DNA, 201 bp, Homo sapiens
gatccatccagtgcagggtctgcaaagtatcccaagcgctgatcttaggagcagtgtagggagggtcagaatcttgtagcctctagctgcatggctataaattatggtttataatttgtaatctggtgcctaatttgttagtcctacaaagacagtctgatccccaggcaagaaggaggtttgttttgggaaagggctgcc

SEQ ID NO: 36665 - DNA, 201 bp, Homo sapiens
acgaagggcagggtttcaccacattggccaggctggtctcaaactcctggcctaaagtgatccacccgcctcagcctcctacagtgctgggattataggcrtgagccaccgcacccggtctacagttttctttaaatcttcatcatgccagtacttccctcctcctgttttcatcttcctgtatttgcaagtttcattcat

SEQ ID NO: 36666 - DNA, 201 bp, Homo sapiens
acggggagggtagcgggggctgttggtcaagtggtgggattagccggcacctcaatatgagtcatgggtcaggtcacgcagagggggtggcagcaaaggakgttggggagggaggtcttggatcccaggcgagggaacatggctggtctcccaatggcactggggagccactgaaggggtcatcctgagggaatggcctgg

SEQ ID NO: 36667 - DNA, 201 bp, Homo sapiens
ccttccactcctgcaacagtgattctagaattggttgactggtattttgaagaaagtaccagacaagctcattggcaggttatatctgttggtatctaccycttgacccattccatctgctatctgagatcagtcaggcaagtcagaaagcagttagcaccaccagaggctttggataaggcaccgtgggggttgaaaggg

SEQ ID NO: 36668 - DNA, 201 bp, Homo sapiens
cctagactgaccactaaccccggaaggggacaaacatgtcccctccctgggcctcagtttcctcttacttaccctaataggattggactggtgatcttagrtccttccactcctgcaacagtgattctagaattggttgactggtattttgaagaaagtaccagacaagctcattggcaggttatatctgttggtatctac

SEQ ID NO: 36669 - DNA, 201 bp, Homo sapiens
cagaatgcatcagtagctcattcctttgtattgctgagtggtattctgttgtgtgcctatgctatatatatatacatatatgtatatatatatatacacayatatatatatatatatatattttaatttatgtttttgagacagagtcttactttgtctcccaggctggagtgcagtgggtgcaatcttggctcactgcaa

SEQ ID NO: 36670 - DNA, 201 bp, Homo sapiens
cccaatctcttgctccaaggcagcttaaatgcaggtgtatacattatttgtgagttttgctattacaggtcgagtatctcttatctgaaatgcttgggacyagatgtgttttggattttggatttttccagattttggaatatttgcattatacttgctcagcatctctgatctgaaaatccaaaatccaaagtgctccaa

SEQ ID NO: 36671 - DNA, 201 bp, Homo sapiens
ctcattcctttgtattgctgagtggtattctgttgtgtgcctatgctatatatatatacatatatgtatatatatatatacacacatatatatatatatatatattttaatttatgtttttgagacagagtcttactttgtctcccaggctggagtgcagtgggtgcaatcttggctcactgcaacctctgcctcccgggt

SEQ ID NO: 36672 - DNA, 201 bp, Homo sapiens
gagccaccatgcccacctaatttttgtatttttattagagatggggtttcaccatgttggccagactggtctcaaactcctgtcctcaggtgatccactcrccttggcctcccaaagtgctgggattacaggcgtgagccaccacgtctggcccaaagcactatttttaaaagctacttgtattaatttttgttttttctt

SEQ ID NO: 36673 - DNA, 201 bp, Homo sapiens
agattactctaaaatttatatggaaaggcaaaggaaatagaatagctaaaagaattttgaagaagaaaaataaagtagcagcacatatatcaatgaatcaraatagaaaatccagaaataggcccacccaaatatgcccaaccaatttttgacaaaagtgcaaaagcaattcaatagaggaaagataacgttttcaaaaaa

SEQ ID NO: 36674 - DNA, 201 bp, Homo sapiens
aaccccatctctactaaaaatacaaaattagccgggcgtggaggtgcatgcctgtaatcccagctacttgggaggctgaggcaggagaactgcttgaaccyggaaggtgaaggttttgcggtgagccgagactggccattgccctccagcctgggcaacaagagccaaactccatctcaaaaaaaagaagaagagtttaga

SEQ ID NO: 36675 - DNA, 201 bp, Homo sapiens
ctcccgggttcaagtgattcccctgcctcagcctcccgagtagctgggactacaggcatgagccaccatgcccacctaatttttgtatttttattagagayggggtttcaccatgttggccagactggtctcaaactcctgtcctcaggtgatccactcgccttggcctcccaaagtgctgggattacaggcgtgagccac

SEQ ID NO: 36676 - DNA, 201 bp, Homo sapiens
cgggcgtggaggtgcatgcctgtaatcccagctacttgggaggctgaggcaggagaactgcttgaacctggaaggtgaaggttttgcggtgagccgagacyggccattgccctccagcctgggcaacaagagccaaactccatctcaaaaaaaagaagaagagtttagactctggaatctctcagccctggtttcagttcc

SEQ ID NO: 36677 - DNA, 201 bp, Homo sapiens
ttaggggaaatgaggtaagacctggcatctctctgtattatttcttaattgcatgtgaatctacaattatttcaaaataaaaagtatgattgaagtaactmtcaggaagcttagcctactgtggattaagacatcaaaattgcagcaggctttaacaaagctatactactacaaggatagttcacacttgaattagcttga

SEQ ID NO: 36678 - DNA, 201 bp, Homo sapiens
agctgcaaattgagggaagaggaattagagtaggatgaggcaatcccagcagtggccaagaaggaaaggccgagaagtccagcagtgctcaggaggcactstcatgctagctggagctgcccgcccaggagtattcacagccccaccttacccaccttgtcagggtattgctgtggggggggcaggtgagtcgagatagaa

SEQ ID NO: 36679 - DNA, 201 bp, Homo sapiens
aatacacactattttatgtgctggttttgggcctaacgcctcatgggcattcttagccctgggagaccagtgtatgagctgggattgcctcacactaagartagcaggaacccctagaagtctagggccattgtggctttggggagcccaggctccttgtttttttctgctgtgttattctgaaggcagctcaggatccca

SEQ ID NO: 36680 - DNA, 201 bp, Homo sapiens
ctgaggtcgggagtttgagaccaacctgtccaacatggagaagccccgtctctaataaaaatacaaaattagccgggcctgtggcgtgtgcctgtaatccyagctacttgggaggctgaggcgggagaatcgcttgaacccgggaggaagaggttgcggtgagccgagatcgtgccattgcactccagcctgggcgacaag

SEQ ID NO: 36681 - DNA, 201 bp, Homo sapiens
agtgtgttgaccggtgggggcgcggtggctcacacgtgtaatcccagcactttgggaggctgaggcgggcggatcacctgaggtcgggagtttgagaccamcctgtccaacatggagaagccccgtctctaataaaaatacaaaattagccgggcctgtggcgtgtgcctgtaatcctagctacttgggaggctgaggcgg

SEQ ID NO: 36682 - DNA, 201 bp, Homo sapiens
gggacgcctttcgctggaaagagcaaatgtcctttctctttggagctcagaaaactcagtttctcatttgcctatgaaaacaacagttcagttcctcagamaaatgcacacagacaaacacaattgagattaattatgggagaaaaagcaatagataagaccctttagaatgcatctccgaactagaattaggatccttaa

SEQ ID NO: 36683 - DNA, 201 bp, Homo sapiens
ccgcaagatccagaccccacaagatccagaccccgcaagatccagacccctcaagatatagaccctgcaagatccagacctcacaagatccagaccccacragatccagacctcggctatctggcttctcttttttttgcgacagagtctcaatctgtcacccaggctggagcgcagtggtgtgatctcagctcactgcaa

SEQ ID NO: 36684 - DNA, 201 bp, Homo sapiens
atttgcccaaaatcacagagccaggaaacgagagagccaagatccagaccccgcaagatccagaccccacaagatccagaccccgcaagatccagacccckcaagatatagaccctgcaagatccagacctcacaagatccagaccccacaagatccagacctcggctatctggcttctcttttttttgcgacagagtctc

SEQ ID NO: 36685 - DNA, 201 bp, Homo sapiens
tcattcctttgtattgctgagtggtattctgttgtgtgcctatgctatatatatatacatatatgtatatatatatatacacacatatatatatatatatwtattttaatttatgtttttgagacagagtcttactttgtctcccaggctggagtgcagtgggtgcaatcttggctcactgcaacctctgcctcccgggtt

SEQ ID NO: 36686 - DNA, 201 bp, Homo sapiens
attcctttgtattgctgagtggtattctgttgtgtgcctatgctatatatatatacatatatgtatatatatatatacacacatatatatatatatatatwttttaatttatgtttttgagacagagtcttactttgtctcccaggctggagtgcagtgggtgcaatcttggctcactgcaacctctgcctcccgggttca

SEQ ID NO: 36687 - DNA, 201 bp, Homo sapiens
cagaaaatggaactttattggagtgggacactggatggccagggtttagcagagcctgcccaacaaaagtagcttcagaattggctttattctcaggaagsctcttcctggacagtggcaaacatagccatagcaaatactggctcactttctatcagccagcaaccctggtggaaagagggcctcttactcagttgtacc

SEQ ID NO: 36688 - DNA, 201 bp, Homo sapiens
acatctccttattgaggagaaatcttttctcctgttaatgccactccttgttcttgggtctgcccctgcattcacactgagcgagttattcccttctcccmaggggcactgtgccacctcaatacccacccacttgtctactcttactccacccacatggtttctccttgtttatctctcatggtttccccactatcatcc

SEQ ID NO: 36689 - DNA, 201 bp, Homo sapiens
tgtgttgaatgggagccactttagtgagggagacagaggactcagcatccaggatgagggcagagcaggagccggtactctgaggcaggaacgccctcacrtgggcaaggagttcttggagtcagtggtggctgcgacgcagtgagcaaagaggagggtggcccagtgagctaggggcctccagggagggagaggccagcc

SEQ ID NO: 36690 - DNA, 201 bp, Homo sapiens
agtagagacagggtttcaccatgtcagccaggctggtctcgaactcatgacctcaggtgatccacctgcctcagcctcccaaagtgctgggattacaggcrtgagccaccacgcctggccaagggactgagtttttatgcacttttaattattttggctttagtacttttagatatggctgacttcaaggaaaacaaaatg

SEQ ID NO: 36691 - DNA, 201 bp, Homo sapiens
gttcaagggactgagttttttgtgttttttttgtttttttttgttatttttgtttttgagacggagccttgctctgtcacccaggctggagtgcagtggcrtgatctcagctcactgcaacctccgcctcctgggttcaagcgattctcctgccccagcctcccgagtagctgggactgtgggcgcccgccaccacgcctg

SEQ ID NO: 36692 - DNA, 201 bp, Homo sapiens
cttaggaacatttcgtagatgtgaaagtgcaagttgcaaaggtgtgcagattttaggttttgttcaaatccccaaactgctttcctgaaaggctgtcgctytcctgacagtgctcaagagaacccgtctggggagggttctggggaatgggtgtggcatccctggtgctggattcttctgcagaatgtggacctacctcag

SEQ ID NO: 36693 - DNA, 201 bp, Homo sapiens
cgaggtgggcagatcatttgaggttaggagtttgagaccagccgggccaacatggtgaaactccgtctctactaaaaatacaaaaattagccaggcatggyggtgcatgcttgtaaccccagttacttgggaggctgaggcaggaggattgcttgaacctgagaggtggaggttgcagtgagccaagattgcacccctgca

SEQ ID NO: 36694 - DNA, 201 bp, Homo sapiens
gccagggtgggagtccaggcggcgcacccgcgcgaggacaagggggctttggctgggcggtgctgtctcaaccaatgggaagcgtggctctggccgagccyccctctctccccgccctccggccggccgttggggagcgctgctctgggattggctgcgccgccgtctcgggcgttctcgcgctctgcttacgtgctgacg

SEQ ID NO: 36695 - DNA, 201 bp, Homo sapiens
actactttctaggagaggttctcgggagggacagcttgactaatacaatggagatccatgaagatacgtgaggtctcttgctgctagagagcggtgccagygttgtgagacaaggcttcaaaaacagcttcaaggcttccagagagtggcctcgccacatcctaagctctccaagcgtctgtcaaaatcctgggtttctat

SEQ ID NO: 36696 - DNA, 201 bp, Homo sapiens
agggggtcaactccccagacgctcccacgaggcccctggtcacccagggacgcctttcgctggaaagagcaaatgtcctttctctttggagctcagaaaaytcagtttctcatttgcctatgaaaacaacagttcagttcctcagacaaatgcacacagacaaacacaattgagattaattatgggagaaaaagcaataga

SEQ ID NO: 36697 - DNA, 201 bp, Homo sapiens
agttccaatttcatttagagtccaattattaaagttcagttgaagctgagcatggtggctcatgcctgtaatcccagcactttgggaggctgaggtgggcrgatcatctgaggtcaggagttcaagaccaccctggccaacatggtgaaaccccatctctactaaaaatacaaaaattagctgggcgtggtggcgggcacc

SEQ ID NO: 36698 - DNA, 201 bp, Homo sapiens
atttgaatggcaggccgggcgccgtggctcatgcctgtgatcccagtactttgggaggccgaggcaggcggatcacctgaggtcaggagttcgagaccagygtggccaacatggtgaacccccgtctctactaaaaatacaaaaattggccaggtgtggtgatgcaagcctgtagtcccggctactcaggaggctgaggca

SEQ ID NO: 36699 - DNA, 201 bp, Homo sapiens
acctgtgccactgatatgtgttcctcctaagccccgtcttgttagattcaaatggactcatggctcctctcagcagaaagctgggttactggttattgttkctgattcctgatggggacaataaaaggcacagacacacagactggtaagatagagaagaagccagaatgaacgccctggccagcatagggagcgctctca

SEQ ID NO: 36700 - DNA, 201 bp, Homo sapiens
cccggggagccagccacgggggcgagatgaaggagattgtctggtgagagccacagagccatctgccaccggccccgacccccgcaggacgctgagggacrggacatctggagcctgggaccagccctccctgtccccaccccaggggacaccgagccagtgggcccgagagcaggccgtgggcatggcctgatcttggca

SEQ ID NO: 36701 - DNA, 201 bp, Homo sapiens
gctcagctgggctgtggcctccagctgttcacagggatattggggctttggcattcaaggggctcaaaggggaaccccctggggataggtctttgtttttyttttcctgtagggcagtggtattgaaccttggttgtgggttagaatcacctagagaacagtgagggaaaaagtgtctgtgcctcacctctgggtcaggag

SEQ ID NO: 36702 - DNA, 201 bp, Homo sapiens
gccttggcaattccccctcaggcaatgccggctgtgaactccagggagcaccctcccagagcgttccgacccgcagtggccgccaccgacccacaccccaygcaggacatgtcagaagggtcctcttccccttctccaccgggggggcacatttggttggcgagtttgacgccctgcagcctggctctgtggaacagttgc

SEQ ID NO: 36703 - DNA, 201 bp, Homo sapiens
acagtcttgcccctaatttgctgccccggatccaaccttggaagggtcagaagttaagaataggaggggagaggagctagaaaacagtgagaaagacaacytccaccagcacctacttcccacagccctcagggctgggcaggggaaagctttacctcgcatacaagtttgggagtttgggttctcaaaccaggctgggct

SEQ ID NO: 36704 - DNA, 201 bp, Homo sapiens
ttttgggaaagggctgccatctttgttttaaactataaactatagtctgggcgtggtggctcacacctgtaatcccagcactttgggaggctgaggtgggyggaacacctgaggtcaggagttcgagaccagcctggccaacatggcaaaaccctgtctctactgaaaatacaaaacttagccaggcgtggtggtgggtgc

SEQ ID NO: 36705 - DNA, 201 bp, Homo sapiens
gcgttctactgctatagaagaaggatgaagggaagagtgggcattcaggacaacttgctttctctgctcggtgggtgagacatttttctttattttcaagscagtaggaacccaggggaggaatttcccatactatgttgatatctttgtaatatttgatacccaacgtaaaatttcaataatataaacaagtaaaagaaa

SEQ ID NO: 36706 - DNA, 201 bp, Homo sapiens; identical to SEQ ID NO: 7822

SEQ ID NO: 36707 - DNA, 201 bp, Homo sapiens
ggagggaggaggtagagatgtgtgtgcttagccagctggtcagtacttagatggtgggagggggtgcctcatgaaaaagtctgagccaacgtgggcctgtrccttccataaaaccataaaaagccagtctgggctccattctgctgctctctgcaaggagctttccatggaaacttcttttgtggccacaggccgactttc

SEQ ID NO: 36708 - DNA, 201 bp, Homo sapiens
ctaatctggtgactggaatgtctctcaggacgatcaaggtgtctgcattgggtgtgcctaatgttagacccttggcttttattgaaggtccctgtgaaacragccatgtgagtgtcatctctgcatgtatgatacagtggtggtgagaacactgtctactatatcacttgatgttcctgtgtaattatttctgacttttgt

SEQ ID NO: 36709 - DNA, 201 bp, Homo sapiens
ggggtggccagagaatgtcttagtaaacattttagtaaaggactgtggatattgagggaagagtgttctaggtagagggaacagtaaggacaaaggccctraagcaggagctggcttgctatgttccaaagacagcaagaaagccactgtgaccaaagtgcagtgaaccaggtaggaatgaggtcagagggacaatggaga

SEQ ID NO: 36710 - DNA, 201 bp, Homo sapiens
gcctgggatgtttgcttcagtagcagctgtgtgtgccatgggcaagcccttggctggcgagtgggcatttctctacccctttactcttggctgctagtccwgtcctcttacaagaggtgtcactatgccatgcaccattcaggaaaattgctgccaattaagtcatttatgaccaactatgtttaattttcacatcgagtg

SEQ ID NO: 36711 - DNA, 201 bp, Homo sapiens
gctccagcagatgtctgccacctcctacgtcactggctccacgctctctcctgggtcatttcagcacatgcacacacacacacacacacacacacacactyactcactcactcatacagacctacaccaccacaccctgtgtacattacctccccacggctctgctccttgttgcagaaaagcacccccagagggggtgca

SEQ ID NO: 36712 - DNA, 201 bp, Homo sapiens; identical to SEQ ID NO: 7817

SEQ ID NO: 36713 - DNA, 201 bp, Homo sapiens
ggttcaagtcattagaagccttctctagatttttttggtactgcagatggcaaagggggaaggaggtatagggtagaagaaaagtaaatgaaataaatatwttttttttaagacaggaagcaaacacagaaagcaagtgcatgtttttgttgttgttgttgttgttttgtttgtttgttttagctgtgagaaattttggcc

SEQ ID NO: 36714 - DNA, 201 bp, Homo sapiens
gggccaggcccatgggcagttgccagtatgcctgaggctttggctgggacttgaggccagctcctgccttgacaggagtcctcagggtctgcctcagggtrggaaggaaggaggtagaagcagctcttctctcctccccaggacaaaggccatgatggggtcaaggagctggacagcctaaacagtgaccgattgagaacc

SEQ ID NO: 36715 - DNA, 201 bp, Homo sapiens
ttgaatgacttgaatttttggccctgtgtttcaggaatgcagtttattttgattggcattttctaccgagactaaagatgggattttaattgctgtcagtrtttaaactttagcaggacttggtatcttttttacacccaggagtcaaagccctgtaactaaatgtcacaagtactttaaaacctcatacagagagacata

SEQ ID NO: 36716 - DNA, 201 bp, Homo sapiens
ctttgacattaatgattaatttatagagaaactgaacttattttatctctcaacattggctcttacaatctcacatgcccctttcctgagaaagttgaatracttgaatttttggccctgtgtttcaggaatgcagtttattttgattggcattttctaccgagactaaagatgggattttaattgctgtcagtgtttaaa

SEQ ID NO: 36717 - DNA, 201 bp, Homo sapiens
gaatactattaactagtctacagaccttattccagtgttgccaagtggctgctgatggacctttttctggtccaggatcgaatcccaaatcccacatggcwcggaggtgtcatgtgtttttagtttcttcctgccggggacaggtcttcagtctttttcgctcacgaccttgacactctggctggttatgttgtacaatgt

SEQ ID NO: 36718 - DNA, 201 bp, Homo sapiens
atctataaaattttaatcttgaccataagctataacttccataagcctttcataacctttataacctttacttaggagttggttaatatttcataaaaacmttgttaatttgacatgggctcatatgctggtcttgcatcagtgtgcctttgacattaatgattaatttatagagaaactgaacttattttatctctcaac

SEQ ID NO: 36719 - DNA, 201 bp, Homo sapiens
gaatcccaaatcccacatggcacggaggtgtcatgtgtttttagtttcttcctgccggggacaggtcttcagtctttttcgctcacgaccttgacactctsgctggttatgttgtacaatgtctctcagtttgggtttgtgtggcaagacgcctgcggcagtgaagcggtgcttttctcagcccgtcgtgccaggaggtac

SEQ ID NO: 36720 - DNA, 201 bp, Homo sapiens
ccacatgaatgatgcccagctgattataaaaaattctgtactccatgctgagttcctgtaactctagaaaaaggaaaaaaaaaactgtactccaaatagcyacagaaactgggattttaaaaatccctttcttcaaagaaagaacctcagaacaattggtggtgtgcttaacccaaagcatttggagtaggacagacttgg

SEQ ID NO: 36721 - DNA, 201 bp, Homo sapiens
cagttcaagatgatatttgggtagggacacagccaaaacatatcaatataatcaaccagaacctataacttttcctcattgaagacatcagaaattgccayctgtattgtactaattgaatgaaatttctgtgtaacaaagccattccagcttctgttggattatccacatgaatgatgcccagctgattataaaaaattc

SEQ ID NO: 36722 - DNA, 201 bp, Homo sapiens
ttagtctgttttcttgctgctgataaaggcatacccaagactgagtaatttataaagaaaaagaggtttaatggactcacagttccacatggctggggagkcctcacaatcatggcagaaggcaaaaggcacgtcttacatggtggcagacaagagagaggatgaaagccaagcaaaaggggtttccccttgtaaaaccat

SEQ ID NO: 36723 - DNA, 201 bp, Homo sapiens
tcagttcctgggtcggggccacaagagcagatgagccagtttgtccacctgggtggtgccagctgatccatccagtgcagggtctgcaaagtatcccaagygctgatcttaggagcagtgtagggagggtcagaatcttgtagcctctagctgcatggctataaattatggtttataatttgtaatctggtgcctaatttg

SEQ ID NO: 36724 - DNA, 201 bp, Homo sapiens
tctagttccactagggatgtaactgcccaatggcttcaccttgctcactgcctagacagaaccggtttatcaagacagaggacttgcagtagacaaagagyaattcacgcagagccggctgtgcaagagaccagagttttattattactcaaatcagtctctccaaacattcaggaatcaagagtttttaaggataatttg

SEQ ID NO: 36725 - DNA, 201 bp, Homo sapiens
aaacgcagtctgctggcactttgcacttcaactccccagcttccagaactgtaaggaatataagtctgttgttggtaagccacccggtctatgatattttkttatagcagcccaaacagactaagacaggtgacaaataaacatgaaaagatgttcaacatcattagccattagggaaatgcagattaaaaccacagcgaa

SEQ ID NO: 36726 - DNA, 201 bp, Homo sapiens
gcagtgttgggagtgacctgatttccacagactgtctgtgttcaacctcacagccgaatgtttctccagttccaaagtcaacaaccagaacggtagaaggwggggaaaggttgaaggtggggctgagaatggctttgtctgaccccttaacccagtcccaactcctcagttggccctttctcctgggagtctcttgctact

SEQ ID NO: 36727 - DNA, 201 bp, Homo sapiens
cagattttaagaatgttagcacaggtctttgaataaattttgcttctaagagaagttactatttattcctaattagaggggaggaaagtctttgaagactyacctctactttacttttcacacctccttgaaggcagggactaaggactgtttccctcccaaaactaacgtgctaatttgcaaacagtacctccctgggtt

SEQ ID NO: 36728 - DNA, 201 bp, Homo sapiens
aaatagcttaaaagacgttttcttgtatctgaaaaacaaaacaaaggatcagcaacattttaagcaaaaagtttaaaagattactttagtcttttattagwtcagctcacgcagttagcttttgttctgacattcatgaacatttcagttctccatgagagtcctgaaagtttttttctctattctaatgttccaatctcc

SEQ ID NO: 36729 - DNA, 201 bp, Homo sapiens
ccacccgccttggcctcccaaagtgctaggtttacaggcatgagccactgtgcctggccataaccacttcttaaaaccctttttattttgaaataactttrgacttatacaaaagttgcaaaaatcgttggaaagggtttctggatccccttcagctaacttccctaaatgttaacatcttacaaaaccatactgcaatga

SEQ ID NO: 36730 - DNA, 201 bp, Homo sapiens
cctgttacaaatgaaaacagattcttattgcacttatgcaaataactgtattgtcataagaatactcacacatagttcccaaattttggagaaatcaggtwgacagaaacaaatatggtctaaattttgttcatagaagtatacttcactcaattgttaaaagctgtaaatagcttaaaagacgttttcttgtatctgaaa

SEQ ID NO: 36731 - DNA, 201 bp, Homo sapiens; identical to SEQ ID NO: 7823

SEQ ID NO: 36732 - DNA, 201 bp, Homo sapiens
ttctttacttatgacacatcaggaaccctttacaatggctgtgtagacaaaggtatcacagcagtttatccaatgggcttttattgcctccataagtcaaktttgaatccttaaaggaaagcacaccattccagtcaaaactttagtaaaataaccagtttctccaattgtgtcctgttacaaatgaaaacagattcttat

SEQ ID NO: 36733 - DNA, 201 bp, Homo sapiens
aagcttccagcaacctttagtcagcctcaagaagtctccggctaggaggcaatgctaaaccaggacaacctagagataccctggctggccagggcttcctraaaaagacgtgttgctgggtggttgcgttgccttaagaacacacccattacccagtgaatctgccgtgagtcagagagacgcccctgaagacacattacc

SEQ ID NO: 36734 - DNA, 201 bp, Homo sapiens
agaattctcaacattcaacggggtagaagaatgaacgattcaatagaatatgggcaaaagacatgaagaggcattttaccaaacatagggtgctatggtcygaatgtttgcattctcctcaaattcctgtgttgaaatcctaacccccaaggtattggtattaggaggcaggggccctgggaagtgattaggtcataaagg

SEQ ID NO: 36735 - DNA, 201 bp, Homo sapiens
aaaatcatggtaggactggtttgctttactatacttggcctaattatttgtatacaatgcagccagagtaattatttttttacataggcttttaaattggytttgatggaactttgttccatagaaggaatctcagataagacatttttttaaagctgagcccagctatggatttgtgccatcaggtacctatgagttgag

SEQ ID NO: 36736 - DNA, 201 bp, Homo sapiens
gcagagtctgggttacaacccctggtttcctgattccgagtccaagtgaaatacttttgcccctgcagtagaccctgctacagaggataaaaaggcacgtyataggctaggagaaaaattttgcctaccacatatgtaaccaaggactagcagctaggacatctgaagaattctcaacattcaacggggtagaagaatgaa

SEQ ID NO: 36737 - DNA, 201 bp, Homo sapiens
gagggggcttccaggtcacgggtagatgagagacaaacaattgcactcttttgagtttctgattagcctttccaaaggaggcaattagatatgcatttttstcagtgagcagagggatgactttgaacagaacgggaggcaggttggccctaagcagttcccagcttgactcttcccttagcttagtgattttgggacccc

SEQ ID NO: 36738 - DNA, 201 bp, Homo sapiens
tggcagagtctgggttacaacccctggtttcctgattccgagtccaagtgaaatacttttgcccctgcagtagaccctgctacagaggataaaaaggcacrtcataggctaggagaaaaattttgcctaccacatatgtaaccaaggactagcagctaggacatctgaagaattctcaacattcaacggggtagaagaatg

SEQ ID NO: 36739 - DNA, 201 bp, Homo sapiens
acctcagaacaattggtggtgtgcttaacccaaagcatttggagtaggacagacttgggtgggatctgtctttgccacttcctggttgtattgttgtgggmaagttatttgaacctgctaactgtcaatgtgttcagttgcaaatgggaataatcttaggctacttttagaattgttgcaaaagtaagtgaaataatgcat

SEQ ID NO: 36740 - DNA, 201 bp, Homo sapiens
ctttatcccgattggccgtcggacttatgccagtgcggcggagccggtgagtggaagcccagctacccgggagccagttggatggtcagaaccctttcttytgggcccctaggccctgagctaccctcagagtggggccttagtgtttccaggacactgggagccactttctcacttaaccctcccccaaagcccctcatc

SEQ ID NO: 36741 - DNA, 201 bp, Homo sapiens
ccccactctaccagtaccaatttactgtattagtctgttttcttgctgctgataaaggcatacccaagactgagtaatttataaagaaaaagaggtttaayggactcacagttccacatggctggggaggcctcacaatcatggcagaaggcaaaaggcacgtcttacatggtggcagacaagagagaggatgaaagccaa

SEQ ID NO: 36742 - DNA, 201 bp, Homo sapiens
agggcaggggcaaaatgctgccagtctctttgctaaaacataacaagagtcacctttactccagttcccaagtgcctcatctccatctaagaccacctcarcctggatttcattgtccatatcattgtcagaattttggccaaagccatttaacaagtctctaggaagttccaaactttttcacatttttcctgtcttctt

SEQ ID NO: 36743 - DNA, 201 bp, Homo sapiens
tcattacttatgcaaatttctgcagccagcttgaatttctcctcagaaaatgcgtttttcttttgtattgcgtcaggctgcaaattttccaaacttttatkttctgtttcccttttaaaactgaatgcttttaacagcacccaagtcacactttgaatgctttgctacttagaaatttcttctgccagatatcctaaacca

SEQ ID NO: 36744 - DNA, 201 bp, Homo sapiens
gtgatgggagggggctgccacaaaggtctttgacataccctggagacattttctctatcatcttggcaatctggctcttcattacttatgcaaatttctgmagccagcttgaatttctcctcagaaaatgcgtttttcttttgtattgcgtcaggctgcaaattttccaaacttttatgttctgtttcccttttaaaactg

SEQ ID NO: 36745 - DNA, 201 bp, Homo sapiens
ggctagagcagctgggacgtagggtgccaagtccctaagatgcacacagcagggggcccctgggcccaggccacgcaaacattttctccttctaggcctayaggcctgtgatgggagggggctgccacaaaggtctttgacataccctggagacattttctctatcatcttggcaatctggctcttcattacttatgcaaa

SEQ ID NO: 36746 - DNA, 201 bp, Homo sapiens
aatttttgtagaaacaaggtcttgctgtttgcctaggctggtcttgaactcctagggtcaagtgatcctcccatcttgttctcccaaagtgttgagattayaggcatgaactactatgcttggccatctttcaaagtttatatgtgtattcatccatttccttattgctgataaaggcatacccaagaatgagtaatttat

SEQ ID NO: 36747 - DNA, 201 bp, Homo sapiens
ctaaatgggtcctgttaagaattccttcattattttgtcatgctttaaggcccaggaaaggcctaggcaaaactcttggtgggcttttgttacattcaagsctttgtatagggcactgatgctatcagcttttaatatttaacctaaccactcagtcagtgctgaaacagttgttatggaggcctacctgttcagccatta

SEQ ID NO: 36748 - DNA, 201 bp, Homo sapiens
tcactgagagcggtcagcagaagaaaatttgagccatgggtaaggcctggtagaaagggaggaggttggggaggcgtgaataggcctttggaaagaggtgmtgttaacccaaaacagagaggcagcagctttgcaattagattttctttttgaaatagcaggctctgtccctggtagcaatagggataaataaaaagtaat

SEQ ID NO: 36749 - DNA, 201 bp, Homo sapiens
gtggctgagggtctgtctagtctgtccttgtactcacggcttccttttctcttgcagacgcccactattgcttggttctacttcctttatcccgattggcygtcggacttatgccagtgcggcggagccggtgagtggaagcccagctacccgggagccagttggatggtcagaaccctttcttctgggcccctaggccct

SEQ ID NO: 36750 - DNA, 201 bp, Homo sapiens
tgatctgggccaacctgctcacattatgaatgggtgatgacttgcccagggttgcccagtgtgtttggtggcacagctagagccagaacccaggcttccargcaccctggctcctgactctttccattgtgaagctgcagcttgagagaggaaccagagtggactacctggtggtaccaggactggagctgggtggaacag

SEQ ID NO: 36751 - DNA, 201 bp, Homo sapiens
tagaggaataggacttaccgagtcagaatccctgaggggttaggtccccgagtctcccagtggttggcgggtttgaggatcactgatctgggccaacctgytcacattatgaatgggtgatgacttgcccagggttgcccagtgtgtttggtggcacagctagagccagaacccaggcttccaggcaccctggctcctgac

SEQ ID NO: 36752 - DNA, 201 bp, Homo sapiens
tttgtatcagtcaggtgtggttagtaaaatctggcatattcattctatgggttatttatatcgtagtttaaaaaatgagatcattgtggtattagggaacratagtaaaaatcaagattagaaatttggaaaaccaacaaaacacccaaaccatgtgggtggccaaatgtgagcaaaccactttagaagtcattgacttgg

SEQ ID NO: 36753 - DNA, 201 bp, Homo sapiens
aggggaggagcctcccaggcagtaccttattaccaggaacagtatgacagactacagccaggtaggcaaaggagaggctggaacccatttaccagcccgcmttccttcccttaggcctggaggaatcactattaacagaacaggagggcaacgcatgcccgtgctgatcagcggtcaataatgctgaagagtcgtggtgcc

SEQ ID NO: 36754 - DNA, 201 bp, Homo sapiens; identical to SEQ ID NO: 7820

SEQ ID NO: 36755 - DNA, 201 bp, Homo sapiens
gaccggtgttaaaaaggtttcttgggctgctgtgctgagaatgggggtgtggcaaataggggcaggagtacaagcgagagtttactgtagttctggaaagrtaacaccagagaggtttctgcctgctttcctttcctgaggattaaacagattaaacgcctccacctgcttccagcagagtgcatggcagtggttgctcag

SEQ ID NO: 36756 - DNA, 201 bp, Homo sapiens
agaagctaatcagcaactcaaaagaatgcaaccatttgtctcttatctacctatgacctggaagccccctccctgcttcaagttattctgcctttccggasggaaccaatgttcatcttacatatgttgattgatgtttcatgtctccctaaaatgtataaaagcaagctgtgctccaaccaccttgggcacacgtcgtca

SEQ ID NO: 36757 - DNA, 201 bp, Homo sapiens
atagcttacaggtgaggttgaaagggacagtaagataaagaagtgggtttatcaataagccagttgcacacgcaccaacacagcggaactaaaagcttgtycctgagcagccagacagaggtggacagagactccagagacctgcagagggagcacggagaccagcagagggagcacacagacctgcagagggagcacgga

SEQ ID NO: 36758 - DNA, 201 bp, Homo sapiens
cattgcaacctctgcctcctgggctcagttgatcttcctgcctcagccttccaagtagctgggacttaaaggcgtgagccaccacacctgactaattttcrtattttttgtagagatggggtttcgccatgttgcccgggctgttctcgaactcctgagctcaagcaatctgcccacctcagcctcccaaagcgctgggat

SEQ ID NO: 36759 - DNA, 201 bp, Homo sapiens
ccattccaagaagtagaggatgaaacaggatttaaatttctgggaatttttatatcttacctaaaaacccttgaggcttgaatggggacattccaagcatkcagaaggccactgtgtcacttggatagtaggcccgtgaggtcacctggaactgtgttttcctctctgccctacagacctgtctcctcctcttcctaggca

SEQ ID NO: 36760 - DNA, 201 bp, Homo sapiens; identical to SEQ ID NO: 7863

SEQ ID NO: 36761 - DNA, 201 bp, Homo sapiens
ttaatgactcgggggagaggactaccaagcggtgaaggccactggcccctctaaccattaaccacccaggaagctggcaaacaaaatttaacaggcagcayccaccgcaggcttactgtacacatgctagggtccaggacagcaggaccaagccagcagaaacagcctgagcccaccgcagactgtgagtaacacctgaga

SEQ ID NO: 36762 - DNA, 201 bp, Homo sapiens
tgggaatttttatatcttacctaaaaacccttgaggcttgaatggggacattccaagcatgcagaaggccactgtgtcacttggatagtaggcccgtgagrtcacctggaactgtgttttcctctctgccctacagacctgtctcctcctcttcctaggcacatggacacagccctttgacctggcaagcaccagggagga

SEQ ID NO: 36763 - DNA, 201 bp, Homo sapiens
tttggtattaaaaaaagacttcatagaattgaacgcagagcaaagttaatttgcagcatttctgtgtttactcagctctcctgacaaagcctcccattggytaatgactcgggggagaggactaccaagcggtgaaggccactggcccctctaaccattaaccacccaggaagctggcaaacaaaatttaacaggcagcat

SEQ ID NO: 36764 - DNA, 201 bp, Homo sapiens
gggcattgcagacttgttcaccaaccaggcaaatttctcacgcatcacccaggacgcccagctgaagtcatcaaaggtaaatgtcatgggaacccaccttktcttccccctccaaaattcacaatataaatataatactaggaagtggcactgagttcgttcatgaatgagcctctaggtccctggctgagaaccccaggt

SEQ ID NO: 36765 - DNA, 201 bp, Homo sapiens
aggatgctggccgcgggtcagggcctgggagggctcagctggcccagtgcaggggtattcttctgagtcacgcagacctgtctccaccatggctcctcacycagtgacctggggcagagataatgcacagagaacagaactgtctgcactgtaccacatgtcatgaggtttcactacagaaggtcaagaactgtgcctggc

SEQ ID NO: 36766 - DNA, 201 bp, Homo sapiens
ctgccacttggataagaatccagcaagtgaccttctctgaccctggatttaccttcctaaaaccaaggatgtgaagggtcccagcaatgagtcaggaaagygagaacgcacagcaggtctcactacccatcttcattctgtacctaacaggtggtccataaagctgtgctgcaactcaatgaggagggtgtggacacagct

SEQ ID NO: 36767 - DNA, 201 bp, Homo sapiens
caccagggactctgagtttgagacttgaggtctagcaccacttccagagccctcagaactgggacccactctaggcatggggagccaaggcacagtctgayctacccccaaatccaaggaccagtaccctcttggtctctccctacttccttgtttagaagccagtctcagaaacagagctcatcctcaacccattccaag

SEQ ID NO: 36768 - DNA, 201 bp, Homo sapiens
agacacactgcaggggttccaatcccagctcagcttcttcctagccatgggtgccactcacagagccaccagagcctgagtgtgcttgctggaaagagtcrctggaagttcccaccccttagggtgttgtgagctcaccaatatcacctgttacttatttagccaggttatgagttaccagagtcttttgatacaagctag

SEQ ID NO: 36769 - DNA, 201 bp, Homo sapiens
gccaggcccagccctggaatgtctaactctgtctgcttaccccgagcagccaggtggacctgtacattccaaaggtcaccatctctggagtctatgacctyggagatgtgctggaggaaatgggcattgcagacttgttcaccaaccaggcaaatttctcacgcatcacccaggacgcccagctgaagtcatcaaaggtaa

SEQ ID NO: 36770 - DNA, 201 bp, Homo sapiens
ttactctgtctccctggatctcagttttctcatctgtaaaatgggccccaggatgacccattaagtgaggtcacataagccaagcactgataacagccacrtctggtattcacaacaatattgtggggtggatggagttttcaccctcatcttagagaattaacgcaggagaaggtgagacatgcaatctccccagagctg

SEQ ID NO: 36771 - DNA, 201 bp, Homo sapiens
aacctagccaacatggtgaaaccccgtctctactaaaaatacaaaaaattagccacgcatgatggcacacgcctgtagccccagctactcagcaggctgaygcatgaaaattgcttgagcccaggagcagagcttgaaatgagctgagatcacgccactgcactccagcctgggcaccagaatgagacttctcttaaaaaa

SEQ ID NO: 36772 - DNA, 201 bp, Homo sapiens
ggagagggtctcgtgccttccctcccatctgccaagagagccggtgcgagttcactgacacccctcagtttcagtgttttagacatctgctctccctctgrggagaaggcacaagaagaatttaaaaataacactaaggccttgacatgttaaaaagcgtagatgcccgtgctgcccctagtgtgaccccacttacctttc

SEQ ID NO: 36773 - DNA, 201 bp, Homo sapiens; identical to SEQ ID NO: 7861

SEQ ID NO: 36774 - DNA, 201 bp, Homo sapiens
cattgatgcaactccagccacattttggtattaaaaaaagacttcatagaattgaacgcagagcaaagttaatttgcagcatttctgtgtttactcagctmtcctgacaaagcctcccattggttaatgactcgggggagaggactaccaagcggtgaaggccactggcccctctaaccattaaccacccaggaagctggc

SEQ ID NO: 36775 - DNA, 201 bp, Homo sapiens
tgagaccccaaagggccagatttgaggctggaggcagaactgtcaccagggactgggtcacaaagaccccctgggctacattagtgagaatcagccctgtsgtgggcaatggggagtccctgaaaacttcaaagcagaaccgatcagcttgaatttttgagaatttaaaaagatgcagctgcagatgggtaaaagggctgg

SEQ ID NO: 36776 - DNA, 201 bp, Homo sapiens
tatgcgtgggtgtgaacctgtgtctgggcgatgctagggatccatttgccatctcttcctcctttctacccaccaaagaaaacctgtaatttaggtgtaayaccacaagggggtgataacgcaccatgatgcaaacaatgcattccagctcatactccactgaaaatgacgggaaggactatctatctttctttacaccaa

SEQ ID NO: 36777 - DNA, 201 bp, Homo sapiens
taggggctagagcagccaacaggggttgttttccaccctggtgagataagggagacacgcaaggagggttttgggagactcaggagaactaagggttttgsggggggagttcccacctgtcattcttgagattctgcttttggaacacaccagggaaggggcctctagggaattccagagcagaacagtggttcccacgct

SEQ ID NO: 36778 - DNA, 201 bp, Homo sapiens
tcagcaaagcaagagagagtcctgttaacaggccctcatctgactgactgaatccccagattaccacatcggatcaggagagagaggccaagctcctcccygctgcaaagggcacaaacttcccacagctccaccccattctcccagtgtgcaggccaactgaatgttctccaggcacctctttacacttgactgtctcaa

SEQ ID NO: 36779 - DNA, 201 bp, Homo sapiens
tgcccacgcatctacctttaccagaggtcttttatttcttcattcagcttaaagttactgtccagtgtcctttcatttcaatccgaaataaaatgcctctyatttcttgcagggtaggtattgtggaaaaaagcttactcagcttttgtttttctgggaatgctttaattgtgttttgcttttcttccagcattttgaaca

SEQ ID NO: 36780 - DNA, 201 bp, Homo sapiens
tattgttttccacacattgtagcactttatattcctaccagcaatgcataagggttccaatttccccacatgcaatgctaacatttaaattaaaaaaaaawtttttttaaaggaaatcttgctatgttacctaggctggtctcaaactcctggcctcaagcattcctcctgcctcagctttcagagtagctgggattacag

SEQ ID NO: 36781 - DNA, 201 bp, Homo sapiens
tattaagctaggttacagtttgctacatgaggaggcagctttagcccatctttaatttaatttaacacaacacaacctcctggagcactggtttaaatgakggttcccagcccctcacccagaatggctggttcaacagtgggtggtgcagtaagacctgcttctcctgtaagcatcctgtatttattgtgatacaggtag

SEQ ID NO: 36782 - DNA, 201 bp, Homo sapiens
tgaaccccattttgtattttgttttgtgtcaaactatatacattatgcttactcctagaaaagaaatactccataaaaagcaagcagcaaaatgttaaggwcgaaaaaaacctaacaatgaaaaatattttacccactttgtttttttgctgtaagttagccacaaaatacaactgccctctggttctgaggattttagac

SEQ ID NO: 36783 - DNA, 201 bp, Homo sapiens
aatccccataataaccacaaagggatgagaatagaattattaaagtgtttcaatacaaaaaagcatttcagtacaaaaactaaatacaaaaaaggacagtwatataggaaatgaagaaccaaaaatgttatatcttcttgctgtactgaaaactttattaatatgtcattgccctgtcttttggaacttttttaattcaaa

SEQ ID NO: 36784 - DNA, 201 bp, Homo sapiens
gtgtgatgatagaaatgtaaagctgtaaacacattaaaaacaagaagatctcaaataaacaatggcatatattcaaattcaggtgttaactttaggatgctaatgtaatccccataataaccacaaagggatgagaatagaattattaaagtgtttcaatacaaaaaagcatttcagtacaaaaactaaatacaaaaaagg

SEQ ID NO: 36785 - DNA, 201 bp, Homo sapiens
gagtgcaatggtgcgatctcggctcactgcaacctctgcctcctgggttcaagctattctccagcctcagcctcccgagtagctggaattacaggcacacrccatcacacccagctaatgtttttgtatttttagtagaaatgggtttcgccatgttagcaaggctagtctcgaactcctgacctcagatgatctgcccac

SEQ ID NO: 36786 - DNA, 201 bp, Homo sapiens
aatcccctatagctatgtggaggacacagttcttaaaccatccataactacgcttgagtgtgtacacatatatatgcgtgggtgtgaacctgtgtctgggmgatgctagggatccatttgccatctcttcctcctttctacccaccaaagaaaacctgtaatttaggtgtaataccacaagggggtgataacgcaccatga

SEQ ID NO: 36787 - DNA, 201 bp, Homo sapiens
ttaaaaataacactaaggccttgacatgttaaaaagcgtagatgcccgtgctgcccctagtgtgaccccacttacctttctagaaaccccacctgcttcayctggtagaaactgccagctgaatcagattcttgcagaatcacagagatttcgcacccacctgccctgggagagcctgtgttcaaccacctttgtgtgcag

SEQ ID NO: 36788 - DNA, 201 bp, Homo sapiens
tcttacctaaaaacccttgaggcttgaatggggacattccaagcatgcagaaggccactgtgtcacttggatagtaggcccgtgaggtcacctggaactgygttttcctctctgccctacagacctgtctcctcctcttcctaggcacatggacacagccctttgacctggcaagcaccagggaggagaacttctatgtgg

SEQ ID NO: 36789 - DNA, 201 bp, Homo sapiens
atctgtaaaatgggccccaggatgacccattaagtgaggtcacataagccaagcactgataacagccacgtctggtattcacaacaatattgtggggtggrtggagttttcaccctcatcttagagaattaacgcaggagaaggtgagacatgcaatctccccagagctggcaggggagcccatcctaccattggcatcat

SEQ ID NO: 36790 - DNA, 201 bp, Homo sapiens
cccagagcctcagcactgtctgactttgggaaccagggatcccacagaaatgttttggagagcgggaggtttcccccaatctcctccaagttcttctcccyccaaccagagttgtgtctaactttaggcatcttttaataaatgtcattgcgactctgatgaccggtgtggttaaagagaagggcaggggcgttctggagg

SEQ ID NO: 36791 - DNA, 201 bp, Homo sapiens
tgaggtaaatggaggctcagcaagaaaacatgacatccccaagatcacacaggaagctgtcgacacaggagggccacaggccaggcacctacccatcccaycagaccacacagaggggaactgtgaaaaccaagttgtcatggcagagctgtgagtggcccctggcaaaaagaaacaggaaaagtggtaaatgtctaattg

SEQ ID NO: 36792 - DNA, 201 bp, Homo sapiens
acaattatcttttcaagttccttgactagctgcttgcagttctttggtgtatatactcgaagcaaaattgttgggtcaaatgacaatttgtttaatttttraagaactgtcatattgttttccacacattgtagcactttatattcctaccagcaatgcataagggttccaatttccccacatgcaatgctaacatttaaa

SEQ ID NO: 36793 - DNA, 201 bp, Homo sapiens
agactccagtgcagccacgtggtggaagaagatttacagacagaaaaaggaaagtgatgtacagaaaacagaagagaggaacagaaacagccggattggtyataggttgatgtttgtcttatttggctacttttgatcagccaaaactcggtgactggcacaagtgtaggctatggtctgttcgtccctccacttgttata

SEQ ID NO: 36794 - DNA, 201 bp, Homo sapiens
ccatgccattctgcctatctctacagagagcaaaatgatgagtaaagcagctcttaagagtacccagccatggtcaggtgtggtggctcatgcctgtaatmccagcacttttggaagctgaggtgggcagatcatctgaggtcaggagttcgagactagccttgctaacatggcgaaacccatttctactaaaaatacaaa

SEQ ID NO: 36795 - DNA, 201 bp, Homo sapiens
ttttgtggtttatggtttcagattgttttcattttgaatgataccttcagagatctatttgatgctgggtgcttctagagaagttcatccagttctgtgartgcacatggaagtgtctgggaatttgacttctctcctgtagggaagtcatgtagtcagccctgtgtttctgagcaatcccctatagctatgtggaggaca

SEQ ID NO: 36796 - DNA, 201 bp, Homo sapiens
cactgaaaatgacgggaaggactatctatctttctttacaccaaaaataatcttttcatgaaaatacttcaatgtgagcaacattaatcaataatacatamcttaaagccccatcaccttgctctcagagagctgtcaacaacgcagcaggcggcagatggcaaaactagtcctggccttttcagttctgttgcctcccag

SEQ ID NO: 36797 - DNA, 201 bp, Homo sapiens
cagatggcaaaactagtcctggccttttcagttctgttgcctcccagttgtgtgactttgggggaattcctcaacctctcttaagtgttggtctctcaacytggaaattaaagatgttgattccgacttcataggtgcgtatgtgtgtgtgtgcacatgcatgtgtgagagagacagagagaggagaaaaaaaaagtaaag

SEQ ID NO: 36798 - DNA, 201 bp, Homo sapiens
taaattggtctcccttcctttctttctgttactatttccgcacctggagaaggtacacaccgactcgcctctggttcttctccctctcctttagaaaaggrcggcttccacttcacgcaggatggttgccagcctccgggcctcactcagggctgcttttgctcagtgaggagagggtctcgtgccttccctcccatctgc

SEQ ID NO: 36799 - DNA, 201 bp, Homo sapiens
cagggccagcagtaatgaagacaaatttggcttggacaaatgttgtggtctaaaaattttgcagtagataatctaggaggaagctcctctactttattaayatgtaggttttgtggtttatggtttcagattgttttcattttgaatgataccttcagagatctatttgatgctgggtgcttctagagaagttcatccagt

SEQ ID NO: 36800 - DNA, 201 bp, Homo sapiens
tcaccatctctggagtctatgacctcggagatgtgctggaggaaatgggcattgcagacttgttcaccaaccaggcaaatttctcacgcatcacccaggaygcccagctgaagtcatcaaaggtaaatgtcatgggaacccaccttttcttccccctccaaaattcacaatataaatataatactaggaagtggcactgag

SEQ ID NO: 36801 - DNA, 201 bp, Homo sapiens
gggccagcagtaatgaagacaaatttggcttggacaaatgttgtggtctaaaaattttgcagtagataatctaggaggaagctcctctactttattaacakgtaggttttgtggtttatggtttcagattgttttcattttgaatgataccttcagagatctatttgatgctgggtgcttctagagaagttcatccagttc

SEQ ID NO: 36802 - DNA, 201 bp, Homo sapiens; identical to SEQ ID NO: 7862

SEQ ID NO: 36803 - DNA, 201 bp, Homo sapiens
gcacctaagacatctctgccaactgacacagggcaaccacattgatgcaactccagccacattttggtattaaaaaaagacttcatagaattgaacgcagrgcaaagttaatttgcagcatttctgtgtttactcagctctcctgacaaagcctcccattggttaatgactcgggggagaggactaccaagcggtgaaggc

SEQ ID NO: 36804 - DNA, 201 bp, Homo sapiens; identical to SEQ ID NO: 7865

SEQ ID NO: 36805 - DNA, 201 bp, Homo sapiens
tcaacaattcattttccctcacacatgaaaaatacacccacctcccctatgactcccaaagtctcatccaactgcaacacctccttgaaatccagataccytcacttaaatcagtcacggtacagaggagcgtccttaaacgtccttcctgaagtgtgtagtttctctcaatctgaagaagattgagagaagattgaagat

SEQ ID NO: 36806 - DNA, 201 bp, Homo sapiens
cacctggagaaggtacacaccgactcgcctctggttcttctccctctcctttagaaaaggacggcttccacttcacgcaggatggttgccagcctccgggmctcactcagggctgcttttgctcagtgaggagagggtctcgtgccttccctcccatctgccaagagagccggtgcgagttcactgacacccctcagtttc

SEQ ID NO: 36807 - DNA, 201 bp, Homo sapiens
atacacccacctcccctatgactcccaaagtctcatccaactgcaacacctccttgaaatccagataccctcacttaaatcagtcacggtacagaggagcrtccttaaacgtccttcctgaagtgtgtagtttctctcaatctgaagaagattgagagaagattgaagattgaagagagaagagagaagattgagagaaga

SEQ ID NO: 36808 - DNA, 201 bp, Homo sapiens
agaaaaaaaaagtaaagaacatagaccaggtgtttgggataaattggtctcccttcctttctttctgttactatttccgcacctggagaaggtacacaccractcgcctctggttcttctccctctcctttagaaaaggacggcttccacttcacgcaggatggttgccagcctccgggcctcactcagggctgcttttgc

SEQ ID NO: 36809 - DNA, 201 bp, Homo sapiens
ttcagagtagctgggattacaggcacgggccatcatgcctggtgtgccaacttattgttttctgttttgtttgtctgttagtagccatccctgtggatacraagtggtatctcattgcggttttgatattcctaatgattagtgatgctgagcatcttttcatgtgcttactggccatttgtatgttgtctctgaaaagat

SEQ ID NO: 36810 - DNA, 201 bp, Homo sapiens
agtcttctcaccctgactcttcattaggacaacgtggcctagaaggaaggaccattcagcagggtcaggagcctcagctgggccggccaggctggcaggggtggagatggccccctcgcttcccaccagggactctgagtttgagacttgaggtctagcaccacttccagagccctcagaactgggacccactctaggcat

SEQ ID NO: 36811 - DNA, 201 bp, Homo sapiens
caatggtgcagctccacaataggaaaagggcctaataaggctgctggtttaagtcccagagtttaaaggtccaagaagcaggaggcccagtgttcagggcyggtaaacacagatgtccagctcagggacagaagagagaatttgcccttctcctacctctttgttccattcagcctttaatagattaaaaatgcccaccca

SEQ ID NO: 36812 - DNA, 201 bp, Homo sapiens
tgcccttgtttaatgcttggtgcatggaacaagctcagcagtggttgcacagaggttcaggcaacacaacctggggaaaaggcacagtaaacccaggtgcrgggagggccctcctgagcctgagagatgcctgagcacatgtggtggaatgggtgttggtggaacgggtgctggcctggtgtcattctgtacgaggtttca

SEQ ID NO: 36813 - DNA, 201 bp, Homo sapiens
ttcaggcaacacaacctggggaaaaggcacagtaaacccaggtgcagggagggccctcctgagcctgagagatgcctgagcacatgtggtggaatgggtgytggtggaacgggtgctggcctggtgtcattctgtacgaggtttcacagtgtcctcaggaccacagtggggctaagtggataggagatcacagctttaggt

SEQ ID NO: 36814 - DNA, 201 bp, Homo sapiens
tatttctagcaagccaggataataaacagaaatcaagattagtgtaggtattatcactaaatgtagaatatgtaaaatggccctgatgtgttatttatttmtttatttatttttattttttttgagacggagtcttgctcagttgcccaggctggagtgcagtggcagaatcttggctcactgcaagctccgcctcccggg

SEQ ID NO: 36815 - DNA, 201 bp, Homo sapiens
ttccacacattgtagcactttatattcctaccagcaatgcataagggttccaatttccccacatgcaatgctaacatttaaattaaaaaaaaattttttttaaaggaaatcttgctatgttacctaggctggtctcaaactcctggcctcaagcattcctcctgcctcagctttcagagtagctgggattacaggcacggg

SEQ ID NO: 36816 - DNA, 201 bp, Homo sapiens
cacctgagaaccctctgtccctccccctgcccagcctccagagcaaagccatggctgcagctcgcttgtttggtttgttgagatgctttgtttttttaaasggcacattgaacattagggcagccagcagtgttatgaggcaatctggttaggattttccagaccccggagtctgtgagtcatccacaggggttccgatgt

SEQ ID NO: 36817 - DNA, 201 bp, Homo sapiens
ttgagaaccctcaaataatctcatttgccgtgagacagacggacggtgagtttactaccattggccagtgtctgcagacatcaaggttagtgaggtcattmagaagggaccagcatagctctggtgtctctagactccgcagccatggctgatttctctacatccatcagcctctccctgttgtctccataagtagctatt

SEQ ID NO: 36818 - DNA, 201 bp, Homo sapiens
cacaacagccacaacagccacagagtcgcagcctgcaagctacaatgcatctgctccagtcggcaccaccgatgaaggatgctggccgcgggtcagggcckgggagggctcagctggcccagtgcaggggtattcttctgagtcacgcagacctgtctccaccatggctcctcactcagtgacctggggcagagataatgc

SEQ ID NO: 36819 - DNA, 201 bp, Homo sapiens
ggggagcaggtcacacctgcctctattatctaaagcagagaactaggggctagagcagccaacaggggttgttttccaccctggtgagataagggagacaygcaaggagggttttgggagactcaggagaactaagggttttgcggggggagttcccacctgtcattcttgagattctgcttttggaacacaccagggaag

SEQ ID NO: 36820 - DNA, 201 bp, Homo sapiens
gtcattaagaagggaccagcatagctctggtgtctctagactccgcagccatggctgatttctctacatccatcagcctctccctgttgtctccataagtrgctattacaaaaggtttgtggctggcttagaaccaagaattttggctgagcaatccatagatcccacagacagtaggatggagaaagggctacctggagt

SEQ ID NO: 36821 - DNA, 201 bp, Homo sapiens
acatcacctaattcatacatggcagtgctagggccccaatccagcttgatctgccacgaaacccaggatcttttctgggtttcgcgacaaaagaattgtcrcgaggacccagaaatccaagtcagaaacccgatggagaattcaataaagcccatcatttgggtgcggggagtggggagcaggtcacacctgcctctatta

SEQ ID NO: 36822 - DNA, 201 bp, Homo sapiens
gtgttcattcagcacacgctggctgagtgtctgtcgcgtgccaggctctgtgtaggagccgggcatacgggtggataggctggcgcatcatcctttcagcyagggttaaagcctacatgtttactccaagtcagggtttctcaagcttgacaccactgacttgcgaatggataattgtttgctgtcgcggggctgtcgtct

SEQ ID NO: 36823 - DNA, 201 bp, Homo sapiens
ggtttctcaagcttgacaccactgacttgcgaatggataattgtttgctgtcgcggggctgtcgtctgtgctgtaggatgtttatcagcatccctggcaaygcactagatgccagggcactgcctccctgctccctggccctgttgtgacaaacgaaaaaaaatgtctccagacattgccaaatgtgccttagggagcaga

SEQ ID NO: 36824 - DNA, 201 bp, Homo sapiens
gccagacctggccttggcagcactcactgctctcgtgccttccctgagtgttccccacctttagctctgaatgggatctttctcagtgtaaactgctatcygcttagctaatttatctaagaggttttggcagatgtttcgtggccttggacttttggcagaaagtaaagaactgaaacacaccagccctgagggagggca

SEQ ID NO: 36825 - DNA, 201 bp, Homo sapiens
gtgtaaactgctatctgcttagctaatttatctaagaggttttggcagatgtttcgtggccttggacttttggcagaaagtaaagaactgaaacacaccakccctgagggagggcattggtttgtggggatgagcacgggagcgcctgtgagagccacctggagggaggggaacagctctgctcaccagatgaagtagtag

SEQ ID NO: 36826 - DNA, 201 bp, Homo sapiens
ttcttcccttacaatttgtctagaagaatgtttcctatcagtacacagaaagcactcactctttttacagctctgtggtgtttcgtggaattgatgtttcrtgattgattgaatagacctgcataccgacccttaggggtttctgtaagaagaggttgggccaggagcggtggttcacgcctgtaatcccagcactttggg

SEQ ID NO: 36827 - DNA, 201 bp, Homo sapiens
gacctgcataccgacccttaggggtttctgtaagaagaggttgggccaggagcggtggttcacgcctgtaatcccagcactttgggaggccaaggcaggcrgatcacctgagatcaggagttcgagaccagcctggtcaacatggtgaaaccctgtctctactaaaaacacaaaaattagccaggtgtgagggcaggtgcc

SEQ ID NO: 36828 - DNA, 201 bp, Homo sapiens
ttctggatgccaataaacagccagccgaggctgtcagcgctacagaacctgtgacgtttaaccctcagaaggaagaatcagattgtctacaaagcaacgaratggtgctacagtttcttgcctttagcaggtaaatccttgaatattctgttactcatctggctttcacatttcctgtgttgaagagaaacttcgctgagg

SEQ ID NO: 36829 - DNA, 201 bp, Homo sapiens
cgtgtttggtcttagccatcactccaggaaagtggctcctccctgaggacagggctctgtctctgatgctgctggcctccctccagtgctgccctcctccktttggggcttggtggatacaagtgctgacacacaaaggcaggcaggcaggcctcgggccagggtgtcctccaggcccctctgatggcagggaccagcgag

SEQ ID NO: 36830 - DNA, 201 bp, Homo sapiens
tcactccaggaaagtggctcctccctgaggacagggctctgtctctgatgctgctggcctccctccagtgctgccctcctccgtttggggcttggtggatrcaagtgctgacacacaaaggcaggcaggcaggcctcgggccagggtgtcctccaggcccctctgatggcagggaccagcgagacctggggaaactgcaca

SEQ ID NO: 36831 - DNA, 201 bp, Homo sapiens
tctgtaagatggcgataatgatgattctcatttggcagagttgttggaatagtaaccatagaatgtgagttcctgtcttgcatcaggggctcattaaaagygggtgtattttcttcttcttctttttttttttcccctggagagcccactgtacccttttcttgggttcaagacctggagccttctcgattttctctttta

SEQ ID NO: 36832 - DNA, 201 bp, Homo sapiens
cagttgctgccaccgtacctgtctctgttgtttcttttttatgtatttattgaagaagccacattgtactgtagagcgtccaccccacagtctggattctktttttgtatcctggtggtaacataaaggtgttgttctgtcccctctttagctgtaaattgggagttagatctagatgcatgattagatgcttttttttgt

SEQ ID NO: 36833 - DNA, 201 bp, Homo sapiens
tgaggagggagcatttggtttgactcctagaggccagagcagaggtggaaaggagcaaggagcaggtggaagggcacccggagaggtttgtgaggtgctgrgatggcagtgagagctgctgcgggcgcttgggctcccacctgcagagtctcaggtgtcacctcggcctccgtggcccctcagactaggactgccctgcct

SEQ ID NO: 36834 - DNA, 201 bp, Homo sapiens
gcgtgcactgtgggtggaggcgggacgctgggccaaggatgcagcgtctgggtgcactgtgggtggaggcgggaccctgggccaaggatgcagcgtctggrtgcactgtgggtggaggcgggaccctgggccaaggcccctctcaggctgcctggtcatgtcctctcggttcccacacatgccgggagcatgcagggggtg

SEQ ID NO: 36835 - DNA, 201 bp, Homo sapiens
atccacctgtgctggaattatgggcgtgagcccccatggcggacctagtttttcacaaatttctttttctgataatacagtagttcatatttagctctttctttatgaaatcagaacatgaatgagctgaacttgtgactctcagcagctgtccctggcccggccacagctgggacttgagccgcctgagaccacgtgcat

SEQ ID NO: 36836 - DNA, 201 bp, Homo sapiens
agcatagtgtgggatgtgtcttgcttgggggtttgcctttttttttttcttcgagacagggtcttgctctgtcacccaggctgtagtgcagtggtgcaacrttggctcactgccacctccgcctccagcctcaagcgattcctgtgtgtcatcctcccacgtagctgggattacaggtctgtgccaccatgcctggctaat

SEQ ID NO: 36837 - DNA, 201 bp, Homo sapiens
tggtgtttggctatgttgccaggtgatcttgaactcctgagctcaagtgatcctcctgccttgacctcccaaaagtgctgggattacaggtgcgagccacsaccccaggccccttaattattttaaataaaaacaactgcattgaatttaacgcaatagaaaagcagcagcagagtgaaggtgctttcattcccaagtggg

SEQ ID NO: 36838 - DNA, 201 bp, Homo sapiens
aagtccactcttctggggtttgcagagtgtgggtttgggggatggaggttcctctgggatttagtgggaggcagaagccttcaggattgctgtgaccactstagccctcacagctcttctctttatttgaatacgactggcacagatcatccgggaagcccacgggaccctcaggcgggcaggatgaacgactggcacagg

SEQ ID NO: 36839 - DNA, 201 bp, Homo sapiens
attcctagaagtggaattcctgatccaaagtcgtatgttaaaagttatttaaaacccaattacatgttgtttacaaaaaagtgcactctaagcataaagaygtaaacaggttgcaggtagaagggtggaaaaatataaaccatgtacatactaagcaaagaaagctttgcatctatactagtatcagaaaaagtagatttc

SEQ ID NO: 36840 - DNA, 201 bp, Homo sapiens
cctgcattgtgtgtgaatacatttctgaatgttataaaacatcagtgggaaagaaaagcttgagggtagctttgctaaagcttctgtttggttccgtgaccatttactgagttgtgacggtaccaagaacacaggaggaatgaggcttctttcttcaagaacttggccagcgagcaattcaacacaagataggtgacgaat

SEQ ID NO: 36841 - DNA, 201 bp, Homo sapiens
gctttgcatctatactagtatcagaaaaagtagatttcaaggtgaagagtattcccagaaataaaggggcacctcataaagacagtgatcatcaaggaaaygtaacaatctctaaatgtgtatgcacttgtgttaggggcctccaagaccacctcccaggtttgaagagtctctaagaggactcacatgactcagcatgta

SEQ ID NO: 36842 - DNA, 201 bp, Homo sapiens
agggctccgttcgttgcacctcctctgtgcagtttccgtaggtcacacttgtgtctttttgtatgctaatttgtgccccgtttctttacattctatgggggtagcgagcttgtctgctgtgttcaagaccgtttctcccgggcgcagggtaggtgctgaaagaatgctcatgaatgagggaattccaggcagtgcttaatc

SEQ ID NO: 36843 - DNA, 201 bp, Homo sapiens
ctaccagtattaaaatgaaagaagcatcatgataacgtacgctacagaggttaaaaatacaatgttgaattttatcagatactaaaggaagaaataagacraattctagacaaactcagaaaatagaggaggagggaacacttcccagctcattttttgaggccaccataattctgatacccagtcaagggcactacaaaa

SEQ ID NO: 36844 - DNA, 201 bp, Homo sapiens
ttcttgctcctcggatgtggatgtattaatttccataaatgctaatagcccacttccccaagagctattacttatgtcatctccccttggacacagttcarcacagggcagacaaatgaaagggaggaaaagacaacccccagtggcggtccccagctcctcagccccctcccaaccaggcagctcaggtctggttcctaa

SEQ ID NO: 36845 - DNA, 201 bp, Homo sapiens
ttaatgaggtgggccctggtgatggtggcaggggctgctccaaggcggagggtgtgtgtgcgggtggtcctgggtggcagcccagagactggggccttgcsgagacctcacagcgcgtctcagacttgtgggtccaggcagcacagagcttagtctagcggcaagcgctttgttaccaaacaaaatcttatgtggaagcca

SEQ ID NO: 36846 - DNA, 201 bp, Homo sapiens
tttccacgtgaccccgagtggtcacgataccgtatagggtctgagggaagctgggtaggccccaaagatctcctctgctccctgaagatgctgccagggtmccctggggatgcttcatgcaccccgccccccattcattcctcagtgcctcttcatacattggggcctctctgccagcacctggtgtgggccagccatcat

SEQ ID NO: 36847 - DNA, 201 bp, Homo sapiens
aggggatgggggctcaataccagggcactgcaggacccccacctcggccctgtgactcggaccactggatacagtgttctgacccagcagggccgggtgcrtgagtgtttgctcctgtgctgtgtctctcccggatggaagctccagagagcgtctgtcttatctctgtgggggtccccgtgcacggtgcacaggagactc

SEQ ID NO: 36848 - DNA, 201 bp, Homo sapiens
ggccagggtgtcctccaggcccctctgatggcagggaccagcgagacctggggaaactgcacagtctgtgcctgtctgtgctctcaggagactgagggaaktagtgggtgggagagattttatgttggattaaaaactgcacctccaggccgggcatggtgtctcatgcctgtaatcccagcactttgggaggccaaggtg

SEQ ID NO: 36849 - DNA, 201 bp, Homo sapiens
ttcacagtgaaaccttgaaggcactgggctcttctgggggcagcgtgggccgagcgcccctctgcagctcagcagcacggcctggcgggggttgtgggggrcagtggaggaggatggaatggcagtctagtttccgtttccctcctaaatagtgtctcacatccttcgagtcatttctggctgctttggttgggaaaatgc

SEQ ID NO: 36850 - DNA, 201 bp, Homo sapiens
cccagtttccttccttttcatcttaaggctggatgatattccagtctatggatggaccatgttctgctgattgtttcatcagttaacacttgagccttccrccttctggctgctgtgaacatgggtgtgcagtgacctgaggatttttggaaactgaaattcgtgttaaaggacaagggctctgtcttggtgtggttttca

SEQ ID NO: 36851 - DNA, 201 bp, Homo sapiens
gaactagctttcagatgtcacccggttgatactaatcttgggactagctgtgagatgttgcctattagatactgatcttcaggactagctgtgagatgtcrcctggtggatactgatcttgggactagctgtgagatgtcacctggtggatactgatcttgggactagctgtgagatgtcgcctggtggatactgatcttg

SEQ ID NO: 36852 - DNA, 201 bp, Homo sapiens
gagcacacgccatggtgtccggagggagggagggggactgactgactccaccaggtaagggtcgtatgcgcctttcggagagaaaggataggtatctcagyaacacctgccgcccccccgccccccgcccccactctcagagttgttttgggagagaaacacaatttgcccagcctttctgttgtgtttggggtgccagtg

SEQ ID NO: 36853 - DNA, 201 bp, Homo sapiens
gactgactgactccaccaggtaagggtcgtatgcgcctttcggagagaaaggataggtatctcagcaacacctgccgcccccccgccccccgcccccactytcagagttgttttgggagagaaacacaatttgcccagcctttctgttgtgtttggggtgccagtgccgtgtgggccctgaggttactttctttttatttt

SEQ ID NO: 36854 - DNA, 201 bp, Homo sapiens
taaagatgtatttggggagaaaatgagatggattggtaaagcactagcgtcttcatcatgaaagttgtgtcttaaattcagcccagatccaagcctcctasagtagagcgtcctgggaggtctgatctgtttgccctttgctagctagcccttcagatgtgcgaaggcaacactcagcaccgggcccagctgtgtttttgt

SEQ ID NO: 36855 - DNA, 201 bp, Homo sapiens
cgaaggcaacactcagcaccgggcccagctgtgtttttgtccaggcctggcctctcgaaggtcacagagtaacttggtggctgagccaggcttgggctcasgtgctttactccagagcccatgatgcttgcaagatgtggcctgccaagccggctgaatgaggatacccaggcttctctggcttccctgggccctccagga

SEQ ID NO: 36856 - DNA, 201 bp, Homo sapiens
tggctgagccaggcttgggctcaggtgctttactccagagcccatgatgcttgcaagatgtggcctgccaagccggctgaatgaggatacccaggcttctstggcttccctgggccctccaggatctggaagtttctactcactgcagatgtagctcctcagtctggctgtcctggtgggaacccatctttcctcccttga

SEQ ID NO: 36857 - DNA, 201 bp, Homo sapiens
tctttcctaaaggaagtcggtctgggaaatggcctttgtcctccgttattttagtttatgtcatccctccctgcaccccccccccccagctttttgaaacrttctgttaaaatgtttcttggcttactgtaattgtatatatttatggggaacagtgtgatgtttcagtacacgtatgtgttgtagagtagatcaaatgag

SEQ ID NO: 36858 - DNA, 201 bp, Homo sapiens
ccccagctcagggctctggcaagtcacggaactccccactcggcttgggcctgctgaaccagctcctgttctgggctgcctgcgatctggactcctgcagycctgggctgcctgggatctggactcctgcagcacagagtcctgtgctcactcatcatccagttgccccttgatctctgcttaggttttgttcattttccc

SEQ ID NO: 36859 - DNA, 201 bp, Homo sapiens
gtgagaggaggctggtggctcccagctgggtggcagtggtgtctctaagcacaggtgctggtcgcctaatggtgttgcttcctgacctgcttgtgctgttyggttcctgcaggcctctcctgggttgagcaacgagaagggcatggacgccgtgtcaccttggaagtccagcgcagtgcccactaaacacgccaaggtaaa

SEQ ID NO: 36860 - DNA, 201 bp, Homo sapiens
ccacctcccagccctggtttgttggggattaaatttccaacacatgccttttgggggacatgttaaaattatagcaccccaaatgttacactatcttttgrtgagcggtagttctgattttaagtctagctggcctactttttcttgcacgtgggatgctttctgcctgttccagggcaggcagctcttctctgtccctct

SEQ ID NO: 36861 - DNA, 201 bp, Homo sapiens
cggcctccgtggcccctcagactaggactgccctgcctccacatcccgagcctcaggacttccgtgtgggtggcaggtgctttcggaatggatgcccttcygcctagtgtctgccctcctagtacagcagggggccggcatgcttcatgctccctgtgagggtcgactggcgtatgcacgtccttcagcagtgtccttggg

SEQ ID NO: 36862 - DNA, 201 bp, Homo sapiens
gtgtgtcgacaccacagcatctctagcacaggcctcagccccagcaggctctgcatggtggggaggcgtaaaggaggcaggcggtgtgggaggcagagccrggtcccgctgggcatgtgtggggtggcagtggctcccctgtcgtgcccagccgagccttgtgccccctctttgctgtgccacctggagacggaagccatt

SEQ ID NO: 36863 - DNA, 201 bp, Homo sapiens
tgatgtttcagtacacgtatgtgttgtagagtagatcaaatgagagtactagcgtgactgtaatctcccacactcatcatttctgtgtggtcaggacattsagaagccgctcttctagctgctcttctagctcttttgtattttacgggaacttactggtaaccgtcattaccctgctgtgcaggaacagcagaatttaga

SEQ ID NO: 36864 - DNA, 201 bp, Homo sapiens
tcagtacacgtatgtgttgtagagtagatcaaatgagagtactagcgtgactgtaatctcccacactcatcatttctgtgtggtcaggacattcagaagcygctcttctagctgctcttctagctcttttgtattttacgggaacttactggtaaccgtcattaccctgctgtgcaggaacagcagaatttagactgtaac

SEQ ID NO: 36865 - DNA, 201 bp, Homo sapiens
cttgtaccatgaccccttgacaacctctccctcccctcctcagtctctgataaccactgttctgtgctccgcttctatggtaccaactcttctttttgagrtcccacatatgagtaagatcatgtggtatttgtctttctgtgcttggcttattccacttaaccttgatgtctgctaggtccattcatgttgtgttgtcgc

SEQ ID NO: 36866 - DNA, 201 bp, Homo sapiens
cctttttattttgatataatccatttgtttctttttgcttttgttgcctgtgcttttacggttttatttaaaaaaatcctttcacagcccaatgttacttwaaaaaatccttactcagcccagtgttacgaagcacttcttccgttttcttctagtagtttcatagtttcaggttttacatttaagtcttcaatctatttt

SEQ ID NO: 36867 - DNA, 201 bp, Homo sapiens
gcatgtgtgggtggatgtgtgtgcatgtatgtgtgcattgtgtgcgtgtgtgcatgtgggtgcatgcatatgtgtacatgtgtgggtgcatgcatgtgggygtgcatgtgtgtgtgtggggcatgcgtgcatgtatatgtgtacatgcatgtgtgtgcatttgtggctggatgcgtgtgtgcatgcatgggtgcatgtttg

SEQ ID NO: 36868 - DNA, 201 bp, Homo sapiens
gttttcttctagtagtttcatagtttcaggttttacatttaagtcttcaatctattttgagttgacttttatatatggagagaggtagggcgtctcatctyattcttctgcatgtgggtgtccagtttgtccagcaccatttattgaagagactgccttttccccagtgcgtgttcttggcacctctttaaaaatcagtca

SEQ ID NO: 36869 - DNA, 201 bp, Homo sapiens
gcatgtgtgggtgcatgcatgtgggcatgcatgtgtgtgcgtgtgggggcatgtgtgcatgtatgtgtgtgcatgtgtgtgtgtatgggtgcgtgtgtgtscatgtgtgggtggatgtgtgtgcatgtgtgtgtgcattgtgtgtgtgtgcatgtgggtgcatgcatgtgtgtacatgtgtgggtgcatgcatgtgggcgt

SEQ ID NO: 36870 - DNA, 201 bp, Homo sapiens
tagggcgtctcatctcattcttctgcatgtgggtgtccagtttgtccagcaccatttattgaagagactgccttttccccagtgcgtgttcttggcacctytttaaaaatcagtcagctgtaggtggcatgaatttatttctggaatctctattctgttccattgggcaaacctaatgtgagtttgtgatggggacaatat

SEQ ID NO: 36871 - DNA, 201 bp, Homo sapiens
ttggcttacttatttgcctaatttcctctgtatataaccaatctgctgaccacactggccaaatccctttggctacaataccactggccatctttatgtaygtgtatatttcaaaacatcagtaccaaccagggctagacactatctgtcagtgcaagatttctgaaggtgcatttgtctttaggtcctttgtgtcctgtg

SEQ ID NO: 36872 - DNA, 201 bp, Homo sapiens
tgatggggacaatatagaaaactataaagaagaaaataatctacagttcctgcctgcagatccacatgtatacatgtaagtgcacatgcttttaaataccrtcgctatcagatggaatcgtaatagtttcatatgttactattcttttcacttacaatattacgattatttctcaatttattaaatctttgacagtatgat

SEQ ID NO: 36873 - DNA, 201 bp, Homo sapiens
agggaaatcctagacactgtgttagtttacccataattactgcagtgtgtatctctgactgataaggacttttctttttatcatgactgcatgctgtcgtygctgcccccagtcaacgcagacctcggcatcgtctgctggggctgtaaccacgggcctttctaccactggtgcgtttggatcaggacccgctgtcctggg

SEQ ID NO: 36874 - DNA, 201 bp, Homo sapiens
aaactgttcctgggccaggtgtggtggctcacgcctgtaatctcagcactttgggaggccgaggtaggcggatcacaaggttaggagttcgagaccagccyggccaatatggtgaaaccccgcctctactaaaaatacaaaaattagctgggcgtcatggtagtcacctgtaatcgcagctacttgggaggctgaggcaga

SEQ ID NO: 36875 - DNA, 201 bp, Homo sapiens
ctgggcagtgacactggtgtggctgttccccactggcatgtccagccaaataagcaaagtcccttaggacccctggccaccaccactggagtcttgcctcstccttcgctcccagggcagcgcaaattcctggatcctctgggtgtctctgttcctggtggatgctgtgctccacccatcctaggcagggcatgggcgtcc

SEQ ID NO: 36876 - DNA, 201 bp, Homo sapiens
gcttgcccagaatgattctttaactgatttttttgccagggttccttgagcttcttagatctctagatttatagttttcatcacatttggaaaaattgtgktcattatttcttcacatatttcttctgtctttctctctcatcctctcattcagaggccccagttacgtgtttatcaggctgccagaaattgcctcacagc

SEQ ID NO: 36877 - DNA, 201 bp, Homo sapiens
tcaccagtgaaaacttgctttattttatttaagtgtgcagccacagctttgccttgatctaaggaatgtatctgatctttattgagtgctctaggttaacrctttttccttacatgagtgggaagtcccagccatcgcgtcctgttgccaaaaccgttgggaggaaggttttcctctgctagctcaggtctgaatggtaag

SEQ ID NO: 36878 - DNA, 201 bp, Homo sapiens
tttgtttttttttgggttttatttgagacaggatcttactctgtcacccaggctggagtgcagtggcacaattatggctcatggcagcctcgacctcctgrgcccaaacaatcctcccaccttagcccccacatagctgggaccacaggcatgcaccaccatgcccaactaatattttttttgtagtttttgtagagatgg

SEQ ID NO: 36879 - DNA, 201 bp, Homo sapiens
cctttggcttcaggcagagccgggtttccacctgggatctgctgttccctttgttcctggcagcctcagccttctctggcacagtgaggccggttggtgayggttgctgcctggagagtcagtgtgagaggaggctggtggctcccagctgggtggcagtggtgtctctaagcacaggtgctggtcgcctaatggtgttgc

SEQ ID NO: 36880 - DNA, 201 bp, Homo sapiens
tttgtagagatggggttttgccttgttgcccaggctggtgttgaactccttggctcaagtgatcctcctgcctcagcctcccaaagtgctgagatgacagrcgtgagccaccatgtaacaaatgtaacatttgttacaattgatgaaccagtattaaaaaattattatgaactaaactcatagtttacactaaagttcatt

SEQ ID NO: 36881 - DNA, 201 bp, Homo sapiens
ttgtgtgcagggggtggtgtgtgaggtgtgcctgcagggggtgtgtcatgcccgggtgcgtgaggccggcatggggtgtggagtgtgtgtttcagcttttraccttttggggtcagctctctagggtggtggtcatcgcttaaggtggacttgagatgtccctagaggctcactcacaggatgccatgctggctcttggga

SEQ ID NO: 36882 - DNA, 201 bp, Homo sapiens
tccagcctgatgggtgtcgagctggaccatctcctcctaattttctttactaagttggttggaagggcttcttaaagcccagtgaatctaatggattgacrttttctagcatcttctttccagttaatgttgtttggtcccttccgactgcagcactgtctgctctatgcaagatgcagctttgcaggcatgtgtgcgggg

SEQ ID NO: 36883 - DNA, 201 bp, Homo sapiens
accgcccacgtccccttcaagttccagagcttctctgcagggcagctggccatggtgcaggtgcgggtgtcaggcacacagggaagttgcatttggctgaygacggtgggaaattgagaatgcttccagtctccaccagtgtccctcccttacctgtgcagacagactagccttggggctgccgcccactccccttggtgc

SEQ ID NO: 36884 - DNA, 201 bp, Homo sapiens
cccccacgagaccgcccacgtccccttcaagttccagagcttctctgcagggcagctggccatggtgcaggtgcgggtgtcaggcacacagggaagttgcrtttggctgacgacggtgggaaattgagaatgcttccagtctccaccagtgtccctcccttacctgtgcagacagactagccttggggctgccgcccactc

SEQ ID NO: 36885 - DNA, 201 bp, Homo sapiens
atatgtattatatattttatatatagtatatttatatgtgtgttatatatatataaaatatatacatataaaaagttgagagtgaggtctcctttccccaycccctcacctgctaccaggtaacctctctctttgggttcttgtggatctgtcactggagaaccgagttcttttcccactttgtgtcggctgcaaagaaag

SEQ ID NO: 36886 - DNA, 201 bp, Homo sapiens
ttgctggtgagagcgtgggacagcccgggggtggatgctgggatttggatgcttatttccaggtcgggggtggagagacctacaccatcggcttgcagttwgcgcctagtcagagagtgggtgaggaggagatcctgatctacatcaatgaccatgaggacaaaaacgaagaggcattttgcgtgaaggtcatctaccagt

SEQ ID NO: 36887 - DNA, 201 bp, Homo sapiens
aagtgagctgcgaggcaggggtgacagagagcccgtctccctctgtctccagtgaccttgccctgcaggcgatttgatgggcttgacttaaccttttaatmgtgcagtttcagttgatgtagagaatgttcctttccaaatgtatggcagtggcgctcgttaagtttccctagactgaaggatgtgtgtacaggtattcct

SEQ ID NO: 36888 - DNA, 201 bp, Homo sapiens
actaaagagcttcctcatgtaaccaaataccacctgttccccaaaaacctatgaaaaaaaagaaagaaagaaattaaattaatttgcaagaaaaaaataarctcctcctgacttgattcatttgctcatgagagataaagagtgtgcatcccctaagtgctgctggagtatttagtcatgtgcttttccataagcagggac

SEQ ID NO: 36889 - DNA, 201 bp, Homo sapiens
ttatgttggattaaaaactgcacctccaggccgggcatggtgtctcatgcctgtaatcccagcactttgggaggccaaggtgggaggatcacttgagcccyggagtttgaggcttcaggaagctatgattacaccactgctctccagcctgggcaaacagagtggcaccctgtctctaaaaacaaacaaacaaacaaacaa

SEQ ID NO: 36890 - DNA, 201 bp, Homo sapiens
gggggactagtggaacatagtccttaaaacctctggaaaaatctgcacccttggacttggaatcgctgaagaagggaatgcagcaaggacagtgtggtgtrgccagggcactttcagctgtgagggtgatgctgaagcccccgtgctattcatggagcctgctgtctgcagctgctatgccccgtgtgggcagcagaggcc

SEQ ID NO: 36891 - DNA, 201 bp, Homo sapiens
gcggggatctgtgtgggacctgagtgcagtctgggcagtgacactggtgtggctgttccccactggcatgtccagccaaataagcaaagtcccttaggacycctggccaccaccactggagtcttgcctcctccttcgctcccagggcagcgcaaattcctggatcctctgggtgtctctgttcctggtggatgctgtgct

SEQ ID NO: 36892 - DNA, 201 bp, Homo sapiens
gccaagcccgggactgggagcagtggggagccaccccattttacttttgtcacccctgaagggtgcagctgtctctgttagccagggctggggggaagccrtagcaagtggagcactgtaggaagtggagcactgtgctcatggtccagtcaccacctcctgcttgggggttgtttctcctgcgcatgggacacagaggct

SEQ ID NO: 36893 - DNA, 201 bp, Homo sapiens
agctgggtggcagtggtgtctctaagcacaggtgctggtcgcctaatggtgttgcttcctgacctgcttgtgctgttcggttcctgcaggcctctcctggsttgagcaacgagaagggcatggacgccgtgtcaccttggaagtccagcgcagtgcccactaaacacgccaaggtaaaggggcaacggaggacaaactgat

SEQ ID NO: 36894 - DNA, 201 bp, Homo sapiens
tgcatagatgtcgcctgtgcccgtttctacggtagccgcatcatgctctgtggggtggttatgctgctctttattcagccggtctcctaatagacgtttgygtcatttctagtatttcgctatctcagcaattagtaaccttggttctttctggttctggaaaggggataatggaatcacaggcttcagtggtgttgacag

SEQ ID NO: 36895 - DNA, 201 bp, Homo sapiens
cagtctttcgttggccaggggagggccaaatgctttggtttataaccccaccaagaccagtagctgtgggagagaggtagcctcccaataaggaaaccagsgtgctgatatctgagcgaggtggccccatatgcacccacatggcctgccagtgacctcctggctcatggtgctcagactcttgagggtcaattccccgtt

SEQ ID NO: 36896 - DNA, 201 bp, Homo sapiens
catagatgtgaagtccatcttaatgcagtttttttgttgtgttttgttttgtttctgtttgaaacgaagtcttactctgttgcccaagctggagtgcagtkgcgcgatcttggcaaactgcagcctccacctcccgggttcaagtgattctcctgcctcagcctcctgagtagctgggactacaggcacctgccaccatgc

SEQ ID NO: 36897 - DNA, 201 bp, Homo sapiens
gtcaccccaaaatctgggaagttgaggatttagtttctggttatatcaggaagggctcatttggttggaaatgattaacaaacccatccaaaatgatttamgtgagaggcgatttgttgactcacagcaaatccacagccagcataagcttcaggtgtggcttgagcgaggtctcaggtgatgtcccctggacttgttctc

SEQ ID NO: 36898 - DNA, 201 bp, Homo sapiens
tctgtgtagaagcttgtttgtatgccagacaagacttggaaaagcctttgcaggtttggggactgcttatgttttctaggcgataatctgtccttggtctrgaaaaattgggcctgatgaactgtcacaaatagtgttggaatgaggtctgtccgccctggctcttctgtcgccagcagcagggggaacaggcatgtggga

SEQ ID NO: 36899 - DNA, 201 bp, Homo sapiens
aattaatgataatgtcacttcaagaagatgaaggcaggggccgcagtccagttcccatctcttagcctgatgaccagggcagaccgcacgggaggagcccrggatacccacggggcaggtgccgtcctgctttagggccaggagaggggctgctgggtgtcccacacatcattctaagcctgatctcggtttgagctctgc

SEQ ID NO: 36900 - DNA, 201 bp, Homo sapiens
gcctcctttggtgcctctttgacagggtctcctggcttccagctgaggtacatggtgggccctgggttcctgaagccaggtgagcggcgctgctttgcccrctacctggccgtgcagaccctgcagattgacgtctgggacggagactccctgctgctcatcggatctgctgccgtccagatgaaggtagcggctctctgg

SEQ ID NO: 36901 - DNA, 201 bp, Homo sapiens
cctggctcttctgtcgccagcagcagggggaacaggcatgtgggacggagattgcctggttctgctggagccctgggctcagcccccttgcctgcgccttygctgatgatcaccagatggagtagggagaagaggggtcagccctggctgctctcaactctggaaggaggggccctcagacctgggttgtgggcaaaccac

SEQ ID NO: 36902 - DNA, 201 bp, Homo sapiens
acacgctccacgccacgctgggggtcgccgagttctttgagtttgtgcttaagaacccccacaacacacagcacacggtgactgtggagatcgacaacccygagctcaggtgaggtctcagtggtgcccgtcctgccccagcccagatctgtgtcgggtgcagccggcacccctgctgagctggctcgaattctgcccgag

SEQ ID NO: 36903 - DNA, 201 bp, Homo sapiens
cggctgcaccttcctccccgcccattccctcgggcctttgtgctaatcacatcttggctttctgttctggttctaccgcctatcgatgcatctctaaacartataggcttgcctgcttttgacctatctttaaatgaagtcgtacttttttcttctgttttgttttgctgcttttgctcaagaccatgctcccgtgggagg

SEQ ID NO: 36904 - DNA, 201 bp, Homo sapiens
tcagtgtgacccctagcccagccctggggcagttctgtttttatccttgtttctggtggagaaaacagaggcccagggtcacactgatgatcatcagggcrgagtcttagcctaattctgtctccggggcttgtgctatttaccatcctcttctccctaatgacatgttcccggaagtagaattctgatggtgccaccgtg

SEQ ID NO: 36905 - DNA, 201 bp, Homo sapiens
tgaaggctggtgcggtctgttatgctgccatccttgattggtggcatattttgctccttaggtattgggggaaggaaattctctgaggaagtgtccctcaygttcacttgaaagtcccagagaacatttttttcactcagtagtcaaagaggtcttttaaaaacataaattcattgcttctcggccttttgggtaagatga

SEQ ID NO: 36906 - DNA, 201 bp, Homo sapiens
ccagggtcacactgatgatcatcagggcagagtcttagcctaattctgtctccggggcttgtgctatttaccatcctcttctccctaatgacatgttcccrgaagtagaattctgatggtgccaccgtgagggccgcaggcatgcagagccagatgggggtttggcccgaaggctcagccaggcctgcacttcctgaagac

SEQ ID NO: 36907 - DNA, 201 bp, Homo sapiens
tttcccctgcctcactatgtgctgcctcctggtcatggtttggtctttgctggtttccctacttcactgtgtgctgcttcctgggcctgttttgtggtccyggattcaggcatgcctctgcctaggtggcctcggactcatgcttgtccctgcatgggtcctggagcatgtagctgactttcctgaatgttcttcctgcac

SEQ ID NO: 36908 - DNA, 201 bp, Homo sapiens
gttatctccaattgtcattttcatactttgcctgcaagagagagataagctcataggaaggggaggctgagatagccagcctgggagactccggcgctgaygggagagggagaggttttcacaaaggtcgaatccacccgcagcactctgcgcatcagtgcagcgagcctggctctcctccgtcagttctgcgttttttgg

SEQ ID NO: 36909 - DNA, 201 bp, Homo sapiens
tgtagagtaggacgggggtttttctgggagcttgggcacttatcttggttgcggagtaggacgggtttggctgggagcttgggcagtgatcttggttgtcragtaggacgggggttcagctgggagcttggacagtgatcttggttgtcgagtaggatgggggttcggctgggagcttgggcagtgatcttggttgtggag

SEQ ID NO: 36910 - DNA, 201 bp, Homo sapiens
gggggagtgggctgtgggaccttggaggagtcttgaaggagccaagtacgagtttgctgcatcttgagaatggtcagcccagccttggaaagctagtgtcrggttttggggatcgaggcatctgagggtgtgcgttgctgagaggatcatgctgtgttggaaatgccaaaactgcccgggcagtgccccaaggccagtggc

SEQ ID NO: 36911 - DNA, 201 bp, Homo sapiens
agatgactcacacactttaccctgccccttttgctttgtatccaataaataacagcgcaaccagacattcggggccactaccggtctctgcgcattggtgrtagtggtcccctgggcccagctgtcttttcttttatctctttgtcttgtgtctttatttctacactctctcgttgccgcacacggggagagacccaccga

SEQ ID NO: 36912 - DNA, 201 bp, Homo sapiens
tgaaagagcaatgagaggctgaggcgggaggattgcttgagctcaggagtttgagaccagtcatggcagcctagtgagacccccatctcttaaaaagcagygttttggggaatttctgaatcatttggaagagcgtgcagtgttacatggtggacttgctgttgcagcagcacccctgtgtcccccagggtgtccccttga

SEQ ID NO: 36913 - DNA, 201 bp, Homo sapiens
tcctctctctctctgcctgggctgccaggcagggaagggccccctgtccagtggacacgtgacccgcgtgaccttacctatcattggagatgactcacacwctttaccctgccccttttgctttgtatccaataaataacagcgcaaccagacattcggggccactaccggtctctgcgcattggtggtagtggtcccctg

SEQ ID NO: 36914 - DNA, 201 bp, Homo sapiens
tttgtctcctctctctctctgcctgggctgccaggcagggaagggccccctgtccagtggacacgtgacccgcgtgaccttacctatcattggagatgacycacacactttaccctgccccttttgctttgtatccaataaataacagcgcaaccagacattcggggccactaccggtctctgcgcattggtggtagtggt

SEQ ID NO: 36915 - DNA, 201 bp, Homo sapiens
ttgactaagcatcatctgatctgcagttatctgcaacttctgctccagtttcttctctctgctcgcctcccccagggacttctggcgagctccctctttcygtctgtgccggggctcattccttctgtgcctcttccagggatgtggcccactggacggtggtgccctggagatcctggagcggcgcctgcgtgtgggcgt

SEQ ID NO: 36916 - DNA, 201 bp, Homo sapiens
aggcaggtcctgcactgaccctgcagcccacatgttgcaggctcacctgttggaagtagatacctcttgagggtgacagatggcctcatggcttcatgccstggtgctgtcagagcagcacgtggggcctggggaattctctctcctgcctttatggtttgaaacggtgtccctcttgccacctctgagatgactaggtgc

SEQ ID NO: 36917 - DNA, 201 bp, Homo sapiens
ttagggaactgacgctcctcttctgtcatcacaggccccattcacattcacaaatgtcccagcacttgatagatggcccgtccagtggcccccaccagccygctgcccatggagtccttctggcgtggctgcagctgttgtgaagtgcacaggcggttatcctgcagggcgtgcccagtggggctggtctggtgttcgttt

SEQ ID NO: 36918 - DNA, 201 bp, Homo sapiens
atctcagaactctgcagattggagctgcaaaaagcatgagccgcactcttgagctccctccctatataggtggtcctgggaggcctgccctggtgtctgckcctggaaggcagacactgcacatctacctgactcgcgctctgaccctttcgcaggaaaacacgtggtgcaagcacagaagctggcggacgtggacagtga

SEQ ID NO: 36919 - DNA, 201 bp, Homo sapiens
actgtttccttgtgagaaggaggcgggggtcacgttgctgtccactgtgtggaggcttctgcagggggtgcccatgccccatacaagtggaaccaggctgrgagagctcgggctggcattggtttcctgtgggaagtttctgctggtgccagagagtgaggaaggacccaggccctaagctggtaagctggggcgcctctc

SEQ ID NO: 36920 - DNA, 201 bp, Homo sapiens
ggtccctccactcacagccgtggctgcaggtagctcagaccaggcctgtgccggagacttgtaagagccacgcggggcatctgcagagcagtttgccggcrttaaaattggatggtggtgagggacctgacagtggcactgtttccttgtgagaaggaggcgggggtcacgttgctgtccactgtgtggaggcttctgcag

SEQ ID NO: 36921 - DNA, 201 bp, Homo sapiens
gtgaaagtactaaaagtctctgatatgcagaaataatggtgtaagctgtctttctctttgtctcctctctctctctgcctgggctgccaggcagggaaggkccccctgtccagtggacacgtgacccgcgtgaccttacctatcattggagatgactcacacactttaccctgccccttttgctttgtatccaataaataa

SEQ ID NO: 36922 - DNA, 201 bp, Homo sapiens
gccacctaggggctaccagccacagtcatctcattagcacacaaaagatagcacttcggagattccgggggtttcaggagttgtataccaggaaactggaygaagatcaaatacatatttcacaaatcacaggtgcattctgctggctgggagtaatgcataggtcagtaagtttcatgtatcataatagcgttaattcat

SEQ ID NO: 36923 - DNA, 201 bp, Homo sapiens
aattagtgaaagtactaaaagtctctgatatgcagaaataatggtgtaagctgtctttctctttgtctcctctctctctctgcctgggctgccaggcaggraagggccccctgtccagtggacacgtgacccgcgtgaccttacctatcattggagatgactcacacactttaccctgccccttttgctttgtatccaata

SEQ ID NO: 36924 - DNA, 201 bp, Homo sapiens
gcgtttgttccaagaccccagtgggggcctgaaacctctgtagtactgacccctacacggtacatactaggttttgtcctgcatatacatacctatgacayagtttataaattaggtacggtaagatatttaacaacaataacaataaaatagaacaattataatatacagtaataaaagtgaacgtagtctctctctctc

SEQ ID NO: 36925 - DNA, 201 bp, Homo sapiens
gacgcccgttgccaggcggaccatggtctagcggtagcgaaaagtgtcaaggaacaacacccgctacttagcagaccgggaaagggagtctctctttcccygggggagtttagagaagactctgctcctccatctcttgtggagggcctgacatcagtcatgctcgcctgcagttatccggaggcctaaccgtctccctgt

SEQ ID NO: 36926 - DNA, 201 bp, Homo sapiens
aatttctagtttattgcattatgttaagagaatattatttgtagtatttctactttatggagtgcagttttttgtggcctgtgggtggcaagccaaccagrtgctgaggcaagagaacgaggacatgagctgttccagtataataaaatataaaacaagaatagttataccagatatagatcttagatgtgtttatatatg

SEQ ID NO: 36927 - DNA, 201 bp, Homo sapiens
cccgtctgcagcagtgtctcccagagcagccttcttcagctgggtggggattttttcagctgggtgtggttgtgccttccggctgcagcgtcctcctcctygtctttggtgaggaccctgcgtggtggaagctgtaagcacagctgaaaacaggctggctggtgcgatgggccccacggagcttccccggctgccagcttc

SEQ ID NO: 36928 - DNA, 201 bp, Homo sapiens
gtggtggaagctgtaagcacagctgaaaacaggctggctggtgcgatgggccccacggagcttccccggctgccagcttcctggacaatctgcttcttctrtgtcctctcccacaacccgttttgaattattctgaaacaaattccaggcatcattttatttcatctgtaaaccttttggcatgaacatttcttttttttt

SEQ ID NO: 36929 - DNA, 201 bp, Homo sapiens
atttatgagtaagttgcaaatttgtttcttaaaaaattttacctttttttttttttttgagactgggtcttgctctgtagcccaggctggaatgcagtggygtgatctcagcttacttcaacctgcacctcctgggttcaagtgatgggcctcagtctcatgagtagctggggctacaggcatgcaccactatgcctgggc

SEQ ID NO: 36930 - DNA, 201 bp, Homo sapiens
cagaaaatcttttttgattgtgttttccctttgacagaaagttatttatgagtaagttgcaaatttgtttcttaaaaaattttacctttttttttttttttgagactgggtcttgctctgtagcccaggctggaatgcagtggcgtgatctcagcttacttcaacctgcacctcctgggttcaagtgatgggcctcagtct

SEQ ID NO: 36931 - DNA, 201 bp, Homo sapiens
atacgcgtttcctagcatgtctcatgggtgtggttaccacgagtttgccagcacacccgtatacactgtgggtttctttcatttttcttttttcttttttcttttttttttttttttttgagacggagtctcactgtgttgcccaggctggagtgcagtggcgcgatctcggctcaccgaaagctccgcctcccgggttca

SEQ ID NO: 36932 - DNA, 201 bp, Homo sapiens
aggccccattcacattcacaaatgtcccagcacttgatagatggcccgtccagtggcccccaccagcctgctgcccatggagtccttctggcgtggctgcrgctgttgtgaagtgcacaggcggttatcctgcagggcgtgcccagtggggctggtctggtgttcgtttcagttagacccaggttatgcacttggggcagg

SEQ ID NO: 36933 - DNA, 201 bp, Homo sapiens
cacgagaggtatttgttggggtgatgcaatctgaaaacttgagctcatgataaaccccaacttgcgcaggccccaggtccctccactcacagccgtggctkcaggtagctcagaccaggcctgtgccggagacttgtaagagccacgcggggcatctgcagagcagtttgccggcgttaaaattggatggtggtgagggac

SEQ ID NO: 36934 - DNA, 201 bp, Homo sapiens
aatccaggcgctgttccctgggatgtagaggggctgaactcaggtagagcagctcggagacctgcctggctcccttggtaggacgggcactccctttccarcctcagctcagacccattctagagagacacctccgtcagccagctctggttttgtcaccaggagaacctgggttggacggaggatatggctcacctccac

SEQ ID NO: 36935 - DNA, 201 bp, Homo sapiens
ggagacccctgcgaagcatgtgggagcagaggtggccatggcgggcaggacaggagggagggtctgagagcaacagggagaggaccgaaatagcccttgtyctaggtgctcgttcccaggaagctggcttggagtgaggactgagtggacgctgcagctgccaggaggcggttggtagcccgaaggcagaagcacagtgta

SEQ ID NO: 36936 - DNA, 201 bp, Homo sapiens
ccagttccacccagaccacatggtcaaggaagggggtggtggtggcgatgcttgtggagaaatgtcctcttctgagatcgcgggtggtgggcagccagcartagccccttgtggaggagagtgtgcctgggaccctgtccacccatgtcctcttgtctgcaggcgcagcagagcgtccgcacacagcacttgcgggaccta

SEQ ID NO: 36937 - DNA, 201 bp, Homo sapiens
gaaggaggctgtcatgagccaggtggggacaggacatgggctggagactgggctgtgggcctcagggaagccaggcagatgactcagtgtgcagggctccyaccctggcctctgagtgggcagaggtggccccgtcaggatgggcttggggtctggcttggtggtttcatggtgggcaaaggcaaatggcagtgtatgtga

SEQ ID NO: 36938 - DNA, 201 bp, Homo sapiens
agcttgggcagtgatcttggttgtcgagtaggacgggggttcagctgggagcttggacagtgatcttggttgtcgagtaggatgggggttcggctgggagyttgggcagtgatcttggttgtggagtaggacaggggctcggctgggagcttgggcactgatcttggttgtggagtaggacgggggctcggctgggagctt

SEQ ID NO: 36939 - DNA, 201 bp, Homo sapiens
attatgttgaggaaaaatagtttcttttaattccttgtttgaaaacactcctagcaccatgagtctctgctgctttatctaaagcatctctggggctcatgtgtttgtgaagagcttgcctagctttttattattggcgcatgagacatggtgtgagggtgacctggtttcctctgggctgaaacagaaagcttgggaatg

SEQ ID NO: 36940 - DNA, 201 bp, Homo sapiens
tccgagttcccatttacggaggaacggcgtggagcttcacttaccactctgctgtgtcatctttcaggctttttctgggaggaggtgggcaggggtttgcygtacggagctctgaaatggactgtaagaggcactcagggaatctggggagaggcatcggctttgaggacagctgggcccctgcagaatcctcatctgcat

SEQ ID NO: 36941 - DNA, 201 bp, Homo sapiens
gatgatggcgctcacctaacagaactgcagactgtttcggagacgcactgagcaggtaacagagtaattgcaagttgtgttaaattctcaggaggagaccrataggagaacgtggagaccaataggagaacgtggagacctgctttaggtgggtgacgagggaggcctctctgcgaagctgctgattaagctgggacttac

SEQ ID NO: 36942 - DNA, 201 bp, Homo sapiens
tatttttgcattgctcgagtatattgactttggaaacaaaagacatcattctatttatagcattatgtttttagtagtggtatttccatatacaagatacrgtaattttccgtcaatgaaaatgtcaaattctagaaaatgtaacattcctatgcgtggtgttaacatcgttctctaacagttgttggccgaagattcgtt

SEQ ID NO: 36943 - DNA, 201 bp, Homo sapiens
actcagttctgcatgtactggatccgatttgaggactgagtagcttctggttgatggcatctggcttgtgaacctccgctgttgctggcagtggctgtgcygctgttgtgacctctgggctcctggttcttcctgctgctcagccaggaggtagaggcaccaacgccagcctggctgcctgccacccccagctcttcacct

SEQ ID NO: 36944 - DNA, 201 bp, Homo sapiens
aggaaaccccaggtgtggcaggactgagttcctccggaggttctgtgggatggggcctccctgcctcttgtgggttttggggctcctagctgtccttggcytgtggccatatcactccgttctccgccccctcgtcatgtggcctcttctctgtgtctccctctgtgtctgtctctctctcccctgctcctacagggatgc

SEQ ID NO: 36945 - DNA, 201 bp, Homo sapiens
gagtgcacctgtggtcccagctacttgacaggatgaggcaggaggattgcttgagcctgggaggtggaggctgcagtggccagacctccagcctgggtgasagacgagacccttttcttaaaaacaaaaacaaaacacaggtactatagctaaatatagttcctgcacttctcgctggctcctggagcacgtgtgctctct

SEQ ID NO: 36946 - DNA, 201 bp, Homo sapiens
ccggaggttctgtgggatggggcctccctgcctcttgtgggttttggggctcctagctgtccttggcctgtggccatatcactccgttctccgccccctcrtcatgtggcctcttctctgtgtctccctctgtgtctgtctctctctcccctgctcctacagggatgcttgccattggagttagggccagtctagataatg

SEQ ID NO: 36947 - DNA, 201 bp, Homo sapiens
gcaggtatcagagcctggactcacacctgtgccttctgtcttgagaccggcaggtggatgggcactggttgagcagcgtgttttcgctcaggtggtcttgyggctggccaccctgcgggccggcgtgctctgtctctgtggttcactgcacagcatgcattccattcagcacctgctctctgcagggcatcatgctaggct

SEQ ID NO: 36948 - DNA, 201 bp, Homo sapiens
tttgacccgatcgatttcccaatttcctgaaagctacagatacgaaatgtgctattgtaagctggagctttgtggagaaaatgtgtgctaataatgctgarttgaatatacatgtgcattcttcgttattttaccaaatttctgattaggaattcaaagtgctgttcctagtattttcctgacggatttgagttggtgttg

SEQ ID NO: 36949 - DNA, 201 bp, Homo sapiens
cagcatgcattccattcagcacctgctctctgcagggcatcatgctaggctcagggtgatgatggcgctcacctaacagaactgcagactgtttcggagaygcactgagcaggtaacagagtaattgcaagttgtgttaaattctcaggaggagaccgataggagaacgtggagaccaataggagaacgtggagacctgct

SEQ ID NO: 36950 - DNA, 201 bp, Homo sapiens
agtggcgcagtctcagctcactgcaacctccatctcccaggttcacgcgattcttctggctcagcctcccaagtagctgggattataggtgcccaccaccrtgcctggctaatttttatatttttagtagagatggggtttcatcatgttggccaggctggtcttgaactcctgaccttaggtgatctgtgtgcctctcaa

SEQ ID NO: 36951 - DNA, 201 bp, Homo sapiens
actgtttcggagacgcactgagcaggtaacagagtaattgcaagttgtgttaaattctcaggaggagaccgataggagaacgtggagaccaataggagaaygtggagacctgctttaggtgggtgacgagggaggcctctctgcgaagctgctgattaagctgggacttacaggatgagaaagaaactgactccgtgacaa

SEQ ID NO: 36952 - DNA, 201 bp, Homo sapiens
tgattaagctgggacttacaggatgagaaagaaactgactccgtgacaagcagggacgaggctgcttcaagcagagcagggagacccaggggtgttaggaygagaggagagcccaggtttgctgacgggtggggttggcagggtggccccgtcgtgccttctggctgggtcctacagggtcttcttagggacgctgacgtt

SEQ ID NO: 36953 - DNA, 201 bp, Homo sapiens
ccacttcactctccctagaaaagtccttttcctgtttgtggtgtttctaacattctctgttaattggctggtttgactggaagcacctttgctttcagctrtcagttgatcacattgtgttttcttcaccagaaaacagacacatgaccctcattgagaactgcagcctgcagtacacgctgaagccacacccggccctgg

SEQ ID NO: 36954 - DNA, 201 bp, Homo sapiens
aggtgatctgtgtgcctctcaaagtgctgggattgcagatgtgagtcactgcacccggccagcaataaagtatttttaaattaaggtaggtacagtacttktttttttttttttttagacatatgctattacacacctattgactacagtatagtataaatacaacttttaaatgcactgggaaaccaaaaaattcagtga

SEQ ID NO: 36955 - DNA, 201 bp, Homo sapiens
tcctcctaccttggcctcccagagtgttgggattataggcgtgagtcaccatacctataatggcacaatggttagcatttttttagcaagaaagttttttkttttttttttttttttttgagatgaagtcctgctctgtaacccaggctggagtgcagtggcgcagtctcagctcactgcaacctccatctcccaggttca

SEQ ID NO: 36956 - DNA, 201 bp, Homo sapiens
ctggcttatctttgtgacttatcactaatgcttgttggaccttgggtgtgtaccaaggggtaggaccacagcagagattctcaggttttttttttttttttaattctgaaatgaaatgttctctgcaccccaattaagacggcaaaaacaagtagagcgaagtgggttgaagtgtgtatgagggtctcatccccagcctcc

SEQ ID NO: 36957 - DNA, 201 bp, Homo sapiens
agaggccctgcagggcccacgtgccagccaccaggcctcagactaggctcagatgacggagagctgcacacctgcccaacccaggccctgcagtgcccacwtgccagccgctggggcccagacttgctccagagggcggagagctttacaccggcccaacccaggccatggctccaaatgcgtgacagttttgctgttgct

SEQ ID NO: 36958 - DNA, 201 bp, Homo sapiens
tatggcatccttcgtcctgttttgtgtttgagtactttctggcttcagaagatgcttcaggctcatcttcatctctacttattttgcccatttttctgtartttttgcatttttcatcaaatattaaaagttctttgtatgttaaggatatttgctctttatctgtgataaatagtgcagatattttctcctcattttgtc

SEQ ID NO: 36959 - DNA, 201 bp, Homo sapiens
taaggtgcccacccccaggtttctcctgtagaaagagagttttttccctttgaactgactgaagaattcttggcgacattttttggcttcatgcaaatatytggtccccagcaaccttccacctcttgttttaacaccctgggctgagctttgcttgcgtcagttatttaattggtgtttttgaaatggtaatttgtctaa

SEQ ID NO: 36960 - DNA, 201 bp, Homo sapiens
tcatttatgattttatttttaatattttagtctcctttttttttttttttttttttgagatggagtctcgctctgtcgcccaggctggagtgcagtggcgygacctcggctcactgcaacctccgcctcctgagttcaagcgattctcctgcctcagcctcctgagtagctgggactacaggtgcctgccaccacgcccgg

SEQ ID NO: 36961 - DNA, 201 bp, Homo sapiens
gccatgggagctgaggcccggggccagcggcatggtgtgcccagagtcctaaggaaggccaccaggctgagaagccatccctgatgcaaaacaaggtcctktcaggccatgaggaggacttttatctgtatcaaaaagcgtcaggaagcctttgaaaggttttatgcaaggatgggtgtatttgggtaagatgggggcagt

SEQ ID NO: 36962 - DNA, 201 bp, Homo sapiens
ctcagctttttttttttttttttgtcatttatgattttatttttaatattttagtctcctttttttttttttttttttttgagatggagtctcgctctgtygcccaggctggagtgcagtggcgcgacctcggctcactgcaacctccgcctcctgagttcaagcgattctcctgcctcagcctcctgagtagctgggact

SEQ ID NO: 36963 - DNA, 201 bp, Homo sapiens
cgtgtccagttcaggatcatgtcttgtgtctggtttctgtgtctctttgacctccttaattctggaacagttcctcagctttttttttttttttttgtcawttatgattttatttttaatattttagtctcctttttttttttttttttttttgagatggagtctcgctctgtcgcccaggctggagtgcagtggcgcgac

SEQ ID NO: 36964 - DNA, 201 bp, Homo sapiens
cggtgacagtggccgtcctttgagacgttactctaggtaaccactgcccaggtgtgcctttcccatgggggcctgctctggccagtcagcacccccacctrgggccacgagctcgttgctctccgtaccccaccatcacccagcgcttggattatgtgtgtcttgacatggatgggtcctgactcttgcccttcctcccat

SEQ ID NO: 36965 - DNA, 201 bp, Homo sapiens
gtatcctgtgtacccattttaaagaggaggacactgaggtgcatggagatggaataactccaccagcttattcccatgtggcgggtgggggtgggagcgayggccctgtgcatctgacggcaccacctgctgtggcctccgtgacctcctgcttctgaggagccctgcattttgttctgaagtgttctgtagaatgctgag

SEQ ID NO: 36966 - DNA, 201 bp, Homo sapiens
gctctgctgtaggaatcttctgggtggtcctcatggcctgggctgcatgcttcttccaggcacttctggagacttttgtgtggctttcttgaggactccakgagaagggacacaccagcctccttctacctgtcatgtgatggagatgtcctggcaccaccagaacctcgggtgtcttgggtgactgactccctgctgggt

SEQ ID NO: 36967 - DNA, 201 bp, Homo sapiens
gagacttttgtgtggctttcttgaggactccaggagaagggacacaccagcctccttctacctgtcatgtgatggagatgtcctggcaccaccagaacctygggtgtcttgggtgactgactccctgctgggttccaggaagagcaggatttgaccttgtgtgtgaggggcggggaccgagagcagtgctgtgctgagagt

SEQ ID NO: 36968 - DNA, 201 bp, Homo sapiens
tagctgtgtgctgctgcctagttgatactgatcttcagaactagctttcagatgtcacccggttgatactaatcttgggactagctgtgagatgttgcctrttagatactgatcttcaggactagctgtgagatgtcacctggtggatactgatcttgggactagctgtgagatgtcacctggtggatactgatcttggga

SEQ ID NO: 36969 - DNA, 201 bp, Homo sapiens
tgtgccccgtttctttacattctatgggggtagcgagcttgtctgctgtgttcaagaccgtttctcccgggcgcagggtaggtgctgaaagaatgctcatsaatgagggaattccaggcagtgcttaatcagacctctgcttccccaaaagctccccaaggcatctgggtctcaggcattacacattttccattccgggaa

SEQ ID NO: 36970 - DNA, 201 bp, Homo sapiens
gcagcttctgacgggcaagaggggaaggaacctggcgcagcaggtggatctgctgcagccaaggagggacctggccagtgtggaagtccctccctcccctrgggctgagggtaggcaggagtgaagggatgcagagaggcaggaagcccaggggaaggggttcccgtttttaacagctcccgggaaaatggtgaggacatc

SEQ ID NO: 36971 - DNA, 201 bp, Homo sapiens
tagtgtaaacacaccagtttaaaagatattgtcaggcttaatgaaagacaaagcccaactatatactgtctataagaagtatactttaaataaatataacrtaaattaaaagaatggaaaatattcttttcaaacactaaaagaaaactggagtgggtatattactattgacactatcagacaaactagacttcagaatac

SEQ ID NO: 36972 - DNA, 201 bp, Homo sapiens
tggctgtgctgctgttgtgacctctgggctcctggttcttcctgctgctcagccaggaggtagaggcaccaacgccagcctggctgcctgccacccccagmtcttcacctggtggggctcagtctctctggccttgtgaagttcgcctcaagggccaagagctccgtgtccttcagggagaatgccggccagcgagcgagc

SEQ ID NO: 36973 - DNA, 201 bp, Homo sapiens
agctcaaatatgcttagcgttaggtgcttatattagaacagaaaaaagatcttaattcagtgatctgatctttgtcttcagaaactagaaaaagaagagtraaataaacccaaagctattcagaagtcaataacagcagaaaccaatgaaattgaaaacaaaaacaatagattaaaaattaaaaaatagcaaaaacccagt

SEQ ID NO: 36974 - DNA, 201 bp, Homo sapiens
gcgtatgcacgtccttcagcagtgtccttgggccaagtgtggcactgagtcctgcagacacccagggagagggcaggaggcaccgggtcagaaatctgggrcaggtgaggagcatgggcatctgcgtcaggagagacttcctctctgaaatccccacctggggccatcacggcctgcattgtgtgtgaatacatttctgaa

SEQ ID NO: 36975 - DNA, 201 bp, Homo sapiens
gtttttaagttattaattttttctttaatcttaatttaattctatattttatctttattcatcctctttgaaaagcagaattcttagcttatttgctcatygtgtttaataataaaatcatttaagattctgcaattttcttccaagtacatcttttaccccatttcataggttttgatttggaatgttatttcctacatt

SEQ ID NO: 36976 - DNA, 201 bp, Homo sapiens
ttggtgcgggtgtaacctgtttcatggaaggtgaagaaagcctgcactaatttaacatccaagttgtgccctgatgaaatgcagtgcctttgccgcttgtycccttcttgagtgagcatgcaagtgtaaattcagcttacctggtttattttcccatgtgccctaagtagaaatatagtaagaggaaacggtcatgaagcc

SEQ ID NO: 36977 - DNA, 201 bp, Homo sapiens
cccaaagctattcagaagtcaataacagcagaaaccaatgaaattgaaaacaaaaacaatagattaaaaattaaaaaatagcaaaaacccagtgaaacaaraacctgtttgaaaatatcagtaaaactgatgaacttctagcaagactgaaaaagaagggaggacacaaatgactaatattaggaatgaaagaaggaatat

SEQ ID NO: 36978 - DNA, 201 bp, Homo sapiens
actcagccaagatgaagtagatgacctgagtagtcctataactaatatgtaagttgaattcatagtttaaaaacttttgaaaaagaaatattcaggcctaytcactatgaattctattagacatgtgaagaagaaataatgccacttttatataatctatttcagaaaacagaaaagatgggagcaattcccaactcatga

SEQ ID NO: 36979 - DNA, 201 bp, Homo sapiens
gttgaattcatagtttaaaaacttttgaaaaagaaatattcaggcctattcactatgaattctattagacatgtgaagaagaaataatgccacttttatayaatctatttcagaaaacagaaaagatgggagcaattcccaactcatgaaatgaagccagcattaccctgatatcaaaaccagaaaaataatattaataat

SEQ ID NO: 36980 - DNA, 201 bp, Homo sapiens
cttacttttctaagtaagccaaggagttgctctttaggccagagggagaactggctttcgccatgggcgtcggagttgaggtaggatgggctagtgtcctrctccatcactgatcccagtgggacttcagacaagtgctttaaactccttgatcctagagggtgagggataaaagactacaaattgaggccgggtgcagtg

SEQ ID NO: 36981 - DNA, 201 bp, Homo sapiens
gatactgaaaaaacatttgacgatattcagcatcagtttatgattaaaaactgagcaaactagcaataaaagaaaacttccttagcataatcagtgatgtytacaaaaactctttagttaacatcatacttaatggtgaaagactgattgctttccccctaagattaggaacaagtaaaggatgtccactgttagcattca

SEQ ID NO: 36982 - DNA, 201 bp, Homo sapiens
ggctcccccgatccctgctgtctttgaggggtagtgtctgggaagccctccgaacccgcagtgtgagtctgagccagagggtaggaactgcatgaagtctytgcattgtttgcctggctgaagatatcctgttaaaggcttattaaaacagttctttggaagggactcattctgttcctgctcagctcctctctggccttg

SEQ ID NO: 36983 - DNA, 201 bp, Homo sapiens
ggacaggatcagataacactcaaaacgggccaagacccaccaagaagctggtaacacctgaaacctgtccccaaatggctttagcaacaagagactttgtycatgtagctgaagtgtcgtggggtgaccaactgaggtctctaataatgacatggggacccagtggccctcactcctaccttttcctctctgcttgttttt

SEQ ID NO: 36984 - DNA, 201 bp, Homo sapiens
gttgtagtcagtgctgtaagtcaagaaaacaaaagacctacacattagaaggaagaaacaaaactgtccttatttgcagaaaacgtgattgtctatgccaragattctgaggagtctacaaaaaagtccttttagaatgagtaagtgggtttagtgaggttgcaggataacacaggaagtcaacatgaaaaatcaatccta

SEQ ID NO: 36985 - DNA, 201 bp, Homo sapiens
cagttctttggaagggactcattctgttcctgctcagctcctctctggccttgctgcccagcgttgtctgaggagcccatgtcatgcaggtgccaggtcaygtggccgtgccatggggggtgcccggctgcggcctcttcatccaggcacatcggcagaggcccaattccacttccatcactgcgggtgaaaaatggaaac

SEQ ID NO: 36986 - DNA, 201 bp, Homo sapiens
tgtggtggctgctgcttttgtagctttacttctagcacttcactgtgttcattcacttaatcctcagagcagctctatgaggctgccaccaccttactccygttttatagacgagcagcagcacctgctaattaagagtgaagccagctgcccagggcgacggctttagctgggatgccaccctcctggtctggctcagcc

SEQ ID NO: 36987 - DNA, 201 bp, Homo sapiens
acgtgattgtctatgccaaagattctgaggagtctacaaaaaagtccttttagaatgagtaagtgggtttagtgaggttgcaggataacacaggaagtcarcatgaaaaatcaatcctatttctgtatactagcactgaaaaattgaaagcaaaatacagaaacagtattgtttacaaagcctgccctccatgaactaaat

SEQ ID NO: 36988 - DNA, 201 bp, Homo sapiens
gtttttgaagatgaaggcattaagacaggagcatttaaatgatttattaatctgtttatgctgtcaaggaggaaacttgaccagtgcagataagtgagctkcgaggcaggggtgacagagagcccgtctccctctgtctccagtgaccttgccctgcaggcgatttgatgggcttgacttaaccttttaatcgtgcagttt

SEQ ID NO: 36989 - DNA, 201 bp, Homo sapiens
tggttattcttaggtgaaatcaaagaagacctaaataattggagagacgtaacatgtttatgtcttgggaaactcaacatagtaaagctgtcagttctgcmcaagattgatctagagattttatgcagtttcagtcaaaatctcagcaggatttttttggcgatatagacaagctgattctgaaatttatatggaaagcta

SEQ ID NO: 36990 - DNA, 201 bp, Homo sapiens
cagctgggtgctgcctggctgagtgaggcgggaattgggtggtcaggcaccggtgacctggtcgaatatgactttgctggggtgacccgaggggtgcagcmatgtggctctgttgctcgcagttttgtgcctgcctcatctgtcgtttatgaagccttcgaggctcgagcttcttgaaagctgacttgtgttttccaggtt

SEQ ID NO: 36991 - DNA, 201 bp, Homo sapiens
tagtggtggatgtgttacgtcttgggctgatctaaccatggtcctacctggtgtgtccccctgcagggttgggtgcatagctgctctagccccattctgcwctagtgggcctgggatctgttggtgtttcttgtggtggaattcctagggaatggaaagttcctggagcggaagcagacatctgatgccctggttgttggg

SEQ ID NO: 36992 - DNA, 201 bp, Homo sapiens
tttttcttgtaagtcccacaggaaaaacaggccagtctccaacctgtagaacccatgtgtgctggccaagccccttgagtccctgcggcatcagagcaagsgggtggctgagccttgctgaggcagcgtgctgcttgcctggactctgacccggtgtgaccgagactcagcaggccgggggcatgtcctctcctgtggacg

SEQ ID NO: 36993 - DNA, 201 bp, Homo sapiens
tctctcccctcctggaggggagggctggggccaggtcagggcaggggtggcgtgggcctgggaatggccttttccgtgtcctcgctgggcagggcagctcygtctgggcgctggcacagcctgcatggtatctggtcggaaatgcctccttggtggccgccttctcacagcccagggctctccgggtgtgaagccgcagtt

SEQ ID NO: 36994 - DNA, 201 bp, Homo sapiens
agtaccgtgtccagttcaggatcatgtcttgtgtctggtttctgtgtctctttgacctccttaattctggaacagttcctcagctttttttttttttttttgtcatttatgattttatttttaatattttagtctcctttttttttttttttttttttgagatggagtctcgctctgtcgcccaggctggagtgcagtggc

SEQ ID NO: 36995 - DNA, 201 bp, Homo sapiens
agctctgcctctgagcacctctccatcgtcgtccagggaattgggccccagggaagggggctctggggaagcagcctctgggaaaggggggctctgggggrgtgggctgtgggaccttggaggagtcttgaaggagccaagtacgagtttgctgcatcttgagaatggtcagcccagccttggaaagctagtgtcgggttt

SEQ ID NO: 36996 - DNA, 201 bp, Homo sapiens
acaccactgcactccagcctgggcgacagaacgagactccgtctcaaagcaaacaaacaaacaaacaagcagaaaaacaaaaaaatgaaaaacaaaacaayagaaaaactgttcctggaggaggtttggggtagattttggactgccaatgaaatctgtatttgcttaattgttgtggaggcttggcttgggccttgtgct

SEQ ID NO: 36997 - DNA, 201 bp, Homo sapiens
acctggaggcggaggttgcagtgagctgagatcacaccactgcactccagcctgggcgacagaacgagactccgtctcaaagcaaacaaacaaacaaacaagcagaaaaacaaaaaaatgaaaaacaaaacaacagaaaaactgttcctggaggaggtttggggtagattttggactgccaatgaaatctgtatttgctta

SEQ ID NO: 36998 - DNA, 201 bp, Homo sapiens
aacctggaggcggaggttgcagtgagctgagatcacaccactgcactccagcctgggcgacagaacgagactccgtctcaaagcaaacaaacaaacaaacaagcagaaaaacaaaaaaatgaaaaacaaaacaacagaaaaactgttcctggaggaggtttggggtagattttggactgccaatgaaatctgtatttgctt

SEQ ID NO: 36999 - DNA, 201 bp, Homo sapiens
ccctggtagagggatgcaggtgattgggttgtgtctcttcccgtcatcacagccatgagaaagcccctcttgagcggctcttactcgtcagagcaatgagygtgctataatttcccattgaaaagtggatgctgtcaaggagtatcagcataacccacgtgaaactcctgcgagcccttccagggcctggattcttgggcc

SEQ ID NO: 37000 - DNA, 201 bp, Homo sapiens
gaacctggaggcggaggttgcagtgagctgagatcacaccactgcactccagcctgggcgacagaacgagactccgtctcaaagcaaacaaacaaacaaacaagcagaaaaacaaaaaaatgaaaaacaaaacaacagaaaaactgttcctggaggaggtttggggtagattttggactgccaatgaaatctgtatttgct

SEQ ID NO: 37001 - DNA, 201 bp, Homo sapiens
gcctggctctggagcttgcaggaagccctggctgcagagcccgatggctgctcctgtgctcttgctgttgctcggcagagggcaggcatgtcctgaacatygtcacaacaaaagcaagaagctggcttcgtgtcccagcgagctgcttccacagagggaggctctatggctctaggaggccaactcgggccctgtgtgcct

SEQ ID NO: 37002 - DNA, 201 bp, Homo sapiens
tgaacctggaggcggaggttgcagtgagctgagatcacaccactgcactccagcctgggcgacagaacgagactccgtctcaaagcaaacaaacaaacaaacaagcagaaaaacaaaaaaatgaaaaacaaaacaacagaaaaactgttcctggaggaggtttggggtagattttggactgccaatgaaatctgtatttgc

SEQ ID NO: 37003 - DNA, 201 bp, Homo sapiens
cctggctctggagcttgcaggaagccctggctgcagagcccgatggctgctcctgtgctcttgctgttgctcggcagagggcaggcatgtcctgaacattrtcacaacaaaagcaagaagctggcttcgtgtcccagcgagctgcttccacagagggaggctctatggctctaggaggccaactcgggccctgtgtgcctg

SEQ ID NO: 37004 - DNA, 201 bp, Homo sapiens
cactccagcctgggtgacacagtgagaccctgtctcaaacaaaacaaaacaaaacgtcaaacccactccctttgcccctcactggtcttggtgacaatctygtgataggagatgtcagctgaagagtgatgaggttcctgagactggaaaggagagattcatttctcataaagggctgcagcctgcaggtggcctttctga

SEQ ID NO: 37005 - DNA, 201 bp, Homo sapiens
cacctgtgctggaattatgggcgtgagcccccatggcggacctagtttttcacaaatttctttttctgataatacagtagttcatatttagctctttctttatgaaatcagaacatgaatgagctgaacttgtgactctcagcagctgtccctggcccggccacagctgggacttgagccgcctgagaccacgtgcatgcc

SEQ ID NO: 37006 - DNA, 201 bp, Homo sapiens
ccacctgtgctggaattatgggcgtgagcccccatggcggacctagtttttcacaaatttctttttctgataatacagtagttcatatttagctctttctttatgaaatcagaacatgaatgagctgaacttgtgactctcagcagctgtccctggcccggccacagctgggacttgagccgcctgagaccacgtgcatgc

SEQ ID NO: 37007 - DNA, 201 bp, Homo sapiens
aaggggggctgaactcgtccttgtagaagaggcccattcccgagacaatggcattcatccattcactccaccctcatggcctcaccacctctcatgaggcyccacctcccagccctggtttgttggggattaaatttccaacacatgccttttgggggacatgttaaaattatagcaccccaaatgttacactatcttttg

SEQ ID NO: 37008 - DNA, 201 bp, Homo sapiens
tccacctgtgctggaattatgggcgtgagcccccatggcggacctagtttttcacaaatttctttttctgataatacagtagttcatatttagctctttctttatgaaatcagaacatgaatgagctgaacttgtgactctcagcagctgtccctggcccggccacagctgggacttgagccgcctgagaccacgtgcatg

SEQ ID NO: 37009 - DNA, 201 bp, Homo sapiens
tcgctgcgtgtattagtcacagatttaggggccaggctggggtcggcagagcactgtgtgccctgatgtgctgcacatctggttggcagggccccggggarccacgggacatatttctgaaggtggccagtggtccaagcccggagatcaaagacttctttgtcatcatttactcgtaagtgcacaggctttggggacctg

SEQ ID NO: 37010 - DNA, 201 bp, Homo sapiens
aacctgcactcagtgcccaccacagaggggccacgtgaccacgtctcagagtggcttcctcgtgagcccatgaagatgcctcacccagccccatttgactrtgaagcagcaggctcttggccctaaaatgctaacaggggcttccgtgctcaggccggcatgacctccagccccaccctgtctcctgcgtggcgctgccct

SEQ ID NO: 37011 - DNA, 201 bp, Homo sapiens
aaggccacaccgaggttgtgggtcccatccttgcaggagagtgtgccgtgggcaagcacggcttcccccaggacactcaggtttgcaagttgcaagtttgyagggtgccacacccaccggccgtgagacacgcttgtcccgaggccacaccacttgcttgccaaagccttctgttatgaacacaactctggtgaaggctcc

SEQ ID NO: 37012 - DNA, 201 bp, Homo sapiens
atccccttagatctgagcaccgttggttgttacgggttggggtccttggtggcctcacttggaagccctcgttttgttcagcaggagttcccgttggaggscggtatctcccacctggaagccgacctgagccagacctccctggtcctggaaacatccattgccgaacagttacaggagctgccgttcacgcctttgcat

SEQ ID NO: 37013 - DNA, 201 bp, Homo sapiens
atgttctccctgggagcagacatgaggggctcaaagggattcatgatccaggcagatagagtctgttgttctgggccagcttcctcattgtaattttgaaraaactgagacgaagagaggtcaggtgacttggccagtgccgtggctaaggggtgaacttggcttagaatctggattccctgccctggggtcagtgccctt

SEQ ID NO: 37014 - DNA, 201 bp, Homo sapiens
gccgggggagacttgggccggcgcgggacgagcgtgttggtaagggtttgttcagctgtcactgtcctgggatctccatgcagactgagtcactgtgcacrtcctttccctgcctcccacatgattctctcttaccttcctcccaaatcctggggacagaatataagaaaatcggactttttcagccaccgggggaaatct

SEQ ID NO: 37015 - DNA, 201 bp, Homo sapiens
aacccagagctgttgttggattcagagtggcccaggactgccgaggaacatcatggccaaagactgtgtatttcaccttccagttctaccgcttcccaccygcaacgacgccacgactgcagctggtccagctggatgaggccggccagcccagctctggcgccctgacccacatcctcgtgcctgtgagcagagatggca

SEQ ID NO: 37016 - DNA, 201 bp, Homo sapiens
aaagctaaaggaattagaagagtcaaaatagttttgaaaaaagaacagtaaagttggaggaatcatactacacagtttaaacacttactgtacagctacaytgattaatataattagtatcaaggaattcagttaatggaacagactagagagtccagaaataaagtttggaagtgccttatgaaattaaatatgccatat

SEQ ID NO: 37017 - DNA, 201 bp, Homo sapiens
gaagaacacctggatgcacccacggagcctgtcagtggccccaaagtggagcggcggccttccaggaaaccacccacgtccccttcgagtaagtgtttccrgagagctgactggccaggcacatggcaggcagcacttccatctcttcccggggaaaggtacttagtctagtacggtaatcaccacatttgtaagataatc

SEQ ID NO: 37018 - DNA, 201 bp, Homo sapiens
tcccaagttcatatggaacagtcaccaagatagaccgtatgctgggccattaaaatgtcccaataagcttcaaaggacccaaattatagagtatgtttatygactactgtgcttttaagttagaaataaataatatgagatctagaaaatcctcaaataggaaattaacatactggatcaaagaagaattaatagggaaat

SEQ ID NO: 37019 - DNA, 201 bp, Homo sapiens
ttgttttgttttttcagtgtttgaattttgtgcctaacagcttgttctcaagatttctgtttaccaccagtgtgtacattaataatcccatctttataaayggcactgaaatgtacagtcccccttgtactagaatcccttgtggtggtgggtggtaggcatgcatgcatttcctgtcagagtcggtttagaatgaatttc

SEQ ID NO: 37020 - DNA, 201 bp, Homo sapiens
tatatacagtctgttgctgatcgaaatgtcattatgttacacatgactgtatatgagcagaaatcaataaaggacaaataatagagaaaatcagcaaagcyagaagttgattctctgaaaagattgataaaattgatcaagacaaaaaaaaaagaaaacacagactaccagtattaaaatgaaagaagcatcatgataacg

SEQ ID NO: 37021 - DNA, 201 bp, Homo sapiens
tatattttaaaaataaaatacctatcaacctttgagaaacataattatgaaaaacggaggaccttagattataaattgggtatattttgtaattaaatacraacatgattagagttatccctcggtatccgtgggggactggttccacatgctcaagtcccttatataaaatggtgtggtatttgcctgtaatctacgcac

SEQ ID NO: 37022 - DNA, 201 bp, Homo sapiens
aagttacttagaagtacagtagtaatacataataaacatagtttgcccatgtctgtagaaatgcctgaacagagaatgaacctgtatagctagctttcagraaaaatatgactaccttctctggaaagaaattttcatgtgtttaaattatgatacaggccaggcatggtggctcatgcatgtaatcctagcactttagaa

SEQ ID NO: 37023 - DNA, 201 bp, Homo sapiens
tactgaatgctagggtgggaccctctgtaaatggctggcattctctctctgtgctgctcatcctgtctggtgcaaactcactgaacacagtaagctggggkcagggtaggccttccctcttctgtttcccagcccttgggatcactctcctttgttgcctgaagtccactgtcttgaaaaccactgttctacatattttgt

SEQ ID NO: 37024 - DNA, 201 bp, Homo sapiens
agtcctgttaatagtctcttggctgctgaaatcatccccaccggggccgatcatcccggggtttgaaagcgtcttctagctgtgtgtgctacttgtgattyactcaccatgctgcgtgttttccggacttttgagtcttggctcatgctctccgcctggtgtgtctttctcccatacgctgcatttattttcttttaggat

SEQ ID NO: 37025 - DNA, 201 bp, Homo sapiens
tagctgtgtgtgctacttgtgattcactcaccatgctgcgtgttttccggacttttgagtcttggctcatgctctccgcctggtgtgtctttctcccataygctgcatttattttcttttaggatatattccagggtttttgttttgttttgcttttagagataaattctcacttcgttgctctggctggagtgcgtgcca

SEQ ID NO: 37026 - DNA, 201 bp, Homo sapiens
cctgtcaccctccctgcccctccctgtctcgcctcctcctaattggcccctgcttccactcccgcccccacatggcagctgcgggaattttcttaaatccygaaccagattgtgtcatttctgcttagaatctctccctggcctccctgcatgattggagtgagaacccagcttctcctcgcgccgtgaggcctgcctgaa

SEQ ID NO: 37027 - DNA, 201 bp, Homo sapiens
tgcttttagagataaattctcacttcgttgctctggctggagtgcgtgccataatcacagctcactgtagccttgaactcctgagctcaagcaatccaccygcctcagcctcctgagtagccaggactacagggagtgccaccgtgcccggctaagccaggactgcaggcagtgccaccgtgcccggctaagccaggactg

SEQ ID NO: 37028 - DNA, 201 bp, Homo sapiens
accgtgcccggctaagccaggactgcaggcagtgccaccgtgcccggctaagccaggactgcaggcagtgccaccgtgcccggctaagccaggactgcagrcagtgccaccgtgcctggctaagttttttgttttgtagagatatggtcttgctgtgttgtacaggctgctcttgaactcctggcctcaagtggtcctccc

SEQ ID NO: 37029 - DNA, 201 bp, Homo sapiens
cccaggagccccttgcttgcacatcctgagaggctgtgctctgacccgcctctctcgctcttgaagacagaccccaaaggtgtcttcgtgctgccgcctcrtggggtgcaggacctgcatgttggcgtgaggccccttagggccggcagccgctttgtccatctcaacctggtggacgtggattgccaccagctggtggcc

SEQ ID NO: 37030 - DNA, 201 bp, Homo sapiens
tcgcctcagccacccaaagtgttgggattacagacgtgagccgctgtgtccggctgggtttgccatttctaagtgacttaaggaattgttctttaggccgsagtaagggctggctttgaccaccagtgatggatttgaggtagtatggatatgggccaaagttgtactctagcactgattctctgtgggacttcaggtaag

SEQ ID NO: 37031 - DNA, 201 bp, Homo sapiens
ctccttgaagcaatcactgcagtctctggctggaatcggggagcagctctccccatacatggaattgggtcagggtcctccacaaaacaagggaagttgarcgacaaaaatagcccacagagaacaaaaaggaacaaaccagcatgtgtgcctgctggattcacacaggaccagactgagtctggtcctcaggaatacctg

SEQ ID NO: 37032 - DNA, 201 bp, Homo sapiens
cggcctctgatgtcaaaaggtgaagcaggggacacgaaagccctccctgcatgccctccgtagactatccagaagagggagagcggtgggtgatcgctggrcagcagcagcgatggagtctctagaagggctggttccagtcctgagggaagaaaggctaacggtggttagcatgggccggggcatgtggaggcctgtctg

SEQ ID NO: 37033 - DNA, 201 bp, Homo sapiens
gggtggtgaagttagccatccttcaccgggaggcgcttcccgtggccaggcatcggctcagaagcatgccgtcatttcatgcctgtcatcctcctgtggakgtcagtatcctgtgtacccattttaaagaggaggacactgaggtgcatggagatggaataactccaccagcttattcccatgtggcgggtgggggtggga

SEQ ID NO: 37034 - DNA, 201 bp, Homo sapiens
gggcagctggacgggcttgcgttggccaaggagagtcatgtcgtggtctctgaggtgcagggatggcccgaggtgtctggtcactgaccctgagagaccakggcagagggtgggactcctggggtgtgtgagccagacagaggtagtggggcatgtggtctctggacgggttggttttcatgtcagacacattctgatagg

SEQ ID NO: 37035 - DNA, 201 bp, Homo sapiens
gggaaaatccatttcctctccttttccagctgctagaggccacctgcgtcccttggctccttcttccatcttcaaaggcagccatgtagcactttccagtygtcactgaactctgaccctcctgcctccctgcctttcacttacaaagactattgtgagtacattgggcccacctggataatccagggtcatccccccatc

SEQ ID NO: 37036 - DNA, 201 bp, Homo sapiens
ctgcctttcacttacaaagactattgtgagtacattgggcccacctggataatccagggtcatccccccatctcagggtcagctgatgagcaccttagtcycttggcattgaacatatgtataggttctggggttaggacgtgggtatctctggggtggcagcagttactccgcttaccgcaaggagtagcagtcagtaaa

SEQ ID NO: 37037 - DNA, 201 bp, Homo sapiens
tctggggttaggacgtgggtatctctggggtggcagcagttactccgcttaccgcaaggagtagcagtcagtaaatggtgtggcgtgatcccttgcccacrtggaaaatataaaattcagtcctagcttcatgtcatgtacaataataaattccagatggcctaaaaaccaaaacttcagaaatgttagaattagaagatc

SEQ ID NO: 37038 - DNA, 201 bp, Homo sapiens
gtccctgcatgggtcctggagcatgtagctgactttcctgaatgttcttcctgcacatctctgcttgtttcccctcaggcttcaggtctggacggggtccyctgactgtcctgcgggggtgctgttccccgcccttgccaccgtgtctccagctgtcaccccgcgttcctcccgggtgctcagcccttcctgggagcagct

SEQ ID NO: 37039 - DNA, 201 bp, Homo sapiens
gggttggggctcctggtctcccgatcccagtccagggtctttccctgccactgccgctttggctgcactcttgcattccagctttgcccagctattcttgyattttgccgtcagtgaatgcatagacttgagtagttcctgtgactctttcttttgtttgagaaggacgaagacaggtaagaagcagcctgtcctccttct

SEQ ID NO: 37040 - DNA, 201 bp, Homo sapiens
gtaatttgatttttaaaaagcagtggagttataatcaccatgtcgttggtatgctatagttgctcagcactgttttataatctgttgtcagctaactggayggggaacaggaagacattgtttttgtatttggcaaatgttgaaagtgtggcttagagtcatatgcttccatttcttacttttctgattctatgtccttcc

SEQ ID NO: 37041 - DNA, 201 bp, Homo sapiens
ttctggtgtcctgggaaaccagtgacttagtctcttcctgctcttctcagatctggctctgggccagaggtgtgtgctggcaaccccatctcagggccccrctggccacgagcttcttggagcagccgtggaagagctgagtctctgtgctttttttttttttttttttgagatggagtctcactctttttgcccaggttg

SEQ ID NO: 37042 - DNA, 201 bp, Homo sapiens
ccaccatacccggctaattttttgtatttttagtagagatggggtttcaccgtgttagccaggatggtctcgatctcctgaccttgtgatccacccgcctmggcctcccaaagtgctgggattacaggcgtgagccaccgtgcccggcctatcgtcactttttaacttgccgcggctgccttcccagttctgcacacaccg

SEQ ID NO: 37043 - DNA, 201 bp, Homo sapiens
tctgtgtctcagctctgcagggcagccctcgagagcctccatggtgctcctgcagtcctccggctttcccgagattctggatgccaataaacagccagccraggctgtcagcgctacagaacctgtgacgtttaaccctcagaaggaagaatcagattgtctacaaagcaacgagatggtgctacagtttcttgcctttag

SEQ ID NO: 37044 - DNA, 201 bp, Homo sapiens
agttttccgagttcccatttacggaggaacggcgtggagcttcacttaccactctgctgtgtcatctttcaggctttttctgggaggaggtgggcaggggkttgccgtacggagctctgaaatggactgtaagaggcactcagggaatctggggagaggcatcggctttgaggacagctgggcccctgcagaatcctcatc

SEQ ID NO: 37045 - DNA, 201 bp, Homo sapiens
agcccctgagtctctgagatttccccacttttcttgagtgccgcatagctgctttcctcctggattcctgacacggctgaacccccggggcttcctgtccyctccagcagctgctgacccctgagaagcacggctcctctgctccttcagctgcgctgtgctctcggggtggggggatggggtatgggagtttttccagct

SEQ ID NO: 37046 - DNA, 201 bp, Homo sapiens
cctctctgtcattaaataaaggaacttgagaagcggtcccaggttccagagctgccctggccaggaggctgcaggcatcactcccttccgtggctggatcyagggctaccccgttccccggtgtggccagtgcatgttgggagctttgtggacggactggcaagcttctgagcccctcacctgtgctctctttccttccag

SEQ ID NO: 37047 - DNA, 201 bp, Homo sapiens
aatgtcctcttctgagatcgcgggtggtgggcagccagcagtagccccttgtggaggagagtgtgcctgggaccctgtccacccatgtcctcttgtctgcwggcgcagcagagcgtccgcacacagcacttgcgggacctacaggtcatcgccgcctaccgggaacgcacgaaggccgagagcatcgccagcctgctgagc

SEQ ID NO: 37048 - DNA, 201 bp, Homo sapiens
gagaaccttctggtgtctggtctgcagcagatacctggcctgcttccagctcatggagaatccggtaagggcgtctttgattctctccacttggtgaggtragtctgtcctagttcacagtgaaaccttgaaggcactgggctcttctgggggcagcgtgggccgagcgcccctctgcagctcagcagcacggcctggcgg

SEQ ID NO: 37049 - DNA, 201 bp, Homo sapiens
aatttaccatctcaggtgtcaggtatctcccacggtcctgacctgctcataaaattaggattccctcctcaccgcttctcaactcacacattggattgccrcgtgaaatataggatgcccagttaaatttgaacctcaggtacacaacaaataattttttagtgtaagtatatcccaaatatcgtagggaccatacttata

SEQ ID NO: 37050 - DNA, 201 bp, Homo sapiens
agctgcaaaaagcatgagccgcactcttgagctccctccctatataggtggtcctgggaggcctgccctggtgtctgctcctggaaggcagacactgcacrtctacctgactcgcgctctgaccctttcgcaggaaaacacgtggtgcaagcacagaagctggcggacgtggacagtgagctggctgccatgctactgacc

SEQ ID NO: 37051 - DNA, 201 bp, Homo sapiens
aatgattttagtatatttcttttactgtcccatttactttttttgtttaattttaccatgatcattgcttatatttctttattttgggatgagtatttcarttcagcttgatatgtattgggcaccacgatatgttaggaaccgtgcagatgacacagagttgactctgccctatactgtgtcttcaggaagctctcagtg

SEQ ID NO: 37052 - DNA, 201 bp, Homo sapiens
ggcagtgaacagaatagtgaattccgattggtatagaacatgaacagatgcgttctgggagggactggccgtcactcgctgcgtgtattagtcacagatttaggggccaggctggggtcggcagagcactgtgtgccctgatgtgctgcacatctggttggcagggccccggggagccacgggacatatttctgaaggtgg

SEQ ID NO: 37053 - DNA, 201 bp, Homo sapiens
ggtggaaatgcccatccctctctcctccaggctaaatgacccggcccctttcccctcccctcctaagtcggatccccaagccctgtgagaatcctttcaarctggtgtgagctcggagatttcctgcagtgcttctgaggatggggcaggggctaacctgcactcagtgcccaccacagaggggccacgtgaccacgtctc

SEQ ID NO: 37054 - DNA, 201 bp, Homo sapiens
agaatcctttcaaactggtgtgagctcggagatttcctgcagtgcttctgaggatggggcaggggctaacctgcactcagtgcccaccacagaggggccaygtgaccacgtctcagagtggcttcctcgtgagcccatgaagatgcctcacccagccccatttgactatgaagcagcaggctcttggccctaaaatgctaa

SEQ ID NO: 37055 - DNA, 201 bp, Homo sapiens
tgaagggaaatcctagacactgtgttagtttacccataattactgcagtgtgtatctctgactgataaggacttttctttttatcatgactgcatgctgtygtcgctgcccccagtcaacgcagacctcggcatcgtctgctggggctgtaaccacgggcctttctaccactggtgcgtttggatcaggacccgctgtcct

SEQ ID NO: 37056 - DNA, 201 bp, Homo sapiens
tctgacctggcagaactgtctgtgctgaggtcttagtagattcgggagtgccatctgtttttatcttctcttggctaggacccacccacagcatgctaaaygctgtgaaagctgctttaccccatcttttgtggtccttcattaaaatgtggacggtgggttgtccaggtcttagatcttagtgtagctccaaaggcagct

SEQ ID NO: 37057 - DNA, 201 bp, Homo sapiens
tccaaaggcagcttctctagccgggagtgtccttacactcgagaatgctgctgtctggccggcttgctgagagcacagcaaagcggttgcattggtgaccrcggcagcctctttactgttccccagcgactaaggtgcctggaccatcccctatgcaaacacacattagacccctcaggttctgtgccatggatactcagt

SEQ ID NO: 37058 - DNA, 201 bp, Homo sapiens
gccagggcgatttgacttctctctcccactcctctgagcaccgctctcggtgggtgggaccgcagcctcctgtgggtcctcctgggaagaactgccctgaygcctggacactgcctcccccagcgtcatcgtggacagtcaggagtggagggacttcaagggtgctgctggcctgcacacaccggtggaggaggacatgtt

SEQ ID NO: 37059 - DNA, 201 bp, Homo sapiens
tcacttcaactaagccaaccacctttcctttttcagtcctcctgaggcctttggtagacagtccaactgatgtccccagaaggctgtaaaatggatcagaytaatgcatttgtctcaaggctcctctgtacccactgctgaagactcattccccactctgtttcccattccaaattccatccagtcattttatccagcaca

SEQ ID NO: 37060 - DNA, 201 bp, Homo sapiens
ctcagagagcggcatctgaggcgtggctgtctgcccggcagagccgctggggggctcgtgccaaggccctgcacgctggtcctactgaactgaagcttccsgcagccacgcccgtgagcctggaggagccaaggagcccagggctcccgagagtggttttctccgtgtttgggtgtttggagctgtgagtggcctttcttc

SEQ ID NO: 37061 - DNA, 201 bp, Homo sapiens
ctggaggagccaaggagcccagggctcccgagagtggttttctccgtgtttgggtgtttggagctgtgagtggcctttcttctcatcacctcttcttcctrcactttttggggggctctgccgagggcgtggtctcccctgcgtgtgttggttccctccttggccctgggcttggtgccttcaaccctttttgttttcttc

SEQ ID NO: 37062 - DNA, 201 bp, Homo sapiens
accatttccccatttgtcccccatgtgtatttttttgatctgggatccagcccggtttcctgtattgtatttgtaattatcactttaatctcgtagtcgcytgcattcttttccagtgacactggctttcaggagagaccaagtgagctgtcttgcagaacgtcccgtgttccgggcttacctggttgcttcttcatgttg

SEQ ID NO: 37063 - DNA, 201 bp, Homo sapiens
gctttcaggagagaccaagtgagctgtcttgcagaacgtcccgtgttccgggcttacctggttgcttcttcatgttgttgaacttgttgctttatcccccrtagttcttgaatgccgggagcgacggctgaaagctgtttgattctggatctcagcatgaacacttcattgtcagtgctgtgtgcttcacagcccaccacc

SEQ ID NO: 37064 - DNA, 201 bp, Homo sapiens
ggtcaaaggagagccatgaaaattagggaactgacgctcctcttctgtcatcacaggccccattcacattcacaaatgtcccagcacttgatagatggccygtccagtggcccccaccagcctgctgcccatggagtccttctggcgtggctgcagctgttgtgaagtgcacaggcggttatcctgcagggcgtgcccagt

SEQ ID NO: 37065 - DNA, 201 bp, Homo sapiens
gaccaagtgagctgtcttgcagaacgtcccgtgttccgggcttacctggttgcttcttcatgttgttgaacttgttgctttatcccccgtagttcttgaaygccgggagcgacggctgaaagctgtttgattctggatctcagcatgaacacttcattgtcagtgctgtgtgcttcacagcccaccacctcaggaggcgcg

SEQ ID NO: 37066 - DNA, 201 bp, Homo sapiens
tctggctgacccttccagtgtttttactgatttgttttttcaaaaataagcaaacatttacattttattttccctgttttctaattcagtggtaacatacmaaatacactcttctgctccctgcttttttcagttaatgtcatagcccaagtttggctgcgcagacgtcgcctgtgcccgtctctacggtagctgcgtcat

SEQ ID NO: 37067 - DNA, 201 bp, Homo sapiens
agaccatggggccatctgtgtccggattttagaggccttgagagcacgcatgcatgcggggatctgtgtgggacctgagtgcagtctgggcagtgacactrgtgtggctgttccccactggcatgtccagccaaataagcaaagtcccttaggacccctggccaccaccactggagtcttgcctcctccttcgctcccagg

SEQ ID NO: 37068 - DNA, 201 bp, Homo sapiens
gttcaaataccctattcttcatcagactttgacgcactaggtgtcagtgtgcactgatgacctggcccgagttggttggtagtgggatgcttgcctgccayggattttccaattccatcattccttctctgttgattactggtattttaagtaaggtagagctgtgccttcaccccattcacctatttactttttatatcc

SEQ ID NO: 37069 - DNA, 201 bp, Homo sapiens
gctccctgcttttttcagttaatgtcatagcccaagtttggctgcgcagacgtcgcctgtgcccgtctctacggtagctgcgtcatgctctgtgggctgcrcagacgtcacctgtgcccgtctctacggtagctgcgtcatgctctgtgggctgcatagatgtcgcctgtgcccgtttctacggtagccgcatcatgctct

SEQ ID NO: 37070 - DNA, 201 bp, Homo sapiens
aggccttgggcccggcacccacagaggcaccctcagagcctcgcgggtctcctccggctgcaccttcctccccgcccattccctcgggcctttgtgctaaycacatcttggctttctgttctggttctaccgcctatcgatgcatctctaaacagtataggcttgcctgcttttgacctatctttaaatgaagtcgtactt

SEQ ID NO: 37071 - DNA, 201 bp, Homo sapiens
ggcacatccatctgtgcccttcagctggcggggaacctgctggacaagctggtgcttctgtgctgctgcccacgggacacccacacgattggattgtcctygtgaggcccagtggccggtgggaatgcgtgagaaggatcagtcttgccattgtcaaccctttttacaggatttggcttggcaaggccgttttcctctgca

SEQ ID NO: 37072 - DNA, 201 bp, Homo sapiens
gaatgtgagttcctgtcttgcatcaggggctcattaaaagtgggtgtattttcttcttcttctttttttttttcccctggagagcccactgtacccttttyttgggttcaagacctggagccttctcgattttctcttttattgttgatttggccccaaaggcccctctgcacttcctccagggcatttgtatttcatcct

SEQ ID NO: 37073 - DNA, 201 bp, Homo sapiens
gattggctgtttatcctttctgagtctcagtgttctcatctgtaagatggcgataatgatgattctcatttggcagagttgttggaatagtaaccatagawtgtgagttcctgtcttgcatcaggggctcattaaaagtgggtgtattttcttcttcttctttttttttttcccctggagagcccactgtacccttttctt

SEQ ID NO: 37074 - DNA, 201 bp, Homo sapiens
cggttctcaaccaagaaacacacgaaaagggtttcacactttttcacgacaccccccaactccagtgcctggctcagcccccaggtgttgactagcacctmcaaagcatttgctgactggcgcagggaaaaaaaaaatggccctgggtgtcaacagggaagcccctaccatgctgctctcgagggatgtgctgcggcccga

SEQ ID NO: 37075 - DNA, 201 bp, Homo sapiens
agcactgttgatttcccctctccaggtgacttctgtgataactcatacaccgatgtgctttgttttaattctaggcagcttcggtcacctctctgtccaamctggcatgcatgcacatggtccgctgggctgtttggaaccccttgctggaagctgattctggaagggtgaccctgcctctgcagggtgggatccagccca

SEQ ID NO: 37076 - DNA, 201 bp, Homo sapiens
gtggatgtgtatgcatgtgggtggatatgtgtgcatgtatgtgtgcattgtgtgcatgtgggtgcgtgtgtgtgcatgtgtgggcggatatgtgtgcattgtgcgtgtgtgcatgtgggtgcatgcatgtgtgcatgtgtgggtgcatgcatgtgggcatgcatgtgtgtgcgtgtgggggcatgtgtgcatgtatgtgtg

SEQ ID NO: 37077 - DNA, 201 bp, Homo sapiens
cctttcgcaggaaaacacgtggtgcaagcacagaagctggcggacgtggacagtgagctggctgccatgctactgacccatgcccggcagggcaaggggcsccaggacgtcagccgcgagtcggatgccacccgcaggcgtaagctggagcggatgaggtctgtgcgcctgcaggaggccgggggagacttgggccggcgc

SEQ ID NO: 37078 - DNA, 201 bp, Homo sapiens
gtattgggcaccacgatatgttaggaaccgtgcagatgacacagagttgactctgccctatactgtgtcttcaggaagctctcagtggattcttatttgartagactggatgtgaagtagcatagaggtggtgggagggtggttaggatctggcattctggaaagaagcccaagccagcgacggttctgggagccacggga

SEQ ID NO: 37079 - DNA, 201 bp, Homo sapiens
tggtgtgtgtgtatgtgcatccatgtttgtatttgtgcatctgtgtacatgtatggatgcatgcatgcatgtgggtgtgcatgtgtgtgtgtgtgtgtgtkcatgtgggtggatgtgtatgcatgtgggtggatatgtgtgcatgtatgtgtgcattgtgtgcatgtgggtgcgtgtgtgtgcatgtgtgggcggatatgt

SEQ ID NO: 37080 - DNA, 201 bp, Homo sapiens
tgggtggtgtgtgtgtatgtgcatccatgtttgtatttgtgcatctgtgtacatgtatggatgcatgcatgcatgtgggtgtgcatgtgtgtgtgtgtgtstgtgcatgtgggtggatgtgtatgcatgtgggtggatatgtgtgcatgtatgtgtgcattgtgtgcatgtgggtgcgtgtgtgtgcatgtgtgggcggat

SEQ ID NO: 37081 - DNA, 201 bp, Homo sapiens
tgtgggtggtgtgtgtgtatgtgcatccatgtttgtatttgtgcatctgtgtacatgtatggatgcatgcatgcatgtgggtgtgcatgtgtgtgtgtgtgtgtgtgcatgtgggtggatgtgtatgcatgtgggtggatatgtgtgcatgtatgtgtgcattgtgtgcatgtgggtgcgtgtgtgtgcatgtgtgggcgg

SEQ ID NO: 37082 - DNA, 201 bp, Homo sapiens
attttatgctggtattatatctgttttttaaattgttgaacaaaatactaaacttttacacgtcttcccttggcagttttcttgagtgtctgctggcgcaktgtcagaggcttcctgtctacagcacaagcccggtttctccttgaggagacatggtgggggccggtcaggcagcccatgccatgtgtcctcatggagagg

SEQ ID NO: 37083 - DNA, 201 bp, Homo sapiens
ggctgcagagcccgatggctgctcctgtgctcttgctgttgctcggcagagggcaggcatgtcctgaacattgtcacaacaaaagcaagaagctggcttcrtgtcccagcgagctgcttccacagagggaggctctatggctctaggaggccaactcgggccctgtgtgcctgtctgtttgcagctggggagggctgattt

SEQ ID NO: 37084 - DNA, 201 bp, Homo sapiens
tgtgcgtgcatgtgtgggtggtgtgtgtgtatgtgcatccatgtttgtatttgtgcatctgtgtacatgtatggatgcatgcatgcatgtgggtgtgcatstgtgtgtgtgtgtgtgtgcatgtgggtggatgtgtatgcatgtgggtggatatgtgtgcatgtatgtgtgcattgtgtgcatgtgggtgcgtgtgtgtgc

SEQ ID NO: 37085 - DNA, 201 bp, Homo sapiens
cccccacaacacacagcacacggtgactgtggagatcgacaaccccgagctcaggtgaggtctcagtggtgcccgtcctgccccagcccagatctgtgtcrggtgcagccggcacccctgctgagctggctcgaattctgcccgagagccagggcgatttgacttctctctcccactcctctgagcaccgctctcggtggg

SEQ ID NO: 37086 - DNA, 201 bp, Homo sapiens
gttgattcacccctgtcctcctttgagtctttccttactgcccagcacagcaagacgccccaggctcagcttgcatttcaggagtgtcagctatttagctygggttcctttggttggagaatgatatttagaaaccaagatttgagcgttagatgtactcagtactactgggatgtcactgctgctaagtccctctcagca

SEQ ID NO: 37087 - DNA, 201 bp, Homo sapiens
gttattttgaaataatttagaacttagggaagagttacaggaagagtgcagagtccccacatagggttttcccagacttcccggtcactaacctttgccaygtttgcctcgccactctctgtttgtgcatttttcttgaacaatttgagaataaattatcaggtaatgccctttactccatgacacttcgagctgggttat

SEQ ID NO: 37088 - DNA, 201 bp, Homo sapiens
gggccaaggatgcagcgtctgggtgcactgtgggtggaggcgggaccctgggccaaggcccctctcaggctgcctggtcatgtcctctcggttcccacacrtgccgggagcatgcagggggtgaaccattagcacaacccttctcaaactttttggtctcagatccctttaccctttaaaagattattgaggaccccaaag

SEQ ID NO: 37089 - DNA, 201 bp, Homo sapiens
cctcctgtggcctggtcctctggggctttccctgcacagcctcctgtctgcccacgctcctggcagcccttgttggcctctcgtgggccggtgctgagtcytccgggacaagtgcagatggctcccatcccactgcagggatcgctggctggcgacacccacacagacgtggcaggtctacctccactccctgcagcgcgt

SEQ ID NO: 37090 - DNA, 201 bp, Homo sapiens
ttctgagcctctccccaaccccagcctggagacgggcagtgggcattcagctggagcacagtgggtggccctgacagcagcttttccagcgcctccagcgygcagacgctgttaccagaggcctctcggcagttgcctttcgttagatgtgccattgtggggtgagtgacgtacacaccaaccccaaaggccggtgttcag

SEQ ID NO: 37091 - DNA, 201 bp, Homo sapiens
ccatcccctatgcaaacacacattagacccctcaggttctgtgccatggatactcagttaacccagagctgttgttggattcagagtggcccaggactgcygaggaacatcatggccaaagactgtgtatttcaccttccagttctaccgcttcccacccgcaacgacgccacgactgcagctggtccagctggatgaggc

SEQ ID NO: 37092 - DNA, 201 bp, Homo sapiens
ctctctcccactcctctgagcaccgctctcggtgggtgggaccgcagcctcctgtgggtcctcctgggaagaactgccctgacgcctggacactgcctccyccagcgtcatcgtggacagtcaggagtggagggacttcaagggtgctgctggcctgcacacaccggtggaggaggacatgttccacctgcgtggcagcct

SEQ ID NO: 37093 - DNA, 201 bp, Homo sapiens
tgttggattcagagtggcccaggactgccgaggaacatcatggccaaagactgtgtatttcaccttccagttctaccgcttcccacccgcaacgacgccaygactgcagctggtccagctggatgaggccggccagcccagctctggcgccctgacccacatcctcgtgcctgtgagcagagatggcacctttgatgctgg

SEQ ID NO: 37094 - DNA, 201 bp, Homo sapiens
agaaggccatccgcctgccgccctggcacacatttccaggcaggtcctgcactgaccctgcagcccacatgttgcaggctcacctgttggaagtagatacytcttgagggtgacagatggcctcatggcttcatgccctggtgctgtcagagcagcacgtggggcctggggaattctctctcctgcctttatggtttgaaa

SEQ ID NO: 37095 - DNA, 201 bp, Homo sapiens
gctgaggtacatggtgggccctgggttcctgaagccaggtgagcggcgctgctttgcccgctacctggccgtgcagaccctgcagattgacgtctgggacrgagactccctgctgctcatcggatctgctgccgtccagatgaaggtagcggctctctggaaggacaggcacagtgggtgctgcgtccctcatgggacgag

SEQ ID NO: 37096 - DNA, 201 bp, Homo sapiens
cggctccagcctctgaacgcgcttttctcttctgcagcatctcctccgccaaggccggccggctgtgcaggcctcccacgagcttgaggtcgtggcaactkaatacgagcaggacaacatggtggtgagtggagacatgctggggtttggccgcgtcaagcccatcggcgtccactcggtggtgaagggccggctgcacct

SEQ ID NO: 37097 - DNA, 201 bp, Homo sapiens
cctctgaacgcgcttttctcttctgcagcatctcctccgccaaggccggccggctgtgcaggcctcccacgagcttgaggtcgtggcaactgaatacgagyaggacaacatggtggtgagtggagacatgctggggtttggccgcgtcaagcccatcggcgtccactcggtggtgaagggccggctgcacctgactttggc

SEQ ID NO: 37098 - DNA, 201 bp, Homo sapiens
ctcatttggggttcatgtcttatgttgggatgtttttcatgtaggtcacccgtgtgaacagaaagtgagaggttgtagcacattgccaccgtccagatctygggtcatctcaaacgatggagccagccgcttctctggaggcagcctcctcacgactggaagctcaaggcgtgagtttacactgttgggcccatgtgtggg

SEQ ID NO: 37099 - DNA, 201 bp, Homo sapiens
cccctggcactactgttcttttgactgtttccatgttgcctcttccagaatgtcatacagctggaattatgtagtatgtagcttttcaaaactggtttctyccccccagcactgtgcatttagttcctccatggctttttgtgtctcgctcactcacgtattggattgctgaatgatacttcattgcacgtatgtgccaca

SEQ ID NO: 37100 - DNA, 201 bp, Homo sapiens
tcaggtgaggtctcagtggtgcccgtcctgccccagcccagatctgtgtcgggtgcagccggcacccctgctgagctggctcgaattctgcccgagagccrgggcgatttgacttctctctcccactcctctgagcaccgctctcggtgggtgggaccgcagcctcctgtgggtcctcctgggaagaactgccctgacgcc

SEQ ID NO: 37101 - DNA, 201 bp, Homo sapiens
cgtgcggggggccagactcgtgtctgtgaagagtctctcaggaataggcagggatgctgtgtggacctccgtgtcagggacacagccagcagatctctgtycagcactgcctgagatccatgcctgggcggggccggccagttccacccagaccacatggtcaaggaagggggtggtggtggcgatgcttgtggagaaatg

SEQ ID NO: 37102 - DNA, 201 bp, Homo sapiens
gaggccattcttttctcttgtttgaaacttctgattctccaccgtgcggggggccagactcgtgtctgtgaagagtctctcaggaataggcagggatgctrtgtggacctccgtgtcagggacacagccagcagatctctgtccagcactgcctgagatccatgcctgggcggggccggccagttccacccagaccacatg

SEQ ID NO: 37103 - DNA, 201 bp, Homo sapiens
aggcagcctctagtgggccttactttttcttgtaagtcccacaggaaaaacaggccagtctccaacctgtagaacccatgtgtgctggccaagccccttgmgtccctgcggcatcagagcaagggggtggctgagccttgctgaggcagcgtgctgcttgcctggactctgacccggtgtgaccgagactcagcaggccgg

SEQ ID NO: 37104 - DNA, 201 bp, Homo sapiens
tcctcttctgagatcgcgggtggtgggcagccagcagtagccccttgtggaggagagtgtgcctgggaccctgtccacccatgtcctcttgtctgcaggcrcagcagagcgtccgcacacagcacttgcgggacctacaggtcatcgccgcctaccgggaacgcacgaaggccgagagcatcgccagcctgctgagcctgg

SEQ ID NO: 37105 - DNA, 201 bp, Homo sapiens
ggagctttgtggacggactggcaagcttctgagcccctcacctgtgctctctttccttccagttgtcaatttcccagctggcggcctccccgcggtccccractcagcactgcttggccaggcctacttcacagctaccccatggctctcaggcctccccggcccaggcagtaagtgccgcccacctgccgccttgccttc

SEQ ID NO: 37106 - DNA, 201 bp, Homo sapiens
taccgggaacgcacgaaggccgagagcatcgccagcctgctgagcctggccatcaccacggagcacacgctccacgccacgctgggggtcgccgagttctytgagtttgtgcttaagaacccccacaacacacagcacacggtgactgtggagatcgacaaccccgagctcaggtgaggtctcagtggtgcccgtcctgcc

SEQ ID NO: 37107 - DNA, 201 bp, Homo sapiens
attgttcacgccagtcacattaccattggttgaggggtcgtcggacatgcaaatcaggatgggcccgccgccgcaccgattggctggcgctcgcaaagcgyagccctcgacttgggctctgattggctccgcggccctgacggcgacagtgacgcgaggcgggttcttggactgagtgtgcggcgcggtgcgccgccttcc

SEQ ID NO: 37108 - DNA, 201 bp, Homo sapiens
aaggctgtgctcctacagcatttccagggtttggttttctcaactcactggccttcatcattacgtttatggccaaccaggggtgtggcctttgtctttgkgggagggggctggtcaccaccagggcggttccaaccttcctgaatcacttcaactaagccaaccacctttcctttttcagtcctcctgaggcctttggta

SEQ ID NO: 37109 - DNA, 201 bp, Homo sapiens
gctgggccatgaggtgtccatgtggcctggggaggggttgcagaagcagcacaaatgccagctgggctgaggcggggctgggcaggtacaggtggccctgkgaggaggctgctggctctttaggcagcccctggatgcttgggaggcagctgtggccttataaagggccaaggcagttctcagtccctggctccaggggga

SEQ ID NO: 37110 - DNA, 201 bp, Homo sapiens
aacaaacaaacaaacaaacaaaaaagaaaaattaaaacattttttaaattgtaactttaccagagaaggttattaaagatcaatgcctttcacttgaggcrgaacagagcaccacttcactctccctagaaaagtccttttcctgtttgtggtgtttctaacattctctgttaattggctggtttgactggaagcaccttt

SEQ ID NO: 37111 - DNA, 201 bp, Homo sapiens
cgctgcagcgacccgaacgtcatctgtgagacccagaatgtggtaggttgtgttgtggccccagctcaggcagatccttcccagtgagtctgcgcccctgycggcttccccacgggtatcctgggatcctcttcattttaggttttctgctaagtggtttctttcccaaggtactaaagggctattttgacatccttatga

SEQ ID NO: 37112 - DNA, 201 bp, Homo sapiens
tctgttggtgtttcttgtggtggaattcctagggaatggaaagttcctggagcggaagcagacatctgatgccctggttgttgggtgctctggaataaagrgctccgacaccaacatttcagtctgagggagttacctcagtgtgcctgcttccctggcatcctgcagagatgtggtacaccacatgagggcatggtagag

SEQ ID NO: 37113 - DNA, 201 bp, Homo sapiens
gggggtgtcagctactgggacattggcaagaacgaaattaattcccctggaaagagatggctgggtaagcgcaccactgagagatggctgggtaagcgcgycactgagagatggctgggtaagcgcgccactgagagatggctgggtaagcgcgccactgagagatggctgggtaagcgcgccactgagagatggctgggt

SEQ ID NO: 37114 - DNA, 201 bp, Homo sapiens
gagggtctgagagcaacagggagaggaccgaaatagcccttgttctaggtgctcgttcccaggaagctggcttggagtgaggactgagtggacgctgcagstgccaggaggcggttggtagcccgaaggcagaagcacagtgtagggcatgtgggcgacatggaggctgcgtctttatggggatgtagcagggacctgggc

SEQ ID NO: 37115 - DNA, 201 bp, Homo sapiens
cttcctttcccctgccttttggggccatctgtttacccctgtttgtaacagggccacagtctacccccaaggcccaaggcccaaggcccaaggcctggcccgtccctgccttccaccagctgccatgagttgctaagcaacagcctctgcgtgctgccccctctccctcctccctcaggacttctctctcccacggaattg

SEQ ID NO: 37116 - DNA, 201 bp, Homo sapiens
ctctcaaagtgctgggattgcagatgtgagtcactgcacccggccagcaataaagtatttttaaattaaggtaggtacagtacttttttttttttttttttagacatatgctattacacacctattgactacagtatagtataaatacaacttttaaatgcactgggaaaccaaaaaattcagtgacttgctttattgtag

SEQ ID NO: 37117 - DNA, 201 bp, Homo sapiens
tgcagggcagccctcgagagcctccatggtgctcctgcagtcctccggctttcccgagattctggatgccaataaacagccagccgaggctgtcagcgctrcagaacctgtgacgtttaaccctcagaaggaagaatcagattgtctacaaagcaacgagatggtgctacagtttcttgcctttagcaggtaaatccttga

SEQ ID NO: 37118 - DNA, 201 bp, Homo sapiens
atctgagtcaccagggactggtggccaaggagcttgctaagctgcaccaggacccctgagggctgggcaggtgccacaccctacaagcctgctgggcacaycgatatctcaggaccctcggcccacccaggccccaagactccacaattcttacacagaacgtaaagcactacgcagccaacctatgcagggcaaccaaca

SEQ ID NO: 37119 - DNA, 201 bp, Homo sapiens
tgccctgtctgttaatgtaccatggccatactgttttaattttggaggctctgttgtgtgttttagcatttggtaaggcaagttcagctttatggttcttsttttccttgcttttctagcttttcttgcatgtttattttctggattaacttttgtatcaagaggtctagctccaaaaaatgctgattggcattttaaaaa

SEQ ID NO: 37120 - DNA, 201 bp, Homo sapiens
ggtgctgaatctggggtcctgcgccccctcgctgctcctgggagcccagctctgcttcccctctcaacagaggctgcctccttggcagcagctggcccacyggatgcagcagatacctgcctcatcctctattttcctctcctccccgggctctggaagaatccagggttccctactgtctgtcttgaccttcatcttccc

SEQ ID NO: 37121 - DNA, 201 bp, Homo sapiens
catgacaaaataaccctctccccaaatctctaaggggtgaagatttgcctgatttattgtttatgtattaactcatattcttggaacaaaatcaatggccyatgttccagggtctgttgaactgatccatgtgtgtccctgatggcctttcctccagtaccgtgtccagttcaggatcatgtcttgtgtctggtttctgtg

SEQ ID NO: 37122 - DNA, 201 bp, Homo sapiens
tgaacgtagtctctctctctctacctctcaactgcaatgggtgggtggtgtctacagtgtggatatgcgggacggagggatgattcacgccctggggggggacaatgccagatctaatcacactgctcagagtggcacgcaatttaggacttagggattgttttcttctggagttttctgtttaatattttcagaccaagg

SEQ ID NO: 37123 - DNA, 201 bp, Homo sapiens
tgaatgagctggacttgtttgctccctacccgttcttgaaaatgcagttctacataatatggtcttatgtaaacacaaagcagagaataggattgaaacascaacatccgtttccttggtgtagttcctgctgttttcttgtttgtcagggcggattgtgtgagggtagagttgttttaggaatatcattgttgaatttta

SEQ ID NO: 37124 - DNA, 201 bp, Homo sapiens
gcttgaactcgggaggcggaggttgcagtgagccgagatcatgccactgcactgcagcctgggtgacagcaagattctgtctcaaaaaaaaaaaaaaaaaagaaaagaaaaggttggaaaccccgttgcagtgggcgtccgcccttcccctgagcatgtgcgtgaattcttagggcaaaatcctgaagctggtggctgggt

SEQ ID NO: 37125 - DNA, 201 bp, Homo sapiens
ggctcggctgggagcttgggcagtgatcttggttgtggagtaggacgggggctcggctgggagcttgggcagtgatcttggttgtcgagtaggacgggggytcggctgggagcttgtgtgttacttgtgttctgtgacctttcctgggggaggcaggcgtcaggacagatggccccacaggctaagcgtctgtgttctcac

SEQ ID NO: 37126 - DNA, 201 bp, Homo sapiens
gtggagtaggacgggggctcggctgggagcttgggcagtgatcttggttgtggagtaggacgggggctcggctgggagcttgggcagtgatcttggttgtsgagtaggacgggggttcggctgggagcttgtgtgttacttgtgttctgtgacctttcctgggggaggcaggcgtcaggacagatggccccacaggctaag

SEQ ID NO: 37127 - DNA, 201 bp, Homo sapiens
gggggtttggctgggagcttgggcagtgatcttggttgtggagtaggatgggggtttggcagggagcttgggcagtgatcttggttgtggagtaggacggstgggagcttgggcagtgatcttggttgtggagtaggacgggggctcggctgggagcttgggcagtgatcttggttgtggagtaggacgggggctcggctg

SEQ ID NO: 37128 - DNA, 201 bp, Homo sapiens
caggcccgagggcactcaacactgcctcgtcggaattaaggaaattgatggcacaagcattttgtgcgtaccctgggtggttcattttgggacacagcttygttggcggtgctctgcctcgccccttggggaagtaaaggccacaccgaggttgtgggtcccatccttgcaggagagtgtgccgtgggcaagcacggcttc

SEQ ID NO: 37129 - DNA, 201 bp, Homo sapiens
gtcgagtaggacgggtttggctgggagcttgggcagttatcttggtcgtggagtaggacaggggctcggctgggagcttgggcagttatcttggttgtggmgtaggatgggggtttggctgggagcttgggcagtgatcttggttgtggagtaggatgggggtttggcagggagcttgggcagtgatcttggttgtggagt

SEQ ID NO: 37130 - DNA, 201 bp, Homo sapiens
cttggttgtggagtaggacgggttcggctgggagcttgggcagtgatcttggttgtcgagtaggacgggtttggctgggagcttgggcagttatcttggtygtggagtaggacaggggctcggctgggagcttgggcagttatcttggttgtggagtaggatgggggtttggctgggagcttgggcagtgatcttggttgt

SEQ ID NO: 37131 - DNA, 201 bp, Homo sapiens
ctcggctgggagcttgggcagtgatcttggttgcggcgtaggatgggctcggctgggagcttgggcagtgatcttggttgtggagtaggacgggttcggcwgggagcttgggcagtgatcttggttgtcgagtaggacgggtttggctgggagcttgggcagttatcttggtcgtggagtaggacaggggctcggctggga

SEQ ID NO: 37132 - DNA, 201 bp, Homo sapiens
gccggggttttaagcccaagatggcttcagttctgtctgcggaggcagcgcttagggaatagtcgccgtgtgagaggagggacttgcctggtgtggacccragtcgcggccacagtcatgtcagggttggttgtggcctcagatttggccgccccggaaccacccatgaccttgggctcccctggctgattgggctgcagg

SEQ ID NO: 37133 - DNA, 201 bp, Homo sapiens
gccctggtgtctgctcctggaaggcagacactgcacatctacctgactcgcgctctgaccctttcgcaggaaaacacgtggtgcaagcacagaagctggcrgacgtggacagtgagctggctgccatgctactgacccatgcccggcagggcaaggggccccaggacgtcagccgcgagtcggatgccacccgcaggcgta

SEQ ID NO: 37134 - DNA, 201 bp, Homo sapiens
cccaggacgtcagccgcgagtcggatgccacccgcaggcgtaagctggagcggatgaggtctgtgcgcctgcaggaggccgggggagacttgggccggcgygggacgagcgtgttggtaagggtttgttcagctgtcactgtcctgggatctccatgcagactgagtcactgtgcacgtcctttccctgcctcccacatga

SEQ ID NO: 37135 - DNA, 201 bp, Homo sapiens
agagggaggctggccttcatctgagttccccaggatgtggcagaggacaagagggcccagcatctgctcaggcccatgagacagggagtctcacgcatctsccaagcccaggcaggcaggaaagcctcgagccagtgggcagtgacaggacgaagcccaggtgtgccaccccatctcccccagtgtgctctctcctgggga

SEQ ID NO: 37136 - DNA, 201 bp, Homo sapiens
gtccctgtaagagcccccaggacaaatgccaggaggagggacaccaggatgcggctggttggcggggtgggaaggtgggcaggtaccccggctgctgctamtgccgcaggacgcggtgcagcagtggggtctttgcatcctgggagcagcagcaggtagggaggtgcggaagtgctttgtgccaaggcctggcaggaggga

SEQ ID NO: 37137 - DNA, 201 bp, Homo sapiens
aaccagccggactctcctatctctgcttcccaggacaaaaggtacctgccttgtttctacaaccctggggttttccagcgtctgtctttttttttttttttgagacagattctcactctgtcaaccaggctagagtgcagtggtgtaatgtcggctcactgcaacctccgcttcctgggttcgagcgattctcgtgcctca

SEQ ID NO: 37138 - DNA, 201 bp, Homo sapiens
caggtaccccggctgctgctaatgccgcaggacgcggtgcagcagtggggtctttgcatcctgggagcagcagcaggtagggaggtgcggaagtgctttgygccaaggcctggcaggagggagaagcttaagataggagtaggggctcagggtcagaagtggcggtgtgtgtgctgtaaacagcccgaggaactggtgcag

SEQ ID NO: 37139 - DNA, 201 bp, Homo sapiens
tgaatatcatctacttggcttacatcttgagaaatcttttaataaaatgatctcaaggtgattttcggcataaaaagactttagtcttttgggctctgaaycggggataattacttagcacctaaagaaattcaaggattcttcttgttaatagtttaaatacagttcagatggaactcaaaatggttacgcacgaagcag

SEQ ID NO: 37140 - DNA, 201 bp, Homo sapiens
gtagggtggtccacgccgtccctgcgtgggggcccggtgcctggggtgcggcggtggcgcgcggcgggggctgtccccgcgttagtcgcaggcgtcccccstcgtcgggacacttggggtcggggccgctgggtgccgtttggctacgtgggttcctttctgcccttgccctttgccccctgccccctgccccctgccccc

SEQ ID NO: 37141 - DNA, 201 bp, Homo sapiens
cgcgtaatcccagctacttgggaggctgaggctagagaatcacctgagctcggcgggtggaggttgcagtgagctgagattcacgccactgcactccagcstgggtgatagagcaagactctgtcaaaaaaaagaaaaaccaaacaaaaaaaaaccctacaaattaggttcagtggatactgctcgggtgatgggtgcacc

SEQ ID NO: 37142 - DNA, 201 bp, Homo sapiens
ttttgataatgatttgggaggaaaatggtgccttgttttcattcgcatttccttgcctcttggagaagctgacatggtttcttgtatttgttggctgttcyctaaaggagacttctcatatcttctcagtctcccagtgactgaggttccggaatcatcgatgtctatgcagtgatcgtatgcagtgtagacgagtgtggc

SEQ ID NO: 37143 - DNA, 201 bp, Homo sapiens
tgaaatgagaggatgaaagaaaatggttttcagaaggagaaatgattggtctctgtgacgtttccagtgtttaattgtacagtgattgaactgtcagtcayctggggacaatggaaagctgtaagtttgtcaattttgttgttgtgtgttcacagcagcatagtgtgggatctttcttttctaagagatggggtctcacta

SEQ ID NO: 37144 - DNA, 201 bp, Homo sapiens
ccctttgccccctgccccctgccccctgccccctgccccctggcctctctgcagcccctcggctgaagggagcgcggtaccgatgttctgggccttggctscccgcgccctagtccgcgcgcatccttcccaggccggagtccgcggaccccgcctggccgcgcccctccgcccctcctccccgccccccggctccagctc

SEQ ID NO: 37145 - DNA, 201 bp, Homo sapiens
aggattgcttgagctcaggagtttgagaccagtcatggcagcctagtgagacccccatctcttaaaaagcagcgttttggggaatttctgaatcatttggragagcgtgcagtgttacatggtggacttgctgttgcagcagcacccctgtgtcccccagggtgtccccttgactgttctgacagtggtcgacgtggatgc

SEQ ID NO: 37146 - DNA, 201 bp, Homo sapiens
aggtgcccccagagggctctgcccggtgtcccatgaagaatgaggattaccaggtggctggagggaacagcgctatgtctgcctgccctgtgaagaccagsccctattccctgtaatcctctctggtggttctttctcttttggccttaggaagtttcctgatccgcgctctactgaatgctagggtgggaccctctgtaa

SEQ ID NO: 37147 - DNA, 201 bp, Homo sapiens
aagaggaggacactgaggtgcatggagatggaataactccaccagcttattcccatgtggcgggtgggggtgggagcgacggccctgtgcatctgacggcwccacctgctgtggcctccgtgacctcctgcttctgaggagccctgcattttgttctgaagtgttctgtagaatgctgagggatggagtatgctctgaaac

SEQ ID NO: 37148 - DNA, 201 bp, Homo sapiens
tttgaagaatgaagtccaggtttacttggttttagtaaatttagaaggatccatgcagacagcatttatgttaacattttattctctataatgtttttatratgtgctttctccttccccttgcatttgaatatctgaatgttgatttgatttgcttctagtaatttggagttttgatttgtatttaatcatgggggtcat

SEQ ID NO: 37149 - DNA, 201 bp, Homo sapiens; identical to SEQ ID NO: 7926

SEQ ID NO: 37150 - DNA, 201 bp, Homo sapiens
tatggtaataatgaaactggtggttttcttttcttccccctcacagtatctcagagatgttaactgtcctttcaagattcaagatcgacaagaagctattsactggcttcttggtttagctgttagacttgaatatggagataatggtacgttttgtggggaatgtgtattttaaagagagaggaaagatgggaaagggag

SEQ ID NO: 37151 - DNA, 201 bp, Homo sapiens
ttattcttatcacaagttaaaagcacttttattgtctttcattggtgtttatatatttctgttagaatttggaaatggtgccctctggagaaggctaattractgtcttctcacagagtaacactactttgataatatggtctgcaccttagcctttcaaattaaattgtttttagtgtcccagaattgatgggactttga

SEQ ID NO: 37152 - DNA, 201 bp, Homo sapiens
tctcttgtaagttttcccatctctaatttacttgtttaaatcagtatagatacatggatttttattttattcaatggattataatcctttctgtcatcacrtattttgctgttgatactgttccagatttggccagtggaagcctttttaactctgacttaaattttatgcttttattttttcctcgtttcattaacagat

SEQ ID NO: 37153 - DNA, 201 bp, Homo sapiens
tatctctgaaagacactgttttcttttaaaggttcttactggctcgttgtatatgaatcgagccactggaagttgggttaaagatcagcttatttcacccwcactatagaacagacagtaaattgttctggtgtaataaagtcattcattcattcattcattccttcagcaaaactatgctttggaaggcagtgtaagtaa

SEQ ID NO: 37154 - DNA, 201 bp, Homo sapiens; identical to SEQ ID NO: 7923

SEQ ID NO: 37155 - DNA, 201 bp, Homo sapiens
gccaggagtattataatatctcccattagtgtcaccttctgttcttaactgcatggccaaccaagctaactttctgaaacgttaatctattttaggatgcmacttactccttgtttccaaagaacagttccagttacatattcatattaataaacatacatatccataaacactaatttcccattttctataaaaagaatt

SEQ ID NO: 37156 - DNA, 201 bp, Homo sapiens
attattaaatgtcagttttaacaagactgttgtattcctaagttattaaaattttctatactgaatctgaatgttaacttggattttctcaatccagattrcatgccaaaagacaaaaatgtttttagtgaaatttagctatttcaaaggcttgttctttattccgacaattatgtaaattgccttggaactgttctatag

SEQ ID NO: 37157 - DNA, 201 bp, Homo sapiens
cagttacatattcatattaataaacatacatatccataaacactaatttcccattttctataaaaagaattttaagctccttagcatggtagttaatgatractgatatccaacctgtattcacatcttgacatcccagctaaattagaataatagtgcttcctgtttatatcccatttccccctctgtttctttgttcac

SEQ ID NO: 37158 - DNA, 201 bp, Homo sapiens
tttatttaattgttgatagtctacagggctttcttttttctcttgtgagtagcagttttaaaaactaagagatttgttgctaccgaaaagttaaaaatgtwtttgtatgttcacaaatatgtttgtaattatacgtttgcagggttgtaagtttttgtttgtttttaatcttttatagtaaataatcctgattttaaggct

SEQ ID NO: 37159 - DNA, 201 bp, Homo sapiens
tacagtaataggaaaaccattttatcttaccaatttatttaattgttgatagtctacagggctttcttttttctcttgtgagtagcagttttaaaaactamgagatttgttgctaccgaaaagttaaaaatgtttttgtatgttcacaaatatgtttgtaattatacgtttgcagggttgtaagtttttgtttgtttttaa

SEQ ID NO: 37160 - DNA, 201 bp, Homo sapiens
tcaatattgtgtctgtcacagtacctgacatagtttcttgcacacaacaggtgcttatcaatttcagtaatgtgtggcgaatgcagtatatgtgagtgttwacatacactgatttggagcatcagccaattttttgctgatgcctcagacttaaatttcagaagccttatggcaaaaatcttaaggaaagctcaatttgag

SEQ ID NO: 37161 - DNA, 201 bp, Homo sapiens
atctgtttaagatatccattctacgttctacaacttagagaaaggatagcttacttcagtgcttcctaaagcaaattgaatgtattcagtggctagggggkcatttttgagtgaaaaacttcatgttcctctcactttgtaccttaaaaaagccacaaatagctcatgcacagtccacaaatcatgcttgtggcccgttga

SEQ ID NO: 37162 - DNA, 201 bp, Homo sapiens
ttgaacataaaaatgaattttgtgtttagacttcagtcccatccccaaaatatcccattttatatatgcagataatccgaagtctgaaaaaatttaaaatyggaaattattggcatttccagtaagggaaactcaacctgtaatcattttggctcagttaaatttggtaaatagcagtagtcattttaccttgagttgcag

SEQ ID NO: 37163 - DNA, 201 bp, Homo sapiens
tctctgaaagacactgttttcttttaaaggttcttactggctcgttgtatatgaatcgagccactggaagttgggttaaagatcagcttatttcacccacmctatagaacagacagtaaattgttctggtgtaataaagtcattcattcattcattcattccttcagcaaaactatgctttggaaggcagtgtaagtaaag

SEQ ID NO: 37164 - DNA, 201 bp, Homo sapiens
agggaaaatgtttatcttgatttctgctacagcaacactgaagccagaggtgtctgagctttggctaatgtcacttgatgtaggtcagccctactgtgagygtcaaccctggtttctaaatgtgctgctggaggaatcccacttcacttccagtttaagtgtcagctgaggcctcgcctgatcatttgattcagagtagcc

SEQ ID NO: 37165 - DNA, 201 bp, Homo sapiens
tttattattttagaatgagaaggccaacattagcctcactgggttcatgtcaagttgtcagcaaggcaggttccttttggaggctctcgggggaatctgtktctttccttttttaacttctagaggctgcctgaattccttgactctggccccttcttccttcttcaagtctagcagcatagcattttccagtctcttatc

SEQ ID NO: 37166 - DNA, 201 bp, Homo sapiens
ctgatgttcttttgtggttttacattgatatgttgcctccttgacttttaagttacttattttaaaatttgctgaaaccattgtgagtttttattatttgygctctactattttttgaagccttttggtagcttgtcaacatgatcaataactgaaattttttaaatgtataatttcagatgtatagaaaaattacaaaat

SEQ ID NO: 37167 - DNA, 201 bp, Homo sapiens
cgttgtatatgaatcgagccactggaagttgggttaaagatcagcttatttcacccacactatagaacagacagtaaattgttctggtgtaataaagtcawtcattcattcattcattccttcagcaaaactatgctttggaaggcagtgtaagtaaaggcttagccaaatctctttgctcttgtttgtaaagtaaaattt

SEQ ID NO: 37168 - DNA, 201 bp, Homo sapiens; identical to SEQ ID NO: 7924

SEQ ID NO: 37169 - DNA, 201 bp, Homo sapiens
ttggaaccactgtaagttcagattttcctcatcttgcactagggttacatcccactgaactcattgtaaggtcaaaaaattacaagtctaaccatcctaarttggggaccgtctcatacagtaataggaaaaccattttatcttaccaatttatttaattgttgatagtctacagggctttcttttttctcttgtgagtag

SEQ ID NO: 37170 - DNA, 201 bp, Homo sapiens
cttttaagtattgtttttcaaatgaaaataataaaatctacctttggaattctgaatttcaagtttccatgaaataagtttgaggtttgtatatgatggtrtatttgatgtattgatttttttggggaaagcaaggtttttggattttatgtacagcattcaaaagaagatggggggaaagcgtactttttaatgagtttg

SEQ ID NO: 37171 - DNA, 201 bp, Homo sapiens
aaacatacatatccataaacactaatttcccattttctataaaaagaattttaagctccttagcatggtagttaatgatgactgatatccaacctgtattmacatcttgacatcccagctaaattagaataatagtgcttcctgtttatatcccatttccccctctgtttctttgttcacacttttcccttggctaatata

SEQ ID NO: 37172 - DNA, 201 bp, Homo sapiens
gcctgacacaggatgcagttgctaaggcaaatcaaacaaaagaggtacgtttctataaatcctaaataagttgttaatgaacatttcttctggtatggccrtgattttaaactttgcatgtatctgtttaagatatccattctacgttctacaacttagagaaaggatagcttacttcagtgcttcctaaagcaaattgaa

SEQ ID NO: 37173 - DNA, 201 bp, Homo sapiens
aaaaggttactaatgccagggcagtatctctgaaagacactgttttcttttaaaggttcttactggctcgttgtatatgaatcgagccactggaagttggrttaaagatcagcttatttcacccacactatagaacagacagtaaattgttctggtgtaataaagtcattcattcattcattcattccttcagcaaaacta

SEQ ID NO: 37174 - DNA, 201 bp, Homo sapiens
tcttttcctttgctcttagaaaatatttttaaaattttcagtggacttcttaaaactttgaaatatatttttaggattttatgtttgtttatattacattwtatggtctattcatgtgtacaagacagtacagaattctgcatgtagaaaggtatctggagaatataaaaaattgtctaggctgggcacggtggctcatgc

SEQ ID NO: 37175 - DNA, 201 bp, Homo sapiens; identical to SEQ ID NO: 7922

SEQ ID NO: 37176 - DNA, 201 bp, Homo sapiens
tccttctaggctttccttacacttcactgtctcaatgaggcccaacctgaccatcttgtctaaaactgcaacacccattatatccccaccgctatttgttrccccccttaccttgttataattttcctatagtacttagaaccttctgaatagtaaataatgtatttatttattattgtactgtttgtcttcccttgccca

SEQ ID NO: 37177 - DNA, 201 bp, Homo sapiens
ctaaattagaataatagtgcttcctgtttatatcccatttccccctctgtttctttgttcacacttttcccttggctaatataccatttcattctatctamacatctaaatcctacccatctttttaagatccatctcatatgctgtcttatgtcttagcagcagtataatttccctctgaacttccatagcttttaaccc

SEQ ID NO: 37178 - DNA, 201 bp, Homo sapiens
ttttaagatccatctcatatgctgtcttatgtcttagcagcagtataatttccctctgaacttccatagcttttaaccctatacattttaagtcattaacmactttccattttgcttctatgtcttattcgtcccagtaatttgtaaactgatactcagctttgattcctacatggtacctctcttagcttccaattgatg

SEQ ID NO: 37179 - DNA, 201 bp, Homo sapiens
actcagtgactgaaaacacaatttattattttagaatgagaaggccaacattagcctcactgggttcatgtcaagttgtcagcaaggcaggttccttttgraggctctcgggggaatctgtttctttccttttttaacttctagaggctgcctgaattccttgactctggccccttcttccttcttcaagtctagcagcat

SEQ ID NO: 37180 - DNA, 201 bp, Homo sapiens
tggctctgatcctcctgagcccacctggataatccaggataatcccctatctcaagatccttaattttatcatatttgcaaatcttgccatgtaaggtaamacatacacaggttccagggatcaggacatggacatcttggggggtacaggtcaatattgtgtctgtcacagtacctgacatagtttcttgcacacaacag

SEQ ID NO: 37181 - DNA, 201 bp, Homo sapiens
tctatggcaagtccttcagggcttatcagacctggaaataaagcaaagtcaggactggagtgtttgcaggatatggagggcaaacctgaagccctccaacrgtcgggtgggcaggggggtcagcaggggaaagcaaagcccaagtgtctccaagtccccaagaaccaggttaatagagaaacaagtacttttgttacatat

SEQ ID NO: 37182 - DNA, 201 bp, Homo sapiens
ggggataaagtataaatcaactacaacaaaatgctataaaattctagtcctgctgcacatttgtcccttttgagttattttaagaggcattcaaacaatarcataatatggaaaacatcttagtacgtttgccaagtacaagcatcagtatattaactgtttggcaaccagactatttaataacatctgcaataactgtta

SEQ ID NO: 37183 - DNA, 201 bp, Homo sapiens
tctcttattagaccatttcattttgaaaggcctgccaacatctaaatgcaagatttgattatcttatctgcatcccctgcattttgtgtttttcggttagytacagtcctcttaattatttactttggaagcctttttatatcttggcttatccctttcccttcatcccacctacactgactttttctcatgtttgttgta

SEQ ID NO: 37184 - DNA, 201 bp, Homo sapiens
ttagttacagtcctcttaattatttactttggaagcctttttatatcttggcttatccctttcccttcatcccacctacactgactttttctcatgtttgwtgtatcttcattcccattggcataatcctaattcaggctcttgtcactttctgccaggagtattataatatctcccattagtgtcaccttctgttcttaa

SEQ ID NO: 37185 - DNA, 201 bp, Homo sapiens
taatgccaatatacattaatactctataggccagaatatattacttatgtttactgtcttagcacagatacttctatggttggaagcttctgaatgttagyacctatagtaaaaacaatttttctttaaacgggtgttttctcttattagaccatttcattttgaaaggcctgccaacatctaaatgcaagatttgattat

SEQ ID NO: 37186 - DNA, 201 bp, Homo sapiens
ttttatgcttttattttttcctcgtttcattaacagatcccataagcactgtatagcctaagatgccattttgaacattaagtttagtgaattattaataagtgtttttatttttgaattccttttaagtattgtttttcaaatgaaaataataaaatctacctttggaattctgaatttcaagtttccatgaaataagtt

SEQ ID NO: 37187 - DNA, 201 bp, Homo sapiens
gaccatttcattttgaaaggcctgccaacatctaaatgcaagatttgattatcttatctgcatcccctgcattttgtgtttttcggttagttacagtcctsttaattatttactttggaagcctttttatatcttggcttatccctttcccttcatcccacctacactgactttttctcatgtttgttgtatcttcattcc

SEQ ID NO: 37188 - DNA, 201 bp, Homo sapiens
atttgcttcatccttctctctacacagaggcacacaccatttttttccaaaccatttgatagtaaattatagatgattcctttttactcttaaacactttraagtgcatttcctaaaaacaactttgtcttatataaccacagtacagtgatcaaaatcaggaagttatctttgatatactattatttattcacattttac

SEQ ID NO: 37189 - DNA, 201 bp, Homo sapiens; identical to SEQ ID NO: 7921

SEQ ID NO: 37190 - DNA, 201 bp, Homo sapiens
agacaaacatattcttggttttgacacaggaggtaagtgattttgtttaaattcaaactattttttttacagactgaatacttgggaggaaataaataaatggccttaaatgtaaaaattatgtattgaagcagtgttcttttctcataaaacagatgcagttcttaatgaagctgctcaaattctgcgattgctgcacat

SEQ ID NO: 37191 - DNA, 201 bp, Homo sapiens
tagacaaacatattcttggttttgacacaggaggtaagtgattttgtttaaattcaaactattttttttacagactgaatacttgggaggaaataaataaatggccttaaatgtaaaaattatgtattgaagcagtgttcttttctcataaaacagatgcagttcttaatgaagctgctcaaattctgcgattgctgcaca

SEQ ID NO: 37192 - DNA, 201 bp, Homo sapiens
atgatgattacctggtaatgcttaaggtcagcttcatgttcttgattcttgacagaaactgtgcacatagaaaaatgtctttattttctaaatattaactrttgatattaaaattatggttgaatgactaaaatacacagaagaatatgaaacataaagtagatttcatggttttatctgatttggattctgttttctgcc

SEQ ID NO: 37193 - DNA, 201 bp, Homo sapiens
attagaccatttcattttgaaaggcctgccaacatctaaatgcaagatttgattatcttatctgcatcccctgcattttgtgtttttcggttagttacagycctcttaattatttactttggaagcctttttatatcttggcttatccctttcccttcatcccacctacactgactttttctcatgtttgttgtatcttca

SEQ ID NO: 37194 - DNA, 201 bp, Homo sapiens
tacaacttgttccaaaaattctgatttcatggggtgttcaattgataacattcattagaatataaaacctgtttttctgtgcactgtagagacttttgtgrctattcctggttattaccaacttgttctgttcactgttttcggaagactaatttgaacaaaggcttctagtaaaactgccaagactttaaaagttgttac

SEQ ID NO: 37195 - DNA, 201 bp, Homo sapiens
tgaatcgagccactggaagttgggttaaagatcagcttatttcacccacactatagaacagacagtaaattgttctggtgtaataaagtcattcattcatwcattcattccttcagcaaaactatgctttggaaggcagtgtaagtaaaggcttagccaaatctctttgctcttgtttgtaaagtaaaatttagttttatt

SEQ ID NO: 37196 - DNA, 201 bp, Homo sapiens
tcagcaaaactatgctttggaaggcagtgtaagtaaaggcttagccaaatctctttgctcttgtttgtaaagtaaaatttagttttatttttaatgctccmaattttaattttggtgtcatctcaaaagataccagcctataacaatttagtggagttcttacagtctagtgtacttataagcatttataactactatttg

SEQ ID NO: 37197 - DNA, 201 bp, Homo sapiens
tgtttccaaagaacagttccagttacatattcatattaataaacatacatatccataaacactaatttcccattttctataaaaagaattttaagctcctyagcatggtagttaatgatgactgatatccaacctgtattcacatcttgacatcccagctaaattagaataatagtgcttcctgtttatatcccatttccc

SEQ ID NO: 37198 - DNA, 201 bp, Homo sapiens
aattatttactttggaagcctttttatatcttggcttatccctttcccttcatcccacctacactgactttttctcatgtttgttgtatcttcattcccaytggcataatcctaattcaggctcttgtcactttctgccaggagtattataatatctcccattagtgtcaccttctgttcttaactgcatggccaaccaag

SEQ ID NO: 37199 - DNA, 201 bp, Homo sapiens
ttcttgcacacaacaggtgcttatcaatttcagtaatgtgtggcgaatgcagtatatgtgagtgtttacatacactgatttggagcatcagccaatttttkgctgatgcctcagacttaaatttcagaagccttatggcaaaaatcttaaggaaagctcaatttgagacttcgtttacttttccatttaatttaaaaaaaa

SEQ ID NO: 37200 - DNA, 201 bp, Homo sapiens
ctgggcacggtggctcatgcctataatccaagcagtttgggaagccaagatgggtggatcacctgaggtcaggggttcgagaccagccgggccaacgtggygaaaccccgtctctactaaaaacacaaaattagccaggtgtggtggcgcatgtgtgtaatctcagctgcccagggggctgagccaggagaatcatttgaa

SEQ ID NO: 37201 - DNA, 201 bp, Homo sapiens
ctttgtcttatataaccacagtacagtgatcaaaatcaggaagttatctttgatatactattatttattcacattttaccaaaccccccacttctctcgamagaaaaaaataacccagagcaatcctggattatgcaccgcattagttgttacatctgtcttagtatcttaaaatctggaacagttcctgtctttatttgt

SEQ ID NO: 37202 - DNA, 201 bp, Homo sapiens
gcagatcatttgagctcaggagttctgacagcagcctgggcaacatgatgaaaccctgtctctacaagaaaatagaaagttatctgggtgtgctggcctgygtctgtagtgtcagctaattgggaggctgaggttctccagcctgggcgacagagtgacaccttgtctcaaaaaaagacattattgagatgcttgaaaacc

SEQ ID NO: 37203 - DNA, 201 bp, Homo sapiens
ttcattaacagatcccataagcactgtatagcctaagatgccattttgaacattaagtttagtgaattattaataagtgtttttatttttgaattcctttkaagtattgtttttcaaatgaaaataataaaatctacctttggaattctgaatttcaagtttccatgaaataagtttgaggtttgtatatgatggtgtatt

SEQ ID NO: 37204 - DNA, 201 bp, Homo sapiens
ttagacaaacatattcttggttttgacacaggaggtaagtgattttgtttaaattcaaactattttttttacagactgaatacttgggaggaaataaataaatggccttaaatgtaaaaattatgtattgaagcagtgttcttttctcataaaacagatgcagttcttaatgaagctgctcaaattctgcgattgctgcac

SEQ ID NO: 37205 - DNA, 201 bp, Homo sapiens
tttagacaaacatattcttggttttgacacaggaggtaagtgattttgtttaaattcaaactattttttttacagactgaatacttgggaggaaataaataaatggccttaaatgtaaaaattatgtattgaagcagtgttcttttctcataaaacagatgcagttcttaatgaagctgctcaaattctgcgattgctgca

SEQ ID NO: 37206 - DNA, 201 bp, Homo sapiens
agggaaactcaacctgtaatcattttggctcagttaaatttggtaaatagcagtagtcattttaccttgagttgcagttgtacaaattatatttttgcctstttttatagctgaaaaatacaaggatttagtacctgataattcaaaaactgctgacaatgcaactaaaaatgcagaaccattgatcaatttggatggtga

SEQ ID NO: 37207 - DNA, 201 bp, Homo sapiens
ctacgtagatttacattactagataaggcaagaattgagcagtgactaaagcatttgaatagtaacaggttgtaacattgaaagattgaaagtacgggtastgtgtttttcttggcagtgattttatataatcagcaggaagtacagactgtcctcattttagaatttgtttctgtgaagtttggcatcaccatagtcacc

SEQ ID NO: 37208 - DNA, 201 bp, Homo sapiens
ttcttgtaattcacttactctttctaactccagattataagtatttatttacacatctatatttgtcattatacttaaacttcctgaaaatagagactgtrgtttactcatttgtatgctcctcagatcctaagtgtttaattaaaatcttaattaatgaaatgaaatgaaacgtacatagttggcttacccccaagaatt

SEQ ID NO: 37209 - DNA, 201 bp, Homo sapiens
tttattttatttaagaaacttcttaaataaaacaacttcttttaatcttcataactctatgaggtaagttctattagcaccctcattttgtagctgaagartctgaggcacagaaaatgtgggtgattatcccaagttcacacaaccagtaagtatctggacccaggatttgaacagatcattgttaatctgtactttcaa

SEQ ID NO: 37210 - DNA, 201 bp, Homo sapiens
tagtcattttaccttgagttgcagttgtacaaattatatttttgcctgtttttatagctgaaaaatacaaggatttagtacctgataattcaaaaactgcwgacaatgcaactaaaaatgcagaaccattgatcaatttggatggtgagtatataaatgcataacattgaacatcaacatttttggttttttaaatgtttt

SEQ ID NO: 37211 - DNA, 201 bp, Homo sapiens
aggtctctttcaactctcccattcttttttctgtgactttatggtaataatgaaactggtggttttcttttcttccccctcacagtatctcagagatgttmactgtcctttcaagattcaagatcgacaagaagctattgactggcttcttggtttagctgttagacttgaatatggagataatggtacgttttgtgggga

SEQ ID NO: 37212 - DNA, 201 bp, Homo sapiens
tagaccatttcattttgaaaggcctgccaacatctaaatgcaagatttgattatcttatctgcatcccctgcattttgtgtttttcggttagttacagtcytcttaattatttactttggaagcctttttatatcttggcttatccctttcccttcatcccacctacactgactttttctcatgtttgttgtatcttcatt

SEQ ID NO: 37213 - DNA, 201 bp, Homo sapiens
ggactttgaagtgttgttgcagtaggtaatttctcaaaagactgaaacatgtctaatgccaatatacattaatactctataggccagaatatattacttaygtttactgtcttagcacagatacttctatggttggaagcttctgaatgttagtacctatagtaaaaacaatttttctttaaacgggtgttttctcttatt

SEQ ID NO: 37214 - DNA, 201 bp, Homo sapiens
ctctgtttctttgttcacacttttcccttggctaatataccatttcattctatctacacatctaaatcctacccatctttttaagatccatctcatatgcygtcttatgtcttagcagcagtataatttccctctgaacttccatagcttttaaccctatacattttaagtcattaaccactttccattttgcttctatgt

SEQ ID NO: 37215 - DNA, 201 bp, Homo sapiens
cccttgcccatgcagctaaaagagttaagacaccagaatagctaggtgcttttcagtttcagttgaggaaaggatgctattcttaaccataaatactctcrttttgtctttctttttttaaagggcttacctgttgctttagacaaacatattcttggttttgacacaggaggtaagtgattttgtttaaattcaaactat

SEQ ID NO: 37216 - DNA, 201 bp, Homo sapiens; identical to SEQ ID NO: 7920

SEQ ID NO: 37217 - DNA, 201 bp, Homo sapiens
cacactatagaacagacagtaaattgttctggtgtaataaagtcattcattcattcattcattccttcagcaaaactatgctttggaaggcagtgtaagtwaaggcttagccaaatctctttgctcttgtttgtaaagtaaaatttagttttatttttaatgctccaaattttaattttggtgtcatctcaaaagatacca

SEQ ID NO: 37218 - DNA, 201 bp, Homo sapiens
tagcagtagtcattttaccttgagttgcagttgtacaaattatatttttgcctgtttttatagctgaaaaatacaaggatttagtacctgataattcaaaractgctgacaatgcaactaaaaatgcagaaccattgatcaatttggatggtgagtatataaatgcataacattgaacatcaacatttttggttttttaaa

SEQ ID NO: 37219 - DNA, 201 bp, Homo sapiens
aatcctagagacagctgctaatatctttttaaaaatatatatcatatgaagaaactgagactcaatgaggataatgtctaagatgacacagaaaatgacaragccaggattttaagcactataaccctgtggtccattgtttttcccacattaccctacttctgtttagtgagtctttttaatgattcatagtctgcattt

SEQ ID NO: 37220 - DNA, 201 bp, Homo sapiens
tgctaaggcaaatcaaacaaaagaggtacgtttctataaatcctaaataagttgttaatgaacatttcttctggtatggccgtgattttaaactttgcatrtatctgtttaagatatccattctacgttctacaacttagagaaaggatagcttacttcagtgcttcctaaagcaaattgaatgtattcagtggctagggg

SEQ ID NO: 37221 - DNA, 201 bp, Homo sapiens
ataatgtctaagatgacacagaaaatgacaaagccaggattttaagcactataaccctgtggtccattgtttttcccacattaccctacttctgtttagtkagtctttttaatgattcatagtctgcatttgttaagatggtcgaaaatgccaaatgagtaatggtgaatttggtcaaaaatatataaccccaaaatctct

SEQ ID NO: 37222 - DNA, 201 bp, Homo sapiens
tattaaatttgactggcgtagtgtctatctgtgagtgtgtgttcacatgcctatgtgtagaactaaagaataatttaaataaattatgacttatacaaatrtgaatgaatgtatgcccaaaattccatttaactgattgattaatgagggaaccagtaagatgttacaactgattcaaatgagaagttaaagtatcacata

SEQ ID NO: 37223 - DNA, 201 bp, Homo sapiens
gatttcaaaccaatgcaattttattttagttacctgttaaggaaaattttatatttttacctgtggtttcaggtaaatacaaaggcatatgactgtctccrttaatgcatttgtaccacttaatgacagcatttttttgggatggatacaacatcatccattttgatcttagttgtcgaaagaagagtcaagtttttcacc

SEQ ID NO: 37224 - DNA, 201 bp, Homo sapiens
gttacctgttaaggaaaattttatatttttacctgtggtttcaggtaaatacaaaggcatatgactgtctccattaatgcatttgtaccacttaatgacarcatttttttgggatggatacaacatcatccattttgatcttagttgtcgaaagaagagtcaagtttttcaccactgatgtgagaaagacacttttaggag

SEQ ID NO: 37225 - DNA, 201 bp, Homo sapiens
gatacgtgtagagactttcaaagcattacttgaatttttttcatagttttttaaaactttgtttctaattattgaaataatcaatgcttactgaacaaatyttaaaaaataaagagaagtatgtgaagagaagtacttaaaatccaagcataatataatattaaatttgactggcgtagtgtctatctgtgagtgtgtgtt

SEQ ID NO: 37226 - DNA, 201 bp, Homo sapiens
aatacttggaattttccaatttttgatttagtggaaaatataggaagaaaatgtggccgtattcttagtcaggtaagaaatgcattcattcacactaattkaaatataggaaaaacagttcctttgttgcttaaagctctgtaaattcttgacacttgtggataggtgttatgtggagaaaggaagttttagaacacaaca

SEQ ID NO: 37227 - DNA, 201 bp, Homo sapiens
aataccatgacaactgactgtcttcagaatcatctagggctgattgattcataatctaaatttagggattgttcatatcagaatctaaggaggacttcacrttgcattcattttgttaattcagcaaaagtagtactagttagatctgggaaagtggatgttaaactttatgaatgccagactggattatagttttctcat

SEQ ID NO: 37228 - DNA, 201 bp, Homo sapiens
tctaccatcttcacgtctctcactattaactctggccctcctgcctcttcttataagtaccttgtgataacattgggcccacccagaaaatcaggatcatygctctaactcaacatccttaatcgcatctgcaaagtaacttttgccatgtacgataacttattcacaaattctagggtttagaacatggacatctttggg

SEQ ID NO: 37229 - DNA, 201 bp, Homo sapiens
ggctttttgcaagaaaatatttttgtatatggcagcatggagctgccatatacaaaacaaatatatgtggagctactctggttgtataaggtgataaggcrccaagtccattggttagtgcccccaaaacacatattccagtgtctgctaacttcactggtttctagggaccatagtgggtttcagtggatagggctattt

SEQ ID NO: 37230 - DNA, 201 bp, Homo sapiens
cgcattcactttttggatttatttttttcccctcatcccagaagccagaatgtaagctacatttctgtttgtattggacctttgagagactatgctacatrgctaatggaaaaacctgcatacgagtccaagttctgcctcttctaaaattcattaccataaaggaagttggttagccacagggagtttcttaggctttct

SEQ ID NO: 37231 - DNA, 201 bp, Homo sapiens
tggtcttcatccctgttttctgtcatacagctcctaaaacccttgataagaatatcctttgtgtgctaataagacgactagtggctggaggcccctttgtracttctggatgggggctggtcaccagaatggtcaggggattgggactttcagccccatctctcaacctctgcagggctgaaggttgtgttgattactaat

SEQ ID NO: 37232 - DNA, 201 bp, Homo sapiens
agtttcttaggctttctcagtttgatttcttagtccctagaaagttcaagtctgtaaaaactagaagtttttataaggaagttatgagaagtaaatgacarggtatttgaaagtacatgacattgtgtatggcatatgttaattgaccagtgaatgctttacatcccttgatctcttaactagaaattaagtggcagactg

SEQ ID NO: 37233 - DNA, 201 bp, Homo sapiens
gagaaaaatagagagtgtgctctcacttaaccaagaaaaaaatctttctagaagaaaatatgatagaatcagagaatgtaaacagaaaaatcacttttackcaatcattccacccagtttttacggttctgtcgaaggagagttagcagaatagtactagctgattatgcttgcgatggttaaggtgacagagactggtag

SEQ ID NO: 37234 - DNA, 201 bp, Homo sapiens
agtacatgacattgtgtatggcatatgttaattgaccagtgaatgctttacatcccttgatctcttaactagaaattaagtggcagactgataactcctargttcatatcgacagcttcccctcttctgaattccacactcatatatccaattgcaataattggcttcttgacttagatacctaacagacgcctcatactc

SEQ ID NO: 37235 - DNA, 201 bp, Homo sapiens
taagtggcagactgataactcctaagttcatatcgacagcttcccctcttctgaattccacactcatatatccaattgcaataattggcttcttgacttaratacctaacagacgcctcatactccaaatgtgccaaatggaacttccaattattgcctccaaatctgctccatcctttctaacagctgatggcaactcca

SEQ ID NO: 37236 - DNA, 201 bp, Homo sapiens
agctcaatttatgaaatgcctaacaagtgatcattgttaagcttttgcctaatcactaccataatagggaactaagtccccttccatgccattttgttctycccttttcccctcctctctgtttagatatggtcttttgaaattgaggagtccagaatctggtacaacagatatggtatgactggaacaaagcgaagggtg

SEQ ID NO: 37237 - DNA, 201 bp, Homo sapiens
gtactctgaggttgatactgttgttctcattttacagctgaagacacaggcacagtgagcctgtctctatatatgtctctctatatgtctttatatatgtstctatatattctagtaaatcatagttaaaaatttttgtgcatatgagtgctagacatggtatcatgtgtttatatacctttgttaatttttgccagaaga

SEQ ID NO: 37238 - DNA, 201 bp, Homo sapiens; identical to SEQ ID NO: 7931

SEQ ID NO: 37239 - DNA, 201 bp, Homo sapiens; identical to SEQ ID NO: 7933

SEQ ID NO: 37240 - DNA, 201 bp, Homo sapiens
gttcttttctggagacagacagggactcatgtctccctccttggcaacagctattctttcatgggtaattcctatgtactatttgaatatcaaaatatttwtatctccctaagaatggggagacacaacgtatttgccccataagggtaaattgcaaacaaattgctccagtgcttcagaaaggactggttattcattcct

SEQ ID NO: 37241 - DNA, 201 bp, Homo sapiens
aatatgagaacagcaccaagccattcatgagaaacctgtcccccatgatctcatcacctctaatcaggcctacctccaacattggggatgacaattcaacrtgagatttagaggggtaagatatccaaactttatcaaggaccgtaatggaaatagacttgtactcatacagcttacattttatcctagtagacatgcctt

SEQ ID NO: 37242 - DNA, 201 bp, Homo sapiens
ctgtagaattgaagcctctatgtaaaacctaaaggacagggttcagaggacttctggatagctgaacatgtggaggttcctagaaggtggtacaaccaccyagggaggacatgggagctctgcaccccttctcctatacttcaccctatgcagctctccaactggctgttcattcatatgctttgtaatttttttataata

SEQ ID NO: 37243 - DNA, 201 bp, Homo sapiens
aagaactataattggctgctcattcttctctaattactgagaccaccttacacattcacttttgaaagatttcaaaccaatgcaattttattttagttacytgttaaggaaaattttatatttttacctgtggtttcaggtaaatacaaaggcatatgactgtctccattaatgcatttgtaccacttaatgacagcattt

SEQ ID NO: 37244 - DNA, 201 bp, Homo sapiens
cattctccaggagttattcgaaagctgaaactttcagtggattgtgggcctggggagaagaaggattccgagggtggaattgggaagagcgtgcgtgcgtktgtgtgtgtgtgtgtgcgcgcgcgcgcgtgggtcggggcgggggcgtcggggggccactgggaattcagtgaagagggcaccctataccatggcagtgcc

SEQ ID NO: 37245 - DNA, 201 bp, Homo sapiens
ggcagtcttgagggactgaggggtgatgctatgtccaggtggatagtgttaggattgaattgaattagacgatgctcagctggtgtctgttgaagaatctkgtgtcagaagtgttgagtgatgtgtgagagtaggagaaacaatggtttttcctacattctcttacactaatggatttgtattcggagagattggaaagat

SEQ ID NO: 37246 - DNA, 201 bp, Homo sapiens
gcagtcttgagggactgaggggtgatgctatgtccaggtggatagtgttaggattgaattgaattagacgatgctcagctggtgtctgttgaagaatctgktgtcagaagtgttgagtgatgtgtgagagtaggagaaacaatggtttttcctacattctcttacactaatggatttgtattcggagagattggaaagatg

SEQ ID NO: 37247 - DNA, 201 bp, Homo sapiens
tttatggtagacattatttcatttaaaaaattctaaaatgggctttatttagatagcaacacattttatcagtattttcttctaaattttttcatttagckgatttttaacatagttctttaatacttttggaattcagttatacaaatggtagttgcatataataagcaaactgtgagtttttttctaaattgctataca

SEQ ID NO: 37248 - DNA, 201 bp, Homo sapiens
gtacaggaagcacaggccttactttttattgttgtatggagcagagtcccagaaggaccggctgtggagtgctgaataaaatccctgtgaatgcacaccgrgttctctgaaaatacaagcttctagtcatttctgggttaaggtgtagtccatttcgctttgctatcagattacacataagttattgagcaataaaaggaa

SEQ ID NO: 37249 - DNA, 201 bp, Homo sapiens
ttaaaaaaaggcttcatgttgatacaagtgggtagatatgaaaccaggtgttaaaatatacacatatatttccttgctccgcatactgcagtgttcattgytacactccagcagcaaggatcatacccagcactgagatcgtgatttctaatacctttgcaaattgaaggaaccagagatctgtgaaaaagtggcttaatc

SEQ ID NO: 37250 - DNA, 201 bp, Homo sapiens
agaaaagttctttgctttaaaatgactcatcaagtgctattgggaacatttaaaatgttatttcaattgcacatactctttaggaagatacaagtttattrctttatatgtgtgtatcactgataaaaggtattttcatatatttaacaaaaatttaaagggaggaatggttaaatgactgtctaaggactcatacctctt

SEQ ID NO: 37251 - DNA, 201 bp, Homo sapiens
acctaatattttgcttgtttttagtttcaaatcatcctaggatattattgattactcaactgattgacatggtttgggaaataaggtattttgaaaggaawaatgtcttctttttataaactgtacaggaaccttctattaaattctgtaaatgtcattgatctcaaatccatgcatcacatgtgtaaattatattatttg

SEQ ID NO: 37252 - DNA, 201 bp, Homo sapiens
aagatacatataaagaattatacttatggtatatctcaaaactgagtttgtttcctataacccatactaaaaacaatttatcaagttaatatagtaatatrttgtgtaagtatacatgtataatatagtaagatgtatatgataatatatgttcaagttaatatagcataattagcaaaatcataattgggttcaaataat

SEQ ID NO: 37253 - DNA, 201 bp, Homo sapiens
gcgggaaaaagaagggtgtgtgagaggaggaattattcagttatcactggtctggagaagaaagagcatggcccatttgcaaaaatgattcttagttcacttttttttttttttttgcctttagtgatattatgggtaatagcgataaatttttattttctcaatttatatatatcagatttctcactctgtgtcatcaat

SEQ ID NO: 37254 - DNA, 201 bp, Homo sapiens
tttttggtagaacgattgctatatttagtttaaaattttagggcggcaggccgggcgcaatggctcacgcctgtaatcctagcactttgggaggccgaggygggcggatcactaggtcaggagatcgagaccatcctggctaacatggtgaaactccatctctactaaaaatacaaaaaattagccgggcatggtggcggg

SEQ ID NO: 37255 - DNA, 201 bp, Homo sapiens
cgggaaaaagaagggtgtgtgagaggaggaattattcagttatcactggtctggagaagaaagagcatggcccatttgcaaaaatgattcttagttcacttttttttttttttttgcctttagtgatattatgggtaatagcgataaatttttattttctcaatttatatatatcagatttctcactctgtgtcatcaatt

SEQ ID NO: 37256 - DNA, 201 bp, Homo sapiens
aaactccatctctactaaaaatacaaaaaattagccgggcatggtggcgggcacctgtagtcccagctactcgggaggctgaggggagaatggcgtgaacycgggaagtggagcttgcagtgagccaagatcgcaccactgcactccagcctgggcaacagagcgagactctgtctcaaaaaaaaaaaaatttagggtggc

SEQ ID NO: 37257 - DNA, 201 bp, Homo sapiens
aaaagctagaaagttcaagattatgatatcagtatctgacaaggaccttcttgctgcatcatcacatggcagaagggcaaagaaagggcaagagggggccraactcatcctttcataatggtatcaatcccagccatgagggtagagccctcagggcccgttcaactcttcaaattactacatcttaatactgttacaatg

SEQ ID NO: 37258 - DNA, 201 bp, Homo sapiens
tatcagtatctgacaaggaccttcttgctgcatcatcacatggcagaagggcaaagaaagggcaagagggggccgaactcatcctttcataatggtatcartcccagccatgagggtagagccctcagggcccgttcaactcttcaaattactacatcttaatactgttacaatggcatttaaatttcaacgtaagtttga

SEQ ID NO: 37259 - DNA, 201 bp, Homo sapiens
ttaactattcttgatatcttatatgagtggattcatgatgtttgtccttttatgactggcttagtttacttggcataatgtcttcagagttcatccatgtygtagcacatgtcagaatttccttcctttttaaggctgaataatattccattatatacgtatgccatattttgtttatccatttattattgatggatactt

SEQ ID NO: 37260 - DNA, 201 bp, Homo sapiens
cccatattctatattcagatctctgaaaaaagtggcctttcattgatcaaaatatatttatataaaacattttaatgaagaatacctatttataaaatatscagaggaaatatatgcagatgtaaaattgagcccaataaatccttgtgttttcataggtatgaaagttacaataaataatggcaattagatattgtgtgt

SEQ ID NO: 37261 - DNA, 201 bp, Homo sapiens
gagtcctgctgtctaaaggagtagcacagccagacactgatgagggtggaggtagtagctgagtcttttgttataaaagctcatgttgactcgttaacatkggtttttttttttttttttttttttttgtttttttttttttttgagatggagtctcgatctgtcgcccaggctggagtgcagtggcgctatcacggctca

SEQ ID NO: 37262 - DNA, 201 bp, Homo sapiens
tagcacagccagacactgatgagggtggaggtagtagctgagtcttttgttataaaagctcatgttgactcgttaacattggttttttttttttttttttkttttttgtttttttttttttttgagatggagtctcgatctgtcgcccaggctggagtgcagtggcgctatcacggctcactgcaagctccacctccctgg

SEQ ID NO: 37263 - DNA, 201 bp, Homo sapiens
gaccttgaattttatttgtgtgagtttctctgagcttcctgcatctagatgtctaaatctctttttgttagacttgggaagttttcacctataattttgtwaaacaggttttctgtcccttttattttcttttcaccttctgggacactgaaaattcaaatatgtcatgcaagctttgttcattattattattttttatgt

SEQ ID NO: 37264 - DNA, 201 bp, Homo sapiens; identical to SEQ ID NO: 7942

SEQ ID NO: 37265 - DNA, 201 bp, Homo sapiens
gccagacactgatgagggtggaggtagtagctgagtcttttgttataaaagctcatgttgactcgttaacattggtttttttttttttttttttttttttktttttttttttttttgagatggagtctcgatctgtcgcccaggctggagtgcagtggcgctatcacggctcactgcaagctccacctccctggttcacac

SEQ ID NO: 37266 - DNA, 201 bp, Homo sapiens
ccagacactgatgagggtggaggtagtagctgagtcttttgttataaaagctcatgttgactcgttaacattggtttttttttttttttttttttttttgtttttttttttttttgagatggagtctcgatctgtcgcccaggctggagtgcagtggcgctatcacggctcactgcaagctccacctccctggttcacacc

SEQ ID NO: 37267 - DNA, 201 bp, Homo sapiens
aagtattctcaagaatgtttaaatttggtttattttcttgaagcaaagttatttaattttttaatttttaacttaaaatgaaacccacaaaatgacattcygtggtactgagtattttcacataatcagaactgtaaactactgattattttcatatactcagaggctgaatattttgatataataagaactagtatcata

SEQ ID NO: 37268 - DNA, 201 bp, Homo sapiens
cagacactgatgagggtggaggtagtagctgagtcttttgttataaaagctcatgttgactcgttaacattggtttttttttttttttttttttttttgtttttttttttttttgagatggagtctcgatctgtcgcccaggctggagtgcagtggcgctatcacggctcactgcaagctccacctccctggttcacacca

SEQ ID NO: 37269 - DNA, 201 bp, Homo sapiens
agacactgatgagggtggaggtagtagctgagtcttttgttataaaagctcatgttgactcgttaacattggtttttttttttttttttttttttttgtttttttttttttttgagatggagtctcgatctgtcgcccaggctggagtgcagtggcgctatcacggctcactgcaagctccacctccctggttcacaccat

SEQ ID NO: 37270 - DNA, 201 bp, Homo sapiens; identical to SEQ ID NO: 7934

SEQ ID NO: 37271 - DNA, 201 bp, Homo sapiens
tttgtatcatccatttacattttgagaagcatagtcaatcagataaacttactgttttaattctaaattcactgactttctgtcagtctctatgttccctrtatgtagcagctgggttaagaatataattgtcttgacaacaaattattgacatttacgagctcaaaagttacctcagaagcttttgaaatcaaagaaata

SEQ ID NO: 37272 - DNA, 201 bp, Homo sapiens
tccctatcccttcttgtgagttaaaagggaattaaggaaaaggaatctcactgcagaagaatgttttggttgttcatcctatatttaatcttgctcctttragtttatggtcaaacatgagcacatttataaaatgctttcctggggcagcgtggaagaaactgtgtttggaaagtgatattacactgaggacacttgggc

SEQ ID NO: 37273 - DNA, 201 bp, Homo sapiens
aagaaaatcattccatagcatggatctcttaaaaatagaattatatatatatatgtttatttttgtctatttttgaacgcgttagaatcatactgtgtttmttctttgactcatttttttcattcaggtttgtttttgagattcaaccgtgttgatatgtataattatagttcattcattttcccactatatattaatgca

SEQ ID NO: 37274 - DNA, 201 bp, Homo sapiens
taaatgtctaaagatattaaagaatgcatactttcagattcacctttttaaatacattgaaatttttattcaccatcatggtaaatcttttaaatctgttygaattaacatattgtaaatgatactcaatatatacatattgtatgtgattttatatgcagtaagttataagacccatggctttttgaacaattgataatg

SEQ ID NO: 37275 - DNA, 201 bp, Homo sapiens; identical to SEQ ID NO: 7936

SEQ ID NO: 37276 - DNA, 201 bp, Homo sapiens
aaaggcattaaatatctaaaggcattaaatgtctaaagatattaaagaatgcatactttcagattcacctttttaaatacattgaaatttttattcaccawcatggtaaatcttttaaatctgtttgaattaacatattgtaaatgatactcaatatatacatattgtatgtgattttatatgcagtaagttataagaccc

SEQ ID NO: 37277 - DNA, 201 bp, Homo sapiens
tctcatataactcattagagaaccacaaataaatgcatttacttaataaataatttattttaaattatatgacaaccctatgattaaatttaatattgtattttttttttttttttttgagacaaagtctcactctgtcacccaggctggagtgcagtggctgtgatctcggctcactgcaacatctgcctccgaggttca

SEQ ID NO: 37278 - DNA, 201 bp, Homo sapiens
cctgtttttctgaataatgtattggtattttaaaaataaagattgcgggggaggagccaagatggccgaacaggaacagctccggtctacagctcccagcrtggtggatgcagaagatggtgatttctgcatttccatctgaggtaccgggttcatctctctagggagtgcgagacagtgggcgcaggtcagtgggtgcgc

SEQ ID NO: 37279 - DNA, 201 bp, Homo sapiens
tttaagagcagaaacaaagtttggtggggataaaatagagaacactgaaatggtaaaaccacaataatattgacaaataggatagttatattagacaaaamcatgttccttgagtctggaaattgttagtgtcaagttacactatgtattaaggcaccgtaacatattgtggcactgacttttaggcacatatatttgtat

SEQ ID NO: 37280 - DNA, 201 bp, Homo sapiens
tgtattaaggcaccgtaacatattgtggcactgacttttaggcacatatatttgtatatctttctaatttttttcaaaagtggatttttctgccatttatrtttgccatcgtataaataaaatttttatgttttgatgttcaacagccattttatactaataggagctctaactgtgacaatcaaataaattaatgttttt

SEQ ID NO: 37281 - DNA, 201 bp, Homo sapiens
tgttgccatctatcttaagggtttataactctggtatagaataagcaaatagcataaaacacttgtacctgtgtgtactcctcagagttttattggtaataaaaaaaaaaaaaaaaaccacccatgctcacttttgtgcttgggaacagaatctgtttctaacctttgctattaacaggaagtgggagaggtgaaatgagc

SEQ ID NO: 37282 - DNA, 201 bp, Homo sapiens; identical to SEQ ID NO: 7939

SEQ ID NO: 37283 - DNA, 201 bp, Homo sapiens
ctgagaaagatcctggaggaaaagctggggccagtatgctgaaaaagacacagtcctcttgccctaccccaagagtaaagggcaagaggtagtggctgccaaaaaaaaaaaaaacaaaacaaaacaaaacaaaaaaacctgaaaaaacaaaaaagttttgtggagagatatcgaatggatatttatatggctttttgctgt

SEQ ID NO: 37284 - DNA, 201 bp, Homo sapiens; identical to SEQ ID NO: 7940

SEQ ID NO: 37285 - DNA, 201 bp, Homo sapiens
tgagaaagatcctggaggaaaagctggggccagtatgctgaaaaagacacagtcctcttgccctaccccaagagtaaagggcaagaggtagtggctgccaaaaaaaaaaaaaacaaaacaaaacaaaacaaaaaaacctgaaaaaacaaaaaagttttgtggagagatatcgaatggatatttatatggctttttgctgta

SEQ ID NO: 37286 - DNA, 201 bp, Homo sapiens
gtgaaccatattataatcatctttagtatcaataaatatttttgagatgatataatgccagtaaatccataaattaaaaaattaaagcattaaagaaatayctactatgtaagcattcaattttatataatgattatctgggtcagtgtacccaaaattgtgtgctagccaaactacaattaaatcatcatgataattcca

SEQ ID NO: 37287 - DNA, 201 bp, Homo sapiens
tagttgacttctttcttgagactttaaattctgaaatgttttacactgcatgtacagctaagattaaagtcttctttttaacagtacactttttataatgycttgaacttgtttctctgtggcagaggaaaacagcctcatgcacctggacaaacaaaggtgttccttcaaaaacagactttcagaatcattaattctggt

SEQ ID NO: 37288 - DNA, 201 bp, Homo sapiens
actgcatgtacagctaagattaaagtcttctttttaacagtacactttttataatgccttgaacttgtttctctgtggcagaggaaaacagcctcatgcayctggacaaacaaaggtgttccttcaaaaacagactttcagaatcattaattctggtttagaaataattatgaaggttaagtggactctcatgcgtaagat

SEQ ID NO: 37289 - DNA, 201 bp, Homo sapiens
ggaaatggaaaggattaattttcaaagagacaagcaaaattggttgattttaatttttaaaggctgagtacattgataaatgtggatacaagtaataactrttttaataccacctggaaaaagctggcatatggccaccacattaataaatatgtgtgtataaatgggttattctaaatgaatgagtgttgtcataagcat

SEQ ID NO: 37290 - DNA, 201 bp, Homo sapiens
gtgagatcatgtggtatggcttatttcacttagcatgatatcctacaggttcacccatgttgtgcaaatagtaggattttctcctttttatggctgaatartatttcattgtgtatgcacacacatacatatacacacatcacatgttctttatccatttatatattgttgaacacttaggttgtttcaatgtcttggctt

SEQ ID NO: 37291 - DNA, 201 bp, Homo sapiens
tgaggattgatacaggtctctcttctcacagcctctggcaccacagcaataatattgtaaactctaaggagagccatttacattatagtgtacatgaatgmtgacccccctggagttgtgcagcgcacaacactcacaactgcatacatgatccttttaagccctttacatctacttctgtacttagaattacttccaaag

SEQ ID NO: 37292 - DNA, 201 bp, Homo sapiens
cttagccccaaatgagctgggtaatcttggaccagtcaaataatctctttatgttcattatgttgaactagtcaaataacatctttatgttccagttttgytaattttaaaaaagaatgaatctagcttggattacctctactatctcttcttcttttattttgtggttgtgttctgtggcacagaaatggaatttaacac

SEQ ID NO: 37293 - DNA, 201 bp, Homo sapiens
taagctataaaattaattaagattaagctgtaagaaaaagttctgactaaaattaggagggaaaaataaagctctgattaaataaacaattacagaaaacyaaattttaactctaagataaatttgccttgcaacttggttttgatgtacaatttgtgtattagctgattaggtaacttcaaaagtcatcagctgtctact

SEQ ID NO: 37294 - DNA, 201 bp, Homo sapiens
actccagcctgggcaacagaatgcgacgctgtctcaaaaaaaaaaaaaaaaaaaaaaaaaaaaaaaaaggtgtaaagggagtgaaatttttctctttgtcwttctgtaaggtgatatttggacaagtgaatagaacacagagcagtcagattttgcttaaatataaggaatacatttctagccattcaaattgatttaaaa

SEQ ID NO: 37295 - DNA, 201 bp, Homo sapiens
gaacttacaggatataactttcttcaaagtggtaatcattatacccagtccttctttccgttttctactctcactgtcctagtttatggccgtatcacttygtagttggatgggctgttgcagtaacttctcaactggtctccctaccctcatgccatctgaatattaatttattcattgaactaccacactacatcttct

SEQ ID NO: 37296 - DNA, 201 bp, Homo sapiens
attgacgtcaagcccaatatcatatggcttttctaacagcaagtgccactttgggcttcactaacgtatttatggcatacagaacagaataattaattcartaaattctgcactggccagatgacctctgcagtgttgaattcagttctgagtacataatttcaagaaggatattgaaaagctgatgcactcacataaaca

SEQ ID NO: 37297 - DNA, 201 bp, Homo sapiens
tatttatgtggggcacatgatattttgctacattcatcaaatgtgtaatgattaaatcaggatatttagagtatctgtcacctcgagtatttgtcatttctttttttttttttttttttttgagaccgagtctcagtctgtcacccagtctggagggcagtggcacattctcagctcactgcaagctcactccgtctcctg

SEQ ID NO: 37298 - DNA, 201 bp, Homo sapiens
accatgcccggctaatttttgtatttttagtagagatggggtttcaccatgttggccaggctggtcttaaactcctgacctcaagtggtccatccgcctcrgcctcccaaagtgctgggattacaggcatgagccactgcacccggccatatttatcatttctatgtgttgggaagtcccctcttcccactattttaaagt

SEQ ID NO: 37299 - DNA, 201 bp, Homo sapiens
aaagtaaacatagtagtcttctcaagattattagcaaattttccttaaaatgcttgcatctgaaaagatggcttcagcctgattattttaaagcctgtgtrgttcatcagtttaagtagggaagtggaacttggcgatctcagaggagttctgtagcctccatgcccctgctccccccttttcatggctcactactgccat

SEQ ID NO: 37300 - DNA, 201 bp, Homo sapiens
ttattagcaaattttccttaaaatgcttgcatctgaaaagatggcttcagcctgattattttaaagcctgtgtagttcatcagtttaagtagggaagtggracttggcgatctcagaggagttctgtagcctccatgcccctgctccccccttttcatggctcactactgccattcacataagcaaacactagcttccctc

SEQ ID NO: 37301 - DNA, 201 bp, Homo sapiens
gcagatctcaccttggagctaggatgctttcatgtccctccaaccctcactgattatctttgtaacagagagcaggcctcaggctaggagtgtttgtcagaaaaaaaaaaaaaaaaaaaagaggatcttgtgagaattgaaagagatagcattgtctttccttgactttagttttatggccactttgtacttatataaagt

SEQ ID NO: 37302 - DNA, 201 bp, Homo sapiens
attactttgttatgttttttacctattatactgtgaacatttcacatgttcttttttataaaggccttggaagccaaattttaattgctctatggtatcaytttgtataccgtaatctattgagtaatttcccttttgttggataaacaattagtagcacattatagttactggatttttagatcttagtttactggttca

SEQ ID NO: 37303 - DNA, 201 bp, Homo sapiens
ttgactttagttttatggccactttgtacttatataaagtattactgagtttccatttaagtagtgacataaagttttaaaaaataaatccaattggaaasaaaattttatttatagaagactaagtgtacaatattatgggtggctggtccataacatggtagaatcaccaaggtaattgctacatgaataattgaaatt

SEQ ID NO: 37304 - DNA, 201 bp, Homo sapiens
acttaggttgattccatatctttgctattgtgaagactgctgcaataaatatgggggtgcaattatctttttaatatactaatttcttttcctttgataartacccagtagtgggattgctagatcatatggtagttctcttttgagattttgagaaatctgcatactgttttccatagtggctataccaacttatatacc

SEQ ID NO: 37305 - DNA, 201 bp, Homo sapiens
ggagtgcgagacagtgggcgcaggtcagtgggtgcgcgcaccgtgcgcgagccaaagcagggcgaggcattgcctcacttgggaaacgcaaggggtcaggkagttccctttcccagtcaaagaaaggggtgacagatggcacctggaaaatcaggtcactcccacctgaatactgcgcttttccgacgggcttaaaaaacg

SEQ ID NO: 37306 - DNA, 201 bp, Homo sapiens
tgcgtttttggtagaacgattgctatatttagtttaaaattttagggcggcaggccgggcgcaatggctcacgcctgtaatcctagcactttgggaggccraggtgggcggatcactaggtcaggagatcgagaccatcctggctaacatggtgaaactccatctctactaaaaatacaaaaaattagccgggcatggtgg

SEQ ID NO: 37307 - DNA, 201 bp, Homo sapiens
cgcgcgtgggtcggggcgggggcgtcggggggccactgggaattcagtgaagagggcaccctataccatggcagtgcccggcgacgctgcacgagtcaggracaagcccgtccacagtggggtgagtcaagcccccacggcgggccgggactgccaccatcgtgcggaccccgcatcgccgcgggactcgggctgccgtgg

SEQ ID NO: 37308 - DNA, 201 bp, Homo sapiens
cgattgctatatttagtttaaaattttagggcggcaggccgggcgcaatggctcacgcctgtaatcctagcactttgggaggccgaggtgggcggatcackaggtcaggagatcgagaccatcctggctaacatggtgaaactccatctctactaaaaatacaaaaaattagccgggcatggtggcgggcacctgtagtcc

SEQ ID NO: 37309 - DNA, 201 bp, Homo sapiens
aggaaaacaaaacaaggcctgtttttttctgactcctagcttttctaccagtatcttacctctctgtctaaagtagatcaaatatcctgtactctgggtgkcatcatgttatttcactcctctgggcctttacaagtacattgtttcaacttttaataaatcttaaatacaactgaaacattatttgagtcccagctctaa

SEQ ID NO: 37310 - DNA, 201 bp, Homo sapiens
ctgttttcgtaacacattttacatccataatgcatttatcatagaacttagaacactatgcaaaatttcccactagactaaagcttctagtatccaagtastacttcatttgactctccaatagtgattgccacccataagttgttcaggaaatgttgaatcaatgaatgagagtggggcataaaatgggaaatttgagca

SEQ ID NO: 37311 - DNA, 201 bp, Homo sapiens
agcacacagaactttcatttaacctacttcactatttgactatggtgtggccttgcttttaattggaggatagctggagttgcaatcagtattcatgaaarcatgtttttaaaaaaatgagaatcagtctaacagaatctgaactttaaagaacatctcattactgattatacatggtgacgatattttccaaatcgtgga

SEQ ID NO: 37312 - DNA, 201 bp, Homo sapiens
tatttggagtagaaattacctctgaatatgaactttggaagacttctaaaagtgatataacctctcatttaaccagcacgaggtccatgggggtaaaattwactatacctggtcttcttaaagctgcacatctgtgaaagcaaaaggttataattaagtttttctggaatttcatgaaattacacattttaaagtatagtc

SEQ ID NO: 37313 - DNA, 201 bp, Homo sapiens
gatatattgagtcctataaccttaatttgattttgctcttaaacactttaatccattcataggatttataacgggtgtggtgaccacatcttgattaaccsttactgaggctgagttgaaatatgcatttttagctcagtgcccttcccagttcttctgctatttaagaagggaaagcagttgccttttccgtgttcttgg

SEQ ID NO: 37314 - DNA, 201 bp, Homo sapiens
caaggaggagataaattaaatttccacctacaagatcagtatagcaatattctgaattcaaaattctgttgttaaggatggtgtaaccatatatgacaagscttttacaaactcctttttgaacattgctttaagcaatcatttgtgtatttgtattaattttcaatctaatcattccaaatgaggcaaagttttgtgtac

SEQ ID NO: 37315 - DNA, 201 bp, Homo sapiens
ctaatcttcttaatgagttcatagcaaggcatgtggtatttgcgatagaaaagactcagtaaaagctgtcttccattcagtttttgaaaagtgaatggatrccagtttatgttatttcctatagtgcctatcttaaactgatttttttttttttacttgctgaatctcatttcatgtcaatatgagttttgtattggtaat

SEQ ID NO: 37316 - DNA, 201 bp, Homo sapiens
caatcagcagtatgtacaatgattcagagttgcgcattaggtaatgctttggtaaaaatcaaaggttcttaggctcaatcaaagggattgagaaaaatctmagagactgcagagaaaacaattgaagagccatgtattatagaaattggagtgggaatgagctctcacagaaagaaaagtaccaactgaaaggctggtcaa

SEQ ID NO: 37317 - DNA, 201 bp, Homo sapiens
aaaggttcttaggctcaatcaaagggattgagaaaaatctaagagactgcagagaaaacaattgaagagccatgtattatagaaattggagtgggaatgarctctcacagaaagaaaagtaccaactgaaaggctggtcaagatttcattaattcacaaagaaaattacaaaaactttaggaaaaaaacctagtatttggg

SEQ ID NO: 37318 - DNA, 201 bp, Homo sapiens
ctgcagagaaaacaattgaagagccatgtattatagaaattggagtgggaatgagctctcacagaaagaaaagtaccaactgaaaggctggtcaagatttsattaattcacaaagaaaattacaaaaactttaggaaaaaaacctagtatttgggatgtacaaatgagaccatgcacgttagatcaaaatttggtaaatat

SEQ ID NO: 37319 - DNA, 201 bp, Homo sapiens
gacatcaagagcaataatgtgtgctaagtcagaggaataaatgtacagcctagtattaaagtaatgctcctttaccccctctgcacactcgcatgttgctktcctaacaaacacgcaaatatgcaagcgtttcctagaagtgacagctaatggtataaattaacctcttgaatctggcattttcaaaactactgtagcaca

SEQ ID NO: 37320 - DNA, 201 bp, Homo sapiens
ttcatttttatttaatttactgttactaattggctttttttcattgatcaatgaaaattgttttaagtaactaatgtacctactttgatttttatagcctrgaaatagtaggaaaaaaatcacaagtgatgtgaaatatgtgttaattctattatagaacaggaaagctgttccatttctatgaaaactgggaagtacaaa

SEQ ID NO: 37321 - DNA, 201 bp, Homo sapiens
cctgaactcctgagctcaagcaatctgcccacctcggtctcccaaagtgctagaattataggcatgagccccggcagctggccaaggcttttattctttcmctgtagagaatttataagtattacagctaaacaagaaaataacgtactaatgtggattcatggttcaggcatacaagttttttctcttaatactaggttc

SEQ ID NO: 37322 - DNA, 201 bp, Homo sapiens
ggaatgaaaggaatactgaaggaaggaaaagagatgaagtgacgaagcacttcttttggccactttcctgctgcatgtctcactttgggtgctacttagawgtagatagagttggcaccaccaaacagggttattactaatcttggatctcacatataacttttaattttaggttgaaaatatgagaaaagtgttcttctc

SEQ ID NO: 37323 - DNA, 201 bp, Homo sapiens
gagaaaagtgttcttctcattgacaagtaattagccccagaatttccaaatcaattttgaatatcaggaagattaaaaattgaactactagaggccaggcrcggtggcttatgcctgtaatcccagcactttgggaggctaagatgggcagatcacttgaggtcaggagttcgagaccagcctggccaacatggcaaaact

SEQ ID NO: 37324 - DNA, 201 bp, Homo sapiens
ttttaaagcattaatataaacttaattaataatagtaggaatgatcaggtcctactactcatggatttcttttgagagcttaatttaaggagggaaccctyatctcagaaaaatttacatgactatgtagagatataaatttacatgtaatttcagaatattctgaagtctttaaaactttatttaagaaccttgcagtag

SEQ ID NO: 37325 - DNA, 201 bp, Homo sapiens
tggataggtgttatgtggagaaaggaagttttagaacacaacattctgtagattccttgctgtgtgttaacaaaagaaactggaacttcaagtgagtcgartgtcatattctacaattaaaatatgatatatttttaaagacaaagtaggtggggatagagatatatagacaagggacaaacgatctagaattcatagaat

SEQ ID NO: 37326 - DNA, 201 bp, Homo sapiens
catggaaaactgcaactttgagggagtgatctttcctgcaaataagcctgtaacggtgccacaggatgtggcaatgagtcaggaagcattttctctcttgwttttatttttttgctagggagtgtgttccctggtatagagagacacatctcatctcattttatatttgatgtatatctcacagactctcgaaaacttaat

SEQ ID NO: 37327 - DNA, 201 bp, Homo sapiens
ctcactctgtcatagggaatccccactgcattccttgttactgtagagtcaactgtgagattcttggtcgtggaacattttcattccattactaacatcarttatctctgactagcatttgtattcaggtcgattaaaaatatccctctgctgttgaatgaaatcttagaatcttaattcttctacgtcattcaatagaat

SEQ ID NO: 37328 - DNA, 201 bp, Homo sapiens
aaatcctctttttaaaatataaataaatatctttaaaataatattttaggccgggcatggtggctcattcctgtaatcccagcactttgggaggctgagaygggcggatcacgaggtcaggaggtcaggagtaatcccacatcgttcaagtcagtaatgaatttatttgaatcaaaagtggatacatttaaggaattgttt

SEQ ID NO: 37329 - DNA, 201 bp, Homo sapiens
aaaataaagattgcactgaatccatacattgcttgggtagaatggtcattttaacaatattaatacttcagatccatgatcatgggatgtctttgcattcrtgtgtgttgtcttcaacgtgtttcatcagatttttgtagttttccatgtagaggtctttatccatcttggttaaatttatttctaattttttatagctat

SEQ ID NO: 37330 - DNA, 201 bp, Homo sapiens
ccacatggtaattcctcccttaaagaagtctgctgtatataatgttaaggcagggttgtcagggctgttatgctgtgtcccaagccaaatacatttctcarcattccaaggttatgcgaatacacagaaataattattttcagatgttgacattgcacttagtgatttagtaatatgagaaaatatggttcaaaagttatt

SEQ ID NO: 37331 - DNA, 201 bp, Homo sapiens
tagccaggagagttagttaagtatttctgatcttatagtgaatgataatgtttgtacaacctaatagttgccccttttcctttctttttcttctctaatartaatagcaaaaacattgtttctggcattcagtgagtgccagataaatagaaaggctatgagcttgatgcacagtttcttttctttttcctgggtcctctc

SEQ ID NO: 37332 - DNA, 201 bp, Homo sapiens
tcgaaagctgaaactttcagtggattgtgggcctggggagaagaaggattccgagggtggaattgggaagagcgtgcgtgcgtgtgtgtgtgtgtgtgtgygcgcgcgcgcgtgggtcggggcgggggcgtcggggggccactgggaattcagtgaagagggcaccctataccatggcagtgcccggcgacgctgcacgag

SEQ ID NO: 37333 - DNA, 201 bp, Homo sapiens
aggtaggtcttggctcaggttcagagagagccatctaatgaccacaaccttcaagttctagacgcacctactgtgtgaaaggtgaattcctttttgctttyaataaaggagaatccagagaaagactggttgtgctcttgagcagggtgggacacctaggaagtgtctcttgtcaaagacataatccttgattttgcaggt

SEQ ID NO: 37334 - DNA, 201 bp, Homo sapiens
tgacttttcttatattctttcccccagatagcttatagtacacattaagaaaattaatgcaagtattttgcacgtacgttcttgtaaagcaaatatacacrttctgaaaaatttccagctctcaagttttgccttccacttgagagaataacaggagaaaaatatgctaacttgataacagttaattttatctttgaattg

SEQ ID NO: 37335 - DNA, 201 bp, Homo sapiens
gtagagatggggtttcaccgtgttagccaggatggtctcgatctcctgacctcatgatccgccccgcccccctttggactcccaaagtgctgggattacargcatgagccaccgcgcccggcccccactttcttacactgtatctttctaaagaataagtctgaacaaagtagtgactattttaaaccaatagtatacatt

SEQ ID NO: 37336 - DNA, 201 bp, Homo sapiens
ccacacagagttactactggggcagtgcctaatggaactgtgagaagagagccactgtcctccagaccccagaatggtagatccaccaacagctggcaccrtgtgcctggaaaagccacagacactcaatgccagcccatgaaagcatccatgagggaggctgtaccctgtaaagccacaggggcagagctgcccaacact

SEQ ID NO: 37337 - DNA, 201 bp, Homo sapiens
aggactatctgcctttgttcttaaaaaaaaaaaaaaaaacttgtgagagtctttttaaaattctatagtcagatctatgacaacaaaagagactgagacawccacaagttatttctaccatgtttgtttaactcaggagattgaatttgatgtgttatatacatggtatgaaccaaacgcataatagaaattgggtcttct

SEQ ID NO: 37338 - DNA, 201 bp, Homo sapiens
tatcttgggcatatggggcacaccctgcaaccagaaacagcacaggaatagtcattccttcatgacaacttctacgaaagtgtaaattgaggctaacaggraaatcaccctattactcctgtaaagtgacgatagctttcagttttcaaatgcgactttctgatcatgtttgaatgtgtttctgttcatgtttatggagaa

SEQ ID NO: 37339 - DNA, 201 bp, Homo sapiens
ttccccttcttttctggaatgcaatcaatggtgaaacatgttttacggtaaaacatttaatactccaaattgtgaataaagcaaagagaatgtgtttaatrtattttttaaatcatatactttctttaagaccctctcactcctaacataagctagagttttccgtttcaatatataatcaaaaaaccaagtatcctatta

SEQ ID NO: 37340 - DNA, 201 bp, Homo sapiens
atcaaaattgtgaaatctttgatagatggaagaaagtagttgtctttgcttgtaatgaatactttcaaaataaagtcgctgaataaaaatagtgatcttaygaaatattatagttggatatcatcagagaggtgatattataaatcttctaccccagatagtgattttttaatagtctttctgttgcaaatgtttagtcac

SEQ ID NO: 37341 - DNA, 201 bp, Homo sapiens
tataggaaagtttggaacttctagagacttgttgaatggcactgaccaaaatgctgatagtgatatggacaataaactccaggctgaggtggtctcagatraagatgaggaacttgttgagaactggagtaaaagtcactcttgttttgcttaccctgcagagccacaggggcaaagctgcccaagaacacctcctgcatc

SEQ ID NO: 37342 - DNA, 201 bp, Homo sapiens
cacatctcatctcattttatatttgatgtatatctcacagactctcgaaaacttaatcttcatagtaactttagtgcaggttttttttttaaatatgtatyttatagaagaagaaactaaggcttaaaagaggctatgctactcttctaaagtcatatagtaaatattcaacccaggattccaaagcagatttatccatat

SEQ ID NO: 37343 - DNA, 201 bp, Homo sapiens
ctcttccaccaaacgtgtgcacatccttgagagccgtgagcaacttgctcagcacacagctcaccttccaggccattcacaagcccagagtgaatcccgtyacttcgctcagtgaaaactatacctgttctgactctgaagagagctctgaaaaagacaagcttgctattccaaaggtaggtagtaatgacatacccctta

SEQ ID NO: 37344 - DNA, 201 bp, Homo sapiens
agacattaaactttgaacaaatgtagtttcatatgacttgctaagtagaactttttgggatttttccttttatttgagtttataagaacaaaaatcatgarattttcattatggaaaatatgtatatatttttgccatagtgagactttaggacagctgaaatgaattaatgtgaacattccaataaatcaccttttggct

SEQ ID NO: 37345 - DNA, 201 bp, Homo sapiens
aaaatgtctccagggcatgtcagagaccttagtggcagtccctcctatcatagacccagatgcctaggcagaaaaaacgatttcacaggccaggccccagwccctctgctgtgtgcagcctagggacttggtgccgtgagtcccagctgtttcagccatggcagaaaggggccaatgtacagctcaggttgtggcttcaga

SEQ ID NO: 37346 - DNA, 201 bp, Homo sapiens
tcaccaatacaagttctgttcatctagttgtctgggctctggcttgaacctttattgctggcacttagcataacagctaaatacttaaaatgctttcattrtaccagattttggatttctttaatttgtgaccacaagctcagtgttttgaaaggtagaatcatacaaagaaacaactataatctaattaacctaagataa

SEQ ID NO: 37347 - DNA, 201 bp, Homo sapiens
atgttatttaaatcatattttagcttttaagcttttaaaagttttaaaagcttttatatttgcttatgcacctcagacttcagagtcccataactttttcktaattgtaaagagctgaaattacattaaaaaataattaatactaataaaacacaagtatttccaggaaggggtatcacatcaacttagggatttattatg

SEQ ID NO: 37348 - DNA, 201 bp, Homo sapiens
ccacttgctgtagtatctcaaagtttcagcgttatcttgggtgtttatgttacgtgttgaagtgggcgcttattctataatggaagctatattattagatmcttcttctcaaaaagccagtcaaatcgctttaatgaaaactgtaagtagttgtgctctaaagaggatgcaattatttaggaaacattctcataagattta

SEQ ID NO: 37349 - DNA, 201 bp, Homo sapiens
gggtatcacatcaacttagggatttattatgagcatatttattgttttcaaaatcccatccacctgctacattggaatgaatatacacagctgttagtgtrtcatagaaaaagagaatgaaaaactgaatctacaagtgagattttctgaagaatgtgggaccaaaatacagacagagtaaggcagttggagtacgggaaa

SEQ ID NO: 37350 - DNA, 201 bp, Homo sapiens
accagctctcagggagtggggaggaaatcatgtaagtcaatatatcttttgctatcccactgtttaccaattgcgtatgagctaattaactatgcagaaaygtgttatagcagaaaagatttagtagtgttatacggtaggctaaaaggagtactggttagaaaaattatcaaactatatcctatcatttttccatttatc

SEQ ID NO: 37351 - DNA, 201 bp, Homo sapiens
atcctttaatagctagtctggattacccctcataaaaatttgcaaatggtcaggaaagtgtgttataatttacaacacttttccacttgaagtattttagrcaggactagggaacaatgtaaggatgtaaaagtggaggtggtagagatggggtttatctcttttcttcttaaataataatcttggaattatgaatctgta

SEQ ID NO: 37352 - DNA, 201 bp, Homo sapiens
tccattttacaaaactgaaacactgtacccactaagaaattactccccatttcttcctttaccaagcctctggtagccaccattccactttctgtccctawgaatttgactactttaggtaccttttagaagtaaaataggacagtatgtgtctttttttgtgactagcttattttacttggcataatgtattcaaggttt

SEQ ID NO: 37353 - DNA, 201 bp, Homo sapiens
agactgaatttccaaattcatgttatattttcaaatgtattttaatgatgtaattagccatagcaaagttccactgagttcaaattgatactaaactccayagacataactaccaactttttcacaggtggtatatcattaaatcatagttgaaagatggcaaatgtttaagtacaaaaataagttttcagattctaagat

SEQ ID NO: 37354 - DNA, 201 bp, Homo sapiens
agtcaatatatcttttgctatcccactgtttaccaattgcgtatgagctaattaactatgcagaaatgtgttatagcagaaaagatttagtagtgttatayggtaggctaaaaggagtactggttagaaaaattatcaaactatatcctatcatttttccatttatccatatcaagcattttccactataatctctgttat

SEQ ID NO: 37355 - DNA, 201 bp, Homo sapiens
tataccaaaacaatatttgatatatgatgcctttctaaaggttatctttctgatttttttcccaaaatatatttattgaatacttttttgtaatccctccyagctactgtgttggcactcaggatgtaaatgaaatggtaacatttagaatattttttaaccagcgtggcattgacgcgattggtcagaaagaacattgat

SEQ ID NO: 37356 - DNA, 201 bp, Homo sapiens
aaggcctaaggttttattactttgcacctgcgctactgaaataatgtcctaacaggtctctggagattccctccctgcttactgtcataatctgtaatgcrtgaatagtctttatatacatggctttcttctggttgttgacaataggactatcatgaatggacctccatgggtggttagtgcaatgtagaggtccgagat

SEQ ID NO: 37357 - DNA, 201 bp, Homo sapiens
ctttaatatgataatgtgtgcaaatattagaaactaaatttcttattatagttctaagtgtacctttaacggttttcaagaaaagagggtaagtaggaaakcttttaaatttgtaattagaatccttacaaaaattgaagaatctagatttaaacagagaattaaagtaatttcatggtagtagcaatagaaagacaagaa

SEQ ID NO: 37358 - DNA, 201 bp, Homo sapiens
gagatgggtcctgttgtgtgctctgacatcagcaaccctgtgaccttggacaatttacttagtctaacggttctacagtttcacatttatatggtagattkaagaccatactcctgtagaattgttgggaagattataagaggaaatacttgtaaaatgcttaacgttgtgcctaaggtgcaatagtgtctcattggctac

SEQ ID NO: 37359 - DNA, 201 bp, Homo sapiens
ctgtgttggcactcaggatgtaaatgaaatggtaacatttagaatattttttaaccagcgtggcattgacgcgattggtcagaaagaacattgattgtaarccaccctatggtcatcctggtgcattttggctctgaatttaataccaaaagaggcagctacatccccaccctcttaaggcttatggttccttgtaaagtc

SEQ ID NO: 37360 - DNA, 201 bp, Homo sapiens
gacatggtacatgctagaggggcagaactaccagagtattaactatattccaaaagaaaaaaaaatatttaaagtgttacctctattctttattacttctkcttaccctatggtgcataggagcatagacaaaattttaaatacaaaatatataaatttggatcttaaaatctgtgaatttacatacaactccaaccctcc

SEQ ID NO: 37361 - DNA, 201 bp, Homo sapiens
tattttattgaagtacaatttgtatgcactaatgcacaagtcttaaatgtacggttcaattagtttggccaatgtatataacctgcatatattttctcagstcatattactagttcctttattataattaacagcatgcaacacattctgagtggtaacgaaggtcaaatgtatgtggggcattttagctgtacgcttgtt

SEQ ID NO: 37362 - DNA, 201 bp, Homo sapiens
gagtaaaactttctatttacttcaatagacgtgatgtgaaattattcgtagagcgaggtagttaaattttgtttgcttgtttgcttaccaaatcataccaraagagttactttttgttcatttaatgagtacttataaaaaatgaagctattttttagtgattgtaaatatttaagtgatcattccagactattttgcaaa

SEQ ID NO: 37363 - DNA, 201 bp, Homo sapiens
tataatttggctcatacatatcttcagaaatgatatttgatacgttaacctggttaattgtctaagatgtgcatcttgtgtaactatgaatatacataaartggataagagaagtaacatgaaacttctaaggaaagtatttggtaagagagagaattctatttgtttttgaaaaattatggcatcaagttaattcattat

SEQ ID NO: 37364 - DNA, 201 bp, Homo sapiens
aattattgcctccaaatctgctccatcctttctaacagctgatggcaactccaaccttccgcttactctgtcagaaatcctgaaggcatctctgactcccytttctctgttacacctcacatccaatctaccattagttcaacttgctaaataatccagaatctggtaacttctcaccatctctgctgctacaactctagc

SEQ ID NO: 37365 - DNA, 201 bp, Homo sapiens
ccaacaaaaaagaagatggagctacattactgctccggagccttgggcaagttattattctccctgtgcgtcagtttcctcatctgtataaaaggaatagyaatatatgtgttgtgaggactgaatgaggtcacccaggaagtgtgcttacaaaaatatgttgtgtagtcatcatcgtttactattcttgttactatcatc

SEQ ID NO: 37366 - DNA, 201 bp, Homo sapiens
tttcaactttccacattcaatatgatattagctgtggttttattatgtgtggtgtttattatgttgaggcatgttccttcctagtatttttagtttttatyatgaagtgatgttgaattttatcaaatgctttttctgcatatattgagaggatagatgcaaaaaagcatttttatgcgaagtcacccagtactgaacttt

SEQ ID NO: 37367 - DNA, 201 bp, Homo sapiens
acctcccagaaaggttctatgtgcttatttttaattacacaatggaatatctggcagaacataagacattttaagctgtaagtagaatgattttccaggartttctgagcatcttagagcctacatttaccattatcagaggcacctgagtactgcttcgtaaattgcaacttcgttacgttagatagtgtcctatttcca

SEQ ID NO: 37368 - DNA, 201 bp, Homo sapiens
cccattccttgccctcagaggtaacctctgtgcactaccctcttgtggttagaagatggagctaggccgggctcggtggctcacgcctgtaatcccagcaytttgggagactgaggcgggtggatcacctgaggttggtagttcaagaccagcctgaccaacacggagaaaccccgtctctgctaaaaatacaaaaagcca

SEQ ID NO: 37369 - DNA, 201 bp, Homo sapiens
agatgcaaaaaagcatttttatgcgaagtcacccagtactgaactttttattgttgggagtctttattgctgatttaatctgattacttattattggtctrtttaggttttctatttcttcctgattcaatcttggtatatgtgtccaggaatttatccatttcatctaggttttctagtttgctaatacatacttgttca

SEQ ID NO: 37370 - DNA, 201 bp, Homo sapiens
acagagctacacagtagcttcttttatcacacagtgatattaaaatactctcaaaatgattagaagttgaaatattagctatcaaaccaggagtttgctaytaatttaggtatgttaatttattcatgatagctatttaatatattactaataaagattggaacaacctgattattctttaaaataaagaagaaaaatgtt

SEQ ID NO: 37371 - DNA, 201 bp, Homo sapiens
accacttgttcatgcatttcactgacctcgcatggcctcaccaaatgtcaaggagacagggaagcaccatcctaccacgtggctgaaagtgggagacgcayggaaatacttagttcacaccactgcaatgggttaaagatctgaaattgtaagacaattcttttgaaatttatgttcactagtagtttgtaatagtgtcga

SEQ ID NO: 37372 - DNA, 201 bp, Homo sapiens
aattttgcattttaaagacatttgtttagttacttaactctcattctttctcaggtgccctcgctaaaatttcacctctttcatcgccctgctcctcacckctccaagggactcctgccagcagcctggtcagcaaaatttctgcagtgcagtttccagaatctgctgacacaactgccaaacaaagcctaggttctcaca

SEQ ID NO: 37373 - DNA, 201 bp, Homo sapiens
gttcaaaatagtctctgatacttttgtatttctgtgctatcagttataatgtctcctttttcatttctgattttatttttggaggtcttctcatttttctyggttagtctagctagtggcttattcattttgtttatcttttcaaaaaaccaacttttgtttccttgacacattgtactttttaaatttttattttattta

SEQ ID NO: 37374 - DNA, 201 bp, Homo sapiens
ttttgactactactttgtgttgtttccattttcatttgtttcaagaaatttattgatttattccttaattatctctttgacccaaaggtcattcagagacwttttttttaattttcatgtatttatacagtttccaaagtttcttttgttattgatttctagttttattcattgtggtctgagaagaaacttgatataatt

SEQ ID NO: 37375 - DNA, 201 bp, Homo sapiens
tagcatctggtctatcctggagaatagttccatgtgctgacaatgagtactctgcagctgttcaacaaaatgttctgtaaatatctgtgaagtccattggyctaaaatgcagtttaaatccaacgtttatttattaattttctgtctagatgagctgtctggttctgagagtgggatgttgaattcctcaactatttttgt

SEQ ID NO: 37376 - DNA, 201 bp, Homo sapiens
atcatatactttctttaagaccctctcactcctaacataagctagagttttccgtttcaatatataatcaaaaaaccaagtatcctattaagtgtatattrttgactcaaattgacaaggacattggtaaccttccttttttttttttttttttttttttttttttttgagacagggtctccctctgttatccaggctgga

SEQ ID NO: 37377 - DNA, 201 bp, Homo sapiens
gaaaaatttgtattgagatgtgctaatagagaatttggtataactaaacatctgatatataatttatattttgaggtaactctttagccaacattttaaartatgattaatttatagtacttacgaaggattttcagagacattacatttttctgttatttcactgttttaaacaagatggagattagagggtggaaaatg

SEQ ID NO: 37378 - DNA, 201 bp, Homo sapiens
tattaaactaaggctcagaaatttaaatgacattgcaaggttgtagaaccagaaagggaacctaggtctcttaatttttaacttcaatgcttttggctctyagtaatgttaatatcagaattcatactggctaaaatggttaccttgactttgcctaatacttaggtttcagaaaaaaataaatatgcacagataacttct

SEQ ID NO: 37379 - DNA, 201 bp, Homo sapiens
aaattcagtcacaatgctatatatcaggctctcagtgattttttaaaggagggtcaattttaagaattctaaggaatctctttgttcctgctaatttgtcygaaggtttacgaggaatacaggagaaagctaaattgtttggggaacagtaagagatttagattctgagaaagatcctggaggaaaagctggggccagtat

SEQ ID NO: 37380 - DNA, 201 bp, Homo sapiens
tctcagtaatgttaatatcagaattcatactggctaaaatggttaccttgactttgcctaatacttaggtttcagaaaaaaataaatatgcacagataacktctgtagtttgtaaaacttggagatgtcccaggaaacagaataaaatgtttcaatatggtatcctaggaaaagaaggtttttatcccaccttataattaa

SEQ ID NO: 37381 - DNA, 201 bp, Homo sapiens
acacacaaataataattttttatttcccatctagttacagtcctccttcagctttcatccctttagtaatagttgtggtgaattttttctcccgagaagcycctaaaaaggcgttcatttttacgtaaacaaacaacaggagaaaaacatataaacatgaaagcaaaatattttacctacagaaatatattttcagcaatc

SEQ ID NO: 37382 - DNA, 201 bp, Homo sapiens
acaacaggagaaaaacatataaacatgaaagcaaaatattttacctacagaaatatattttcagcaatctatttctcatgctattgttaaaaatatctctrcttggatagaacctttttgtttccatgctgacttcttctttgcttctcctgtgaactttttaaattctgtgtttggcagcagttttgttttccttggagc

SEQ ID NO: 37383 - DNA, 201 bp, Homo sapiens
gggtcttcattgtgcctatcttggttaatgagaactgagaagagaagaaacattctcttttaaaaaaaattttttttagagaatttcttcatcagacggaragattttatttgccatttgcaggcataaccttggtgacctatatatccccagaccttctggtaagatgcttattaaaatgtcattacccagaggagtaat

SEQ ID NO: 37384 - DNA, 201 bp, Homo sapiens
gcacttaattctgaaattcattgacctcaatgtgcaagctgtcttctttactatttattgtgaataaccatttttttttatttgttgtaatcacacatcargaaagggctagggagatgtctttgtgaaacatttatccctatggttctgtttaataggagtacttaccagtagctaaatgcctcattttattttaaataa

SEQ ID NO: 37385 - DNA, 201 bp, Homo sapiens
aaggttttattactttgcacctgcgctactgaaataatgtcctaacaggtctctggagattccctccctgcttactgtcataatctgtaatgcgtgaatartctttatatacatggctttcttctggttgttgacaataggactatcatgaatggacctccatgggtggttagtgcaatgtagaggtccgagataacccca

SEQ ID NO: 37386 - DNA, 201 bp, Homo sapiens
ccatccatgtaagatgtgagttgcttctccttgccttcctgtatgattgtgaggcttcctgagcaacatggaactgtgagtgagtgctcaattaaacctcyttcctttgtaaattgcccagtctcaggtatgtctttgtcagctgcatggaaatggacgaatacagtaaattggtactggtagagttgggtgctgctgaaa

SEQ ID NO: 37387 - DNA, 201 bp, Homo sapiens
atgaggtcctggcgtcactcaaggaccggccggcgagcggcagcccgttccagttgttcctgagtaaagtggaggagacgttccagtgtatctgctgtcasgagctggtgttccggcccatcacgaccgtgtgccagcacaacgtgtgcaaggactgcctggacagatcctttcgggcacaggtgttcagctgccctgcct

SEQ ID NO: 37388 - DNA, 201 bp, Homo sapiens
attactttgcacctgcgctactgaaataatgtcctaacaggtctctggagattccctccctgcttactgtcataatctgtaatgcgtgaatagtctttathtacatggctttcttctggttgttgacaataggactatcatgaatggacctccatgggtggttagtgcaatgtagaggtccgagataaccccattcttgct

SEQ ID NO: 37389 - DNA, 201 bp, Homo sapiens
actcaatgtaaagcatattatttattattattgtggtaacacctatcattatataaatataaccattcaataatgccgtattattcataatagaagtcacmagattcttatccattcttcgtactctgggcttcctatgagtaaatgtattttgttctttttgcagaattaagtaaacagaattatttctgctttgccaaa

SEQ ID NO: 37390 - DNA, 201 bp, Homo sapiens
ttaaatgatgccattaaatgagattaaaatatttctgaatttaatactgccaacttaaagtactgttaactttttttggcttgtttcaattggaagaaaaraagaggtagtgaatataacacacatctggaactaagaaaactaatttgtaagtcccacctcctccgctaaccatctgtagtctgttacacttgcagtggc

SEQ ID NO: 37391 - DNA, 201 bp, Homo sapiens
agacacaggcattttatttttgtttgaaattttcaaagaagatatcaaaatttgcaaggcataatcaaataaggcaattaacatactttagcctatacctmatattttgcttgtttttagtttcaaatcatcctaggatattattgattactcaactgattgacatggtttgggaaataaggtattttgaaaggaaaaatg

SEQ ID NO: 37392 - DNA, 201 bp, Homo sapiens
gccttatatataagtggaaagagtgacttgatgtgatctctgccattgtgaccttagatgggaagggttaagcccaggataaaggtaggtaattttatctrcattgagattcataccgagacccttaaatcaaaagcatacaacttgacatttgcatttgatatgagatcccccagcccagtcattagcctcccacaagac

SEQ ID NO: 37393 - DNA, 201 bp, Homo sapiens
gtgaagacaagcatacttttttttcatagattcttactcagactcattcaaaaagggatggattttgagtattcattttggtgaagtctctgaccttattrgatagtgatacctccaggtcttgctttatgtggggtcaattactgagccgttgatgaatttcatttatttcttgtttaatagagtggcacttaaaataag

SEQ ID NO: 37394 - DNA, 201 bp, Homo sapiens
cccatgattcaattacatccacttggtgtctcccttgacacatcggaatcatggggattacaattcaagatgagattttgagtggggacacagccaaaccrtatcagagggatacattcattaagattaacaattcttacttcccagtgtatatgttcctcatgtttttaaaaaggaaaatatgatagatgtggtgattta

SEQ ID NO: 37395 - DNA, 201 bp, Homo sapiens
ttttgagacagagtcttgctctgtcacctgtgctggagtgcagtggtgcaatctcaatccactgcaacccccgccttccaggttcaagcaattctcatgcstcagcctcccaggtagctgggattacaggcatgtgccaccacatctggctagtttttgtatttttagtagagatggggtttcaccctgttggccaggctg

SEQ ID NO: 37396 - DNA, 201 bp, Homo sapiens
gccttggcctcccaaagtgttgggattacaggcatgagtcaccacgcttggcttaatcacagatattaaaatcacatgtttgtttgagagttagagatacrtgtagagactttcaaagcattacttgaatttttttcatagttttttaaaactttgtttctaattattgaaataatcaatgcttactgaacaaatcttaaa

SEQ ID NO: 37397 - DNA, 201 bp, Homo sapiens
gaagagccccctcgtggcaaagagtgtaagcaaatggaatcaaatgaaatgtgaagagagtctgaggaaacatgtagcagcaataggcaatgaggcggagrgaaagcgagtatgaagtaagaagaggcatacagaaagataaataccctgtttccagagagggctaatgaaatctgttctttgcgcaaatcaagtaaacag

SEQ ID NO: 37398 - DNA, 201 bp, Homo sapiens
gaggaataagaagagtttcagatgaagagaagcagattctggcacacaaagttgaacagtgcaaaacattgaagcccagctatacataatcaagctggctragctataatacacattaaaataaaagtttttttctcaatggacaaaattggaactaagtatgtctgactgttttagagataagcacttctcaacttctaa

SEQ ID NO: 37399 - DNA, 201 bp, Homo sapiens
ctatggctgggagacattgattgttaacatttatgccccaataatgaatgacctgaatttttcccacatgtttgctcaggaaacacagggctgtggaggtsttgacgtcatagaggcagaaggatttggggccagagtatattcactgctggcagtcattcattagtaaatccttggtaagagagttggatttgagtgaca

SEQ ID NO: 37400 - DNA, 201 bp, Homo sapiens
gttaatttagtgttaggtgctaatataaaacattgcttgagccatgtagtgtcaggaaaacatatctgttattagttcttggttgccatttaaaaatggakattgaaatttcctttacctagcaggaaaattacaacagtgatccttgaatatttggaaaggacacatacattccaaagtgtctagtgatgaggcaaaatt

SEQ ID NO: 37401 - DNA, 201 bp, Homo sapiens
gatcattcaagtcctcctataggcctcttgatctgtacattaattggaataatggtctgttctttttgtagaaattaatcatgttcttaaacacctccatkcagtgtaagttctgactgtttaattaaaactttatagtaagctcaaactgggatcctgaaaatgaaaagatattttttgttatctggttcaggtttttgt

SEQ ID NO: 37402 - DNA, 201 bp, Homo sapiens
gacttttaagaacttaacgcccaaggatcttgtcattcttctttgtaaaatggatcatccaaatatttacaatagaaataaggaaaatacttacaatagamataaggaatagcatacaattccattcattctcattctctcattcctgaaaatactcgtagatgtcttgtctggacattcattttcctcactgcctaatat

SEQ ID NO: 37403 - DNA, 201 bp, Homo sapiens
aattttctgtctagatgagctgtctggttctgagagtgggatgttgaattcctcaactatttttgtgttgaagtgtctctctccctttagatctattaatrtttgctttgcatatatctgggtgtgatactgcttctcagccttttggctaagatcaggtttagtatctggttgctctggtattggtgcatatatgtttag

SEQ ID NO: 37404 - DNA, 201 bp, Homo sapiens
aatgatttctgctgagaaatctgttagtctgattggagtttccttataagttactagatacttttcttttgctgtttttagaactctctatgtctttgacttttttttttttttttttgagatggagtctcgctctgtcccccatgctggagtgcagtggcgtgatctcagctcactgcaagctccgcctcctgggttcac

SEQ ID NO: 37405 - DNA, 201 bp, Homo sapiens
tctgtaatattaagtcagtttatcacactatgagtagttttttttaatggattctgacaatatgctgcttattgtagtctttcatcctttatctgagaacwatgtttttatgacagtaaaatattttttatacaaataggataaaaattcatatgctgtcatgcgctaatatgaagtttatccttacatctcccactctcc

SEQ ID NO: 37406 - DNA, 201 bp, Homo sapiens
tctaaatcatactacttatttcattagttaattattgcttgtgaaccatattataatcatctttagtatcaataaatatttttgagatgatataatgccartaaatccataaattaaaaaattaaagcattaaagaaatatctactatgtaagcattcaattttatataatgattatctgggtcagtgtacccaaaattgt

SEQ ID NO: 37407 - DNA, 201 bp, Homo sapiens
aagaagctgaaaattatggttagggcagaccctggaaatatcagatcaagtgatggaacagcctcatattcctgtgtcctgatccccagtttgtatgactkcactctagaagaaagagcaaaggagcaaaatgtaaaagggaaggaatgtccacataagataccacatgggcaggtggtaggaatgagagccacaggcata

SEQ ID NO: 37408 - DNA, 201 bp, Homo sapiens
aatggggaaaatgtctccagtatatgtcagaggtcttcatggcagcccctcccatcacaggcctaggggcctaggaggaaaaagtggtttaatgggctggrttcagggtccctgagcagtgtgcagcctagggacttggttccctgcatcccaaccactccagttgtcactgaaagaggccaaggtacagcttgggctgtt

SEQ ID NO: 37409 - DNA, 201 bp, Homo sapiens
gagagcctaaagagattacaaccctccctaatcagatgggcccttctgctttaaaatccttgcttccctgtttgggttgatggagctaagtggttgtgacwtgtttgatgcagttgactgtgatgcatcctggttttccataaactccatggaaagaagctgggaagagccccctcgtggcaaagagtgtaagcaaatgga

SEQ ID NO: 37410 - DNA, 201 bp, Homo sapiens
tactgaaataatgtcctaacaggtctctggagattccctccctgcttactgtcataatctgtaatgcgtgaatagtctttatatacatggctttcttctgrttgttgacaataggactatcatgaatggacctccatgggtggttagtgcaatgtagaggtccgagataaccccattcttgctaaaaacattacacatttt

SEQ ID NO: 37411 - DNA, 201 bp, Homo sapiens
ctgtgcattgttttcttcctattacttgaatttaagttaattttcttttttattgactttagtttttagtttctgtctcccctaaaaaagtgggagctccrttagagcagggtttttattttataacctactccatccgtggagcaagactcacaataactacttgttggatgaagaaatcattgagatactcagtacaga

SEQ ID NO: 37412 - DNA, 201 bp, Homo sapiens
ctaattttttgtatttttaatagagacggagtttcaccatgttggccaggctggtctcgatttgcccactttggcatcccaaagtgctgggattacaggcrtgagccaccacgcccagcctcaccattgcattttcgtgcatttatattctcatataaaagacactgacttgtgtgattaaaatatcatctacttatacat

SEQ ID NO: 37413 - DNA, 201 bp, Homo sapiens
cctaaatactaggattacaggcataagccactgcgccccggcctctaatggattcttttttattgtatatacttgaggtgtacaacataatattttgatgyatatttacaatgtaaagtaattactaaggtcaagtaaattaacatcgatcgtctctcatagttttaactttgtgtttggtgaaatcaccgaaaatctacc

SEQ ID NO: 37414 - DNA, 201 bp, Homo sapiens
tattttgatgtatatttacaatgtaaagtaattactaaggtcaagtaaattaacatcgatcgtctctcatagttttaactttgtgtttggtgaaatcacckaaaatctaccctcttagcaaacttcagcacactgtataacatcatgaggtatagttctcatattctgcgttgtatcgctacacttattcatctgacataa

SEQ ID NO: 37415 - DNA, 201 bp, Homo sapiens
tccctcccccaccttttgtttcaatgggttgttgtcatggtgattgtaaactgtcatggtgctgtgaggtgtatcatttagcatgaaaattagattataaygaagttagagtttcttcagaggtcaagaaagctgccatcttggatcccgctagtcttggccagtttggtcactagggggacttttgacctcaggtgtccc

SEQ ID NO: 37416 - DNA, 201 bp, Homo sapiens
gtactggttagaagccatattaactagatttcagtttcttgaaaatttatacattagcaagcatagtgtaaatatgtattaagtgggcaataaatatttgytgtgttagtggcattttaatagtacatgatggaataaatgatagatgtgttgtaaaagcttttattgcatgattgccagtttctacctcattgttgtttc

SEQ ID NO: 37417 - DNA, 201 bp, Homo sapiens
tatggaattgattactgacaaatctttgttaagtaaggaatatatatctcaattttgatatccgcaataataaaggatagtgaataaaaaatattttactrtgtgctcatagaacacattgtatgaatttgccctttgatgtatatattcattaagttctacatttatgaagtacgctttgtggaaagtattaatttaagt

SEQ ID NO: 37418 - DNA, 201 bp, Homo sapiens
gtataatgggcaccatgatgacataaataagcttctttataaaatttctgctgtgtttcctacagctccctcctatgacaaactgagtatttgtgatttarttctactggatgatttacttctactggatatccttaagattatatttatttacaaataagtaaaaatcactgaagtgggatccctgggtttgttgttata

SEQ ID NO: 37419 - DNA, 201 bp, Homo sapiens
cggttttctccatactcctccaacgtagatgtccttaatcctcatttcaatgatgatgcagctgattcggatttaaagaagtttgcctaaggtgacatcgytattcagtgagggtactaagctttgaacctaggtatgtttaacgctaaagcctgtgaattgcaccatagtcattggtatcagtaatgaaaaatccaacgt

SEQ ID NO: 37420 - DNA, 201 bp, Homo sapiens
catataaatggtattttaaaaaactagttagcctgagatcaccaagggaatgaatgcacatggaggaggtctaaataccaagtcctggggtatacctgggsggtggggtgggtggcattaggctaaagatagtgaaaattctaatgaatgataagtaatattttgctatgttgatcttgagattgatatgttgaaatggca

SEQ ID NO: 37421 - DNA, 201 bp, Homo sapiens
ctcaaatgcataatctggcaaggaatttagtcataattagcaatacaacaatatcataatagatgttgaacaaagtactatggagacttcgaggctgaagygattaatttggtgtcagtttgagaatgaagctggaatgtttttatatattaaagttgaatcttgataatcaatactaaataaaagaaatgaagtggtagg

SEQ ID NO: 37422 - DNA, 201 bp, Homo sapiens
aagaaagatgaaggaagggagggaagaagatattcattgtcttagggcatctgctggttttctctagtatctccttgacttagaacatgaaccaatatttrtttttcttgtcatattgtcaggcatatattggcactagccacctattaaaatattctttaatgattacttactttgtgtatttaaaaagatccatttaag

SEQ ID NO: 37423 - DNA, 201 bp, Homo sapiens
actgcagtgataagagatatctctacacctataatctagactctgtttttcctatacaaaatttgaaaatatagagaactttaatcatggtattgtgattmtttttctttggcattctctttagatgcaatttctgctttggaaaaaatattcgggctatccattttcacctgggcatggaaaaaaagagatgtctttatc

SEQ ID NO: 37424 - DNA, 201 bp, Homo sapiens
gcagtgataagagatatctctacacctataatctagactctgtttttcctatacaaaatttgaaaatatagagaactttaatcatggtattgtgattcttyttctttggcattctctttagatgcaatttctgctttggaaaaaatattcgggctatccattttcacctgggcatggaaaaaaagagatgtctttatcaga

SEQ ID NO: 37425 - DNA, 201 bp, Homo sapiens
gtgatctgcctgtcttggcctccgaaagtgctgggattacaggcgtgagccaccgcacccagccatctttgacttttgaaagtttggctacaatgcaccayggggaggaccttgaattttatttgtgtgagtttctctgagcttcctgcatctagatgtctaaatctctttttgttagacttgggaagttttcacctataa

SEQ ID NO: 37426 - DNA, 201 bp, Homo sapiens
tccttttttccattttaactgcaggctgccttctctgtgtttgggagagagtaacttcaaaagacatcgtcctggtcttccaacagccacgttttgaaatmtaagccagtatcctgtaaaattcttacaatctagagtaaatacagacagtttggcccaaatacccatacttgaaatggaaactttaggtctattgtttgc

SEQ ID NO: 37427 - DNA, 201 bp, Homo sapiens
gtatatcatctgatttcaacttcggaaaatatataaatgtacatctaagcttctagtgaatggttgaaagaagtatatatggtgtgtaagttcttaagccratggattcagcctagagcagcagacctgttcccagcattttaacactaggtgtttatttacagtgatcaaagtgagaatgtgttacatcagaagttagat

SEQ ID NO: 37428 - DNA, 201 bp, Homo sapiens
aattaagacctcttttccagaagcaatctattatttttgtccagtgagatctatttaccctagaagtgtttgttcttataccttaatttttaaagtttttkttcagtaaaaaacagatatgaataagttggtaggaaaactattttaaaagggtatttttggccctataaaaatcccagcaggtatctctgcctacttttt

SEQ ID NO: 37429 - DNA, 201 bp, Homo sapiens
agttttgaactttaaggtttaatgactgccctattgaattttagacttgcatggggcctgtagcgcctttgtttcagcaaggaaactggtggcattttgcyctagccctagagatctgtgaaactttgaacttgagggagatgatttagggtatctggccgaagaaatctctaagcagcaaagcactcaagaggtgacttt

SEQ ID NO: 37430 - DNA, 201 bp, Homo sapiens
gttaaatgtcttttcttctctttagtgccacttagaaaacttggaaataaacaaaaaatgaagctcatatatttttttaccactgtctagaaaccattacwataatgctggtcttaattcatacttactagaattgggagatgtatttgacttactcataaatttgataggtggaaaaagtagcttatttattacgaagct

SEQ ID NO: 37431 - DNA, 201 bp, Homo sapiens
aaggggttgctgctcttcacactgaagcaaggggagagtgagatttctcatctttaacaacaacaacgacaaaaagaaataacagcgccaacaagaaattraaaagaaaattacacacgaacacacaaaatcgttcaacaaacttaatattcttttcagtggaccagaaaacctttggtatgacaactcaaacttttgagg

SEQ ID NO: 37432 - DNA, 201 bp, Homo sapiens
agtaacaaggagccaaatgttaatcaccaagacaatggagaaaatgtctccagggcatgtcagagaccttagtggcagtccctcctatcatagacccagakgcctaggcagaaaaaacgatttcacaggccaggccccagaccctctgctgtgtgcagcctagggacttggtgccgtgagtcccagctgtttcagccatgg

SEQ ID NO: 37433 - DNA, 201 bp, Homo sapiens
ttggaatgtttgtacttgttctccagggaatgggttacattgatattaggcatatttaattgtcagtttgcatttcccatttttgcaattttaaaatgtgwgaataatacattgcacaggatggctggactcaaatagttctctgaatgaaatttaagcaattgtatgtgctattctatcatgttgaaacaaaattacaaa

SEQ ID NO: 37434 - DNA, 201 bp, Homo sapiens
gatggctggactcaaatagttctctgaatgaaatttaagcaattgtatgtgctattctatcatgttgaaacaaaattacaaagtgttatctatcacagagkttaagaaaaaaatggcctagcatggctggagtaattattttgccaatgttgtcacgaagaaataattatctcttcttactggttaatgtatttttattgt

SEQ ID NO: 37435 - DNA, 201 bp, Homo sapiens
tgaaggttgtgttgattactaatggccagtgatacagtcagtcatacctgtagaattgaagcctctatgtaaaacctaaaggacagggttcagaggacttytggatagctgaacatgtggaggttcctagaaggtggtacaaccacccagggaggacatgggagctctgcaccccttctcctatacttcaccctatgcagc

SEQ ID NO: 37436 - DNA, 201 bp, Homo sapiens
gccaatgttgtcacgaagaaataattatctcttcttactggttaatgtatttttattgttcttcagtaacagcttgaataatttatcttaaagcattatgrtattttttaagtagaaaaacagttgagtgtttttaactatgagagtaccttgaataaaacagtatttcatttctgaggttgatgaggataactatttgaa

SEQ ID NO: 37437 - DNA, 201 bp, Homo sapiens
tgatgaagtaataatctgtgttattccagttcttttaaatgttaattcattttaacagttgcttcagaaaataaaattttatgaggcaaaatacagcaaartatttcaacaccacatttttgtttttccaaccagagtttgtttcatttacagacattgtcatttattttttatttttattcattttttagaacatcttaa

SEQ ID NO: 37438 - DNA, 201 bp, Homo sapiens
tagttttaactttgtgtttggtgaaatcaccgaaaatctaccctcttagcaaacttcagcacactgtataacatcatgaggtatagttctcatattctgcrttgtatcgctacacttattcatctgacataactgattatatatgtttatactctccaatgaaatttatattctttcaaaattaaaaatactgttagcttt

SEQ ID NO: 37439 - DNA, 201 bp, Homo sapiens
gcatttgaggaaaatgaaatgaactccatttgatatatgacctattgcacttaaaaatattcagatcactggttattgctgactgcttataaggcaaaatrttttgattttactgtattgttcatgctgcgagcaaaatgggtgtctgctaagtttttattttaaaatgcatatttctgtctttaccttgtagccttgcaa

SEQ ID NO: 37440 - DNA, 201 bp, Homo sapiens
tttagccaactaggtaaaaataaattttcacatatttctattgagcccactggacaccaatatactttaataattgtgtttaaaatagaaaactccttcarcttgaagctgtcttttatttgagaaaagtgaaaaagagattcgtgggatattataaaagatgaacaagatgcctaaaatggacaatgctcctttacatgt

SEQ ID NO: 37441 - DNA, 201 bp, Homo sapiens
ttacaagattttgtctctaaattaactctcttcatctgagggaaacagaaagatgaaaggacctattatttttgaaaagaaacaaattctaagtctttctrtattaccagagtgttttcattgtcttgctttatgtcttaggcaaagagaaaagcttccatgacgcatttatgctttttaatgacctaattagacaatgtg

SEQ ID NO: 37442 - DNA, 201 bp, Homo sapiens
tacatgttactttaacatttgagagaatgctatcaaaatgcagaactggctaaaagtgttagaaggagtagttcaagttgtcttcaaccaagagtcatctrgaatttggctgcaccctggtatatcaaatacgctgtatgggaatgtgcttatattttgatgagtaatgtgtttttataacaaatgaagatgcatgtcaga

SEQ ID NO: 37443 - DNA, 201 bp, Homo sapiens
ttaaaatatgggtggcagtgtctttaactcagatttgggatgctttatacagtcatgggaaatatcaggggatcaacttgaaattctttaaaagttaacaraattttggaacgatcaaggaacatgggaatatggcctcaccttttctttctcactgatgacataaatgccgccctcactgtgttgtttattgtttcttcc

SEQ ID NO: 37444 - DNA, 201 bp, Homo sapiens
acagccctgaaaagtgactttcatatttaggattgaatataaactcattctaagattgtctataacctatttctgtgttgcttagcatagttctatttaasagaactaagacaaacatatagaaatatgatgatgacaatgatgatattatattactttcccaagtgtctggcactatgcgtatttcaccaagcatttgta

SEQ ID NO: 37445 - DNA, 201 bp, Homo sapiens
tcattcaatagaatttaggcttgtcttccagatttaaaaaaaaatcatctaaggtgcagtatgtactgaaatagtgaacctggaacaaccccatattccaytgatattctttttttttcctggttatacaactgctggaacaatagtgtaacaatgtcaaagaaaatttgtctgggaggtaggaagattggtgataggaaa

SEQ ID NO: 37446 - DNA, 201 bp, Homo sapiens
tggggttggggttgtttgtttttttcttttttcttctttctttttttctggtagagttggggtttcaccatgttggccagactggtctccgtctcctgacstcaagtgatccacctgccttggcctcccaaaatgtgggattataagtgagagccactgcgcctggcctttttcttgtaaatttaaattccttgtagattc

SEQ ID NO: 37447 - DNA, 201 bp, Homo sapiens
ataggaaaagtactattattatggacaagctctagatttgggagtcataagatttgagtatggttcctggatctaattcctggtagtaaggaggccatgcrtaagtcgcttaccttgaccaatctattttctacttttctaaaatggtaattctatttgctctgcttaactcacagctcttgtaaggatcacatgagaaat

SEQ ID NO: 37448 - DNA, 201 bp, Homo sapiens
ttcttctttctttttttctggtagagttggggtttcaccatgttggccagactggtctccgtctcctgacctcaagtgatccacctgccttggcctcccamaatgtgggattataagtgagagccactgcgcctggcctttttcttgtaaatttaaattccttgtagattctggatattagacctttgtcagatgaataga

SEQ ID NO: 37449 - DNA, 201 bp, Homo sapiens
ttataatattgaaaagaacaatatcaacagtagaacaaccatatcaagacagtggatcatgaagcaatgactataggattccctcctaaatttcgttcatygtaacacccacactgtgttctgtctctgtgcacagcacaacaaactcacttcaaagccaaatgaggacttggcatactcaggaaattctagtaatgagat

SEQ ID NO: 37450 - DNA, 201 bp, Homo sapiens
accaataatgtctggtggtaatgcgtgttttttggagtagtctttaattactaaacaaggtggtgacatacataaagccagtgggttttttttccaccggmagatgggtgctaaagaaactgagcgattttatttttttcatcatataatatttctgatggtcttgcctccttcaagtctcaacatgtgtctctttaaaga

SEQ ID NO: 37451 - DNA, 201 bp, Homo sapiens
gatgggggcatttaagttattgtcaggattaaattcaatcgaaagaattaagtgttaggaaactgtgccttgcctgtcaaatagtgactagtcaggaaaamacacacacacacacacacacacacacgcacacacacgcacgcacaaatgcatgcacacattcctcactgctattttgacgtatatgtacctatagtatgt

SEQ ID NO: 37452 - DNA, 201 bp, Homo sapiens
ttcaatcgaaagaattaagtgttaggaaactgtgccttgcctgtcaaatagtgactagtcaggaaaacacacacacacacacacacacacacacgcacacwcacgcacgcacaaatgcatgcacacattcctcactgctattttgacgtatatgtacctatagtatgtctaaatttttcatggtattagattatacttcaa

SEQ ID NO: 37453 - DNA, 201 bp, Homo sapiens
tggacacaaggaggcgtttaagagggtattgtgaaagtcctgggtagagacattgaagatttattaagatagtagtggtgggcaggaaaggtgatttaagaaaaaaaaaaaaaaaactgcagttgggaggattagcttgtgattgatagtggaaggtgttaacaaagggcatgaacgccacttaaaactgtgaacctgaga

SEQ ID NO: 37454 - DNA, 201 bp, Homo sapiens
agcagcatggtttcttttttttacaaatcttttgcaaagagcagtgataatgtgccaatgacaatgaaatatttgaacaagaaaagttgtttttatttatrgagaaacaagtaaaggccctaaggtggttaaatgattgcttaaagtcacacagaagtggcatggctctgatttcccagtttaccagatacttagatactc

SEQ ID NO: 37455 - DNA, 201 bp, Homo sapiens
tgtctctttaaagagaatatttcacctttcaaaatgaagtctcctaatgactcacttaaatgtttattgttttcttgccgtaaggaactttgtgacttgtaaatatgaatttatgtatgcatttttgtatgaataaatacatttataaaattgatatttaaaaagagctagcacttaagttaggccagacgtttttctaag

SEQ ID NO: 37456 - DNA, 201 bp, Homo sapiens
tactataacgttttgtgtaataaaagttggttttgaaattttattttgatataaatgtctttatattttaaaatctgttttaacaagatgaaattttaatmaatttgtgtcattcacatgctcttccttttaaagagatgtatttgcagctgatactctacctatcttttttaaaaattttaatttaatttaattttaaaa

SEQ ID NO: 37457 - DNA, 201 bp, Homo sapiens
atgagattttatcagatcagattcaaacatggagcttacaaccaggatcactaattgcacaaagaaacaccatgagtttgagttaacagaaacaaaaatayaactttctagatctgtaaaagggttaaaatatttaaattaaaatttaatttaaaaatttacatatttaaggaaaaataatagcaatgagaaaagacataa

SEQ ID NO: 37458 - DNA, 201 bp, Homo sapiens
aagttgaggaagattccataatatgtcctctgtttcttctataaattaagaagggaagcattctctgagagtgaagaggaaggaaggtcatacatgttatktatatgtcttctccttcattcatttgctcaaaaaaacacttattgaatgtttccatgtgccatgttctgtgttaagactagaagaagcaaccaaaaatga

SEQ ID NO: 37459 - DNA, 201 bp, Homo sapiens
ataaattaagaagggaagcattctctgagagtgaagaggaaggaaggtcatacatgttatttatatgtcttctccttcattcatttgctcaaaaaaacacytattgaatgtttccatgtgccatgttctgtgttaagactagaagaagcaaccaaaaatgaagtgcacagtggagtctatcaaacaacttcagtcacgagt

SEQ ID NO: 37460 - DNA, 201 bp, Homo sapiens
atcgatcctgagtttgacagataaaacatgtgtctgaattgtagttacagccaaactacaatctatcagcttttccctcagggtaattatgcttattttaycccaaaacaaggtaattgttttgtgataaagtattcagttcactcggaataagccgttggcctccttttatctacttatttatttatttatttatttatt

SEQ ID NO: 37461 - DNA, 201 bp, Homo sapiens
ttctcccatctcagcctcccaagtagctgggcttataggcacccgccatcatgcccagctaatttttgtattttagtagagacggggtttcaccatgttgrccaggctggtcttgaactcctgacctcaggtgatctgcccgcctcggcctcccagagtgctaggattacaggcgtgagccaccatgcccggctggcctcc

SEQ ID NO: 37462 - DNA, 201 bp, Homo sapiens
atctttcagtatgctttttttttgtgctggagtagaaaacccaactaaaaatgatatacattttaataaccaaagtatattatctcacagatggaagtctrgaaggtcttaagggtgactccatcaaggagttctggctccattttcccaggaattctcttgattttgccctcctctaaatgaaacaatgtaattgaagca

SEQ ID NO: 37463 - DNA, 201 bp, Homo sapiens
ctgtagtagacaatttaggcttaataaaaaggtttccatccagtgtttgctaaaggtaattgaagagaattggagaaaataatattttaaacaattccgcaaaaaaaaaaaaaatacataaatagaagccctatgttttgatggcattgatggcagtctgttctaaattcagtacaactgtgtttcatcagataagttact

SEQ ID NO: 37464 - DNA, 201 bp, Homo sapiens
ggtttccatccagtgtttgctaaaggtaattgaagagaattggagaaaataatattttaaacaattccgcaaaaaaaaaaaaaatacataaatagaagccstatgttttgatggcattgatggcagtctgttctaaattcagtacaactgtgtttcatcagataagttacttagcacaaatgtgattcatgtaaagaaacc

SEQ ID NO: 37465 - DNA, 201 bp, Homo sapiens
cactgcactccagcctgttgacatagcgacactccatctcaacaaaaacaaaaaacaaacaaacttctaaaagattgtaagctgtaacaaattctggcaartgacttgcaaatgagaagaaaaaaatcacgctcattcatgtaaaatggtatctgctttgagaataacccagtatcaagtatgtgttacttgaattagaac

SEQ ID NO: 37466 - DNA, 201 bp, Homo sapiens
tagcttgtgattgatagtggaaggtgttaacaaagggcatgaacgccacttaaaactgtgaacctgagaaactagaaagatagtggcgctggtcactgagaaaaaaagcatcagatcagtttttgtttattttagtttcggggtgaaggagggaagatgatgtgtttggtttggacatattcagtgtatgttacttttgca

SEQ ID NO: 37467 - DNA, 201 bp, Homo sapiens
tccaattagagactcattgatcaaatagaacaaagaagaatactgtgcaggtaaggtttatggattactctatatattactctttgccctgttctgttcarttgtgttagtatactttatgttctgctgctgtgatgactttgtgattaaacattaaccagctctcagggagtggggaggaaatcatgtaagtcaatatat

SEQ ID NO: 37468 - DNA, 201 bp, Homo sapiens
tgggcccttaaccagcatactacactgtatctccttcactgccgaagaagcaagagtctctgccacctgtctaggtttccagagtttctttttcactctgwtgaaattcacaaaaattctcttactcaaacttattagttattgtgtattatgagaatatttaaatcaaaattggatccaagtcaatgtatagggagacat

SEQ ID NO: 37469 - DNA, 201 bp, Homo sapiens
tatgaaaactcagaaggcaacctatctgatttcttaaatttaaatttcctggttaatttatttagattatttgaaaattcttctttgcccaggtacctcayacatacatggactatactacttggtcacttttaatttagaaggaacttcctttaggaacagatattttgtatagctgtaaattatttaaattcacatgaa

SEQ ID NO: 37470 - DNA, 201 bp, Homo sapiens
caagttgttttaaaaatatgtatatttgtatcttgctgcaggacttctctaattttttaaaaaattgatcgatgtgtaagaggctttcattctttctttctttttttttttttttttgagacaaggtcttgctctgttgcccaggctggagtacagtggcgccatctcagctcactgcagcctcgacctcctgggttcaag

SEQ ID NO: 37471 - DNA, 201 bp, Homo sapiens
cattacttcttaaagccctcaagaaattatgaaaactcagaaggcaacctatctgatttcttaaatttaaatttcctggttaatttatttagattatttgmaaattcttctttgcccaggtacctcatacatacatggactatactacttggtcacttttaatttagaaggaacttcctttaggaacagatattttgtata

SEQ ID NO: 37472 - DNA, 201 bp, Homo sapiens
aagttgttttaaaaatatgtatatttgtatcttgctgcaggacttctctaattttttaaaaaattgatcgatgtgtaagaggctttcattctttctttctttttttttttttttttgagacaaggtcttgctctgttgcccaggctggagtacagtggcgccatctcagctcactgcagcctcgacctcctgggttcaagc

SEQ ID NO: 37473 - DNA, 201 bp, Homo sapiens
gaataaataaaatcttctaaagtttacagttactttaaagtactccaaatttaagcatacttcacacgtgctatataaaacataaaacaacttaattcttyattagtgtgtatttcagttgcatctttaggctttttctgaatgccttcattacttcttaaagccctcaagaaattatgaaaactcagaaggcaacctatc

SEQ ID NO: 37474 - DNA, 201 bp, Homo sapiens
ttatgaaacatctagaataattaaatcagaaaagggaaaatatttgttaagtcaaaggaagtattttcttcatctttgtaaacataagtctctacagcacygtaatccatataacctcagcgtcaagtcagattttttttattgcctgaaaactgctaagtgaacacattatatgtaaaattaaagtagtggaagtataca

SEQ ID NO: 37475 - DNA, 201 bp, Homo sapiens
cattcaaaaaacatttattaagcagccactatgtgccaggaatagtagaataaataaaatcttctaaagtttacagttactttaaagtactccaaatttargcatacttcacacgtgctatataaaacataaaacaacttaattctttattagtgtgtatttcagttgcatctttaggctttttctgaatgccttcattac

SEQ ID NO: 37476 - DNA, 201 bp, Homo sapiens
tcaaatgttaagctttctggtaaattagacaaagcagatttatcatgccatttcttttttgaatggcagtgttagtccaagttcctgttgatggtctcackattctttccatagttctgttacataaatgtgaaactttaatacctaaataattctaaatatatttttaatgaggaagtcttcaggacagtggttttccaa

SEQ ID NO: 37477 - DNA, 201 bp, Homo sapiens
ctcagtaataaggagaatcatctgggaccccagcaaggtagagaaactgcatttgagaattccacattaaacccaagactcttaaaggggtgctaaagtgrttttaggtatgtaggaccccttggctccctacaaaaatatatatggatacttttggaagggaagcatcaccagttaagggccatgagattttatcagatc

SEQ ID NO: 37478 - DNA, 201 bp, Homo sapiens
cacaatttaaaacaagaccagaattaagcattcaaaaaacatttattaagcagccactatgtgccaggaatagtagaataaataaaatcttctaaagtttrcagttactttaaagtactccaaatttaagcatacttcacacgtgctatataaaacataaaacaacttaattctttattagtgtgtatttcagttgcatct

SEQ ID NO: 37479 - DNA, 201 bp, Homo sapiens
cttagtttcttaatcttctgcctttagcagtttaagagttcatcaaatggttaaaaggaaaactgcccacttcccactgagatatgaaacattcaagttcwggcttccatggcaaccccaaactccaatttttatgtcaccagcctcatgacattgctagaagctctgctggcttgcctcccaaatagctgcacccctctg

SEQ ID NO: 37480 - DNA, 201 bp, Homo sapiens
gaagactacctcatttgttcagggtccttgctcacccaaaactgtaaaaggagtttttgtcagattccgtctctgaattgcctttcccctagaagcccaaytaagaacctgggagatttcctctgacctttcctttttggaatctaacttcatggtttcacttctcagtattacagaaaatatcaatgagattttcagtaa

SEQ ID NO: 37481 - DNA, 201 bp, Homo sapiens
aagctttaaatgggaacatgaaatgatatcggggaagactacctcatttgttcagggtccttgctcacccaaaactgtaaaaggagtttttgtcagattcygtctctgaattgcctttcccctagaagcccaattaagaacctgggagatttcctctgacctttcctttttggaatctaacttcatggtttcacttctcag

SEQ ID NO: 37482 - DNA, 201 bp, Homo sapiens
tcaagaaagtgttttatttactacacatgagctatgataaggaatttagatatcaaaattaagaataataaagctttaaatgggaacatgaaatgatatcrgggaagactacctcatttgttcagggtccttgctcacccaaaactgtaaaaggagtttttgtcagattccgtctctgaattgcctttcccctagaagccc

SEQ ID NO: 37483 - DNA, 201 bp, Homo sapiens
caagcacttttcccttggagcagtccaagattgtcaacacaactttcgaaattcccttctctcccacattaggatggagtctatttcagattcaacatgtrtaagttttaagcaacacatgcagagaaattttgtcttggaatacctccaaaatttatatcacaatcattgcatgacttacataacattctctagttcagt

SEQ ID NO: 37484 - DNA, 201 bp, Homo sapiens
tgtttagaaatctactttctagtttaattgttatggagaaatcatcttcctgtatagattaaaattcaatcttttttgaactcaaagaaaaatttggaggsaaagataaatattaatgatggattatctaatatttgttccaatctcaacatgttttacttctcatagccttttatcttccagataaaattatgagcgcag

SEQ ID NO: 37485 - DNA, 201 bp, Homo sapiens
atgggggtggttattgtcatgctgctgttcttgttataatgagttcttatgagatctaatggttttgtaagggacttttccccctttgcttggcacttctstcttcctgccaccatgtgaattaaggacatgtttgcttccccttccaccatgattatgtttcctgaggcctccccagccctgtggaactgtgagtcaatt

SEQ ID NO: 37486 - DNA, 201 bp, Homo sapiens
tttttcagacaacattactaaggagatttgatgcctacatatcagtcttcatctcaaaacttctaaaagaggccttacgcggtagctcactcctgtaatcycagcactttgggaggccgaggtgggcggatcgcgaggtcaggatatcgggaccatcctggccaaaatgttgaagccccgtctctactaaaaatacaaaaa

SEQ ID NO: 37487 - DNA, 201 bp, Homo sapiens
ttccagacacttcatgttcagaatacctctattcattttctgctgatatggttttgctgtgtccccacccaaatctcattttgaattgtagctccaataaytctcatgtgttgtggaaaggacccaatgggagacacttgaatcatgagggcagtttcccccatattgttctcctggtactgaataagtcatggatctgat

SEQ ID NO: 37488 - DNA, 201 bp, Homo sapiens
ctaatattttgcttgtttttagtttcaaatcatcctaggatattattgattactcaactgattgacatggtttgggaaataaggtattttgaaaggaaaaatgtcttctttttataaactgtacaggaaccttctattaaattctgtaaatgtcattgatctcaaatccatgcatcacatgtgtaaattatattatttgtg

SEQ ID NO: 37489 - DNA, 201 bp, Homo sapiens
taatattttgcttgtttttagtttcaaatcatcctaggatattattgattactcaactgattgacatggtttgggaaataaggtattttgaaaggaaaaatgtcttctttttataaactgtacaggaaccttctattaaattctgtaaatgtcattgatctcaaatccatgcatcacatgtgtaaattatattatttgtgt

SEQ ID NO: 37490 - DNA, 201 bp, Homo sapiens
ggttgtgactctggatgtgatattcaatttctatgtgtttccatttcctcatgtgtaaaatgagataactacaagccttttgaaactttgatcctgaagaygtcgttttggtagatctaaaatgaatacatggtggatcccatcactgttttatttagaaatacaaaatcaaggttattaattctaagatatgcatccata

SEQ ID NO: 37491 - DNA, 201 bp, Homo sapiens
gaccttccacgggacacgtggagtattctaactaatgcagaaatccgaagcagactagagtatccctgatctccttagtggtgtagaatctcacactgtattatttatttatttatttatttatttatttatttatttatttatttattttgagacggagtctcgctctgtcgcccaggctggagtgcagtggcgggatct

SEQ ID NO: 37492 - DNA, 201 bp, Homo sapiens
accttccacgggacacgtggagtattctaactaatgcagaaatccgaagcagactagagtatccctgatctccttagtggtgtagaatctcacactgtattatttatttatttatttatttatttatttatttatttatttatttattttgagacggagtctcgctctgtcgcccaggctggagtgcagtggcgggatctc

SEQ ID NO: 37493 - DNA, 201 bp, Homo sapiens
cttgaagaaaatagctaaggaaagtgcatttagagggagatactgtgtccttttctatttagaataaaaatattatacttatcttactttattcaaattcrttaattgtgagaacatttaccgtatgatttcaggtttttgaaacacatgtataagttttatcaatgacctaatgaatgaaaaaatatccacatctatgtc

SEQ ID NO: 37494 - DNA, 201 bp, Homo sapiens
ccttccacgggacacgtggagtattctaactaatgcagaaatccgaagcagactagagtatccctgatctccttagtggtgtagaatctcacactgtattatttatttatttatttatttatttatttatttatttatttatttattttgagacggagtctcgctctgtcgcccaggctggagtgcagtggcgggatctcg

SEQ ID NO: 37495 - DNA, 201 bp, Homo sapiens
gccaaaaacagataatatttgctgaatgaatcaaacgggtttctgagacgatcaattctttaaagatagagactcagttatttgtctttttcttctgagcsaagtacaaatacttacataacaattatattgaattattgttatttttttcttgtagctattttttctcatggtgtaaactgagggcaataattggcattt

SEQ ID NO: 37496 - DNA, 201 bp, Homo sapiens
cttccacgggacacgtggagtattctaactaatgcagaaatccgaagcagactagagtatccctgatctccttagtggtgtagaatctcacactgtattatttatttatttatttatttatttatttatttatttatttatttattttgagacggagtctcgctctgtcgcccaggctggagtgcagtggcgggatctcgg

SEQ ID NO: 37497 - DNA, 201 bp, Homo sapiens
ctcttgagtattcaaatttgttaaaatatgaaacacagtgcttggccaaaaacagataatatttgctgaatgaatcaaacgggtttctgagacgatcaatyctttaaagatagagactcagttatttgtctttttcttctgagccaagtacaaatacttacataacaattatattgaattattgttatttttttcttgtag

SEQ ID NO: 37498 - DNA, 201 bp, Homo sapiens
ttccacgggacacgtggagtattctaactaatgcagaaatccgaagcagactagagtatccctgatctccttagtggtgtagaatctcacactgtattatwtatttatttatttatttatttatttatttatttatttatttattttgagacggagtctcgctctgtcgcccaggctggagtgcagtggcgggatctcggc

SEQ ID NO: 37499 - DNA, 201 bp, Homo sapiens
acctcctggcagacccttctcttccaccaaacgtgtgcacatccttgagagccgtgagcaacttgctcagcacacagctcaccttccaggccattcacaascccagagtgaatcccgttacttcgctcagtgaaaactatacctgttctgactctgaagagagctctgaaaaagacaagcttgctattccaaaggtaggta

SEQ ID NO: 37500 - DNA, 201 bp, Homo sapiens
cacatctctcttgagtattcaaatttgttaaaatatgaaacacagtgcttggccaaaaacagataatatttgctgaatgaatcaaacgggtttctgagacratcaattctttaaagatagagactcagttatttgtctttttcttctgagccaagtacaaatacttacataacaattatattgaattattgttattttttt

SEQ ID NO: 37501 - DNA, 201 bp, Homo sapiens
atttatttatttatttatttattttgagacggagtctcgctctgtcgcccaggctggagtgcagtggcgggatctcggctcactgcaagctccgcctcccrggttcacgccattctcctgcctcagcctcccaggtagctgggactacaggcgcccgccactacgcccggctaattttttgtatttttagtagagacgggg

SEQ ID NO: 37502 - DNA, 201 bp, Homo sapiens
tcatccaatctgatataatcaaaatgaagatgaatgaaatgaaattctgtcagactgtataaatttctctaagtcatgcatagaaagtctcctaagtctaygtttcttgtgtaggttttgaaaaatacaattcagcttcctattgatattttgtctgaattgaattatatattgcgaaggtgtcaaaaatgttttcctatg

SEQ ID NO: 37503 - DNA, 201 bp, Homo sapiens
gtctcgctctgtcgcccaggctggagtgcagtggcgggatctcggctcactgcaagctccgcctcccgggttcacgccattctcctgcctcagcctcccargtagctgggactacaggcgcccgccactacgcccggctaattttttgtatttttagtagagacggggtttcaccgttttagccgggatggtctcgatctc

SEQ ID NO: 37504 - DNA, 201 bp, Homo sapiens
tatagcaggaaaaagtcttgtacatcatccaatctgatataatcaaaatgaagatgaatgaaatgaaattctgtcagactgtataaatttctctaagtcaygcatagaaagtctcctaagtctatgtttcttgtgtaggttttgaaaaatacaattcagcttcctattgatattttgtctgaattgaattatatattgcga

SEQ ID NO: 37505 - DNA, 201 bp, Homo sapiens
gactcaagcattccttggcttgtaatggcattcttcccatgcctctttttatatgtctgtctctgaatccaaatttcttttttataaagacacagacatattggattggaacctagcctaatgactccaacttgatcatcagcaatgaccctattttcaaataaggtcatgtttattcacactgaggattagaactgcaaa

SEQ ID NO: 37506 - DNA, 201 bp, Homo sapiens
cacaaatggccaataaggccacggaattagacaaaatatattgggagcttgtagaaaaagaagcactcttgagaatacaagtacttaacaagagagtagargtgaatttagggcagacaaccatagatttcaaatcatatagcaggaaaaagtcttgtacatcatccaatctgatataatcaaaatgaagatgaatgaaat

SEQ ID NO: 37507 - DNA, 201 bp, Homo sapiens
gacggcaaagaggaattctgtgatattatacattattgtatgttaatatatagtgtaatatttatgtatacgtatatttgattatatgcctataggatacygattttggaatcatccctccacaaatggccaataaggccacggaattagacaaaatatattgggagcttgtagaaaaagaagcactcttgagaatacaag

SEQ ID NO: 37508 - DNA, 201 bp, Homo sapiens; identical to SEQ ID NO: 7944

SEQ ID NO: 37509 - DNA, 201 bp, Homo sapiens
acttagtaaatcaatattggaattattttttcagctctcgctttttatatcaataactttgatattgagtaagttgttttttcccattgcttggctaattkttatcataattatcttttctgtacttcagtatgatgactgtccttctgtaggcccaagaaatatactctatataagtaagattttcttctggatggctat

SEQ ID NO: 37510 - DNA, 201 bp, Homo sapiens
ctttctctaggtaatgtatattaagctttgggcccaacccagtaactaaatgggatgatggtgatgacgattattattgattattgttttcttaaaagccrtgattcctattaaaatactcttgtagcaaattgtaatgaatttttcccagttggtttaccaagtgcgtaagaatcagatatcagtaaaaatgtcaaagta

SEQ ID NO: 37511 - DNA, 201 bp, Homo sapiens
gacctagtccctgtcatccaggggccaataggtcacagatgtgaattagccctttcccttgacttttgggattccaatttcaaagaggttgtaaaagagasagtgccatattcttgaaccttttagccaactaggtaaaaataaattttcacatatttctattgagcccactggacaccaatatactttaataattgtgtt

SEQ ID NO: 37512 - DNA, 201 bp, Homo sapiens
gtcatttcctgagatgggaagtcacagcgaggagcccattaaccatatattaaaactccattagtaatattaagactgtccattctagaagaggtggtggstcacgcccgtaatcctagctagcactttgggaggccgaggcgggtggatcacctgaggtcaggatttcgagaccagcctggccaacttggtgaaaccccg

SEQ ID NO: 37513 - DNA, 201 bp, Homo sapiens
tgagtgatgtgtgagagtaggagaaacaatggtttttcctacattctcttacactaatggatttgtattcggagagattggaaagatggatctgtcatttmctgagatgggaagtcacagcgaggagcccattaaccatatattaaaactccattagtaatattaagactgtccattctagaagaggtggtgggtcacgcc

SEQ ID NO: 37514 - DNA, 201 bp, Homo sapiens
taggatctctgatttataactggttggtcgaaatacaggtcacaacctgggatttggaattggcatctgaagaggggggcagtcttgagggactgaggggygatgctatgtccaggtggatagtgttaggattgaattgaattagacgatgctcagctggtgtctgttgaagaatctggtgtcagaagtgttgagtgatgt

SEQ ID NO: 37515 - DNA, 201 bp, Homo sapiens
caaaagaatgagctaaaatattttattctgtgaggctaaaaactataactaggatgaggaactcttttctcccaatacaaattatagaatttcaaagcagraagagcatcttgttttacccctctttgtacagatgggaaaaagagccccaggagagcacaagatttgctcgtgtctcacaggcatttactgaatggcaaa

SEQ ID NO: 37516 - DNA, 201 bp, Homo sapiens
gcccaaaattccatttaactgattgattaatgagggaaccagtaagatgttacaactgattcaaatgagaagttaaagtatcacatacatttaaagtcagraaagaagtgctaaatgaatttacaaaaaggtgcataaggctggacacggtggctcatgcctgtaatcccagcaatttgggaggctgagataggcagatca

SEQ ID NO: 37517 - DNA, 201 bp, Homo sapiens
tatggagaatgaaatgaaaggaagccaggagtaaatgtgggaaaaccagcagccaggacagtggaggagagcatctttgaccagtgtgatggtacgggagrgtgaaaatagatggactttagagacgtttagtaatagttttaaactcatgtgctgtaaattcgatttgattttaagaggtgacaggaaggcaggaggcaa

SEQ ID NO: 37518 - DNA, 201 bp, Homo sapiens
gcctgtaatcccagcaatttgggaggctgagataggcagatcacttgaggtcaagagtttgagaccagcctggtcaacatggtgaaaccctgtctctactaaaaaaaaaaaaaaaaaaaaaaaaaaattaattccagctacttgggaggctgaggtgggggaattgcttgaacccaggaggcagaagttgtagcgagccaa

SEQ ID NO: 37519 - DNA, 201 bp, Homo sapiens
tcagtctactcctattggtttcagtttataaattctgcctggagtggtcatctctttcctaacttggttacagacagtccatggatttccacttttgtgayagaagatggaaaaaggtgaggaggaggggacagcagatcacataggccatgaggggtcactgcaagactcgttctgaggcagatgggataccatcaaagg

SEQ ID NO: 37520 - DNA, 201 bp, Homo sapiens
ggaattgcttgaacccaggaggcagaagttgtagcgagccaagattgcgccactgcactccagcctgggcaacagagagagactcaggcttaagaaaaaawaaaaaataaaataaaaaaagtggtcagtttctacaaggcaatattcaattgcattccaatggatacaacatccatttctatttttgttatttttctgtta

SEQ ID NO: 37521 - DNA, 201 bp, Homo sapiens
aacaatgcaaacaaatttgcatttgattacaaaaactcacaagtcttacaaaatatgaaaatttaatggaagttaattaaaacagtattagggagttaaaktgtaagcaaagccactgccaaatgaggcatcctaggagccagataaggcaacagtagaaggagagagatctgatagggacttcagatgcttcgggtgctt

SEQ ID NO: 37522 - DNA, 201 bp, Homo sapiens
tcaatggatgataccagtcacaccatttgaaaaaagcatatgacagtgttgttcagtgttggtgaacaggaattcttgatatttatttttaaggattccawttaattgctaattacagatctttgttaaattaagccgaccttcactcacatttaaaaaatttaactttgttttggttttcatgagacaaatatctctctt

SEQ ID NO: 37523 - DNA, 201 bp, Homo sapiens
agattttgaaaaggcatttaatgttttccgttaccgatatttacctagtttcaccactgttctctttatgtctgacatacacatagggatgtttcataagkctttgtcttcttttacaggtatcttacagactttttgaagacatgggcctctttgaagcttttaaaattccaattagggaatttatgaattattttcatg

SEQ ID NO: 37524 - DNA, 201 bp, Homo sapiens
tatctctgaactttctctattttacattgaatatttgctacattgtaagcattacagtatgactagattcttctttttttctaacttctcccctgttgatrattattcttatataactataatgccatgttaatcaaactattgtttatgaattataacagtaaatgcccctggttaatagattaatcaacctgccttaga

SEQ ID NO: 37525 - DNA, 201 bp, Homo sapiens
gctgaatagagggattgcttgagcctgggaggttgaggctgccgtgagctgtaattgcaccactatactgcagtctgggcaagagtgagtccctgtctccaaaaaaaaaaaaaaaagagaaaaagaagcagttcccctaatgattctggatcattatgccagaagtatccaggttcaaagcgatattttatattttagtaa

SEQ ID NO: 37526 - DNA, 201 bp, Homo sapiens
aagaagactagatcaaaatcaaatgaataattcctcagttttcaaaaaatattttatggtcttttgagggcataatattagtgcatgtaaaaactagaacsctttatgatttgaaaagaggagaagatgctgagagagacactcttggaagctgggcaggaaatccagccatgcattgcctcaaggtctgtcattagatca

SEQ ID NO: 37527 - DNA, 201 bp, Homo sapiens
ggtataacatctagcaaataggtacttgatgacatttttatgaatactatgatttatcaaaataagtatatcctgagaagtatatatttatagatgaaacrgtatttacagagaatagactctagtttagagaaactgaagagcattagtaaaagtgttaataagaataatattttaagtactatgagggacttttttcct

SEQ ID NO: 37528 - DNA, 201 bp, Homo sapiens
agttggctgatatcaatggtccagctaaatgtaaagaactccatcttcagtggacagatggtattgtcaatgaattttatgaacaggtaactgaccactgyttaatacagcttaatctgtacttacaggttgctcatgaattgctcaaagcttctaacagctatgaaagtatgatcactctattttatattcatacttttg

SEQ ID NO: 37529 - DNA, 201 bp, Homo sapiens
aacattttagaagcaaaatcatttaactttgtttgcattttgagacaaggagctaactgtgtgtatcatcttgagtagtgtctgtttttattcctagggaytgttttccctataattggagttgttttttgctaggtaagtaggatccaaataacagcatagttattaaggcagtagcctcgttttgtccacttctcgtca

SEQ ID NO: 37530 - DNA, 201 bp, Homo sapiens
ttcatgagataaatctaatgtgagtatccaataatagattcaaatatttttcaagaattgactatgagtctgtgaatatatattaatgactatacaatacttttttttttttttttaagagatggggtctcactgtgtaactcaggctggactctagctcctgagctcaaatgattttcccactcttagctcagccacact

SEQ ID NO: 37531 - DNA, 201 bp, Homo sapiens
ttttaattgtgatcaattacaaaacaaagtttgagatggttgcttccagagatgacattgtgaaattgactttttaaaaatgtcatccaactgccgtgctrgttccatcatgtggaatgatctagaaatttggtagcataattgcagaatcaagttgaactgaaaaatcagaagcttatagggttttattgcagtgataaa

SEQ ID NO: 37532 - DNA, 201 bp, Homo sapiens
gatttattttatgttgaaaattctgacttatttttaaattgtttattccatctcataaacttctatttgttatttaattttaggaactttgaaataaaagtttttttttttaatatatcttatgtcctgtgtgcaagtctaatggatagatctgtaccttgaagttccaacttctgccctcagagatgaaagtgacaaaca

SEQ ID NO: 37533 - DNA, 201 bp, Homo sapiens
ccaacaagatggagtttgagggactaaaattgattttaagaataataatgttgttgttcctttttcaaatcttttaacatggaaacattctgatttggttgggggggggggcttttgacatcatctgtttcaccttatcactgtgtactttcaaaatatcttcaagatgctttcattgaagcaacaagaaaattgttttga

SEQ ID NO: 37534 - DNA, 201 bp, Homo sapiens
ttgtatttttaatcaatatatatttgtacatatttatgtggggcacatgatattttgctacattcatcaaatgtgtaatgattaaatcaggatatttagartatctgtcacctcgagtatttgtcatttctttttttttttttttttttttgagaccgagtctcagtctgtcacccagtctggagggcagtggcacattct

SEQ ID NO: 37535 - DNA, 201 bp, Homo sapiens
tggggtttcaccatgttggccaggctgctctcaaactcctgacctcatgatccacccgcctcggcctcccaaagtgctgggattacaggtgtgaggcaccrtgcccggctgcatcagtcttcattttatagacacattgaaagatatcatggaagcaaactgttgaacaaaacatgttactatgaactcccatatttcaaa

SEQ ID NO: 37536 - DNA, 201 bp, Homo sapiens
atttctaatattgatgatactggtgtttcttaaattcactaaaaaattttatttgtaaagggtaacctgcgttacattatttaaagtttttattttaaggtttttttttttttttgagatggagtcttgctttattgccctggctggtgtcaaacttttgggttcaagcagtccccacgccctagcctcctgagtagttgg

SEQ ID NO: 37537 - DNA, 201 bp, Homo sapiens
tggagtttgagggactaaaattgattttaagaataataatgttgttgttcctttttcaaatcttttaacatggaaacattctgatttggttgggggggggrgcttttgacatcatctgtttcaccttatcactgtgtactttcaaaatatcttcaagatgctttcattgaagcaacaagaaaattgttttgaacaaagacc

SEQ ID NO: 37538 - DNA, 201 bp, Homo sapiens
ctcctttattcagcaacacattgttgctaaatgtggagtggggtatcattttgaaatacttcccatacaaaaccttgatgatcctgcctgacatctgcccrctaaatgtcttggtgagccaccatgtctgctgatcctaggataatcatattttttaattgtctcataacattctgaatataataagattacaactgaaac

SEQ ID NO: 37539 - DNA, 201 bp, Homo sapiens
ataaatctgtaattcaaaccaggttttattattgccttaaaggcagccacccatgtaggcacagagagctccagaaacacacaactaattgttgtggtttcccctgctgaacttgaagagtttggcgttgaatcccagtctcttggctgctgtaatgtctatgcaacaagctatttttctggcatgagagctggcatattt

SEQ ID NO: 37540 - DNA, 201 bp, Homo sapiens
catatactatcattctatttcaacctatgctgtcttaaagttctgtttagacataaaaatatcataacccaattaaataaaataaatctaataatgaggcttttttttttttttttgagatggagtcttgctctgttacccaggctggagtgcagtggtgcaatctccactcactgcagcctccatctcccaggttcaagc

SEQ ID NO: 37541 - DNA, 201 bp, Homo sapiens
agaactatatagaaatattattttatcttgctacttctgacattggaagtactttaagtggttcccaaaacatagcaaatactcaataaacttccttcagkcaccttagtcagctatgagaaatgtcacagttgctcagagaggatagacttcagactctgggtgtttactgattggtcttttagttagcacagtttactg

SEQ ID NO: 37542 - DNA, 201 bp, Homo sapiens
tgaaaatgtttgttttaaaccataaaacaaaatgatggatttgctgtactatggaatagctatcgaaatacacacccttaattaaataaagaggatggtgygataatatgtatcagcttatcttcacatgttttaggtgtattcttataaatttgaataagtatcacagcagagatagtaaagaccatcaaacttgtgaat

SEQ ID NO: 37543 - DNA, 201 bp, Homo sapiens
tcactcacaggatgtttttgagcagagtgagcaatgtgttcctcccaattactctgtctcatctcacccatccctctcttcaaccctgcctttaaactacygagataaaccatttggaattacagatctgatcatatagtgcatgtgcttatgatcctccggggcccacagcatgcatttcttgtttcttcccatggtgta

SEQ ID NO: 37544 - DNA, 201 bp, Homo sapiens
tctttatgacagaacagtttatgttcctttgggtatatacccagtaatgagatttctgggttgaatggtagttctgtttttagctctttgtggaattgccwcactgctttctacagtggctgaactcccaccaacagtgtataagcgtttctttttctccacagcctcaccagcatctgttactttttgactttttaataa

SEQ ID NO: 37545 - DNA, 201 bp, Homo sapiens
aagaactgaactatgccctgattaaattaattaacgtgtcacatagattgccatttagaaaggttatttccctaaaattgctgcattttgagcctatcttytcagtaagttttcacaatgttatttatacagttagatattatgattacttttgtgattcgtttagatactaactttactaattgacagatatgatcattt

SEQ ID NO: 37546 - DNA, 201 bp, Homo sapiens
gtgtatcatagaaaaagagaatgaaaaactgaatctacaagtgagattttctgaagaatgtgggaccaaaatacagacagagtaaggcagttggagtacgkgaaagaggagctcaacagtaccagggcccctgggaacatctggctgacaaatccatggaagttggaagagaaacatgaaaaaaggggtagttggaaagga

SEQ ID NO: 37547 - DNA, 201 bp, Homo sapiens
gcctggaatgtacttttttccagtgtacacatagattattttttcacttccttgcctgtgctccagttttcctcatgaatacgcttaccctcaccactctrtctttacctaactgtatttttctgcagttaccagctgacgtgttattgtttgtattaccagctgacatgttattgtcttattggctgccttctttaacta

SEQ ID NO: 37548 - DNA, 201 bp, Homo sapiens
caaccaggatcactaattgcacaaagaaacaccatgagtttgagttaacagaaacaaaaatacaactttctagatctgtaaaagggttaaaatatttaaaytaaaatttaatttaaaaatttacatatttaaggaaaaataatagcaatgagaaaagacataactgcagagcagctaaatgtaacttttggaaatgtagtc

SEQ ID NO: 37549 - DNA, 201 bp, Homo sapiens
gatgaagaattgggaagtataatagattttaggagatatagaaaaatgagtctaatgtacatgatatatgtaatcatagttttagtagcagatagaagacaaaaatacttaggtgaagcctagtaaatggaaagaaactcacacgtagatacaaaatagtgaaactacacaacaccaaagatatacacaaacaaaaatcct

SEQ ID NO: 37550 - DNA, 201 bp, Homo sapiens
taaaggaaggctgtccttgttgctttgaggaatgcagatgactgattccattggttctgagtgctcagtttgtggcctgactgaattatgtgcaccagatytggtggtaggtttttgtgaattgacctcaccccggttgcatcttagcttttctccaccttttaggggatatactttcctcagccgtttcatttaaattgt

SEQ ID NO: 37551 - DNA, 201 bp, Homo sapiens
ggttgcagttgtacatggcacacagttgtttatttaactgtgtttcatcctttcatcttgtgtgggatgctcacacttaaccgcatttctcttcattgcawagtgtagccctgactcactggctcttcatctgatcagtctgccttgcttttgtatctgaacagtatctctcatcacctgaccaaaatgctctgctccgat

SEQ ID NO: 37552 - DNA, 201 bp, Homo sapiens
ataggtgctatataaatatttaaattaggatagctgattgctctgtaagttaggagtttgctaattctacattgtggttaatttctgattatgaaacattktttacatactgcttgggaacaacaaaagataagatattttaaaatgtgtgaaatgaagagtttttaaatcacatgggaaaatacttttgatgagtggaaa

SEQ ID NO: 37553 - DNA, 201 bp, Homo sapiens
aagacttgagtgttttaagattaggttgaggaatttgatattttatgtgtaccaaacattatattttttaaccaaagagtgatgtgaacagattaaacatrattattctagcagtggattaggtggggacccaaatggacacaaggaggcgtttaagagggtattgtgaaagtcctgggtagagacattgaagatttatta

SEQ ID NO: 37554 - DNA, 201 bp, Homo sapiens
tattatattgtaattatttacatgttttgtttccctctagagaatgagagttcctccaaggtggagactcattcagcttttcgtctctcttacataacctktgcctggcaggttgtaggtacccagtgattattgaattagttaatatacgcaatatggatttgcttgtcagagcatgagtatccatggctttctgaagtc

SEQ ID NO: 37555 - DNA, 201 bp, Homo sapiens
gcaagatggcttttgtccatttcctctttgacttgactgtgctactgaggaaacagtaggaaaggagtcaggctgctaactttaaccctgggtatcatttktaatttttcccatggagccaactctaaattctcattcagcattagaagactgaataatcagattgagtgtcagatgtgtaaataacacaaaacttgttaa

SEQ ID NO: 37556 - DNA, 201 bp, Homo sapiens
atgaaagttcattggaaagtgggggcttctcccaagtgtttacaaagctgatttgttcttgtgttgtcattaaacttgtgtgaataactctatttaattcyggtcactaggaaaacaaaaccaagtcaatcaattgttttagttcacattttaatgactgattttatttctgtccagtatcaatttgattagtaaataatg

SEQ ID NO: 37557 - DNA, 201 bp, Homo sapiens
accaaacattatattttttaaccaaagagtgatgtgaacagattaaacataattattctagcagtggattaggtggggacccaaatggacacaaggaggcrtttaagagggtattgtgaaagtcctgggtagagacattgaagatttattaagatagtagtggtgggcaggaaaggtgatttaagaaaaaaaaaaaaaaaa

SEQ ID NO: 37558 - DNA, 201 bp, Homo sapiens
agaaagagttattgttgtgagttatactgtcctggatgtgtgaagataatcaatgcaactattgtatcatgcctttgcattgggcgatggggaaatgtctyatgctcccggaagtgatgcataaccctacaggtttatggtgaattgtttacttagctgccatatgtctcctcttcagtggagtcttcctgctccatttct

SEQ ID NO: 37559 - DNA, 201 bp, Homo sapiens
ggaattagtcaaatccctgctctgccatgtattaactctgtggctttaggtaaattgtaatgcttaatctctcaaagcttaggttttcttatatagaaaattttttttaagctaccccagaaaaatgttttggggattgactgagattataaagatgctaataataataacttaataaaccttgtatgttgcttactctaa

SEQ ID NO: 37560 - DNA, 201 bp, Homo sapiens
attttatccataattcgtttactttttttgtgaactatttttaccattaatttacacagccaataacatttttaagtagctagaggttcccaattatttgrtattatgatccctatataatatgaagacaataaatgttctattgtttttctcttctcttcaacttttgtttttatcaaagcaaaacatatattaacttta

SEQ ID NO: 37561 - DNA, 201 bp, Homo sapiens
ggttttcatttgaaaaaacatattacaaactgagacattcactataaattaaattgaaataatcaaaatataattaagctatttgtgagtttacattttgyaaaacattttagaagcaaaatcatttaactttgtttgcattttgagacaaggagctaactgtgtgtatcatcttgagtagtgtctgtttttattcctagg

SEQ ID NO: 37562 - DNA, 201 bp, Homo sapiens
atctcttgcctggattatagaactgtgtcataacaggtctttctgcttggagttacccaccttcacttgaccacaatctgtgatacccagtttctttttctttttttttttttttgttttgagacgtggtctcgtcctgtcacccaggctggagtgcagtggcgccatttcggctcactgcaagctccgcctcccgggttc

SEQ ID NO: 37563 - DNA, 201 bp, Homo sapiens
ctaatctattttctatctttatagatttgcctattccagacttttcttataaaagtaatcaaaatatttgcagtcttttgtaattaccatctttcacttakcataatgttttgaaggtttatccatggtgaagtatgtatcagtactacttcatttctttttgttgccaaataatattccattgtatggatataccatttt

SEQ ID NO: 37564 - DNA, 201 bp, Homo sapiens
gagtgggttctgaagggtgagtggaatttgaacagggagagacctgagaaagacgtagtcgaaggcaacatcattagtagcagaagagtgaaaaaaatatrgtattgaagaagaatagtgcaattatgtaatgggtcataaaatggattagattgacaagttaattctcactaagagccaggtactttgctaaaataagca

SEQ ID NO: 37565 - DNA, 201 bp, Homo sapiens
cccagtgatttctatactgacctcaagtagttgtttcatttgccctatcttaattcctactggtgatttcattaggaataagggttttgataagaatagckttaaactggatttcagtaatgagatggtactttgtagaagctaatggttaagagcacaacaggctgtagagttgcagactgcctgggatcacttactaga

SEQ ID NO: 37566 - DNA, 201 bp, Homo sapiens
ttggaggatttctcattttctatccctaagccgtgcacagctcataaaaaacagtagttgccaagtgacaggtgtttttggaaaacttgcttagtttatamgttcagagaagacattgcctctaaatcagcagctactaatgaccttttgttccagggagttgttagagatccagatgaagtcctgtaattgaagcatagt

SEQ ID NO: 37567 - DNA, 201 bp, Homo sapiens
aaatgatatagcctaataagagagctttactctagtggccttcattatagcccatgtgcaggatgattctgaaatatataaattaaatgaatggaaacagrcatgttgacaagtttgtttagcaccaacgattggatatgctattcttaaaccaaaacttttgtttactcattcattcctagaatttcagtattttaagaa

SEQ ID NO: 37568 - DNA, 201 bp, Homo sapiens
atatagcctaataagagagctttactctagtggccttcattatagcccatgtgcaggatgattctgaaatatataaattaaatgaatggaaacagacatgytgacaagtttgtttagcaccaacgattggatatgctattcttaaaccaaaacttttgtttactcattcattcctagaatttcagtattttaagaagtctc

SEQ ID NO: 37569 - DNA, 201 bp, Homo sapiens
caatattctgaattcaaaattctgttgttaaggatggtgtaaccatatatgacaaggcttttacaaactcctttttgaacattgctttaagcaatcatttstgtatttgtattaattttcaatctaatcattccaaatgaggcaaagttttgtgtaccagtgattgaattagaagaaagaacaagttattttgtatagtct

SEQ ID NO: 37570 - DNA, 201 bp, Homo sapiens
gtagtttgtagttgttttttgcctttcaaatgaaataaatacctccttgtttgggattcaggaccctctctaatctacccttcttaacattcagtcatttyaaactgctactgccttcatcacatcaattttctagtgactttgaagcgtgccttttctctctcaagacagagataggtagatctcttgaggtcctacttc

SEQ ID NO: 37571 - DNA, 201 bp, Homo sapiens
tttagatttctacttcaacttcctaatgaattattttctttcaaaggctcttcctggaatttttctgtttttggcaggtatgtttgcatatctcaagtgasacaatttggccaggtttctgaaaaagaatactttaaaagaaaaatgtaggttggctcttaagtgttttaatgttatttgagataaactaaaatagagcat

SEQ ID NO: 37572 - DNA, 201 bp, Homo sapiens
tgagttcaactttcttagattccacatgtaagtgagatcatgtggtatggcttatttcacttagcatgatatcctacaggttcacccatgttgtgcaaatrgtaggattttctcctttttatggctgaatagtatttcattgtgtatgcacacacatacatatacacacatcacatgttctttatccatttatatattgtt

SEQ ID NO: 37573 - DNA, 201 bp, Homo sapiens
tatactatacagtttgggatcagcatagatgttgattacaggctctgtgatctagagaaagttacttagcatctctgtgccttttctttctctatttaatrgggacaatatttcctatctccaaatgttattacttaatcttgagataatttgcttacagcatctgtcaaagtgccaaacatatagcaggtacacaatata

SEQ ID NO: 37574 - DNA, 201 bp, Homo sapiens
cagttaacgaaattgtattgtattacagatttttgttaaataaggagatttcagctgctcttgtcacaaaaatactatgcaagacgctagataatgttaayctgtctcactatagtaaccatttgactatctgtacatatacacataacatgttgtaagcctcaagtatacacaatgcaaattatttttaaaataagtaaa

SEQ ID NO: 37575 - DNA, 201 bp, Homo sapiens
atgcaagacgctagataatgttaatctgtctcactatagtaaccatttgactatctgtacatatacacataacatgttgtaagcctcaagtatacacaatrcaaattatttttaaaataagtaaataaaataaaattctacttttagctcagaaaaataaaattaaccctatagataacaaatatgacatatgcatgacta

SEQ ID NO: 37576 - DNA, 201 bp, Homo sapiens
ttctatgagatgctggaagatttcttaaaagtgaagagggtgaaatggggaggtgttagtcaaagggtatacagttttggttatgcaagatgagtaagttytaaagatctgtgtagtatattgcctacagttaacagtacatactctgttgtagacttaaaaagagggtagattttatgttgtgttcttatcacaaaaaaa

SEQ ID NO: 37577 - DNA, 201 bp, Homo sapiens
ccatccacctgctacattggaatgaatatacacagctgttagtgtatcatagaaaaagagaatgaaaaactgaatctacaagtgagattttctgaagaatrtgggaccaaaatacagacagagtaaggcagttggagtacgggaaagaggagctcaacagtaccagggcccctgggaacatctggctgacaaatccatgga

SEQ ID NO: 37578 - DNA, 201 bp, Homo sapiens
ctatccctaaaggaagagaaactttcttcagaaaggtatttgttttaatcaaggaagtttctgctgagattaataacttggtatcatcccttagttcctgrtaaacatcataccttaaatgagtcttctgttttttaactagtttttcttttgtctaaaacaaaattgcctcttttgttttagagatgaattactcaattt

SEQ ID NO: 37579 - DNA, 201 bp, Homo sapiens
ggagggaagaagatattcattgtcttagggcatctgctggttttctctagtatctccttgacttagaacatgaaccaatatttgtttttcttgtcatattktcaggcatatattggcactagccacctattaaaatattctttaatgattacttactttgtgtatttaaaaagatccatttaaggaggatggaagcatata

SEQ ID NO: 37580 - DNA, 201 bp, Homo sapiens
attgtctatcaaagttaataaaaataactggcctttgagaaagagtacacctttaaaatttttgaaggccaaatgatttttttttatttttcatccagaartatctatccctaaaggaagagaaactttcttcagaaaggtatttgttttaatcaaggaagtttctgctgagattaataacttggtatcatcccttagttc

SEQ ID NO: 37581 - DNA, 201 bp, Homo sapiens
tttgtacaaaggcattttaagagaacagtgcacttaatcagagaacctccttcaaggtgactctactgcttaaacatggtttaaaaaaattaaaatatttrtggctcagcattgttgtttcattgtctatcaaagttaataaaaataactggcctttgagaaagagtacacctttaaaatttttgaaggccaaatgatttt

SEQ ID NO: 37582 - DNA, 201 bp, Homo sapiens
gttttcaaaataaccttcctttgagttctcagttttatgtgaactgtagttaaactcttttttttccatgacttgtagcatatggtatttaactgtttgcyagtatcgctttctgaaatgaacctatttgtacaaaggcattttaagagaacagtgcacttaatcagagaacctccttcaaggtgactctactgcttaaac

SEQ ID NO: 37583 - DNA, 201 bp, Homo sapiens
ctaaatcctctttttaaaatataaataaatatctttaaaataatattttaggccgggcatggtggctcattcctgtaatcccagcactttgggaggctgagacgggcggatcacgaggtcaggaggtcaggagtaatcccacatcgttcaagtcagtaatgaatttatttgaatcaaaagtggatacatttaaggaattgt

SEQ ID NO: 37584 - DNA, 201 bp, Homo sapiens
agcaattagaaactgtgttatagtccagacttgaaagagattatttcctgaggcaaagggagcattcatggagtagagtagtcattgagtaggatccttcrtggagcagatagtcattgagtgggttctgaagggtgagtggaatttgaacagggagagacctgagaaagacgtagtcgaaggcaacatcattagtagcag

SEQ ID NO: 37585 - DNA, 201 bp, Homo sapiens
tcagccattctgtatgaatattaccaagtttaagacattggtttatgttcaatttcagcagtttgtataactgatttgaaaaagcaataaataggcttcawaattttatattttttataggaaacaggtaatttaatacatttaatacattaatacatttataatgtatgtattttttcatgaggtagactatgtaaaaag

SEQ ID NO: 37586 - DNA, 201 bp, Homo sapiens
tagaagctctgctggcttgcctcccaaatagctgcacccctctgtctggatccttcacttcttactccatgccaatagtcagtaaatcatgctatgaaggsaagaacaatttgcaggattttggctcacctttctgaggttctcttctttatgggaacctagtccctcagaattgtgtgctttgcctcgatagcttttttg

SEQ ID NO: 37587 - DNA, 201 bp, Homo sapiens
gcatggatggttaaaattagacctgatggcactattggttattctaagaaaggagctaaaagtctatataattggtttactttttattcagtctagttttkaaatcttaagaatggatcaaggaacattggatgaagaagggacacagggtaatgttattttcccaaatttcagaaattcttccaatttaggttcagcagg

SEQ ID NO: 37588 - DNA, 201 bp, Homo sapiens
cttgaaaggttgaaatgaactaaattgagggttgtttatattaaataaagctattttcccccaattttagctaaacctctttttatgtaaagaaaaaggattttttttttccagtaagatttaccagtcaaagcaggaaatcattttgttacaattgtcttacaaagcagccctgtgcaaggctgttgctaatgttaagac

SEQ ID NO: 37589 - DNA, 201 bp, Homo sapiens
gcatctgtcaaagtgccaaacatatagcaggtacacaatataattttgttttcctcataaatacatggttaggttcagcatggttattcatgaaaaacttyttttaaaaaattgagcaactgaataaattctaattgaatggctgaattatttgaaaggcaaaaaaggcaggcaataaagttagtctgaagtatcttcatg

SEQ ID NO: 37590 - DNA, 201 bp, Homo sapiens
ccaaacatatagcaggtacacaatataattttgttttcctcataaatacatggttaggttcagcatggttattcatgaaaaacttcttttaaaaaattgarcaactgaataaattctaattgaatggctgaattatttgaaaggcaaaaaaggcaggcaataaagttagtctgaagtatcttcatgtaggtattcttggtg

SEQ ID NO: 37591 - DNA, 201 bp, Homo sapiens
acgtgaccttaatgagatatttaacctttggaagtaatgctttttcatctagaaagtgagtcagtatctactttgaaagtttgttctgtggatacaatacrttggaagacattaaattaaaaagtatgtggaataaacactcttatttagatgatagctttcatcattatcattatcatcaccatcaccatcaacatcatc

SEQ ID NO: 37592 - DNA, 201 bp, Homo sapiens
aatttattgccgttctctatcttatgcttttaattttatttaatgcatgtcttaagtttttcaacagacttttctaaatgccatgataatattaagctctktgacaacattaattatgtgtacatatattatttcgattgcacagtttttgagtgcaatgatggatccattgagaatgaggattctggaaagctctaaaag

SEQ ID NO: 37593 - DNA, 201 bp, Homo sapiens
ataggatttataacgggtgtggtgaccacatcttgattaacccttactgaggctgagttgaaatatgcatttttagctcagtgcccttcccagttcttctsctatttaagaagggaaagcagttgccttttccgtgttcttggacctttctattccctttttttttatccttgcaaacaaatctagtcttttctgagctca

SEQ ID NO: 37594 - DNA, 201 bp, Homo sapiens
ttcatgcaaattcaatgaatgaatggtaaaacaaatctgatccaaactattgacagaagtggaggcaggcacagaactccagcctcttcatcatctcctcrtttcctcctgaattccttttcatgtagtttcttggacagatgcatctggaatctgaaagtaatatttaatagagtattcacattcttaatagttgttata

SEQ ID NO: 37595 - DNA, 201 bp, Homo sapiens
gctgagttgaaatatgcatttttagctcagtgcccttcccagttcttctgctatttaagaagggaaagcagttgccttttccgtgttcttggacctttctrttccctttttttttatccttgcaaacaaatctagtcttttctgagctcatttgtctcttataccttgtcaaatacagatcacagtaaccaataaatgata

SEQ ID NO: 37596 - DNA, 201 bp, Homo sapiens
actttcaaaataaagtcgctgaataaaaatagtgatcttacgaaatattatagttggatatcatcagagaggtgatattataaatcttctaccccagatartgattttttaatagtctttctgttgcaaatgtttagtcactactgaaatacattatatgaaagagagctcaccacaaatcaaaccaatacaaaggagtat

SEQ ID NO: 37597 - DNA, 201 bp, Homo sapiens
ttgaaatatgcatttttagctcagtgcccttcccagttcttctgctatttaagaagggaaagcagttgccttttccgtgttcttggacctttctattccctttttttttatccttgcaaacaaatctagtcttttctgagctcatttgtctcttataccttgtcaaatacagatcacagtaaccaataaatgatacttaca

SEQ ID NO: 37598 - DNA, 201 bp, Homo sapiens
aaaatagtgatcttacgaaatattatagttggatatcatcagagaggtgatattataaatcttctaccccagatagtgattttttaatagtctttctgttrcaaatgtttagtcactactgaaatacattatatgaaagagagctcaccacaaatcaaaccaatacaaaggagtattacaaggaaaaaggctttgaatcca

SEQ ID NO: 37599 - DNA, 201 bp, Homo sapiens
gagctcaccacaaatcaaaccaatacaaaggagtattacaaggaaaaaggctttgaatccaagtgcacattggagcaagctgctattcttttacagattarctatttgttattgcgcattcagcaaattccttagcttttggtcttctgtctactaaaggaaaatttaaattccagctctgcaagtttgttgagtaataat

SEQ ID NO: 37600 - DNA, 201 bp, Homo sapiens
gtttgttttgttgttgttgttgttttgggtgagaaccattaagatgtgtcctgtgatatcatttttacttgtcaattatgtctccataatttttaaaagaygctgttcattataagaccttcccaattcagaggtatcaaaatgtgaaaaaaatactttaatatagcaatctattttgaaaacatctctgttaaaatctag

SEQ ID NO: 37601 - DNA, 201 bp, Homo sapiens
aataacagaaaatcaatagatgggagagccgggattggaattgcaggctgtctgtctctgaagtccattctccatatcactgagctattctagttttcctrggtagagaatctaggatggccaaaaaatgtccccagagcctccctgtaagctgtcctccacaacagacttctggaatagaaagaagttggcttatgacct

SEQ ID NO: 37602 - DNA, 201 bp, Homo sapiens
atttacagtaacaacaataacagttgtcattgatttaattatacattattatcctaaaaataacagaaaatcaatagatgggagagccgggattggaattscaggctgtctgtctctgaagtccattctccatatcactgagctattctagttttcctgggtagagaatctaggatggccaaaaaatgtccccagagcctc

SEQ ID NO: 37603 - DNA, 201 bp, Homo sapiens
gagtgccagaagtctggaaatatgagaaatggaggaagtgggactgtatagtgtagagaagactaataggaactaaaacacttgtctccaactatttatamggttgtcatttagaaaaatggacacgcttatatattgccctagaaaacaaagagtagaatcaatataatgaaagtaccatgtatatttttactcagtatt

SEQ ID NO: 37604 - DNA, 201 bp, Homo sapiens
tctttggcaggttattataagagggacagtgaaaagtaaatggatttagaatatattttagagacaggatcaagtggatttcctaatcgactaaaagtaaracaagataaacaaaggaaagaatcaagacccgttccctcttctggggcctgagcaactaggtagatggttatgttctttactgggatgtaacaagattga

SEQ ID NO: 37605 - DNA, 201 bp, Homo sapiens
tttaaagaactataaagtttgtttagcttttagtttagtcctgacaacccagtgtccgcaatactgaggctgattttgtagatgagtgtgtcaaactactyttttggctgccagtgttaagaaggcaagtgtctgttaaggtgtgtgtatcttttctaagtggactttcgcatcccagagcagatatgtctctctcaaagt

SEQ ID NO: 37606 - DNA, 201 bp, Homo sapiens
ctgtaatgatccagaaaataacaataggacttttaaaaagggcttttcttagctttgcaagaaaagagataagagcagaaaggttcactttttgaagagamcaagactcactcagttggaaagttactctaaatttactttttcctaacattgatttatgacattcagtatgaattttgtctgtttatatccacatatcat

SEQ ID NO: 37607 - DNA, 201 bp, Homo sapiens
tcagaaccagtaatgcaccaaagatcattgtatcaaatccagctcatcttctaaattaatgtagtacattaaagaccaagataccatttcctagtatcacrgacagcctcccagagaaagagttggagggatggagtggcacgtagtgctacagagatgtaggaggagacagcttccaaaaactcatcacacatcttttcc

SEQ ID NO: 37608 - DNA, 201 bp, Homo sapiens
ctttcataaataatttatcagttaatggtagtgaacagagtttgaatgagtcaaaattctacaatgaaatgctcctgtataggtgtaagtatataaatgtatatataaatatacatatacaaatgtaaatatataaatgtatatatttaatgtgtatttgcccctagtttaatttgtcagcagtaactgctggtttttatt

SEQ ID NO: 37609 - DNA, 201 bp, Homo sapiens
gaagtttgttatgtttcacatctcacatggaacctgcccacagacatgttgggaagcagtttgatgaagggccctataggttttcctcctactgtacatayatattatcttaaggaaaaaatccaaatgtaaactcatattccctgccagaaaattaaaatacgcaaacatctgcttccttaggatggcctttagccaagg

SEQ ID NO: 37610 - DNA, 201 bp, Homo sapiens
caggaataactgttagcagctgggcctgggtgctttttccctgctttgtcctggaaagatttcacatcttaagggaaatgaactacacaccttgagaaaatttttttttctatcatattgtataaatctgtgtaaatctcattttccccctttttggagttaagtagcataattaactgtaaggcttttccaaatactttc

SEQ ID NO: 37611 - DNA, 201 bp, Homo sapiens
tgtattaaaatatgggtggcagtgtctttaactcagatttgggatgctttatacagtcatgggaaatatcaggggatcaacttgaaattctttaaaagttracagaattttggaacgatcaaggaacatgggaatatggcctcaccttttctttctcactgatgacataaatgccgccctcactgtgttgtttattgtttc

SEQ ID NO: 37612 - DNA, 201 bp, Homo sapiens
caaaaacatttttaatggtcatgtgccaatttttttctatggctattacataacattctctcttgttagacatttttgttgttttcgacttttccctactrcaattaataatgacatgaaaagttttgtataaaacacttcaagttgcagaacatctctttacagaatattcctagaagtggaattattaggccaaatggt

SEQ ID NO: 37613 - DNA, 201 bp, Homo sapiens
cagcctcccaagtagctgggactacaggcgcccgccactacgcccggctaattttttgtatttttagtagagacggggtttcaccgttttagccgggatgrtctcgatctcctgacctcgtgatccgcccgcctcggcctcccaaagtggtacatagatttctaaatgtaaaatctatagagaaactgtggaacaccagaa

SEQ ID NO: 37614 - DNA, 201 bp, Homo sapiens
gctcattgataaaagcttaaaagtacaaatctactaatagtacctcaatcttgttctttctctagttgctaatttgacattttcctctgcctgattatgtyggaggatttctcattttctatccctaagccgtgcacagctcataaaaaacagtagttgccaagtgacaggtgtttttggaaaacttgcttagtttatacg

SEQ ID NO: 37615 - DNA, 201 bp, Homo sapiens
tgctttttaatgtgatgatctatacaacctctaactggaatttgaaagctggggccaaataccactgcagctcagatgctaaagctgtttcttaaaatgargcagataaaaaatagagaaaatcttttttaaaggctactttgctcctttccttctccataactaaatgttggagctttctgctggggaggggagagcaaa

SEQ ID NO: 37616 - DNA, 201 bp, Homo sapiens
agctgtcacatggggtttcattcatttgcattcccagaagtggtctaaagctttccctaatgtaggagtaatgagggctctgtaccttcagagacccagagggccttttgtaggatgttgttactttaagtggctctgataagggacacaggctcagagaatgccatgtttcactgtcagcttcagaggaccataaactac

SEQ ID NO: 37617 - DNA, 201 bp, Homo sapiens
tgaccccaagactgaaaaataaccagtgcacaacagacctgagcatactacaaacagctttgctcttaccattttgccccatgctgccttgtcagcccctsctcaatatgggggaaaagtggacctttccgataatctggggccctatatgtaggagaaaaagaagttgaagtgccaggagctgctctcagaagctgaccc

SEQ ID NO: 37618 - DNA, 201 bp, Homo sapiens
agtggacctttccgataatctggggccctatatgtaggagaaaaagaagttgaagtgccaggagctgctctcagaagctgaccctggggacacattctcargccaggctggcctgtcctgtctatacctcaacccttcccactgccagaagttttcatgttttacttattttttgcctggaatttgtcaagcttttaattc

SEQ ID NO: 37619 - DNA, 201 bp, Homo sapiens
gatactggtatattaaagaatattttacaaaatcacagtatcaaccatagcctcgagaggtaaaacttatcctatttttaatttccagtggtagcactttrtaaataaaaattatggtgtatgtgccaaaagcctggacttttgtctggcaaaggttgtttaaaacttgaagagacatcaagaaatatgtgagttcatcca

SEQ ID NO: 37620 - DNA, 201 bp, Homo sapiens
ccaggctatatgtataaatatgtgtttctaatagcattaacatcttatttatggtacaggaatttttctttacagccactctagggaacaaactaaaataytgtttaatagcattcctcacaagattttatattctcatcaaaggtgctgattttcttacaaagttttaccttgggagaacaaaggtggtttagcagttat

SEQ ID NO: 37621 - DNA, 201 bp, Homo sapiens
atcagtagtattcatccctccatgagaatgacaggttttttttttttgttttttttttcgggagtactggcaatcaccatctgattcagtctaacgttttytggctggggcaggaactctgaactttatttccaaatgagtaataatgataaacaatcctagaggaaagtgggaaaatgcctgatggcttattggcgggaa

SEQ ID NO: 37622 - DNA, 201 bp, Homo sapiens
agcaagtccccaattatatctttagatactggtatattaaagaatattttacaaaatcacagtatcaaccatagcctcgagaggtaaaacttatcctattyttaatttccagtggtagcactttgtaaataaaaattatggtgtatgtgccaaaagcctggacttttgtctggcaaaggttgtttaaaacttgaagagaca

SEQ ID NO: 37623 - DNA, 201 bp, Homo sapiens
aactttaaggtttaatgactgccctattgaattttagacttgcatggggcctgtagcgcctttgtttcagcaaggaaactggtggcattttgccctagccmtagagatctgtgaaactttgaacttgagggagatgatttagggtatctggccgaagaaatctctaagcagcaaagcactcaagaggtgactttggtgcta

SEQ ID NO: 37624 - DNA, 201 bp, Homo sapiens
attaaatctgataacaatagtgtggaatttggtgattatccccagttgatgaatggtacttaggaattcacagacataggttcagtatgtatctgtggagmtttgtggatagttgtgctgctggggaagttgttaggtagaagtccaagttaaacagtagggagctaacaagacctcctgggaaattggatcctggatttc

SEQ ID NO: 37625 - DNA, 201 bp, Homo sapiens
gtctactaaaggaaaatttaaattccagctctgcaagtttgttgagtaataatataaatggattatctcatagacaaatgttttaaaataaaatattgctrtaggatacttgctatattgaaccaaaaactgccttgtaactttgactcctttgtcctagtgtttattttctatcctacatgtctgttaggattcccaagt

SEQ ID NO: 37626 - DNA, 201 bp, Homo sapiens
cattgaattcaactgtccattgtctgacctcattttcatattccttaaacattgctcttccctgggatgcactagttaaatcttattgtggtattgggctrtccttttttgtagccatcctcagggaagccacacttgtttggcatgaccctgttgtcttggctgcactcaattgtacgtccccaagctgagcagtgagat

SEQ ID NO: 37627 - DNA, 201 bp, Homo sapiens
tgtgtttttgatttgattagagctgtcatttgttatttaggaatctgtgaatgattattaaagctttcaagtatagccagtcctgctaacataataataayattacattaagggcactcatgttctttcctcctgagaagatgactggttacagggggcacatattgtttgctgaagtgtgtgtatgtgcatgtgcatgtg

SEQ ID NO: 37628 - DNA, 201 bp, Homo sapiens
aagcacatttggacaaaatgaaataatgtggatgctggctcgcttctggtaaaagctgacttaatttagagttcttgaagaagctagctgaagaatgaaaygtcattgtaacacacatctgtttcttgaaagagtttatacttgaatgtaactagtcactgttagctctggctaattttgaagttgatttaaattaatata

SEQ ID NO: 37629 - DNA, 201 bp, Homo sapiens
tttcttgaaagagtttatacttgaatgtaactagtcactgttagctctggctaattttgaagttgatttaaattaatatagaggttgttctggtacttttytttttggtcagtctttttctgttctccatctctatctacatgcacattttctttcatttcattttctttttacctaatagagtcttctccctccgaatgt

SEQ ID NO: 37630 - DNA, 201 bp, Homo sapiens
cccctaccatccattacccccacttgttctcccttcgtttattctattctaagcttctttatagctttatcatcacctggtatactatgtttctgtgtttrtcttcttccttcactaaaatataatagccaggaggcagagatacatcttgttttgttcaatggcatacagtttgtgcctagaacagtgctttgcacataa

SEQ ID NO: 37631 - DNA, 201 bp, Homo sapiens
cccatctgtacatcaccatcatcaaagaccaaaagtagataaaaccacaaagatggggaaaaaacagaacagaaaaactggaaactctaaaaagcagagcrccaatcctcctccaaaggaacgcagttcctcaccagcaacggaacaaagctagatggagaatgactttgacgagctgagagaagaaggcttcagacgatc

SEQ ID NO: 37632 - DNA, 201 bp, Homo sapiens
gcttggtgcaggataggtgctcagtaaacgtttgtgttggatgaatggatagatggatggatggatgatcagtcacagaaagtgtcctgaggaagtgttayttgaagtgacacccgaagaatgaaaatgagctgacaatgctaagaaaatgggaaaatgtattctaggcaagatgaacggcatccaaacctttaggttata

SEQ ID NO: 37633 - DNA, 201 bp, Homo sapiens
agctgagagaagaaggcttcagacgatcaaattactccgagctacgggaggacattcaaaccaaaggcaaagaagttgaaaactttgaaaaaaatttagamgaatgtataactagaataaccaatacagagaagtgcttaaaggagctgatggagctgaaaaccaaggctcgagaactacgtgaagaatgcagaagcctca

SEQ ID NO: 37634 - DNA, 201 bp, Homo sapiens
acacagagttcctactggtgcactgcacagtggagctgtaagaagagggccattgtcctccagaccccggaatggtagatccaccaacagcttgcactgtrcacctggaaaagccacaggcagtcaatgccagcctgtgaaagcagctggaggggaggtgctgtaccctgcaaagccacaggggcaaagctgcccaaggct

SEQ ID NO: 37635 - DNA, 201 bp, Homo sapiens
gcagtgagctgagatcgtgccagtgcacttcagcctgggtgacagagtgagactccgtctcaaaaaaaaaaaaaaagaaaaaagaaaaaaaaacacattgraaaatggtgaatttaccaaaagtatcagttatttttggcttgatatataaaaccgcactttcctccactgtttatcgtactgaaatgccacattttctat

SEQ ID NO: 37636 - DNA, 201 bp, Homo sapiens
gagaggcagtacaggcttcagtgttagacagaaatgggattcagtccaaacttggacacatactaggttgtgactctggatgtgatattcaatttctatgwgtttccatttcctcatgtgtaaaatgagataactacaagccttttgaaactttgatcctgaagacgtcgttttggtagatctaaaatgaatacatggtgg

SEQ ID NO: 37637 - DNA, 201 bp, Homo sapiens
gtggaaataggtttttgtttttattgttttatttatttatttaatttatttatttattttggtagagaaatcatatctctgtgctatcttcatttataaargaactactggcccagttcatgtaggggacaaacacccacgtgcacaacatacatttctttgcacacacaatctttctcaacaacaatgtttcaccaacaa

SEQ ID NO: 37638 - DNA, 201 bp, Homo sapiens
gacttgaaagttgagcaggaggtagccaggcataaaggaacccagagagttttccaagtggagttttccaaaaagcatgtgtgaagacttgcaagcttgtrcaacccaccattttttttgttgttgctgttctgttttgttttgctttaggattttagcagcctgaagccatggatctttgtttctgtctctagttttaag

SEQ ID NO: 37639 - DNA, 201 bp, Homo sapiens
ggcaagaagcagatactgtacaaatcagttcaataatgaggcattgaaacacaagttacatactgtgctaggaataaaatgataaacagagtaacactatyctgtccttttggatttttatagtttagtaggaatgtattaagtaatgacaagtacatgaatatgattaaagggatgtaaaatactgaatagcaaagggat

SEQ ID NO: 37640 - DNA, 201 bp, Homo sapiens
taaagtctgtcgctatattagctcataccacatatgtggcaagaagcagatactgtacaaatcagttcaataatgaggcattgaaacacaagttacatacygtgctaggaataaaatgataaacagagtaacactattctgtccttttggatttttatagtttagtaggaatgtattaagtaatgacaagtacatgaatat

SEQ ID NO: 37641 - DNA, 201 bp, Homo sapiens
ccttaatttcctcctttctgttaacattgaaaaccatcatactaactgtaaaaatcaaatactgtaataagagtgagggagtgcatgttttaaagtctgtmgctatattagctcataccacatatgtggcaagaagcagatactgtacaaatcagttcaataatgaggcattgaaacacaagttacatactgtgctaggaa

SEQ ID NO: 37642 - DNA, 201 bp, Homo sapiens
tgaaatcagagacatatcttttgagtatgttaggcagatgatcatgacattagatgaactaggaatacaatatttaggaaaaaagtgatttcgaaccttayggtgtcaagtttctttttatctgtacatgtcaagtgttctcacaggcagactttttagagagattgctatcactgacaacttccagagtttgagagtttt

SEQ ID NO: 37643 - DNA, 201 bp, Homo sapiens
tcctcagttttcaaaaaatattttatggtcttttgagggcataatattagtgcatgtaaaaactagaaccctttatgatttgaaaagaggagaagatgctragagagacactcttggaagctgggcaggaaatccagccatgcattgcctcaaggtctgtcattagatcaaaagcactcaggggacgatggtctgtgtaag

SEQ ID NO: 37644 - DNA, 201 bp, Homo sapiens
aactttttagcacatttatcattttcacttatacatgtatgctaatagcaatcttatgtgaacttttacctcttatatgaccagaattgattaaaaatgtyggcaagtaagtttgttatttaatatctctgaactttctctattttacattgaatatttgctacattgtaagcattacagtatgactagattcttcttttt

SEQ ID NO: 37645 - DNA, 201 bp, Homo sapiens
tgtgttgaagagctggacatcaggtgtggagtgcatactgggttgtggaaaagacaggtggaaaagacatgtgaaaaagacacatagccctgcttttgtgmtgaggagtagaggtgggatgctgggaaattttaagaggtaagataagggggatgtggggccggtgtggagaggggagcaggatgaagacttgagtgtttt

SEQ ID NO: 37646 - DNA, 201 bp, Homo sapiens
cacagtaacataggtatataactagaaaataatatttgacaatttggggagacctatagagatgcaaccttcaagacagtaaactaacgttaaaaatgccraattattaacagaggttatcaatgaggttcgttaaaaagaaaaaatattttcccttttaaaattttttattcttttattattttattttagcgacaggat

SEQ ID NO: 37647 - DNA, 201 bp, Homo sapiens
aaaatgccaaattattaacagaggttatcaatgaggttcgttaaaaagaaaaaatattttcccttttaaaattttttattcttttattattttattttagsgacaggatattgctgtgtcactgtcactcaggctgaagtgcagtggcatgatcatagctcactgtaaccttgaacacttacgctcaagtgaccctctggc

SEQ ID NO: 37648 - DNA, 201 bp, Homo sapiens
aagcgaaggagaaataaaatactttacagacaagcaaatgctgagagattttgtcaccaccaggcctgccctaaaagagctcctgaaggaagcactaaacrtggaaaggaacaaccagtaccagctgctgcaaaatcatgccaagatgtaaagaccatcgagactaggaagaaactacataaactaacgagcaaaataacc

SEQ ID NO: 37649 - DNA, 201 bp, Homo sapiens
aacaatattaactttaaatgtaaatggactaaatgctccaattaaaagacacagactggcaaattggataaagagtcaagaccaatcagtgtgctgtattmaggaaacccatctcacgtgcagacacacataggctcaaaataaaaggatggaggcagatctaccaagcaaatggaaaacaaaaaaaggcagggattgcaa

SEQ ID NO: 37650 - DNA, 201 bp, Homo sapiens
ttggcaaggatattttcatatcattgaaggtaaatgactgtacataggaacggtacccagtatttagcattgtgaatagcgtagggcttcggatccagacyacctgggttggaatgtcatctctgcagcttaagatctttgtaaccttgggcaaattacataaccttttgtgtgcactgctttcaaatgttgaaagtcact

SEQ ID NO: 37651 - DNA, 201 bp, Homo sapiens
agcaatggcaacaaaaaccaaaattgacaaatggggatctcatcaaactaaagagcttctgcacagcaaaagaaactaccatcagagtgaacaggcaaccyacagaatgggagaaagttttgtgtttttaaaacatcatgaaatcatgtattgcctttcctaagaatgggattaattcataaatctcgaaatatggaaatg

SEQ ID NO: 37652 - DNA, 201 bp, Homo sapiens
gaagaaaaaggatttccttttctagaagcatgaagctaagttcccctcatatctcattgactcacattgacttggcctacccattcttgatcaaatccctrgctttggagttgaaattatcatgattggcacagagagtcaatcatgatagccactgcatatgctttgaagacagtttagaattagacatttccaaatgtc

SEQ ID NO: 37653 - DNA, 201 bp, Homo sapiens
ctggcaaattggataaagagtcaagaccaatcagtgtgctgtattcaggaaacccatctcacgtgcagacacacataggctcaaaataaaaggatggaggmagatctaccaagcaaatggaaaacaaaaaaaggcagggattgcaatcctagtctctgataaaacagactttaaaccaacaaagatcaaaagagacaaaga

SEQ ID NO: 37654 - DNA, 201 bp, Homo sapiens
tcaaattctactcagttcagtcaagcccctgcccagaaacctggttagctggtttgttttccctcagaactcagattctgaaatactcccctctactttgyctcattcatagagtaagtttttgaatataaataaaaaactacacactgggtacagtatacactgctctggtgatgggtgcaccaaaatctaataaaaatt

SEQ ID NO: 37655 - DNA, 201 bp, Homo sapiens
tatcaaagatgatgattggaaaatatagaaaagaccatctcatgaagcaaaaagaacatggccattgaagccatgttgaagttagaaacgtgcagtgaatkttttttttgtttgtttgttagtgggaatgaatgatgatttgggtgaccgacaggtcttaactccacttttaccactcattgtccctattcaggtgtacgg

SEQ ID NO: 37656 - DNA, 201 bp, Homo sapiens
gataatagatgtttctctgcagggactgcagatagtttaagcaatagttaattttactaagtgtacaaaagcatattttgagagagaaataaaaacaaaartaatacctattactttaagccacagtttctgaccactgttgcagttgtgacttttcttatattctttcccccagatagcttatagtacacattaagaaaa

SEQ ID NO: 37657 - DNA, 201 bp, Homo sapiens
gtgtcactgtcactcaggctgaagtgcagtggcatgatcatagctcactgtaaccttgaacacttacgctcaagtgaccctctggccttggcatcccaaarcactgggattacaaacatgagccactgcacttggcctattcttccatattgtcatattgcttaattttgttttcaaaaaacatacattccttttgtaatt

SEQ ID NO: 37658 - DNA, 201 bp, Homo sapiens
tggagcatctagcattctccaggagttattcgaaagctgaaactttcagtggattgtgggcctggggagaagaaggattccgagggtggaattgggaagabcgtgcgtgcgtgtgtgtgtgtgtgtgtgcgcgcgcgcgcgtgggtcggggcgggggcgtcggggggccactgggaattcagtgaagagggcaccctatac

SEQ ID NO: 37659 - DNA, 201 bp, Homo sapiens
gcaaaagtcactggtatactatacagtttgggatcagcatagatgttgattacaggctctgtgatctagagaaagttacttagcatctctgtgccttttcwttctctatttaatagggacaatatttcctatctccaaatgttattacttaatcttgagataatttgcttacagcatctgtcaaagtgccaaacatatagc

SEQ ID NO: 37660 - DNA, 201 bp, Homo sapiens
agcattctccaggagttattcgaaagctgaaactttcagtggattgtgggcctggggagaagaaggattccgagggtggaattgggaagagcgtgcgtgcgtgtgtgtgtgtgtgtgtgcgcgcgcgcgcgtgggtcggggcgggggcgtcggggggccactgggaattcagtgaagagggcaccctataccatggcagtg

SEQ ID NO: 37661 - DNA, 201 bp, Homo sapiens
gcattctccaggagttattcgaaagctgaaactttcagtggattgtgggcctggggagaagaaggattccgagggtggaattgggaagagcgtgcgtgcgtgtgtgtgtgtgtgtgtgcgcgcgcgcgcgtgggtcggggcgggggcgtcggggggccactgggaattcagtgaagagggcaccctataccatggcagtgc

SEQ ID NO: 37662 - DNA, 201 bp, Homo sapiens
ccaccttcaactctctaatcaatgcctcccactggcaggacctgacaagaagccagctggctaaggataaagaaaaatgtagtttagagtcttcctgcctyctgtgaatcagaaagatggggatggagttgatggccaataaagagtttgcacacatttgttcattaattcattttagtaattttcttctttcatactgct

SEQ ID NO: 37663 - DNA, 201 bp, Homo sapiens
tctcattatataccagtggtgccattattctcaaatgacagggactttctgcttattaactgtataatacagctaagccctggctcagctgtggccctcartggaaggtagtgagtgtttattttatcacataaaaatattcctcaggatgctgtctctttttaccagcttccacagggctttactctaggccttaaccct

SEQ ID NO: 37664 - DNA, 201 bp, Homo sapiens
atttttctgtctttgcactcttgaaaagcatgttccctagagatctatccaaatagtcactggagtcctgaggccccaccctttgtccagtacactgaacygtgttatgcaacatggaaattgttcccattccaatgcctgacagccagactcttggaagacaagcaaagaaacaggatgcttctacggagcacaaacact

SEQ ID NO: 37665 - DNA, 201 bp, Homo sapiens
gaagataattcctttatatagaaacttgaatccttttggtaattacctatatatactttcatgataggtagtattttttattaaaggagattttttgttgytgtttgtttttttagtaaggctactatggaattgttttaactttgaactgagaatgtatgtttgtgctgttattgatataaaatatacagatttgatcac

SEQ ID NO: 37666 - DNA, 201 bp, Homo sapiens
ttatctgtgcattagtccttgtgctaaaaatcaaaaataatatacagatagatgtgacacagcatttgtctctgcaaagtttagagcctagtgagattaaygagaagtgaacataagaaaaagggaagtcacagtgaaatatcttagataatggagaaatgcatataataacttggagcaggtttttaacctggctccagg

SEQ ID NO: 37667 - DNA, 201 bp, Homo sapiens
gtgtatatgtgccacattttcttaatccagtctatcattcttggacatttgggttggttccaagtctttgctattgtgaatagtgcctcaataaacatacrtgtgcatgtgtctttatagcagcatgatttgtagtcctttgggtatatacccagtaatgggatggctgggtcaaatggtatttctagttctagatccctg

SEQ ID NO: 37668 - DNA, 201 bp, Homo sapiens
cttaacaggctcaacttgtcaacctagcctttagcagcaaatgctacaaccacatattccatttctttctgttctgtagggttgggttgtcataccttccmgtttttatcaagttcactaaagcaggaatgagagactttttgggttctgtttgctcatgccttccaaaagttaactgaccacattatattacaatttaaa

SEQ ID NO: 37669 - DNA, 201 bp, Homo sapiens
aaacagaataaaatgtttcaatatggtatcctaggaaaagaaggtttttatcccaccttataattaaatctgaaagattcctacagtgaactaagaggttyctaatgaagtactaagctgcatttagaattggagcaatgaaaggctctttgttctcctttcaaaaggttccagtacagaacaatttggctcccaatacag

SEQ ID NO: 37670 - DNA, 201 bp, Homo sapiens
tgaagaaattatgaatatcataatttttttttccttttgactctgcctgtgttcatttccctcagcactcattcaatttaataattgtcattctgtgtctrtatggttcaaaattaattcaagataatttaatgtcctttttattcactgtgttttaaaaattaattttattctgtacagtacaagaaatttctgcagtat

SEQ ID NO: 37671 - DNA, 201 bp, Homo sapiens
tgttcatttccctcagcactcattcaatttaataattgtcattctgtgtctatatggttcaaaattaattcaagataatttaatgtcctttttattcactrtgttttaaaaattaattttattctgtacagtacaagaaatttctgcagtatatcaaaataaaactgttaaaagaatgactagcccttccacaaagatgtt

SEQ ID NO: 37672 - DNA, 201 bp, Homo sapiens
acaaaagtaaagagaaaagtccatataccaggtgatatggtttggctgtgttcccacccaaccctcatcttgaattgtagttcccataatccccatgtgtygtgggagggacctggtgggaggtaatcgaatcataaggggagttacccccatgctactgttctcatgacagtgagtgacttgtcacaagatttgctggtt

SEQ ID NO: 37673 - DNA, 201 bp, Homo sapiens
gagattggagggtcatatggtttggctgtgtctccacccaaatctaatcttaaattcccatgtgttgtggagggacccggtgggagataattgtatcatcrtggcaagtcttttctatgctgttctcgtgatagtgaataagtctcacaagatctaatggttttaaaaagaggagttcctttgcacaagttctctttttgg

SEQ ID NO: 37674 - DNA, 201 bp, Homo sapiens
tgcactgccttatgaaagatgggaacaagggtgtttttgtttttgttttttttcaaaaagaaagaagtcaagacaaataatgtcagtacttttttaaaaasttctttgactctcattttctcttctcagattctgacagtggatttacacatggacatatgggatatgtattctcaaaaacgtataatgtgacagatgata

SEQ ID NO: 37675 - DNA, 201 bp, Homo sapiens
gtgtgtgtatgtgcatgtgcatgtgtgtacctgtatgtgcatttatgatttgtgtgtgtgcatgtgtgattttcccctggcagaaaattgctttggttgtrtcaatttagtgaagaaacagtgtcacccagtggctttgatgaaaacagtcctataaacattatagataagcactgtccagtagaaatacaacacaagcca

SEQ ID NO: 37676 - DNA, 201 bp, Homo sapiens
atgatgtatgtgtgctgttattataacgaaagccactttctgtgaagtgtccacctatgcttgagtactaatcatagaaaggagctctgaaaataagcagygggcctgtagtcagggactgctgaaaatgagggagagcatcagggaaattagtgcactgtgcctcttctttcttcagtactcctttatgttcattgctca

SEQ ID NO: 37677 - DNA, 201 bp, Homo sapiens
gaaaataagcagcgggcctgtagtcagggactgctgaaaatgagggagagcatcagggaaattagtgcactgtgcctcttctttcttcagtactcctttaygttcattgctcatggggatctgtgtttgcctgttaattgagtgtgtttattgcaggcagttgccttaagtgacatgatactcagtaggaggttgtgagga

SEQ ID NO: 37678 - DNA, 201 bp, Homo sapiens
ccaacagacaaatagagagccaaatcatgagtgaactcccattcacaattgcttcaaagagaataaaatacctaggaatccaacttacaagggatgtgaargacctcttcaaggagaactacaaaccactgctcaaggaaataaaagaggataaaaacaaatggaagaacattccatgctcatgggtaggaagaatcaata

SEQ ID NO: 37679 - DNA, 201 bp, Homo sapiens
aaaatccccacgtttattgtatgcaaattttcctaaacagagaagttgacagatttctaaaactaccctgatcattccaaaagactctttaggaagttacrgcttcaatgacagcagctgcgagatgttttagcaccacctgggagaacgggggattgggtgggggagaggggctatactaaaaaacaaaacaaaacaaaa

SEQ ID NO: 37680 - DNA, 201 bp, Homo sapiens
cagattcattgtttgtagaatgtttcttaaggcttcacagatattgtaatttcttatagatggattgtggagagagatcatgtgtagatagaattcctacrtggtcccagtgttttaagtatagtagtcttctgccactctaatattgaataagaagtgctagtggaaaaattgggtgatcgattacttatttccactctg

SEQ ID NO: 37681 - DNA, 201 bp, Homo sapiens
gaagtccatcacagtctattgacagtttcatcaaagctgtatagtccaactagtggggcagcttggctactatggtggaagtctcagcaaactgcctggttttgtttgtttgttttgttttaaggtacaggaaataagaggaataatagtggccaaagcaattagaacatcttcattccagaactgtgttcagcaatccag

SEQ ID NO: 37682 - DNA, 201 bp, Homo sapiens
tagtatattgcctacagttaacagtacatactctgttgtagacttaaaaagagggtagattttatgttgtgttcttatcacaaaaaaaggtgggaggaaayttctggaggtgatggataggtttatggcacagattgtggtgatggtttcacaagtatatatatgcttatctccaaactcatcaagttgtatatatttaat

SEQ ID NO: 37683 - DNA, 201 bp, Homo sapiens
atgttccctgtatgtagcagctgggttaagaatataattgtcttgacaacaaattattgacatttacgagctcaaaagttacctcagaagcttttgaaatyaaagaaataaaagtgttaattctctctgatctgaacaagccaggactcagtgtcagccctttataggtcaggctgtggaaggaatgcataggatgaaata

SEQ ID NO: 37684 - DNA, 201 bp, Homo sapiens
aagtccatcacagtctattgacagtttcatcaaagctgtatagtccaactagtggggcagcttggctactatggtggaagtctcagcaaactgcctggttttgtttgtttgttttgttttaaggtacaggaaataagaggaataatagtggccaaagcaattagaacatcttcattccagaactgtgttcagcaatccagg

SEQ ID NO: 37685 - DNA, 201 bp, Homo sapiens
agtccatcacagtctattgacagtttcatcaaagctgtatagtccaactagtggggcagcttggctactatggtggaagtctcagcaaactgcctggttttgtttgtttgttttgttttaaggtacaggaaataagaggaataatagtggccaaagcaattagaacatcttcattccagaactgtgttcagcaatccaggc

SEQ ID NO: 37686 - DNA, 201 bp, Homo sapiens
attaaacccaagttctgtaatatatacttcagaaatattgttttaatctattctctgaactagttttacctggcttgtaggactatctgcctttgttcttaaaaaaaaaaaaaaaaacttgtgagagtctttttaaaattctatagtcagatctatgacaacaaaagagactgagacatccacaagttatttctaccatgt

SEQ ID NO: 37687 - DNA, 201 bp, Homo sapiens
accactgctcaaggaaataaaagaggataaaaacaaatggaagaacattccatgctcatgggtaggaagaatcaatatcgtgaaaatggccatactgcccmaggtaatttacagattcaatgccatccccatcaagctaccaatgcctttcttcacagaattggaaaaaactactttaaagttcatatggaaccaaaaaag

SEQ ID NO: 37688 - DNA, 201 bp, Homo sapiens
gtccatcacagtctattgacagtttcatcaaagctgtatagtccaactagtggggcagcttggctactatggtggaagtctcagcaaactgcctggttttgtttgtttgttttgttttaaggtacaggaaataagaggaataatagtggccaaagcaattagaacatcttcattccagaactgtgttcagcaatccaggca

SEQ ID NO: 37689 - DNA, 201 bp, Homo sapiens
gaagaacattccatgctcatgggtaggaagaatcaatatcgtgaaaatggccatactgcccaaggtaatttacagattcaatgccatccccatcaagctascaatgcctttcttcacagaattggaaaaaactactttaaagttcatatggaaccaaaaaagagcccgcatcgccaagtcaatcctaagccaaaagaacaa

SEQ ID NO: 37690 - DNA, 201 bp, Homo sapiens
aatgcctttcttcacagaattggaaaaaactactttaaagttcatatggaaccaaaaaagagcccgcatcgccaagtcaatcctaagccaaaagaacaaaggctggaggcatcacactacctgacttcaaactatactacaaggctagagtaaccaaaacagcatggtactggtaccaaaacagagatatacaagaatgga

SEQ ID NO: 37691 - DNA, 201 bp, Homo sapiens
ttgacaaacctgagaaaaacaagcaatggggaaaggattccctatttaataaatggtgctgggaaaactggctagccatatgtagaaagctgaaactggawcccttccttacaccttatacaaaaatcaattcaagatggattaaagacttaaacgttagacctaaaaccataaaaaccctagaagaaaacctaggcatta

SEQ ID NO: 37692 - DNA, 201 bp, Homo sapiens
gtgctgggaaaactggctagccatatgtagaaagctgaaactggatcccttccttacaccttatacaaaaatcaattcaagatggattaaagacttaaacrttagacctaaaaccataaaaaccctagaagaaaacctaggcattaccattcaggacataggcatgggcaaggacttcatgtctaaaacaccaaaagcaat

SEQ ID NO: 37693 - DNA, 201 bp, Homo sapiens
ggtcttgtttgaatacaaggggtgggggagtcacacttttcagaccgattagaataatgagattctctaaacagttgagaaccatttgtaagaatagcacrttgtgttagaaggcaattagagctcattcttttaataattaggttttttgagttcttacagtatgctgagtactaagattataaaaatgaacaaaaattg

SEQ ID NO: 37694 - DNA, 201 bp, Homo sapiens
agagcattatgtgaaaaagctaaaaagaaatagacatttcatttgacatgataactaagagttaacagactactcagaaagctaccacaattacataagcygggggtgatcctcctgacattaccctacacccatcagaatgcacttgaaccttcctgtttggcactgtgaaccactcttaaaaagaatgtggaggtgaag

SEQ ID NO: 37695 - DNA, 201 bp, Homo sapiens
gtgagtgagtgctcaattaaacctccttcctttgtaaattgcccagtctcaggtatgtctttgtcagctgcatggaaatggacgaatacagtaaattggtmctggtagagttgggtgctgctgaaaagacaaccaagaatgtggaaacgactttggaactgggtaacaggaagaggttggaacagtttggagggctcagaa

SEQ ID NO: 37696 - DNA, 201 bp, Homo sapiens
tcacaacctactcatctgacaaagggctaatatccagaatctacaatgaactcatacaaatttacaagaaaaaaacaaacaaccccatcaaaaagtgggcraaggacatgaacagacacttttcaaaagaagacatttatgcagccaaaaaacacatgaaaaaatgctcatcatcactggccatcagagaaatgcaaatca

SEQ ID NO: 37697 - DNA, 201 bp, Homo sapiens
tggttccatagagattttggaattgtttttcctgtttttctgaataatgtattggtattttaaaaataaagattgcgggggaggagccaagatggccgaayaggaacagctccggtctacagctcccagcgtggtggatgcagaagatggtgatttctgcatttccatctgaggtaccgggttcatctctctagggagtgc

SEQ ID NO: 37698 - DNA, 201 bp, Homo sapiens
ttgatttaatctatattttgtctagcattatcccaacattagaagtagttaatgtatccataggcaattgttagatacatatgtaagaaagtgaaaaaccracagacagacaaaacccacctaagtcaataatattggcaataggatttagaatgctgttatggcacatgagatgctccacatcctacctacatggaatat

SEQ ID NO: 37699 - DNA, 201 bp, Homo sapiens
catccatgtccctacaaaggacatgaactcatccttttttatggctgcatagtattccatggtgtatatgtgccacattttcttaatccagtctatcattsttggacatttgggttggttccaagtctttgctattgtgaatagtgcctcaataaacatacgtgtgcatgtgtctttatagcagcatgatttgtagtcctt

SEQ ID NO: 37700 - DNA, 201 bp, Homo sapiens
caaattgagtaagtttcagaaataatcacggacttttaattaaattgtagcttctacatttcagtagtgttactcagtttatggtgattcaaagagcaatmttgattacttatgacttggtgacagaattaaaattaattaatgtcaatttctgaaaatactgaaaagggaaaacaagatttccttatcccttgggaaagg

SEQ ID NO: 37701 - DNA, 201 bp, Homo sapiens
tgtggtcagtttcaaggaacgagagaccaacatccaagaatagtctggaggagaaaggacatatcaagaaacacaactcaagctgggtgtagtggctcacrcttctaatcgcagcactttgagaggctaagttgggaggatcacttgagcccaggagtttgagaccagcctaggcaatataaagagccctcatcttaacca

SEQ ID NO: 37702 - DNA, 201 bp, Homo sapiens
catcaccaacatcataactttatagagatattgcattagaattcatctagtttctgtacttattcatgaataagagatgcttatgtagatgttatttcttsttgacaaattctattagcataaaataaaagcattaatatttacttttaataaaagtcataacatttagcgttaagttcctttataagtaagtgctttatg

SEQ ID NO: 37703 - DNA, 201 bp, Homo sapiens
acattgcttaatttcacctacatataattacatatcatttgacactctctaaatcgagctgtttattgtagttctcaaaatttagtgtgaataaaaattayttgggaaaactattaaaatgcagacgtttaaatactagattatagatcctgtaaccttccagatactctgatttagttaagtgtagagtgggatcctgaa

SEQ ID NO: 37704 - DNA, 201 bp, Homo sapiens
aagggtataaaaatatgtaaataaaagtgcctagatgcaagagtgatggaaataagtcaaatgttagcagtgctttcttatcagatggagaaattatggaygacttttccttcccagtttagtgtttctttgtacctctgaaaatttgtacaatgtacatctgttatttataattttgtacattgagtgtgtatcaagtta

SEQ ID NO: 37705 - DNA, 201 bp, Homo sapiens
gtgtctactgaaactgtacaggaagttctgacttttgcaatccaattcaacaaacagtttaaaagtgcttggctcagacaagaagggtcagtatcatgggraaaaactatacacacgcactatagtttatgaacctatgacattcataaatgtttcactttgatttcatttctttgaagttcaaaaaaacttcattgatga

SEQ ID NO: 37706 - DNA, 201 bp, Homo sapiens
agattagagggtggaaaatggattctggagaaataaacccatcatattaactataaccatgagttccttgaagacaaatcaaatctgatgtcttttctttytccttatgaatatacttcagtacgaaggacctgatacttagtttggacccagtaattatttattgttgtaagtagcacagtaagaataaaaacgtttatg

SEQ ID NO: 37707 - DNA, 201 bp, Homo sapiens
ttagcattccttctccaaaaagagtatcatatcatcttaataaagtttctcttttcccagaattgcttaagtagcatgctgctattcatttctcttgaaaktttagtcaaaatgaattattttgcaaaaaggaaaattccacagtttctatttcttttcctcattgtctgtggcccattaacgtcttttatctgctactat

SEQ ID NO: 37708 - DNA, 201 bp, Homo sapiens
ccagtgcacaagggggtgtgtcttctgtgtaaagggaacatgttccaaaagcaaaaaggcaagaaacaatctgttaagaagaaaccacaaagatttcctargaagagagaatggcatgagttgagatggaaatgattgggaaaggagagttaagtcatagagggtctgggtttagatatgacaccctcccctttaaagtta

SEQ ID NO: 37709 - DNA, 201 bp, Homo sapiens
cattttctttttattctctaacccaaactgacagatttaataattagaaatattttacaggtaacgtttttctatttacactcaagggttgaaaagtaaarttacttagtatgcagatacggtctacctacctcttctcttagtgcacacacgagcacaattcaggaaaaaaaatgatgagttatttaagatattaaacaa

SEQ ID NO: 37710 - DNA, 201 bp, Homo sapiens
agaaacagtaggtcacatgaaataaattaaaatccctaaaaaatatggcaattgttattctataggattaatgtccattttaaagcattaatataaacttrattaataatagtaggaatgatcaggtcctactactcatggatttcttttgagagcttaatttaaggagggaaccctcatctcagaaaaatttacatgact

SEQ ID NO: 37711 - DNA, 201 bp, Homo sapiens
ttccatgtgccttagacctgtcttccatctaataagacttcacactgctcacttttcctttctgacactgaatacacataaacaacagagagcaatgtctsttaaacccataaacccattcaaaaaccaaaaccaaaccaaataaaatgaattggttgtattaatttgtatcatccatttacattttgagaagcatagtca

SEQ ID NO: 37712 - DNA, 201 bp, Homo sapiens
tgttttggattctgttgcccaaaatggaaattgccttatttttgttttcctgatcaaaacagtgacctacatttctgatattttggggggcgctgggagayggggtctcatgatgttggccaggtcggtctcaaactcctggcctcaagtgatcctcccgcctcagcctcttgaagtactaggattacaggcatgagccac

SEQ ID NO: 37713 - DNA, 201 bp, Homo sapiens
gacatcatctgtttcaccttatcactgtgtactttcaaaatatcttcaagatgctttcattgaagcaacaagaaaattgttttgaacaaagaccctttagygtcagtcactatttcagaatataacaccagtcattgtttatatgatttactcttaataggattttgatattctgctgtgtaacgttgctgctgactgaat

SEQ ID NO: 37714 - DNA, 201 bp, Homo sapiens
tggaaacattctgatttggttgggggggggggcttttgacatcatctgtttcaccttatcactgtgtactttcaaaatatcttcaagatgctttcattgargcaacaagaaaattgttttgaacaaagaccctttagtgtcagtcactatttcagaatataacaccagtcattgtttatatgatttactcttaataggatt

SEQ ID NO: 37715 - DNA, 201 bp, Homo sapiens
ttgccaacaagatggagtttgagggactaaaattgattttaagaataataatgttgttgttcctttttcaaatcttttaacatggaaacattctgatttgrttgggggggggggcttttgacatcatctgtttcaccttatcactgtgtactttcaaaatatcttcaagatgctttcattgaagcaacaagaaaattgttt

SEQ ID NO: 37716 - DNA, 201 bp, Homo sapiens
tgatatgttgaaatggcagcatcctagaccaatcccaagtttaatgccttccttgaagttgccatgtttctgtttcggagtccttggtgccacaggtcccycttgactttcacaggccagggcttcttgccatacaggtaagtgttctcccttcccagcttatgggatccagactcatcagctgcccgctgtaggttgtcc

SEQ ID NO: 37717 - DNA, 201 bp, Homo sapiens
ctacataaaatattggtatggaatctgcataccttaaataaaagcttgtagttacaaaactttatattcttagtaatattgtatactctagtttaatttamatggctgtttggctctgttaatgatagaaaacccttcattattaaggacagcacttcacagaaaattgactgaagctaactttaacttgcagatggcgtt

SEQ ID NO: 37718 - DNA, 201 bp, Homo sapiens
tttctgaatgaccttaaactcaaggtagtcgttgagtgggagggatgatttttagccatctttttcctccaactcaggtagataggatttaccagcttggycttaatttcctcctttctgttaacattgaaaaccatcatactaactgtaaaaatcaaatactgtaataagagtgagggagtgcatgttttaaagtctgtc

SEQ ID NO: 37719 - DNA, 201 bp, Homo sapiens
aagccttttgaaactttgatcctgaagacgtcgttttggtagatctaaaatgaatacatggtggatcccatcactgttttatttagaaatacaaaatcaargttattaattctaagatatgcatccatagctctgcagtatccaaagcacagcattaactttagttgcatgaaaatttcccaagttggtatatggatgtat

SEQ ID NO: 37720 - DNA, 201 bp, Homo sapiens
tttttccacttattgaatgatctttcagtctagtctgaggtagttattttggtttggccctaggagcagcaggagtcctgtggagtctcagtctactcctrttggtttcagtttataaattctgcctggagtggtcatctctttcctaacttggttacagacagtccatggatttccacttttgtgatagaagatggaaaa

SEQ ID NO: 37721 - DNA, 201 bp, Homo sapiens
acagttgttgaactagtttacagtcccaccaacagtgtaaaagtgttcctatttctccacatcctctccagcacctgttgtttcctgactttttaatgatygccattctaactggtgtgagatggtatctcgttgtggttttgatttgcatttcactgatggccagtgatgatgagcattttttcatgtgtcttttggctg

SEQ ID NO: 37722 - DNA, 201 bp, Homo sapiens
ggtatacaaaagagcaaaattgagaagctgggtgatctaagcctgaagtcctcaaatatttaaaagacttagtttgtcaagatttaaccatctttttctgrgttcttttcatcactgttgacaaaagcaagcactggagaaaaatttttcttttgcctatggggccagcagtgaagatgagctcatctgtccatcaagctc

SEQ ID NO: 37723 - DNA, 201 bp, Homo sapiens
aggtcaggggtttgagaccagcctggccaacgtggtgaaaccccatctctaccaaaaaatacaaaaattagccagacatgttggcacatgcctgtggtccyagctactcgagaggctgaagtaggaggattgattgaacctcggaggcagaggttgcagtgagccgagatgatgccagtgcacttcagcctgggtgacaca

SEQ ID NO: 37724 - DNA, 201 bp, Homo sapiens
aatgatgaggcaacctgggtgcccaaaaagtgaaagtggttatcactaggaccaaaggcacgaggagagggaggtgtaactgagacccagtgagagcagtrcctgtgggaaaggggctactgaacaggagctgtggctatgggtagagaaatgcagccactattggattacgctgctgcactgagcaggtgggggcagggc

SEQ ID NO: 37725 - DNA, 201 bp, Homo sapiens
aaatacatttatgaggtgtttaatgttgtgttaaaaaattgggggctattgaaatcacccgccccctcaaatgtttacactgtggaaggcaatagagattrtcaaaggggaacattttcttagttggtcagacacaatatagattttattaactcacaagtgaattattcacaaattattttgtgaagcctggggtactta

SEQ ID NO: 37726 - DNA, 201 bp, Homo sapiens
gataaccacagattggaaatgctagccctctggacactcaaactttaactctggaaactgggttacactggaaagaatctacaataaactgaccttccackggacacgtggagtattctaactaatgcagaaatccgaagcagactagagtatccctgatctccttagtggtgtagaatctcacactgtattatttattta

SEQ ID NO: 37727 - DNA, 201 bp, Homo sapiens
cacatgtacaagtatttctctaaggcatatacctgggagttaaattgttaggttaaatatggtatgtgcttgttcagctttcctaaatagaatcaaagtayactccaaagtgattgtagcaatatacactctccccggcagggtgggtgaattctagttgtcctatataccgacaaatatgatgggtgtaaaatgaaattt

SEQ ID NO: 37728 - DNA, 201 bp, Homo sapiens
atgggcaggtggtaggaatgagagccacaggcatagcaagagcccccttccattcttgccatcaagtgcataaggcatttctatcatgatcattttggagyggattttgcattgtggcatctttagacagctgtcacagcacagctaaaagtttataaaataacctatatcccaggcatgctgaatccaactaattaaatt

SEQ ID NO: 37729 - DNA, 201 bp, Homo sapiens
ggctaatgagctccattaggtttaatcaacatttcagcaatttttgacttgaattttgtttaaactttctgctttgtcttttaccttttgttctttattaygttagctcatttaatttttatacgtaggataaaacatacactttgaaatggcctcagaatttgaaagtatggctgtaaagggtgaaatcactgatgttaa

SEQ ID NO: 37730 - DNA, 201 bp, Homo sapiens
ctatcccttcaatgtaatttccgagacctttacaatataggtagaccctttaaaaaattaccgtgtgcttaaatttatattccaccattgttagccaaggrccttcatttcaattttatagtcatttaattttctcagtgtttatatctgtgtcttcttctttttgcctttaattcccctcagccaaaaatttcagcatac

SEQ ID NO: 37731 - DNA, 201 bp, Homo sapiens
tcattaaaacttcactattgtttcagccctgtatagttcacttagttacacgtgtaattttaaacactgttgttgactgtgttgtactggttagaagccayattaactagatttcagtttcttgaaaatttatacattagcaagcatagtgtaaatatgtattaagtgggcaataaatatttgctgtgttagtggcatttt

SEQ ID NO: 37732 - DNA, 201 bp, Homo sapiens
actttttagagagattgctatcactgacaacttccagagtttgagagttttttgaatatactacttaaaaaaatctccatatggttttcatttgaaaaaayatattacaaactgagacattcactataaattaaattgaaataatcaaaatataattaagctatttgtgagtttacattttgcaaaacattttagaagcaa

SEQ ID NO: 37733 - DNA, 201 bp, Homo sapiens
acagtgacctacatttctgatattttggggggcgctgggagacggggtctcatgatgttggccaggtcggtctcaaactcctggcctcaagtgatcctccygcctcagcctcttgaagtactaggattacaggcatgagccactgtgcccagcctgattttttaaattatagatttaaaaggacaagggagaaaattaaaa

SEQ ID NO: 37734 - DNA, 201 bp, Homo sapiens
taaggcatttcttcattagcaaaaacagctggtaatttttttcacctgttattttgcagtgtttccttagaatttcattaaaatataagtaaatagggtawaatatcagaggaggtcatgaagaacattaccatttcgaagatggaaagctatttgagagaagtcacaaactaagcaatgtctgtgtttttgatttgatta

SEQ ID NO: 37735 - DNA, 201 bp, Homo sapiens
gaaagcgagtatgaagtaagaagaggcatacagaaagataaataccctgtttccagagagggctaatgaaatctgttctttgcgcaaatcaagtaaacagygtgtcctctagttcagtcaatcaatgttaattttaaatagctgaaacacaaattattatgcagttactaatataaaataaatgaacgaaatcacatagga

SEQ ID NO: 37736 - DNA, 201 bp, Homo sapiens
gacactgatgagggtggaggtagtagctgagtcttttgttataaaagctcatgttgactcgttaacattggtttttttttttttttttttttttttgtttttttttttttttgagatggagtctcgatctgtcgcccaggctggagtgcagtggcgctatcacggctcactgcaagctccacctccctggttcacaccatt

SEQ ID NO: 37737 - DNA, 201 bp, Homo sapiens
tataggtagaccctttaaaaaattaccgtgtgcttaaatttatattccaccattgttagccaaggaccttcatttcaattttatagtcatttaattttctcagtgtttatatctgtgtcttcttctttttgcctttaattcccctcagccaaaaatttcagcatacttatgatctatccaaatatgtgttctgtgtatagc

SEQ ID NO: 37738 - DNA, 201 bp, Homo sapiens
tgtttgtgctgttattgatataaaatatacagatttgatcactgagaaaaaagtctaacagatgtgcctgagttgtagtttagaggaagatgtgttgtatracaatcgtaaaaaatattagttgaccatacctgttcattgtgaatgtataccactgttttaaaagaagatgctacccatagctaatgttacccattatcc

SEQ ID NO: 37739 - DNA, 201 bp, Homo sapiens
ataggtagaccctttaaaaaattaccgtgtgcttaaatttatattccaccattgttagccaaggaccttcatttcaattttatagtcatttaattttctcagtgtttatatctgtgtcttcttctttttgcctttaattcccctcagccaaaaatttcagcatacttatgatctatccaaatatgtgttctgtgtatagct

SEQ ID NO: 37740 - DNA, 201 bp, Homo sapiens
cccagtagataataaagaacaatcaaaggattttaagtaaagaaggtttgctacatttaatgcccctctcctcacagtgttattgaactgtcaataatatsaacacacattaaactgaaccgcatattcagtttaatgtgtgtttttgtataatttgaacaaggctggaaaccaggagacctgaactcagattccagctgg

SEQ ID NO: 37741 - DNA, 201 bp, Homo sapiens
atattgtttagccctattttttcgtttgtttcttttgaactactccgttttccttaactctccttatctttttctgaatgaccttaaactcaaggtagtcrttgagtgggagggatgatttttagccatctttttcctccaactcaggtagataggatttaccagcttggccttaatttcctcctttctgttaacattgaa

SEQ ID NO: 37742 - DNA, 201 bp, Homo sapiens
tatggaacaaagctgcacgttgtgtacaagtaccctagaacttaaagtataatacaaagtattatattaattattaattatattaattattaatatataawatataaaatatatatataaatatatataaaatatatatataaatatatataaaatatatataaatatatataaatatatataaaatatatataaatatat

SEQ ID NO: 37743 - DNA, 201 bp, Homo sapiens
taaaatatatatataaatatatataaaatatatatataaatatatataaaatatatataaatatatataaatatatataaaatatatataaatatataaawatatataaatatatatataaatatatataaatatatataaatatatataaatatatatataaatatatataaatatataaaaatatatataaatatataa

SEQ ID NO: 37744 - DNA, 201 bp, Homo sapiens
tatttcttgaaatgtagagtccgtatcagtggtggtataaaagattgttttacatgcaacgagatatgctggtatataatattaagtgttttgctaaattrtttgcctttcatttctactctaatgttactgattaagataaggggagcagatctcaccttggagctaggatgctttcatgtccctccaaccctcactgat

SEQ ID NO: 37745 - DNA, 201 bp, Homo sapiens
atatataaatatatataaaatatatatataaatatatataaaatatatataaatatatataaatatatataaaatatatataaatatataaatatatatawatatatatataaatatatataaatatatataaatatatataaatatatatataaatatatataaatatataaaaatatatataaatatataaaaatatat

SEQ ID NO: 37746 - DNA, 201 bp, Homo sapiens
tatatataaatatataaaaatatatataaatatataaaaaataaaaatataaatataaatatattaattatattaatatattatattatattatagtataktatagtataataaaaaaatactaaaaaaaaattgccattctgactggcatgtgatggtatctcaatgtggttttggtttgcatttctctaatgatcggtg

SEQ ID NO: 37747 - DNA, 201 bp, Homo sapiens
aaatagacaagtagagatagaagagtaatttttaatttgctttaaaaaatctgatgtattaatgtattttattgactttcatagaaagaattcaaatttakttaaatttcaattgtatctactgcccttgttaggaggctttcaaatggaagaattgatataaggggtcttggcctgtgccccatacacttttgcctatgt

SEQ ID NO: 37748 - DNA, 201 bp, Homo sapiens
aaattaggctatattcaatgatgctagctagcatcatcgtgtgtgtgtatgtatacatatatataacatatatattctcatatatatatatatatatatayacacacacatacatgcattatacatatatatatatatacaattccggaccgttgactctggatcaagggtccggaagtgcaatccactgttgattctttg

SEQ ID NO: 37749 - DNA, 201 bp, Homo sapiens
tactcttctagacttgtgtttatatatcatagtaaatttttggaggacttttttttttccgtttatgtatgtgttacttttcctgaaaaacatcagtgctkttgtatcacaggattggagggaaattaaaggtagagctcaatttatgaaatgcctaacaagtgatcattgttaagcttttgcctaatcactaccataata

SEQ ID NO: 37750 - DNA, 201 bp, Homo sapiens
tttttacctgagtaatgcatacctagtataataggctacagtatttcttgaaatgtagagtccgtatcagtggtggtataaaagattgttttacatgcaaygagatatgctggtatataatattaagtgttttgctaaattatttgcctttcatttctactctaatgttactgattaagataaggggagcagatctcacct

SEQ ID NO: 37751 - DNA, 201 bp, Homo sapiens
tttttttgttattgcaaattgtatttgaaggggtgtctctccattctctttataaataaagaactataattggctgctcattcttctctaattactgagaycaccttacacattcacttttgaaagatttcaaaccaatgcaattttattttagttacctgttaaggaaaattttatatttttacctgtggtttcaggtaa

SEQ ID NO: 37752 - DNA, 201 bp, Homo sapiens
gaaataaaagtgttaattctctctgatctgaacaagccaggactcagtgtcagccctttataggtcaggctgtggaaggaatgcataggatgaaataccastgcatgcctggtgcactaaaactaaatgggatttcagcagatgaagggaaagggtgaggaatcaagccttaaattgtctgcctcaggcatggtaagaaga

SEQ ID NO: 37753 - DNA, 201 bp, Homo sapiens
caggggagacatacagttcaggctcatcttctcacatggaatgctgcagagagcaaatataggtagcatagaaattaaggaaaaagagtatgccaaggaargaatccaatcaaacatgcccaggttaaagaagtgcttttagtttcttatcaaatcaaaaaccgtgtgctcatcagagtaaatgtggttctaaaaggcaac

SEQ ID NO: 37754 - DNA, 201 bp, Homo sapiens
tgctacagtctgagaaattgtatgttgtttaaatgcaatacatcacaatgtttgataaataaaaataaaaaccgttaaacctatccaaatgcaagaactcmtaaatattgttgagttaaagcttttgatgcagctgaggctatgtctggattttattattttccctaggatttccaattttttctaagaaaggagatcaat

SEQ ID NO: 37755 - DNA, 201 bp, Homo sapiens
agccactcggacaccaagtagaacaggtaattcattgttttggattctgttgcccaaaatggaaattgccttatttttgttttcctgatcaaaacagtgayctacatttctgatattttggggggcgctgggagacggggtctcatgatgttggccaggtcggtctcaaactcctggcctcaagtgatcctcccgcctcag

SEQ ID NO: 37756 - DNA, 201 bp, Homo sapiens
gaacaggtaattcattgttttggattctgttgcccaaaatggaaattgccttatttttgttttcctgatcaaaacagtgacctacatttctgatattttgkggggcgctgggagacggggtctcatgatgttggccaggtcggtctcaaactcctggcctcaagtgatcctcccgcctcagcctcttgaagtactaggatt

SEQ ID NO: 37757 - DNA, 201 bp, Homo sapiens
aagtggctggggtgggaggattgtttgagcccagtagctcaagatcagcctgggcaacatagtgagatcctgtctcataaataaataaataaataaataaatacataaataaataaataaataaataaaatctagctggacattatggaaaacagtatggaggttcctcaaaaaactaaaaatagaactcccatgtgatcc

SEQ ID NO: 37758 - DNA, 201 bp, Homo sapiens
tgacttgaatatattatcccattatctcctggactgaatgatttctgctgagaaatctgttagtctgattggagtttccttataagttactagatactttycttttgctgtttttagaactctctatgtctttgacttttttttttttttttttgagatggagtctcgctctgtcccccatgctggagtgcagtggcgtga

SEQ ID NO: 37759 - DNA, 201 bp, Homo sapiens
agtggctggggtgggaggattgtttgagcccagtagctcaagatcagcctgggcaacatagtgagatcctgtctcataaataaataaataaataaataaatacataaataaataaataaataaataaaatctagctggacattatggaaaacagtatggaggttcctcaaaaaactaaaaatagaactcccatgtgatcca

SEQ ID NO: 37760 - DNA, 201 bp, Homo sapiens
gcaaaaaaggcaggcaataaagttagtctgaagtatcttcatgtaggtattcttggtgtagaagtgtagtaactctaaatctagcaaaacaagctttattyccatatactgtagctgattaccaagttcccagagggaggttggtggtgctttggggtccagtttattagattggattagatggggtagatgcaagaagat

SEQ ID NO: 37761 - DNA, 201 bp, Homo sapiens
gtggctggggtgggaggattgtttgagcccagtagctcaagatcagcctgggcaacatagtgagatcctgtctcataaataaataaataaataaataaatacataaataaataaataaataaataaaatctagctggacattatggaaaacagtatggaggttcctcaaaaaactaaaaatagaactcccatgtgatccag

SEQ ID NO: 37762 - DNA, 201 bp, Homo sapiens
tggagtgcagtggcgtgatctcagctcactgcaagctccgcctcctgggttcacaccattctcctgcctcagcctcccgagtagctgggactacaggcacrcgccaccatgcctggctaattttttgtatttttagtagagatggagtttcaccgtgttaggcaggattgtctcgatctcctgacctcgtgatctgcctgt

SEQ ID NO: 37763 - DNA, 201 bp, Homo sapiens
gtttatatctgtgtcttcttctttttgcctttaattcccctcagccaaaaatttcagcatacttatgatctatccaaatatgtgttctgtgtatagcttayctttttcattaaaacttcactattgtttcagccctgtatagttcacttagttacacgtgtaattttaaacactgttgttgactgtgttgtactggttaga

SEQ ID NO: 37764 - DNA, 201 bp, Homo sapiens
tggctggggtgggaggattgtttgagcccagtagctcaagatcagcctgggcaacatagtgagatcctgtctcataaataaataaataaataaataaatacataaataaataaataaataaataaaatctagctggacattatggaaaacagtatggaggttcctcaaaaaactaaaaatagaactcccatgtgatccagc

SEQ ID NO: 37765 - DNA, 201 bp, Homo sapiens
tcattctgtgcaaatgagaaatatctcaggggaggactcaggcccgacttgggccacacacacacccattggccagtcactgtgaaacaattttgtagacyggttgtgagggcagaagtagaatttaacaaccttttctggaaccacataattgaaggaagggggaaaagttccccctaaatgattttggacgcacagtta

SEQ ID NO: 37766 - DNA, 201 bp, Homo sapiens
catgatcctccaaggtagatccctgaaattttagatcggcctacagacaatttttgtaactttacctgaaggtagcgctttatgaaaatatatacatccaygtgtatgcacatatataccgaaacatgtttcagtttttaccaaggctttttggtgtctttttgttttagacgtggcaacaaaactctaccacgtcaactg

SEQ ID NO: 37767 - DNA, 201 bp, Homo sapiens
tatcatccagttacctgatttgattattacacattgtatacatatatccaaacgttacatataccccaaactatgtacaactctgatgtatcaattaaaawgtaaagaaaaacaaaacagaaaaaaagctggaaaaggaaggcttgagatttgatgcactaaattctgtgtacttttggaaataatattaacataaggtgg

SEQ ID NO: 37768 - DNA, 201 bp, Homo sapiens; identical to SEQ ID NO: 7943

SEQ ID NO: 37769 - DNA, 201 bp, Homo sapiens
gttttgctttaggattttagcagcctgaagccatggatctttgtttctgtctctagttttaagtggaaaagtgggctgaggaaggggcttcactggcccarcaagaaacagaaatttggaacccatgactgtatttctcctgtggacaccccctgcctaggacaagagagagctgtgctgtagaatgctggggaaatggaa

SEQ ID NO: 37770 - DNA, 201 bp, Homo sapiens
tgcaactatttagttggatgtaaaatcctacactcttcagttgttaaatctgtctctgaatctagtcatccctcaggggttttattaatctaaatgaccamcattatcacagctgcaactcatcttaagaactatttctcagaaaaaaacagtaagtagctagtgactctgtacacagagaaaaaaataaagaacagttta

SEQ ID NO: 37771 - DNA, 201 bp, Homo sapiens; identical to SEQ ID NO: 7930

SEQ ID NO: 37772 - DNA, 201 bp, Homo sapiens
tttgctttaggattttagcagcctgaagccatggatctttgtttctgtctctagttttaagtggaaaagtgggctgaggaaggggcttcactggcccagcragaaacagaaatttggaacccatgactgtatttctcctgtggacaccccctgcctaggacaagagagagctgtgctgtagaatgctggggaaatggaaag

SEQ ID NO: 37773 - DNA, 201 bp, Homo sapiens
agtgaccaaatacttctgccacttaaagatgggggaatatttctttttccttaacatctatcacttataccaaatgtaggagaggaaaaaatgtgtgtgaktgtgtgtgtgtgtgtgtgtgtgtgtgtgtgtgtgtgtgtatgttccttcttttaaaattcctgagctcctctctttcctcccatgttaaaatcggtagca

SEQ ID NO: 37774 - DNA, 201 bp, Homo sapiens; identical to SEQ ID NO: 7932

SEQ ID NO: 37775 - DNA, 201 bp, Homo sapiens
ggtagcatgtccaagcctctgggcctactgccttcggttagctcacacttgctttttcatgtgaagtttgttctatggcataatcttagtaaagcgttttwaaaacaaaaagatacggaggctttttacaaccccttcgcctaattatatgattcattaaaagaatcttgggggtgggcatggtggtgactcatgcctgtc

SEQ ID NO: 37776 - DNA, 201 bp, Homo sapiens
tcacatctctcttgagtattcaaatttgttaaaatatgaaacacagtgcttggccaaaaacagataatatttgctgaatgaatcaaacgggtttctgagaygatcaattctttaaagatagagactcagttatttgtctttttcttctgagccaagtacaaatacttacataacaattatattgaattattgttatttttt

SEQ ID NO: 37777 - DNA, 201 bp, Homo sapiens
aaaagagaaaaaataagtaaatggggccacatcaaactaaatagcttctgcacaggaagggaaacaatcaacaaaatgaaaaggcaactgacagactgggaaaaaaatattggcaaagcatgtatctgataaggaattaatatccaaactttataaataactcttataacacaataggggaaaaataacctgattaaaaag

SEQ ID NO: 37778 - DNA, 201 bp, Homo sapiens
tgggaaactttgtttctgcaactagaattcatgctataatgtggacattgttagtctataagttaatacgtgtaatttaaccttatccctgtacttgatasatcattagttagcagagttatttatgtgacattatgtggcatgccttaatttttagaaccagtttactttttcaaaaaatacattgcagtacacaaaagt

SEQ ID NO: 37779 - DNA, 201 bp, Homo sapiens
ttgtaagcctcaagtatacacaatgcaaattatttttaaaataagtaaataaaataaaattctacttttagctcagaaaaataaaattaaccctatagataacaaatatgacatatgcatgactatgtatcctaaaattattaatattacacttaaattttcatattggttcataagagatatttatgcctgtgatcagag

SEQ ID NO: 37780 - DNA, 201 bp, Homo sapiens
ttgtaacttaggaaactaaaagtcacaagcctgctcctagctttaatggatgaaaattgtaacagtgtctgtaaagggctaacttttcactactgtttatwtaaataccactttcatggaaacacaatgaaaatggttcattctgtgtatagagcagattggagattttgatagtgtggaatttttaaagtaggaatttag

SEQ ID NO: 37781 - DNA, 201 bp, Homo sapiens
cattctgtgtatagagcagattggagattttgatagtgtggaatttttaaagtaggaatttagattaggtgagttttggagccattttctgagttcactcyggtttgcaatttcaaactgatttcagatgaaaaagtctggaaatgtttaatgtcatgtcctctccatcacctttccttatactctatgaattcgttaaca

SEQ ID NO: 37782 - DNA, 201 bp, Homo sapiens
tggaccatgggaattttttcacatacacgggtagtggtggtcgagagctttccggcaacaagaggaccgcggaacagtcttgtgatcagaaactcaccaayaccaacagggcgctggctctcaactgctttgctcccatcaatgaccaagaaggggccgaggccaaggactggcggtcggggaagccggtcagggtggtgc

SEQ ID NO: 37783 - DNA, 201 bp, Homo sapiens
atttggacaaaatgaaataatgtggatgctggctcgcttctggtaaaagctgacttaatttagagttcttgaagaagctagctgaagaatgaaatgtcatygtaacacacatctgtttcttgaaagagtttatacttgaatgtaactagtcactgttagctctggctaattttgaagttgatttaaattaatatagaggtt

SEQ ID NO: 37784 - DNA, 201 bp, Homo sapiens
tccatcacgaatatcagttttccatgtgccttagacctgtcttccatctaataagacttcacactgctcacttttcctttctgacactgaatacacataawcaacagagagcaatgtctcttaaacccataaacccattcaaaaaccaaaaccaaaccaaataaaatgaattggttgtattaatttgtatcatccatttac

SEQ ID NO: 37785 - DNA, 201 bp, Homo sapiens
atttatgtgacattatgtggcatgccttaatttttagaaccagtttactttttcaaaaaatacattgcagtacacaaaagtcctgtagaaaaaggtcattygaagtcttatattagaatgatataatttccttttttgttttactttgagttttaaaaattgatttatttggaaacagattagcaagtccccaattatatc

SEQ ID NO: 37786 - DNA, 201 bp, Homo sapiens
aacagaaaatcaatagatgggagagccgggattggaattgcaggctgtctgtctctgaagtccattctccatatcactgagctattctagttttcctgggwagagaatctaggatggccaaaaaatgtccccagagcctccctgtaagctgtcctccacaacagacttctggaatagaaagaagttggcttatgacctctt

SEQ ID NO: 37787 - DNA, 201 bp, Homo sapiens
ccaacccactgaacaatattttctagacaataatttatgaatctacccacatcttttaaacaaggatagacaactttataatacagatataatgaaatttaaaaaaaaaaatttatctacttatatgtatctcggttgtcgttgccagaacactgctataccctttgtgttattgtttttatatgtttagatatttgtaga

SEQ ID NO: 37788 - DNA, 201 bp, Homo sapiens
gaaatcataaaaacagaacagagtgtagttagaacactgaacttctaaaaggatatccctgccttagagatggtatataatactttttcatgagttgggayaaataagaaacctctttgtggcactttgggcaagaaaagaagttttgctgtagttaacattgtgatgaaatggactattaatctgaagagttgcacctgg

SEQ ID NO: 37789 - DNA, 201 bp, Homo sapiens
aacaggaatcaggaaataaaggacagcgatgaaaagctgaaaactgtgagggtctcacacagcaatatatgaaagcacctgtgaactataatgcatttatwtataatacattgatttattgtattaatagtaaaatacaattatttagtgtattaagaatgtgatatgactaggatgttatttatcttgagttcattaaat

SEQ ID NO: 37790 - DNA, 201 bp, Homo sapiens
ctgcctgaagatattatttagtttttaggacttgaagagtgctactggtttgacatctgctaggtaaagttcaggagtgttggtaaacatcctacagttcrgaggacaactccctataagaaagaattatctgactcaaaatgtcagtaatgctaaggttgagatatatcttagattattgtgcatttattttaatccata

SEQ ID NO: 37791 - DNA, 201 bp, Homo sapiens
agcaattaatacaataaggacttttctaagtctacataataattttaaaatctttttttaaatgtaaaatgcttaaagatgccaagatgtaattttaaaayctttttcttttttcttatttgatgggggtgtgtatgtgtgtgtgtgtaaatgtagagaaatgaattacttgcccaattggaagggaccttcaaaagatcc

SEQ ID NO: 37792 - DNA, 201 bp, Homo sapiens
ctttctttagaacaacaaagaatggtgcttgaaaagtcttctcatgattcttctgcttcaacagcttgcctttctccttgtcaccagagtaagccattccktccagatcgcatcttctgccagaagccacaagtttggcttcttgaaatctcagaagtactcattcctcaagtaattaattaaaacaaataaataaaatgt

SEQ ID NO: 37793 - DNA, 201 bp, Homo sapiens
agcctctgcctcctgggttcaagtgattctcctgcctcaacgtcccgagtagctgggattacaggctcatgccaccacgcctgcctaatttttgtattttgtttttttagtagagatggggtttcaccatgttggccaggctgctctcaaactcctgacctcatgatccacccgcctcggcctcccaaagtgctgggatta

SEQ ID NO: 37794 - DNA, 201 bp, Homo sapiens
agtaaccaaacaaaactagcattgacagtgaaggcagaacgccattcaggttctgaaatgaaaccataggagaaattgtcttcattgacttgaccttaacyaacttgctagcgttaaccagtgctctggagtctttctgttaaaaataccaactgatgttcatcaattgtggtggttacctggccagtttatgccactttt

SEQ ID NO: 37795 - DNA, 201 bp, Homo sapiens
gcctctgcctcctgggttcaagtgattctcctgcctcaacgtcccgagtagctgggattacaggctcatgccaccacgcctgcctaatttttgtattttgtttttttagtagagatggggtttcaccatgttggccaggctgctctcaaactcctgacctcatgatccacccgcctcggcctcccaaagtgctgggattac

SEQ ID NO: 37796 - DNA, 201 bp, Homo sapiens
aaaactagcattgacagtgaaggcagaacgccattcaggttctgaaatgaaaccataggagaaattgtcttcattgacttgaccttaactaacttgctagmgttaaccagtgctctggagtctttctgttaaaaataccaactgatgttcatcaattgtggtggttacctggccagtttatgccacttttccttagtgttg

SEQ ID NO: 37797 - DNA, 201 bp, Homo sapiens
gtggagtggagtgagaatgttttaagtcatggacattttgggtattccattcatctttaatagctgtatgtgtttaagaggagataatgcttatgccagayagagaaagtaacctagttacctcttgaggtattgtggcattggtataattatatattatatttatatttacatatatatgtaaatataatttttttcttt

SEQ ID NO: 37798 - DNA, 201 bp, Homo sapiens
aaattaattccagctacttgggaggctgaggtgggggaattgcttgaacccaggaggcagaagttgtagcgagccaagattgcgccactgcactccagccygggcaacagagagagactcaggcttaagaaaaaataaaaaataaaataaaaaaagtggtcagtttctacaaggcaatattcaattgcattccaatggata

SEQ ID NO: 37799 - DNA, 201 bp, Homo sapiens
tgcactggtcaattttgatcaggagacaaaaagtgacgtataaaaattggactaaaatataatcatagaactctatgataaaagttatttgcaagcatttggggggaagaagatattgagatagtggaagtcagatgttaggaagatccttgaaatactgtttttttatagatttatttattatcatagaaggtagtttaa

SEQ ID NO: 37800 - DNA, 201 bp, Homo sapiens
gaaaccataggagaaattgtcttcattgacttgaccttaactaacttgctagcgttaaccagtgctctggagtctttctgttaaaaataccaactgatgtycatcaattgtggtggttacctggccagtttatgccacttttccttagtgttgtaattgcagaatttaattaaaaattatataaaccactgaaatataagc

SEQ ID NO: 37801 - DNA, 201 bp, Homo sapiens
gtggtggttacctggccagtttatgccacttttccttagtgttgtaattgcagaatttaattaaaaattatataaaccactgaaatataagccaaaaatawtgttgttgtttctatgaaaacttgattgaatgctttctttgaaagacttgatgaaggcaaagtagatacagcatatatgttaactgaggtgtagatgaaa

SEQ ID NO: 37802 - DNA, 201 bp, Homo sapiens
caacgcctggggtttagatggaaaggccttgcccaaagagcaaaaagatatgacaacaaaattataacccttggcaaattccatcaaattgatttgaatcygtgggctgaaaatgtcagtgcttattaaagtatacattgaaaattattaagaatatgattgctgaatgtcccatattcttttgtgtcattaacaataaag

SEQ ID NO: 37803 - DNA, 201 bp, Homo sapiens
taaattactcagtcttgggagttctttatagcagtgtgaaaatggactaatacagtaagttggtaccagaagtggggtgctgatataaagatacccaaaawtgtggaagcaactttggaacacagtaacaggcagagattggaacagtttggagggctcagaagaagacaggaaaatgacagaaagtttggaacttcctgg

SEQ ID NO: 37804 - DNA, 201 bp, Homo sapiens
tcttttctgtttctctttctattgatcatggggctaggaaaattgctacaaattatattttgctatttattttttgtgacatcaagagcaataatgtgtgytaagtcagaggaataaatgtacagcctagtattaaagtaatgctcctttaccccctctgcacactcgcatgttgctttcctaacaaacacgcaaatatgc

SEQ ID NO: 37805 - DNA, 201 bp, Homo sapiens
caaaatggaaattgccttatttttgttttcctgatcaaaacagtgacctacatttctgatattttggggggcgctgggagacggggtctcatgatgttggycaggtcggtctcaaactcctggcctcaagtgatcctcccgcctcagcctcttgaagtactaggattacaggcatgagccactgtgcccagcctgattttt

SEQ ID NO: 37806 - DNA, 201 bp, Homo sapiens
tagcaatcatgaggctgaggtgcaacttagactccagtcccctataaaatataccttatagagtttagagatttgatgcaattcaaagcaaatttactatrttgaacatcagcaatgtcccaaagaagaccataaaattctgtggtggttaaaatctgttgtttaaacattagaagtataatattaaacatttctttctgt

SEQ ID NO: 37807 - DNA, 201 bp, Homo sapiens
cctattaaaaaatatcacagcaaaaacaaacactatgtgccagcaaatttatgcccctaattatcctgagaattatcatgcagtttgcaaggaagaagggrctctagctttccagttgctgatcggcaataatgaacccctgctctgttgttaaatactttttttttggtagagtcataaagaacagcacttctagcaaag

SEQ ID NO: 37808 - DNA, 201 bp, Homo sapiens
gttctgactctgaagagagctctgaaaaagacaagcttgctattccaaaggtaggtagtaatgacataccccttaaagggttaaactattttttttaattstcttctaggtctccttcctgtcacctcaactccatctgcagattcatatcagtgactcaggcaaaatgtgttgatcgtggtgacagaagtaataaatatt

SEQ ID NO: 37809 - DNA, 201 bp, Homo sapiens
ttttagcctaagcaaacagaagccttaagttcaaatttaatagcaattcttgatatttaacagacaaagaccagcccacatttatcagctttctgagttcstacttatttcagagattcttagttattcctatcattttttaaaactctttctcatatcagagaagtgctcacatccagttaagttctctttgcttcctgt

SEQ ID NO: 37810 - DNA, 201 bp, Homo sapiens
aatcctttgcttactcttttcatgtatgtacccaattgtggaaaaatttgtaggattgctttttgtgtcagtactattacttctccttggcattttcactrttttctggacagtgcttattccagaatcaggttgttaaataatagtttttaatcatgactccagtatttcagtgtaacaattctcagtatactttaagtg

SEQ ID NO: 37811 - DNA, 201 bp, Homo sapiens
aagtccctagctgaaaaagaattaaaaaacactcccatttacaatagcataaaaaatacttagggataaatttaaccaaggaggtaaaagatttgtacatygaaaattataaaacactgatgaaaagaattgaacacagaaatatatagaaaaatattccattactcaatcagaagtattgttaaaatatttatactaccc

SEQ ID NO: 37812 - DNA, 201 bp, Homo sapiens
acggttgaaggcattacactttctgatttacaactatattacaaatctatagtaatcaaaatagcatgctactggcataacaacagaaacctacaccaatrgaacaggatagagagcccagaagtaaattcaagcatacatgttcaaataattttacacaagggtgctaggaggacacaggtggaaaggggagtctctttg

SEQ ID NO: 37813 - DNA, 201 bp, Homo sapiens
aagctgagatgctgtctctatagattctactctgtgctacagaggaataacacattctgtcattgtggtttttgtttgatttaatttgttttcatctctayggtatatttgtataaattatctggcagcagtacagatcaaaaacttgaagcagaattttatacctcaaaagtaaatgcccaaatattaagttatgacaat

SEQ ID NO: 37814 - DNA, 201 bp, Homo sapiens
ttattatcatagaaggtagtttaaatgtatatggagtagcttgtatgtatatggtagtttaaatgtatatgcatatcacattaatttcacttactttcctwaaaaatttatttattatcatagaaggtagtttaaatgtacatggaatagtttatatgtatatgtatatggtagttcgaatgtatctgtatattagattaa

SEQ ID NO: 37815 - DNA, 201 bp, Homo sapiens
tttatatgtatatgtatatggtagttcgaatgtatctgtatattagattaacttcacttttgtaaaaaaattaataagagcattatgtgaaaaagctaaamagaaatagacatttcatttgacatgataactaagagttaacagactactcagaaagctaccacaattacataagctgggggtgatcctcctgacattacc

SEQ ID NO: 37816 - DNA, 201 bp, Homo sapiens
tgaaatattcttgcaagaggcaatatttgactcagtattttcattggtcatttagattttacttttgactttaattactggtattctagccttcaatggtwgactgtttcatgtttctccagaaagttaggtttcatttttattttctatagtttatgagtccatgcttgtaacttatagggaaatcataaaaacagaaca

SEQ ID NO: 37817 - DNA, 201 bp, Homo sapiens
aacaagtattataaatgaaaaaaaccctcatagctccccaatataaatggtgaaaaatataatcgttaaaacattcctcttctaatttataaggttacccytttttgctggtttatctctattagttggttttcctcttcagtcacctttctaaaagtggataagctgtaggacccattaacattttactggcatgataaa

SEQ ID NO: 37818 - DNA, 201 bp, Homo sapiens
ctgattagtgtgagatggtatctcattgtggttttgatttgcatttctctaatgctcagtcatgttgagctttttttcatacgcttgtggccacgtgtacrtcttcttttgaaagtgtttgttcatgttctttgcccactttttaatggagttgtttgttcttttcttgtgagtttaggttccttacagatgctggatatt

SEQ ID NO: 37819 - DNA, 201 bp, Homo sapiens
ttacactcagagtgccccagacctatcccctcaaatcctgactccacctgttatatgtagcaggtaaggattttttatgaactgaagtttaataataaaamcgatgatagttttcccctagaaatacctaccaccagcccacgcagcttggggtaggtttgccaaagtattagacaaccaagtataggataatgtgatttg

SEQ ID NO: 37820 - DNA, 201 bp, Homo sapiens
tacactcagagtgccccagacctatcccctcaaatcctgactccacctgttatatgtagcaggtaaggattttttatgaactgaagtttaataataaaacygatgatagttttcccctagaaatacctaccaccagcccacgcagcttggggtaggtttgccaaagtattagacaaccaagtataggataatgtgatttgt

SEQ ID NO: 37821 - DNA, 201 bp, Homo sapiens
accctatgatcctatgttcttggagtgctcaggaaagcagtatttccctaaacactatatttaccatatgcatcttagcaaaatttgcttaaatgagcccyctttccccattgtagatcttgtaataagttgttctcttttaattgtagatgacactgctcaagttacctctgattatgaaaccaataacaacagtgacag

SEQ ID NO: 37822 - DNA, 201 bp, Homo sapiens
tgtaccacattttctttatctagtctatcgttgatgggcatttgagttgattccatgtctttgctattgtgaatagtactgctgtgaacataaacatgcaygtatttttataatagaatgactcacattcctttgggtgtattcccagtaatgggattgctgagtaaaatggtattactggttctaggtctttgaggaatc

SEQ ID NO: 37823 - DNA, 201 bp, Homo sapiens
gtcgccccacccgacagactccagcatgttgttcccctccccatgtccatgtgttatcattgttcagctcccacttataagtgaaaacatgtggtgtttgsttttctgtttctgcattagtttgctaagaataatggcttccagctccatccgtgtccctgcaaaggagacgacctcattcctctttatggctgcatagta

SEQ ID NO: 37824 - DNA, 201 bp, Homo sapiens
tatgtaaactggtaactatacctatgttgttaaaggaaaatttaccctaatgttaaataatataaaatcccaagtctcatagattggtgggcattgtggarcttgcagattaaaatataccgcccacccccccaactgaaggaaatgtaggaactctgtatagtcagccttctgtatccctggattctacatccatggatt

SEQ ID NO: 37825 - DNA, 201 bp, Homo sapiens
gcaacgattctgtgacatgagagggtgggaacggtttgcaggactgtggtggggggccgagggggtaatcagtgcacatcaggggcaccgggttggggtcrgaaggcaagagacacgatcctgctggctagcttctagcagtcacctccctctctgagtctcagcctccctctctgctctggctctcaataataacaaaga

SEQ ID NO: 37826 - DNA, 201 bp, Homo sapiens
ccaagagccctatgaggtaggtcctatcattatccccattggatggaagatgacactgaagcttaaaggtgaaacactgcccttgtcacacagccaggaastggtgaatgcccaagaggacgggagttttctgggctcagctcagacaactgagtgcctggagaggccgagtgtgcaacgattctgtgacatgagagggtg

SEQ ID NO: 37827 - DNA, 201 bp, Homo sapiens
ggccaggattctaaccacaagagtctagctctataggctgtgatcttacccacctaactcacccggactatgtctgcctgcttctaatggggggtgatatkaggagaagttgagccttaaagttcaaggtcctgggccgggcgctgtggctcacgcctgtaatcccagcactttgggaggcagaggcaggcagaccacctg

SEQ ID NO: 37828 - DNA, 201 bp, Homo sapiens
gagcttcaatgaccgcacccgcttccgggcatctctgagactcaaaccccgcacctctgctgagggtaagcccccggggggctgagtccgatcgagggccrgctgagggtggcagggcggggacagtctgggctgggagcagaaagatctggctcgcgtctcagctctggaactgatggaccgtctttgggctctggtctt

SEQ ID NO: 37829 - DNA, 201 bp, Homo sapiens
ccagcacccgtcccaaggctgagaaacaacccaaccatagtttctctgtgaggtgggtcctctgtgcaagccctattgactcatatgccttgggggctttstttagaatgactgtttcctggtcctaaaataatcagcctaaaataatcactgacctcccatctcccaagagaataggcaaattgtcctcactgcccacct

SEQ ID NO: 37830 - DNA, 201 bp, Homo sapiens
agtggcagggctcctggctgcccatgtgtgcttctgctgagaggtgttttttcctagaaacgtgggttctggaccacaatctagctactacccactattcrtgtgtccttgggcaaatcacctgacccctttgcacctcagtttcctcagatgtaaaatgcagatgtaaatagggtctgcttccactaaaactggacctgg

SEQ ID NO: 37831 - DNA, 201 bp, Homo sapiens
ttcctgcagatcctgcgcatggtgcgcatggaccgccgcggcggcacctggaagctgctgggctcagtggtctacgcgcatagcaaggtgaggcctgcaasccgcgcgcggagacccgagggcgtgtctggggcacgaccggagcgggcagggcggagagggcgaggtcagaggggctgtctccgtgctgggaaggggtgt

SEQ ID NO: 37832 - DNA, 201 bp, Homo sapiens
ccccctgaacccgaacctgaacctgtcggaatctctagtggcaaaccacagcaggggaggcagcgatgacgtcacagggcatgggatggaggacatttgcrtaggtcctaccccaacagccataacattgtccttgaacctcttggacacagagttactctaccagatcatggttaaccagggcttgtcctggggaatgag

SEQ ID NO: 37833 - DNA, 201 bp, Homo sapiens
gcgtcccttggggcacaatggccactgtcccctgggagctggccttctgaggggcattgtaggggcaggcggctggcactgtccatgccaagagacagctrgtattgtggtgcccataattaatgagacagctctggcagctgctccccagcccatgccaggggcctaggcaagcaggaagtaaaaatattcctgtcttag

SEQ ID NO: 37834 - DNA, 201 bp, Homo sapiens
gcggcacctggaagctgctgggctcagtggtctacgcgcatagcaaggtgaggcctgcaacccgcgcgcggagacccgagggcgtgtctggggcacgaccrgagcgggcagggcggagagggcgaggtcagaggggctgtctccgtgctgggaaggggtgtggcctgcgggggttggagccctagcaggaggcgaggtcta

SEQ ID NO: 37835 - DNA, 201 bp, Homo sapiens
gcgggcagggcggagagggcgaggtcagaggggctgtctccgtgctgggaaggggtgtggcctgcgggggttggagccctagcaggaggcgaggtctaagsgggtggggcggagtggagtctgaattaggtaggggcgggcctaggagtccggaccggatcagggggcggggccggagaggcggggcttgagggtttcccc

SEQ ID NO: 37836 - DNA, 201 bp, Homo sapiens
atgttctgtgttgttaattccttgggacctggattattcatttctggttttacaataaacctggctgagtgtaggtgtctgaagtgaatatagcccagagrggtcaggtgacaacctcttttctgctgtgagatgccctgccatctttcctacccccatcatatccccatctctctggcctggcctcccagcagctgtccc

SEQ ID NO: 37837 - DNA, 201 bp, Homo sapiens
ggagagggcgaggtcagaggggctgtctccgtgctgggaaggggtgtggcctgcgggggttggagccctagcaggaggcgaggtctaagggggtggggcgragtggagtctgaattaggtaggggcgggcctaggagtccggaccggatcagggggcggggccggagaggcggggcttgagggtttcccctggatgcttct

SEQ ID NO: 37838 - DNA, 201 bp, Homo sapiens
ctttcaggtaagagcaggacaaccgccgctgcccacccagccacacacagcactgggcacactttaagcacccgcaccaggcacacagtgctcgaccccarcggacacacctcatccccttcggactccacctccactttcgcagccacccacacccgacccataactcacacctcactgactccatccccgcacctggta

SEQ ID NO: 37839 - DNA, 201 bp, Homo sapiens
gggaagggaagtctgagtgcatgtgtagacgtgcacgtacacgttcacatgcacacagactgtgtaaatgctgttgaaccgggagctcagtaggcagtatsggggggtagatctttagcggggatccaagaccacacaggcaggatgtcaatcaaggtgggctgaacttaggtaggagagaccacagaagaacatgttatc

SEQ ID NO: 37840 - DNA, 201 bp, Homo sapiens
ctttactcccaatcccgactctgaccctggagacccgcacagattcagcggaccctccccctccctccccagtcccctgccacatccccagaagtccccgsctccgggtccgtgcgcggggtaggctggctgtgatctcgccgcccccgcccctgcagacttcatcgtgttcgtggcctcggtggccgtcatcgccgcggg

SEQ ID NO: 37841 - DNA, 201 bp, Homo sapiens
ctcactgagagggcaggcaccaggcatggcctgggcatacatgtgggcccagcagctagaaccatggggccgaggccctcagtaggccatcacgctgcacrcctccagggcaccactgcatggaagtctgtgtgatggagtccttattttgcagtgcactgcctgcacagctgtacgaggccctaaaaccctgaccagtgt

SEQ ID NO: 37842 - DNA, 201 bp, Homo sapiens
aggaggcaagagggagcacagtgtggggaaaaaagctggcagcccagtttggcccccctgagactggacatcagagcgaaggttgggggcagagctgggtyatgcagaacctaaaagcccagtgtgagcttcaccctgttggcatgcttggcagcctgagctcatggagtcctgggtttccaaaggtgcctctggggccct

SEQ ID NO: 37843 - DNA, 201 bp, Homo sapiens
gagtccagggagtactgttagctaggacccccttcccagagacgcaggctgtggcaggaggggccccagcagaagagcctgcaagagaagggctctgggcsgggcgcagtggctctcacctgtaatcccagcactgtgagaggctgaggtgggaggatcgcttgagcctaggcaacatggtgagacccctgactctacaaa

SEQ ID NO: 37844 - DNA, 201 bp, Homo sapiens
cataaaatgggaacaataatagcatccacttcctaggattattgtgaggattaaatgagataatccatggaaggtgaacagaagacttttgggaatatagkaggtgctcaacaaatagctaaacacaaatgtactttggaagcggcaggaatgcatccttgatgagccctgactatgcactgcccagcactggcttatctc

SEQ ID NO: 37845 - DNA, 201 bp, Homo sapiens
caagccgtaggtggcccccgtgaccagtcctgcctgtaacctgtttgtgtctccagattacattgacaaccatcggctatggtgacaagacaccgcacacrtggctgggcagggtcctggctgctggcttcgccttactgggcatctctttctttgccctgcctgccgtgagttgcctcctgctcagttggtgggggaggc

SEQ ID NO: 37846 - DNA, 201 bp, Homo sapiens
cacggagctgctcagtggaaccgagggaaggtttccactagccatcttgcttgagtttctcaaatcctggctgcctaaattccaccccatgtttccccttyctttcaatggcatcctgcttgggagggcccacacctccctgtttgagaagtcagctctgtctggccagtcccaacagatggatgcccctgtgtcctcttt

SEQ ID NO: 37847 - DNA, 201 bp, Homo sapiens
acctctgttcgtgtcttattctcaaacttccagccagatgtttaataataaacggagtttctttcggatccacgccagctggagaccgaggtaccccctcrcctgctcctcctgtccccactcctccttgccccacccaatttgggggctggagaggggacaggatgggccaaggacaaggtgcatgtgcctgccgcctgc

SEQ ID NO: 37848 - DNA, 201 bp, Homo sapiens
caggactttagataacaattttcctaacctagccaacaggggagatggatgctctaagaactttgcccttgtgattgggaaagtctttgagtgtgacccamatttttcgtgctgctgtttttcagccctagtccttttgcttggtctttgtaaggagctggggagaccatcctgttcttatactgccttcctcctcctcct

SEQ ID NO: 37849 - DNA, 201 bp, Homo sapiens
tccacaaagccgttttaggcatgctggacccattgtgggctttacttattgtttgttcaatgaatcccactgaattcatgtaacaaccctggaggaagatrctattatgctattttgtgctgaggctcagaaaggagaagtgacttgcccaaggtcattcagctgagaagttgctgacttagggctggactccaggggtcc

SEQ ID NO: 37850 - DNA, 201 bp, Homo sapiens
cgtagtttgaaaaccacaaatctaagcaaaccattcactttttcatctctaatcctcttgctccctcctgaacgagtgggatagtcatgggatggggagaygggggaaatggagaggaaaggttggataagccttgtgatcagaccagctggggagagccagccaggcaacacccgcctgtctcattctgcctcctgggct

SEQ ID NO: 37851 - DNA, 201 bp, Homo sapiens
tgcaaacatttgcaaagcacccacatgtgccagacactatatttgcactgagaatgcagcggtaacaaagacacagcttgcagtctagggggagagaaagwtatcagtcaaatacacaatgaataggtattcatcaaatgtgataaggggaataacaggagtgtttaacagaggaacctggcatgaagtgcctactatata

SEQ ID NO: 37852 - DNA, 201 bp, Homo sapiens
ctaggtagcaggcactattattgttcccattttgcagacaagaaactggggctcaaagaagagaaacaccacatactaagttacacagcttgtctgtggtygagtcaagactcaaacccatgtcggcatcagggccaagcccgagctctaaatggttctcagcctcgccagctgacccaaggcagtttccagtggcctaag

SEQ ID NO: 37853 - DNA, 201 bp, Homo sapiens
gggcccaggccagccagcacccatgtttcatctatatttgtatagatggagaaactgaggtcccagagggggccagagagaatccttagaaagtcctttgwtggatgaatgaagccacaccctagttgtggcaggcatgagaccccagctaaggggctccttcaccttgtctcctctacccctgacctccagatactgatc

SEQ ID NO: 37854 - DNA, 201 bp, Homo sapiens
agcatctcacaatgttgcccaggctggtcttgacctcctggactcaagcaatcctcccaccttggactcccaaatgttgggattacaggcatgagccaccrcgcctcgtcccaggatgttttctattagtccaagtatatcccttcaaatgtaatgagagtatcaagggtatagaaactcttagccagtgggttaaagcag

SEQ ID NO: 37855 - DNA, 201 bp, Homo sapiens
gatctcagtgaggagtaagcgggtaggaacactctccctcttgtagaatagtgtgagaaggggtgcctgagggggcccacaggggccctggaatcctaacsaggggctaaagaagctcctctattcaaagccgatcatggatggatgaggtggaagagagacagcccaagaaggggagacagtacaaaagccaccaaggtg

SEQ ID NO: 37856 - DNA, 201 bp, Homo sapiens
gggatgaggttccagcgtagtgcagtctcatggcccatctctctgcacctctgccaactttcctctgtggttcttagttccattcctgcgaaagacaatcygattggctcagcccaacctatgggtgggcccttcttgggtcagtctccagctctccatgaatctgtggcggccaggagagtgctgtggagccaaccgcag

SEQ ID NO: 37857 - DNA, 201 bp, Homo sapiens
ctcacagccaccactcaggatcctgcctccatcagctgggcctgcaggctgggcagcctttctctttacaggcggaggaaactaagaagagtatctgcagrtgtcctcccagcttccagttaaagaccctcccaaccacccttccaccttagctgtgggtcaggcccagagaagctgcgctcctggcctcgagtcacacag

SEQ ID NO: 37858 - DNA, 201 bp, Homo sapiens
aacaagtcggaaggtttggggctggtgcaggtgggagaggaggaagctattcctcatcaaacaccttgtctagaagacactgcctttcatgtcccgtgggwcagaaaccattcaagctggctcaataaaaactggcttctgtactattacatttgggataaagaaaaagaaaaattggcttctggaggtagaggacagata

SEQ ID NO: 37859 - DNA, 201 bp, Homo sapiens
agagaaggcaggtgacagtctcaaaaccacacacacaagcaggactgggatccaaactcaggtctctctgaccccgagctgctgtccttaaggtcaccacraaacatgaatataaataaagccacatagaaggtgacttgggccacacatagggaggcaagcatcgggagttggcagttctgaaggggggatagtggggtg

SEQ ID NO: 37860 - DNA, 201 bp, Homo sapiens
aagcagacagaacaagtcggaaggtttggggctggtgcaggtgggagaggaggaagctattcctcatcaaacaccttgtctagaagacactgcctttcatrtcccgtgggacagaaaccattcaagctggctcaataaaaactggcttctgtactattacatttgggataaagaaaaagaaaaattggcttctggaggtag

SEQ ID NO: 37861 - DNA, 201 bp, Homo sapiens
tcctcccccaactcctgccccacttcaggtctcctctaaggctggctggtactctcttgatctggggccccagacatttggggtgggtccccctgaacccraacctgaacctgtcggaatctctagtggcaaaccacagcaggggaggcagcgatgacgtcacagggcatgggatggaggacatttgcataggtcctaccc

SEQ ID NO: 37862 - DNA, 201 bp, Homo sapiens
ttggggcacaatggccactgtcccctgggagctggccttctgaggggcattgtaggggcaggcggctggcactgtccatgccaagagacagctagtattgyggtgcccataattaatgagacagctctggcagctgctccccagcccatgccaggggcctaggcaagcaggaagtaaaaatattcctgtcttaggagggtg

SEQ ID NO: 37863 - DNA, 201 bp, Homo sapiens
ggccagacccagcacccgtcccaaggctgagaaacaacccaaccatagtttctctgtgaggtgggtcctctgtgcaagccctattgactcatatgccttgsgggctttgtttagaatgactgtttcctggtcctaaaataatcagcctaaaataatcactgacctcccatctcccaagagaataggcaaattgtcctcact

SEQ ID NO: 37864 - DNA, 201 bp, Homo sapiens
gcttggcccgctgctcgcctttcaggccgccgcgttttcaattgttaatttggaaacggaaaaagtagccggccgggcgggggaggccgcggggaggtaaycggagccgcagcaccgccccggcccctcccgctctcggggcctggcattggcaaagccccgcccctcccagggacgcaagagccccgcccaccattcccc

SEQ ID NO: 37865 - DNA, 201 bp, Homo sapiens
catcaagggttttttctccttggcctggctgcctgggcaaaggagctggctgtggcatgaccatgtgggcacctgccagcccctcccttgttggggtctgktcatctaatgcccttcacatgacaggcatggggtgggccctggctggggagagggatttgcactctcctaatccaagggctgcagccctccctctgtctt

SEQ ID NO: 37866 - DNA, 201 bp, Homo sapiens
aagaaaacatcttggtccccccacggttgtttataccaggactccctctccttctctggcctggtctggcctctccactcctgagctgggctacctgagtygagggtccagcccccggtcatggcaggaggccctggcagcacgcccactggcccccaccagggactgagcactcaccacctcctggtggcctgtcccatt

SEQ ID NO: 37867 - DNA, 201 bp, Homo sapiens
cggtgcacccaccgagtttgcaggctcttgatccggcccagcatgtccaggtggcctgctgagtactgctcaatgacgtccttcacgtcgtacggtcgcaytgtctccttgaatttccttttggccaccaggaacttgagaatcctgttgggggagggggctcagagggagtgtcctgttagagcagggattctttcccag

SEQ ID NO: 37868 - DNA, 201 bp, Homo sapiens
cgtttccagttaatcaccgagccctacttcctgcggtgttttccaacccatccactcctcttccctgctgccaccaccctgggccaggccacagtcatctstcgtctgagctattgtggagctttcttggtctttctgctgagtcttatctcctttgatctattctgtgtacttccccaagtggtcctgagatgcaaattg

SEQ ID NO: 37869 - DNA, 201 bp, Homo sapiens
tccctcatgatcaggctcctacctgcctgtacccccaacaagccgtaggtggcccccgtgaccagtcctgcctgtaacctgtttgtgtctccagattacaytgacaaccatcggctatggtgacaagacaccgcacacatggctgggcagggtcctggctgctggcttcgccttactgggcatctctttctttgccctgcc

SEQ ID NO: 37870 - DNA, 201 bp, Homo sapiens
gttctggaacacagaaggcacccttctggctcagatgtgttggatttgtttttccctctggaggtgggatgggggttaagggagcatgaggtgggggctcygacctaagcctgccagtctgagctcatgctcagacacagcatgagtaaaggtggggaggggaaaagagcgcgtttgccattgtcagggacagagctatga

SEQ ID NO: 37871 - DNA, 201 bp, Homo sapiens
gagaccaaagtcacctgggaaatgagtagcagatacagcggactctgtgcagagacctcagctgggctaggccagggcagagagttgaaattgctcctgcytccttgtccaggactgttcgctccgttcctagtggccaccgggcttggctcttggagtctgaaatgaaatctctggttgtgtgtgcagcaccaactatgc

SEQ ID NO: 37872 - DNA, 201 bp, Homo sapiens
atcttcaacttctccttcttgatctcttggctccttccactctggctctctcatcttaaaagaaaagaaaaagattccctataccctgcatccttctccarctacgatctctgatctcttctttgcagtcaaacatcttcaaattgttaaacctacacttactgtctctacctcctcactgcccctcccctttctcacttt

SEQ ID NO: 37873 - DNA, 201 bp, Homo sapiens
gcccagtgggtatgaagagagagacctcagctggatccagggacatccccagagaatctggagctgagctgatggccgatcctctccaccccactgctggrgagttaccaagctacagggaccttaaccatcactgagttgtccccgacctttgtgtgtgtttctgacagggaaattgaggcccagagcattagtagggcc

SEQ ID NO: 37874 - DNA, 201 bp, Homo sapiens
aactcattaagaacatgcatttagagggcttggcacagtgtctggccaataggaagcctttggccagcaggagcagttatggttattacttcaggtcaccrcatgagagccacctccccagcagagctttccccctcctgccctgtggccgcttctggacagtgacttgaggaggtataaatgtggagaaggcggtgattg

SEQ ID NO: 37875 - DNA, 201 bp, Homo sapiens
gcgaggtcagaggggctgtctccgtgctgggaaggggtgtggcctgcgggggttggagccctagcaggaggcgaggtctaagggggtggggcggagtggaktctgaattaggtaggggcgggcctaggagtccggaccggatcagggggcggggccggagaggcggggcttgagggtttcccctggatgcttctgggtttg

SEQ ID NO: 37876 - DNA, 201 bp, Homo sapiens
ggctgcactggagtgagaggtaggaggtgaggtcagagggctaacggcactcagagagtgtaaagtcctgtaggcccctgcaaagacgttggtgttcatcyaggatgagctgcaagcattggagggttttgtgcaaacgactgacaagatctgaattgtcttttaaaaggatcaccctgggtgctgtgttgaggatggact

SEQ ID NO: 37877 - DNA, 201 bp, Homo sapiens
agctgacagccagcaaccccttttgtcaccaggtcagagttagggagtctgagacagctgggacagggagggcctgttgaggagcagaaaaatccgatcakttcatggggaccggaaggggaggacacactagggcttttagtcttcttgcaggaggcggagggggccacctgccctccggaatcgtcaagtccaggaaac

SEQ ID NO: 37878 - DNA, 201 bp, Homo sapiens
gtgggggtggtcagatggtctaggacctctgcccagaggaacagagcctagtctggagattctggatccactgggcatctgctccctggaccttagtttgstcatccatacaatgggaaggcaggcaggagagagggaagataccctccttggctcatggcagcagaaaatggcctggagagttaggaagaagccacggtc

SEQ ID NO: 37879 - DNA, 201 bp, Homo sapiens
gtcagatggtctaggacctctgcccagaggaacagagcctagtctggagattctggatccactgggcatctgctccctggaccttagtttgctcatccatrcaatgggaaggcaggcaggagagagggaagataccctccttggctcatggcagcagaaaatggcctggagagttaggaagaagccacggtcccgaatcta

SEQ ID NO: 37880 - DNA, 201 bp, Homo sapiens
gcgcgttccctccctccgcctcgcctcgcttgctcgctcgctccctcccgatttgggaaggcggccgcggggcgggcgggggaggggcggggcgggggagkgtgacatgtgagcggcgcgcgccggtggcaggtggaaaggcgagcggcatggagcgcgtaataagagagttggagtcggaaagagcagccccagtcgccg

SEQ ID NO: 37881 - DNA, 201 bp, Homo sapiens
ggcgcagtgatgtggagttccaggcccttggccaaagtgtcagggccttctccactctcctctcttcctctccctcttggaggagtggaggacaggagaargggttgcacggaccgggcagggtggagggtgcttgccagcatgagggagcctgcaggaatggctctgcagaggaaagtttgggagagccaacctcaaact

SEQ ID NO: 37882 - DNA, 201 bp, Homo sapiens
gcagcagaaaatggcctggagagttaggaagaagccacggtcccgaatctagtcttcaaaaacccagtggcaagagtgagtgctggaggggaaggaagctrggctagccaccctgtcacaccgccctcctcacctccatctccccttaaaatccagagtcagatctggagggaaaggatgtcagggccactgctggcctct

SEQ ID NO: 37883 - DNA, 201 bp, Homo sapiens
acctgctcacccctgtcacacatttgcctggggagcctggggtacctcagaggggcaaggatggggacacccttgcagcctcttactgccccaccactgcyagcacattcccccaaccatgccctatccctctagggcatcctaggctccggctttgccctgaaggtccaggagcagcaccggcagaagcacttcgagaag

SEQ ID NO: 37884 - DNA, 201 bp, Homo sapiens
gcaccttggctccctcccctccaccccatgccctgggcatgggagaccccagttcccacccaataccgaaaccagaatctcttctctgctcaacccttgayctgaaagcctctgagagtaggtgacacggtgtcctcccccaactcctgccccacttcaggtctcctctaaggctggctggtactctcttgatctggggcc

SEQ ID NO: 37885 - DNA, 201 bp, Homo sapiens
gcctggtacatcgggttcctggtgctcatcttcgcctccttcctggtctacctggctgagaaggacgccaactccgacttctcctcctacgccgactcgcwctggtgggggacggtgcgtgagggtctttgtagggctgcccttctccctgggatcctccctgggaacttcccgaggtctgcccatcgtgactcctgactc

SEQ ID NO: 37886 - DNA, 201 bp, Homo sapiens
agttaggaagaagccacggtcccgaatctagtcttcaaaaacccagtggcaagagtgagtgctggaggggaaggaagctgggctagccaccctgtcacacygccctcctcacctccatctccccttaaaatccagagtcagatctggagggaaaggatgtcagggccactgctggcctctctgaggaggcacggcacgttc

SEQ ID NO: 37887 - DNA, 201 bp, Homo sapiens
tacatcgggttcctggtgctcatcttcgcctccttcctggtctacctggctgagaaggacgccaactccgacttctcctcctacgccgactcgctctggtsggggacggtgcgtgagggtctttgtagggctgcccttctccctgggatcctccctgggaacttcccgaggtctgcccatcgtgactcctgactcagggtt

SEQ ID NO: 37888 - DNA, 201 bp, Homo sapiens
ctccagggcggccctcattcctacccctgcccagctgactgtgggtgtgtgggggtccctgtgggccccctgggccctgacactcgcatatgctgtgtccsacttgatctgtgtcttcgctcagtcttcccctccaccctcaacttcccagtggcaacggcggccgccctgcctgccctgccctaccctgccggcttggcc

SEQ ID NO: 37889 - DNA, 201 bp, Homo sapiens
tggggctctgagggtctgagtgggagagatgtccatgccatcctttcccatcatctcctccgttcatggcattgtcctctttctttctctgttcccacgtyccccttactcctccatccctgcacccccatccctcccgggaagctggacagaggaggaggccactggccacaggtgcttacggctcaggtaatcgtgggc

SEQ ID NO: 37890 - DNA, 201 bp, Homo sapiens
ccctcatgatcaggctcctacctgcctgtacccccaacaagccgtaggtggcccccgtgaccagtcctgcctgtaacctgtttgtgtctccagattacatygacaaccatcggctatggtgacaagacaccgcacacatggctgggcagggtcctggctgctggcttcgccttactgggcatctctttctttgccctgcct

SEQ ID NO: 37891 - DNA, 201 bp, Homo sapiens
tttcctgatgccaggaaatgccctcgccagggccgtgcttgtcctgaccacttgtccccgggagcccagggccagggcatgtcttgggaactctgggggargaagtatggtgtgaaagtgtcctggtgtttaaggatctcagggaattggtcacccatcttagaggtcaaaggggacagaggtgtcaggaaccccacctct

SEQ ID NO: 37892 - DNA, 201 bp, Homo sapiens
ctcttggacacagagttactctaccagatcatggttaaccagggcttgtcctggggaatgaggcctctgctaacttgttttcctccaacgtttggggaacrtggtggggagttggatgcgggaagggaagtctgagtgcatgtgtagacgtgcacgtacacgttcacatgcacacagactgtgtaaatgctgttgaaccgg

SEQ ID NO: 37893 - DNA, 201 bp, Homo sapiens
aggctcctacctgcctgtacccccaacaagccgtaggtggcccccgtgaccagtcctgcctgtaacctgtttgtgtctccagattacattgacaaccatcdgctatggtgacaagacaccgcacacatggctgggcagggtcctggctgctggcttcgccttactgggcatctctttctttgccctgcctgccgtgagttg

SEQ ID NO: 37894 - DNA, 201 bp, Homo sapiens
aggggcaaggatggggacacccttgcagcctcttactgccccaccactgccagcacattcccccaaccatgccctatccctctagggcatcctaggctccrgctttgccctgaaggtccaggagcagcaccggcagaagcacttcgagaagcggaggatgccggcagccaacctcatccaggtacaagatgcccgggaaga

SEQ ID NO: 37895 - DNA, 201 bp, Homo sapiens
gggaacagtgggtcacacctgtagtcccagcactttgggaggctgagacgggcagatcgcttgagtccaggagttcgagaccagcctgggcagcatagtgrgacccccatctctttaaaaaataaaaattaaaaaaaaaaaaaacagagttattgatgtgcctgccccacaatgtcccattgcccagtctctgccagagat

SEQ ID NO: 37896 - DNA, 201 bp, Homo sapiens
cacccaggctggaaggcagtggtgtgatcatggttcactgcagccttgaactcctgggctcaagcgatcctcctgcctcagcctttcatgtagctgagacygcaggtgcacgtcacggcgctaggctaatttttaaattttttgtagagaggggatcttgttatgttgcccaggctggtttcgaattcctgtgctcaagca

SEQ ID NO: 37897 - DNA, 201 bp, Homo sapiens
tagttgtctccaatgatgataaataacagtgaaaacctttctgcagagcttcccaggggctggcctgggcttaggcaccctctggatggtcttgggcagaygtttttcacatctcgagccttagctcgaggtccaaaatactacctgtactgggaaggaggtcctctctcccactgacagtccacaaagccgttttaggca

SEQ ID NO: 37898 - DNA, 201 bp, Homo sapiens
ctctctcccaacctgcctgccctgccagcagccggatgggcatcaaagaccgcatccgcatgggcagctcccagcggcggacgggtccttccaagcagcakctggcacctccaacaatgcccacctccccaagcagcgagcaggtgggtgaggccaccagccccaccaaggtgcaaaagagctggagcttcaatgaccgca

SEQ ID NO: 37899 - DNA, 201 bp, Homo sapiens
tcattcactcaacatttattgagaacctacaatgcaccaggccctgcactaggttttggagagaaagtaggaacaagatcaagtacctgcattcatggagyttacattgaggggggcgggagaaccaggaactgtatctatccccggtgtctaccatctggcacctgtgcctgggctggatgcctgggaacagggactctt

SEQ ID NO: 37900 - DNA, 201 bp, Homo sapiens
aacaggcccggtgcacccaccgagtttgcaggctcttgatccggcccagcatgtccaggtggcctgctgagtactgctcaatgacgtccttcacgtcgtarggtcgcagtgtctccttgaatttccttttggccaccaggaacttgagaatcctgttgggggagggggctcagagggagtgtcctgttagagcagggattc

SEQ ID NO: 37901 - DNA, 201 bp, Homo sapiens
tctcaagcaagctgctgctctctggcccaaaagggactgggcctggcacacagatggcactcagcaaatggaagcactcgccctcccacccttcctctcartcaatacttgctccattgatggctgatggggacagtgatgaattacagaagatcttggagccctgcccacttcttgcacagatggggaaacaagtccagg

SEQ ID NO: 37902 - DNA, 201 bp, Homo sapiens
caaactgtttcaagtcatagatctggttctttgaatgacacctgatacagaagcacaatatataaaacagatcaaagtagggctactctgggtggagtcaygggttggggcccagaattctacccactctatgccagcctatatggccctggcatatcaacccagagcctgtacatggtcctccttgctctagaacacatt

SEQ ID NO: 37903 - DNA, 201 bp, Homo sapiens
gtccctgtggaagctggagggatccttcctactccacaccagctcctccctggctctggatcccagcctcccatcttccttggggacttcattccattgaytactcactctgtctccccgcatcttcaacttctccttcttgatctcttggctccttccactctggctctctcatcttaaaagaaaagaaaaagattccct

SEQ ID NO: 37904 - DNA, 201 bp, Homo sapiens
gttgtgtgtgcagcaccaactatgcacagggcaccctgctgagctctctctaaaccggtctcattgtgtccttctgcagccttgtgaggtgggcactgttmtcctcctcatttgacagatggggaaactgggactcagcagaggccacccagttaatgtggaagagcctcagcccggagcgggggctgactgggagctgtt

SEQ ID NO: 37905 - DNA, 201 bp, Homo sapiens
gcaagctctgggaagagaggactgctgactcctgtcttctcctgttgggatccagaatgaggggccactgagcccctctccaagctttccctctctctgtrgaccctcagtctgatcaccaagctgcatccccctcctatgccccagtccctgatttaagccctgaagccttcacaggccctgctctctgaattttaagaa

SEQ ID NO: 37906 - DNA, 201 bp, Homo sapiens
aactgatgttgaacttctggcctccagaactgtgagagaataaatttctgttgttttaagcaaccaattttacagtaatttgttatggtaaccacaggaarctaatacggcggattatttggtgtcatagtgagagaagccactctcaccagctcccttggattcctggaaccttatatcctggctatgtcaatgaggata

SEQ ID NO: 37907 - DNA, 201 bp, Homo sapiens
gactgaggggggctgtgtgaggtagcacctctgggctgggagtccgggactgaggggggctgtgtgaggtagcacctctgggctgggagtccgggactgargggggctgtgtgaggtagcacctctgggctgggagtccgggactgaggggggccgtgtgaggtggcacctctgggctgagggctgaaggtggaaagaggc

SEQ ID NO: 37908 - DNA, 201 bp, Homo sapiens
ggggtgagaggagcgcattcgccctagggtatgcctccctcccatctgccagcccgtcccctctgagccccacacagaacctgcatctttctggctccaaraggtgggagattgcctagagtacaagcccagatttggcctgtcctgcggcagctgcaagctctgggaagagaggactgctgactcctgtcttctcctgtt

SEQ ID NO: 37909 - DNA, 201 bp, Homo sapiens
ccttcgctactgcccgtcttggcccagctgccaccctctactggagggaccagcccctgggcacagtggggattcagaccctatggaacttcctcgcttasaggcaggaccagcaggaagggactaggcctttctacccccatcctctctccatatatccctgctatacagaacctcaggtctcagcgctggagcagatcc

SEQ ID NO: 37910 - DNA, 201 bp, Homo sapiens
cacataattttctgaaaataatgttctcctctcttggctctgtaaccccctgccaggggcaccttggctgtcctgtccctccaacaatctaaccctctccytcatgttgtaattgcagatttttgctggtcttcagctgcctggtgctgtctgtgctgtccactatccaggagcaccaggaacttgccaacgagtgtctcc

SEQ ID NO: 37911 - DNA, 201 bp, Homo sapiens
gggaacagcaagtgccaaggacttgagaggggcaagtggctggagtgttggcttcagcacagcagggagcctggtgtggctgcactggagtgagaggtagraggtgaggtcagagggctaacggcactcagagagtgtaaagtcctgtaggcccctgcaaagacgttggtgttcatccaggatgagctgcaagcattggag

SEQ ID NO: 37912 - DNA, 201 bp, Homo sapiens
ctcctcaccgcgcccctccgcctgccccgcaggagctgatcaccgcctggtacatcgggttcctggtgctcatcttcgcctccttcctggtctacctggcygagaaggacgccaactccgacttctcctcctacgccgactcgctctggtgggggacggtgcgtgagggtctttgtagggctgcccttctccctgggatcc

SEQ ID NO: 37913 - DNA, 201 bp, Homo sapiens
ttggggtgcagagcaggagtgtttggggctcatcctgggccaccccttcctggaaaaatttggctacaagtcagggaggcaaatgtgtgggccatgccccycccctcgctaggcagtaaacactgccgtcgcctgggagacaagaaaacatcttggtccccccacggttgtttataccaggactccctctccttctctggc

SEQ ID NO: 37914 - DNA, 201 bp, Homo sapiens
ggacacagggtgatggtagtaaagtggccctttctcccagggaccccagggggctgagccatggtttgtagatcagtcaccaggctcaggcccaatggccrtatcgttaatcgtggctgtctagaccgccagccaggacacccttcctccaccaaaaacacacacacatatacacactcggttggccacacctctggtggt

SEQ ID NO: 37915 - DNA, 201 bp, Homo sapiens
tgagccagggctctctgtgcttccagttcactctggtctcattttgactgaataggaaggcaaggggaatggacattagcctggggcctagtacctgtacrctccccacggctcctttggtccctgacacccccagggcccaggaacagattactactaagggcttggctgtcactgactcccagcctcgtatctatctgc

SEQ ID NO: 37916 - DNA, 201 bp, Homo sapiens
cccactgctgcccccatcagctgtgcagcagtaagcctgccccacttccagcaccttcattcattcattcattccacaagcactcacacaaatgaagagargatggtgcagacagggcttttaggaatctcaacatttagcaggtgggtgggcctgcaaagttgagctgggcaaggagacagaaggaacagccagaggggt

SEQ ID NO: 37917 - DNA, 201 bp, Homo sapiens
aacagggcagggactaaactcaggtcagcagtagagcccagaccagaacccaggctcagtccaagcatcttagttgtctccaatgatgataaataacagtraaaacctttctgcagagcttcccaggggctggcctgggcttaggcaccctctggatggtcttgggcagacgtttttcacatctcgagccttagctcgagg

SEQ ID NO: 37918 - DNA, 201 bp, Homo sapiens
cacgttcaggcagtcagcttgatgggctgagagtaagctccttgcacggctgcccttgagctgtgccagccttcacatccatgcttggcatccctgggaaytgggggtagaaagggagtggggaaggccagtctcccactgtccaccctgtcctattctggccgggctgtcagtgaacacctctagagcagcaggacctgg

SEQ ID NO: 37919 - DNA, 201 bp, Homo sapiens
ggtatgttcagcagttaagatcttatttaccttaaaagaaaatagcttagaaaccatggctgtgggcaatggtttgagctgaagcgttgagctaaggagtytctgggtcaggcccgccattttgcaagcctcctttggctgtggagggtgtggacaggaaggacacagccatggcagaggccagtggcgaggctgtttcca

SEQ ID NO: 37920 - DNA, 201 bp, Homo sapiens; identical to SEQ ID NO: 7957

SEQ ID NO: 37921 - DNA, 201 bp, Homo sapiens
ggaccacaatctagctactacccactattcgtgtgtccttgggcaaatcacctgacccctttgcacctcagtttcctcagatgtaaaatgcagatgtaaayagggtctgcttccactaaaactggacctggctccaataaatattggccttatttgatttggtatgttcagcagttaagatcttatttaccttaaaagaaa

SEQ ID NO: 37922 - DNA, 201 bp, Homo sapiens
agcctgaggccagacccagcacccgtcccaaggctgagaaacaacccaaccatagtttctctgtgaggtgggtcctctgtgcaagccctattgactcataygccttgggggctttgtttagaatgactgtttcctggtcctaaaataatcagcctaaaataatcactgacctcccatctcccaagagaataggcaaattgt

SEQ ID NO: 37923 - DNA, 201 bp, Homo sapiens
gccctttctcccagggaccccagggggctgagccatggtttgtagatcagtcaccaggctcaggcccaatggccatatcgttaatcgtggctgtctagacygccagccaggacacccttcctccaccaaaaacacacacacatatacacactcggttggccacacctctggtggtgcttggggatggacctgggccaagtg

SEQ ID NO: 37924 - DNA, 201 bp, Homo sapiens
gggggatggcattgccagggccagcacctctcctcttcagggttttgcaatgagtttatcaaaccatggtctccagacctcctgcatcagcatcccatggrgtgtttgttcaaaatgcagatacctggacctgtctccaagcccacaggatcagaatctctggagaagagacacagccttctgcatatgtaacatggtccc

SEQ ID NO: 37925 - DNA, 201 bp, Homo sapiens
cctgccgcccgcggccacaactccacattccactttccacaagcacacacgaggcgtcccaccccgggctggccttcggggccacactgccccacgcagckgtggacaccacttgcacgcgtccggcttcccggccccgcgcgctgcccccgccacgcggttcggcccaggcaccaactcggccgcccgtgcgccctgccc

SEQ ID NO: 37926 - DNA, 201 bp, Homo sapiens
gtggggaagagacttgcccaggtgggagtgagtcttagtgaatgcgtctcctcagtggggcagggaagctttcgcagtgttaccagggtggagacagggcytgggggtggaaaggaaactgctgagggtggggtcaggggaacaggtgggagagggaaggaggagggtagggaaccacggtgtccagtcccctccagcaga

SEQ ID NO: 37927 - DNA, 201 bp, Homo sapiens
agcacccccaagggctcactgctgcagctgagtttctagactgaggaggtccctggcttgcagtgccagcctgaggccagacccagcacccgtcccaaggmtgagaaacaacccaaccatagtttctctgtgaggtgggtcctctgtgcaagccctattgactcatatgccttgggggctttgtttagaatgactgtttcc

SEQ ID NO: 37928 - DNA, 201 bp, Homo sapiens
tttcttccctggctgatacacctgcccacaagcctcttttcttgtattccttttaaaattagagtcaggctgggcgtggtggctcatgcctgtaatcccamcactttgggaggctgaggcaagagaatcacttgaggtcagaagttcgagaccagcctgggcagcatagtgaaatcttgtctttgcaaaaaaaaaaaaaaa

SEQ ID NO: 37929 - DNA, 201 bp, Homo sapiens
agaaggttctgagccctttctgggcctctgtcttcctattggacactctactggtggtttggcatacaagggtcggatgggaggttgggagtggccccttyggtgggccacttgccccatacctgccttttcagatgccccctcagaggaagtagcagaggagaagagctaccagtgtgagctcacggtggacgacatcat

SEQ ID NO: 37930 - DNA, 201 bp, Homo sapiens
tggactaggccagctgtgccctaaagcagctcccacctacccaccaggcagatgtttaccctgactggccaccggggcagatgggcatgcaacacactggrgctttccaccctggggagggcagtgagacacaggagcccccaagaaggttctgagccctttctgggcctctgtcttcctattggacactctactggtggt

SEQ ID NO: 37931 - DNA, 201 bp, Homo sapiens; identical to SEQ ID NO: 7955

SEQ ID NO: 37932 - DNA, 201 bp, Homo sapiens
taagatcttatttaccttaaaagaaaatagcttagaaaccatggctgtgggcaatggtttgagctgaagcgttgagctaaggagtctctgggtcaggcccrccattttgcaagcctcctttggctgtggagggtgtggacaggaaggacacagccatggcagaggccagtggcgaggctgtttccatagtccctgaagagg

SEQ ID NO: 37933 - DNA, 201 bp, Homo sapiens
cataattttctgaaaataatgttctcctctcttggctctgtaaccccctgccaggggcaccttggctgtcctgtccctccaacaatctaaccctctccctyatgttgtaattgcagatttttgctggtcttcagctgcctggtgctgtctgtgctgtccactatccaggagcaccaggaacttgccaacgagtgtctcctc

SEQ ID NO: 37934 - DNA, 201 bp, Homo sapiens
tagacaaccaagtggcagcaggtgggggcattcttctaggaatgaggggcatcagcccaccccaggcacctcagtggggttccgggccacctcaggactcyaagaggctgtgtggagccaccactcctagccacagctgccatgataagtccttccatgaaggactgaggagggagagtgggggtccagggctggtgctgc

SEQ ID NO: 37935 - DNA, 201 bp, Homo sapiens
cgcctgcagacggccctggaggagcacctaatcctcaaggagctggcagcccgtgggaaggacctgctattgagtgaggcccaagggcccttcagccacasagaggtaagtgggacttttcccaagcaagctccaaagcctcaccccaagggagagcctctgagtgggagtggcctgcagagtggggatggaggggtgtct

SEQ ID NO: 37936 - DNA, 201 bp, Homo sapiens
cagcctgcctgtggctggccaagaaggcattgttgaacctcatgagatcacagaggtagctgtgcaggccccgcccacttcctataaccctggttctggcygtccctgtgccaagcctccaagttccctgagagctaccggccaggggtcgggaggctatgggagctcagggcaggcacctcccatgctcccgcgggagcc

SEQ ID NO: 37937 - DNA, 201 bp, Homo sapiens
ggagagccttcccatgacccccatgaagagatcagtgcaaacacaggtgtcagagcccttcatggagtcctggggtgaggagtccctgccggagctacccrcagagcagtccctgacggagtactctgacctcgaggaggctccctcggcgcacactctctatgtgggccatctgaacccccagttctcagtgccggtgct

SEQ ID NO: 37938 - DNA, 201 bp, Homo sapiens
aagttgggccagaaggtagggtaggggccaggtcaccaaggctatcatccaaggcaaggctgaactgctggctttattgggtgggacatgggacgttaggrtaggtcactccatgagacaggtgattttggtttcttttggtgtgaaaatgatggtgtttaaactgttgcagaactaaaaggctctgtggcttacatttca

SEQ ID NO: 37939 - DNA, 201 bp, Homo sapiens
cctctgccctccctctctctggccctgcccagtctctgccaatctgtgtacctcccaggagccgggacactccctgagtcctctgggagcccttaagccayactgagaacacagaccctgggagaagcagccagcagtgaggaatcctggaaccccttcccagggagagccttcccatgacccccatgaagagatcagtgc

SEQ ID NO: 37940 - DNA, 201 bp, Homo sapiens
ccacagggacaccctggcctccctcccctggcgcctgcagacggccctggaggagcacctaatcctcaaggagctggcagcccgtgggaaggacctgctaytgagtgaggcccaagggcccttcagccacagagaggtaagtgggacttttcccaagcaagctccaaagcctcaccccaagggagagcctctgagtgggag

SEQ ID NO: 37941 - DNA, 201 bp, Homo sapiens
tgcctgtggctggccaagaaggcattgttgaacctcatgagatcacagaggtagctgtgcaggccccgcccacttcctataaccctggttctggccgtccmtgtgccaagcctccaagttccctgagagctaccggccaggggtcgggaggctatgggagctcagggcaggcacctcccatgctcccgcgggagccaccag

SEQ ID NO: 37942 - DNA, 201 bp, Homo sapiens
acatgagcaggcacccatgtggcttcaaccctgacagacccatctgtgtagccaagaaactgctctcagccctgtccccaaatgaccttactttcagaaasaatgtgtaaaaccctgcccagagctcccctagggctaagctataagggattgtccttctccctaaaatgctcatttggcccaggctgaggtctgtgactc

SEQ ID NO: 37943 - DNA, 201 bp, Homo sapiens
aggctgaggcgggcagatcacgaggtcaggagatcgagaccatggtgaaaccccgtctctactaaaaatacaaaaaaattagccgggcgtggtggcgggcscctgtaatcccagctactcgggaggctgaggcaggagaatggcttgaacccggaaggcggagcttgcagtgagccgagatcacgccactgcactccatcc

SEQ ID NO: 37944 - DNA, 201 bp, Homo sapiens
gcccacttcctataaccctggttctggccgtccctgtgccaagcctccaagttccctgagagctaccggccaggggtcgggaggctatgggagctcagggmaggcacctcccatgctcccgcgggagccaccaggacatgaaggtcataggcctctcctctcctcctcttcctgtttgacctgaatgcccccaggccaact

SEQ ID NO: 37945 - DNA, 201 bp, Homo sapiens
cctccctcccctggcgcctgcagacggccctggaggagcacctaatcctcaaggagctggcagcccgtgggaaggacctgctattgagtgaggcccaaggrcccttcagccacagagaggtaagtgggacttttcccaagcaagctccaaagcctcaccccaagggagagcctctgagtgggagtggcctgcagagtgggg

SEQ ID NO: 37946 - DNA, 201 bp, Homo sapiens
tgttactcaagaaggaggagtggcatttctgagcaccttccacggtccaggtaccatgctaaatgctagtccaggcaccacaatcctcggaaatgtttttsgggggaaaagagcagatttctacaaaggaagggtgaagtcaggcttcagcccagctgctccagactgctaagaactgcccagatcccctggactgaaggg

SEQ ID NO: 37947 - DNA, 201 bp, Homo sapiens
cattcagggtactgcagctctgtcacagggtgctgagatacctgctggaatgatctggttctgggcctcaggggcctgtctgcaacccaagtaagaaaaamtgggcccacacatgtcccagcacccagccctgagaagcagaaatctcttcttccccaccaggcatcccacagctcacctgggaagggcccagcttggcag

SEQ ID NO: 37948 - DNA, 201 bp, Homo sapiens
gggaaaggagcgctgactggaaccctcgatccagcagggtttcctgcctcggctgcaggagggtgggcagaactgggcccctcggcctggtgaggggcatsaggatgtccgtaagagtcaggctgcagcaggggcctgactgggggttcttgcagtccttctcagggtcagggctcccatttcctggctggacccatacat

SEQ ID NO: 37949 - DNA, 201 bp, Homo sapiens
gtggccaggcgcagtggctcacgcctgtaatcccagcactttgggaggatgaggcgaacagatcacaaggtcaggagttcgagaccagcctggccaacatrgtgaaccctcgtctctactaaaaatacaaaaattagctgggcatggtggcgggcgcctgtagttccaaatactcgagagggtgaggcaggagaatcgatc

SEQ ID NO: 37950 - DNA, 201 bp, Homo sapiens
agaccagcctggccaacatggtgaaccctcgtctctactaaaaatacaaaaattagctgggcatggtggcgggcgcctgtagttccaaatactcgagaggstgaggcaggagaatcgatcgaatctgggaagcggaggttgcagtgagccgagatcgcgccactgcactccagcctgggcgacagaccgagactccatctc

SEQ ID NO: 37951 - DNA, 201 bp, Homo sapiens
tctgcttccagtgtgtggtgggacccacagggagctgagttttcctgtttgatttcccgcacccagcctgcctgtggctggccaagaaggcattgttgaamctcatgagatcacagaggtagctgtgcaggccccgcccacttcctataaccctggttctggccgtccctgtgccaagcctccaagttccctgagagctac

SEQ ID NO: 37952 - DNA, 201 bp, Homo sapiens
tgtgatgcagtttgtccgggaagctgatcctcagcttggaccccacgctgacctgtttcgcaaacacgtaggtgctgctgcctgacctctcagtaggaacmtgtgtggagagcctcacctggtggggacaatacgagatgtttggggaggagggatgcttagagacaaaggctgaggagaacaggtaggcttcagcatcac

SEQ ID NO: 37953 - DNA, 201 bp, Homo sapiens
ggctcccatttcctggctggacccatacattcattcttgactaccaccctaggagaaggaggaggaggaggaggacagtggcctgagccctggccccagtmcaggctctggtgtcccgctgcccacctggcctacacacacgctgcctgataggccccaggcccagcagctgcagagctgccagggccggcccagcggcgt

SEQ ID NO: 37954 - DNA, 201 bp, Homo sapiens
actgactaaagagggaggtggaggctttaggcagcagcgctgaaagaggtggcaagaggtgacctgcatgggaactggggcctgaagagacatcactaagkggggaagtgtgtcccacagccaagctgcatggtgggtgggccgctgggtctgcttccagtgtgtggtgggacccacagggagctgagttttcctgtttga

SEQ ID NO: 37955 - DNA, 201 bp, Homo sapiens
cccgacgtttgtgtgaagaaaggccacgaggggacctcctctccttaggtccttttacattccagcctctgggcctgggagaccctagaagacacaggggkcccgattttctccttggcccaactcatttgttcaattgacaaacatgaacaccccctctgtgccaagagtaaggcagggatgagaggcccagccaggccc

SEQ ID NO: 37956 - DNA, 201 bp, Homo sapiens
gaggtagctgtgcaggccccgcccacttcctataaccctggttctggccgtccctgtgccaagcctccaagttccctgagagctaccggccaggggtcggsaggctatgggagctcagggcaggcacctcccatgctcccgcgggagccaccaggacatgaaggtcataggcctctcctctcctcctcttcctgtttgacc

SEQ ID NO: 37957 - DNA, 201 bp, Homo sapiens
acatgaacaccccctctgtgccaagagtaaggcagggatgagaggcccagccaggcccccaggaagccctgcatctgtggccagagctggacagccacccrccgagctgcaaggtggctgcgctcagagctgtgagagaagacaggaaggtttgccctgctctctggggacagattaacaggggaagtgaaatccaggccg

SEQ ID NO: 37958 - DNA, 201 bp, Homo sapiens
cctgggcctgcatgagacctgctgggtaggaagacagcctctctgggctcttcaggtggggctgagcagcccctggaagagcacaggagtctgacgaggasctggtgaggtcctggacccaagagctagggctgcttacagtggcatgagcggatgtggggaagcggcctgtccccgtgctgcagctgtgggatctcccct

SEQ ID NO: 37959 - DNA, 201 bp, Homo sapiens
tgggtacctttagaagagtaaagacgagtttatttatttatagtactttaattaaatttaggggagaataagcaaattaatggttagttatggcatctccrtgcactggtttaatcataaatattagatcatattatctaacctttttttttcttgttgaactagtctctgcaccaccttgtcactgcagtgggaaccaga

SEQ ID NO: 37960 - DNA, 201 bp, Homo sapiens
aagatcaaggtgctggcagattctgtgtctggtaagggtttgttcctcataaaagggctccttgccgcatcctcaaatggtggaagggaggaacaagcccyttgggcctcttttataagggcagtaatcccattcagaatcatttcccaaaggcctcacttcttcataccgccaccttgggaattaggtctcaagctatga

SEQ ID NO: 37961 - DNA, 201 bp, Homo sapiens
aggttttaattaactggtctcccccgccctttgaacagtgcccaatttaatcagtcacacacaaaaatgtaaattattagttcaagcttttctccaggtamttaattcttcctcttggagggaagatcagatttccttcagagctaccaggtgcaaggaggagaatattcagccccaccatgtcaccttccccaccagaaa

SEQ ID NO: 37962 - DNA, 201 bp, Homo sapiens
tctgtcagaggcaggaaacaaactatatatgaccttgaaggaagagttgcatttgagcagcgagagcagagggggaggatggagcagtaagttggaagtaygcaagtgagcaaaggaattgagaatcaggggaaatggagaggagtctttctggaatgtgatgaattgaaaggcaatagcttctgataggatctaaaatgt

SEQ ID NO: 37963 - DNA, 201 bp, Homo sapiens
agcccaacagcccaagaaaccctctccgcagcccagttctccccgacaggttaagcgagccgtggtgagtgggctaaagcaggccctgggtagagcaggcwttccaggtggcggcaacacctgagcactgttcccatttctaagcgagcacagggaacaccggaagcagggggtgttcgccgaaactcgcagtccgactgc

SEQ ID NO: 37964 - DNA, 201 bp, Homo sapiens
cttgtggctggcaagctgtgcttaaggataaggcatcacacagatctgggaccacagcagggcatggactcgtggcagctgctggtttgtgccatcccagsgtgccttggagaagccccctttacttttagcctttacccactgtaccatgaagtcaggaaaccaagccccagtccaggaacagtgaaagtagaagttctg

SEQ ID NO: 37965 - DNA, 201 bp, Homo sapiens
aagaggcctttatttatctagctcaaagtagacactatcacaatcttgtttgttactccttttactaaaatagttcaaatcaatgtttttaccacactatmaaaaagttctatttcttcttgtctccccacgtcagagtggttgaatagaaggtagaaacaggccgggagtccacgggctcccagctctaaacggcgccag

SEQ ID NO: 37966 - DNA, 201 bp, Homo sapiens
ggttttaattaactggtctcccccgccctttgaacagtgcccaatttaatcagtcacacacaaaaatgtaaattattagttcaagcttttctccaggtacwtaattcttcctcttggagggaagatcagatttccttcagagctaccaggtgcaaggaggagaatattcagccccaccatgtcaccttccccaccagaaat

SEQ ID NO: 37967 - DNA, 201 bp, Homo sapiens
ggcgcgggaggaggcgggggctggtccccgggcaccctggtgggcaccgagaactcgcagagaggaacataaaaccgcacagccttccccgagcagcgggktgacgggaggaaggaaggaaatgggagcgcgacccggccgcgcgcagagccgagccgactagcgcgaggggcccgggccccacccgagagcaggcgcgag

SEQ ID NO: 37968 - DNA, 201 bp, Homo sapiens
gttaaagagtcgctaaaaggtagatttcattcatgcattattttatgccatctgtgtagcagatctaggggatgaacaggacagataaaaatcaatatagraatacaggaattatgtgaacaccagttattgatacccagcaatgccataggctgttttgtaaactaatgaggtttcattgataagtggccaaatattact

SEQ ID NO: 37969 - DNA, 201 bp, Homo sapiens
tagagggtattggtattgaaaaagttaagatttcagaattaggagtgtcattccttcttggtacttgaaaaggacagaaatgggatacatatatatatatwtttttttaaccatgatttattttgatatcttcagttaaagtttaacattacagatttgtttcttaacatttggttttctgcatgtgtgcatttgttttct

SEQ ID NO: 37970 - DNA, 201 bp, Homo sapiens
ccaaagctgaggaccctgagccgctgggcccctggggacaagcgtggaaaaaactgaggggcaggttgtcatctcaccctgctgacactggatgccctacragggaagcagctcatggctgggccacccgggaggaagtagacaggctgggcaaggaagaccctcagacaggtggactcactgcaacccagggcccgctgg

SEQ ID NO: 37971 - DNA, 201 bp, Homo sapiens
aggagccagttaatggcaaagctggggctgacgtccaggtcatctgcttcccggcagagggtttccttctgccctgccgtgtcatggtgttgtgaggtgcygaaattttatcaccagtctgaaacataaatccaaaacaatacactggagaattttgaaaactaattacttagagcccatttggttttgcaaaaatatact

SEQ ID NO: 37972 - DNA, 201 bp, Homo sapiens
cagaggcaaaaggtagtgtgtgaggtgctgattggtgggtctagggatgggccatggttttggtggcaagatggacgctagaaatgtaggtttgtagttgwccacttagagaggggctttggactctgaggaagagggtgaagagagaggaagtccctggaacttaaattgagcctgtatttgagatggaggaaatccaga

SEQ ID NO: 37973 - DNA, 201 bp, Homo sapiens
cagctgcccactcgggcaagaatcactgggtaccatgagcagcaggtgttcacccaacttcacgtgtacacccctagtgaccgggagcgcaccacctgacygggcgacactccttcccaaagagcctcctggcaacacccacggcaggagcgccacaccatcccatcaccagcacccacttacccccctggggctaagatg

SEQ ID NO: 37974 - DNA, 201 bp, Homo sapiens
taagtcattttcattggtgtagcaatttttggatgtgctagaattcttctgattctttaaggaatagagaaattactaactatggttaaagtaacttagtygggtacctttagaagagtaaagacgagtttatttatttatagtactttaattaaatttaggggagaataagcaaattaatggttagttatggcatctcca

SEQ ID NO: 37975 - DNA, 201 bp, Homo sapiens
ttcagcaagtactcgtggaataaatgtcaaactaatggtctgaggaaatttctaaatcacagttaaagctaaagcgatgaagttcagccccattcatggtgttgtttttcctaactagcttgtattgtctcacaatagttatctttttctctgccaagcattatgtatgtatatacaaaatgtatagtcattctcctcatt

SEQ ID NO: 37976 - DNA, 201 bp, Homo sapiens
ttttgttgtgtttttaaaataccacttttagggacccatggcagtgttcctccactcccattcgcatcaagttccccttgttgcaacctcagtaacacctgttaattatccttcataacatttatcacagtttgcaattaaatagattttcaaaaatactttaggccaagccgggcagattgcttgagcccaggaattcaa

SEQ ID NO: 37977 - DNA, 201 bp, Homo sapiens
taggggaatgaggaagaccagtttattacgaaggccaaaatttattgtatctatttctgtgtgacctttgataacaaaaatcaagaacttttgtttccctyttaggtgacaggagcctgttgcctctttctggctgggaaagtagaagaaacaccaaaaaaatgtaaagatatcatcaaaacagctcgtagtttattaaat

SEQ ID NO: 37978 - DNA, 201 bp, Homo sapiens
gtcccctggggggcaaaattgtcccaggtttaaaaaccactgctctgcggcagtgagaatgaacaaatactgctttatgcaacaacaggaatgaatcccaygaacttaatattgagcagaagaaaccaaatgtaaaagtggtactgtgtcatcgcacagtccttcaaaaacaggcaaaacaaattgatggaaatagaggtc

SEQ ID NO: 37979 - DNA, 201 bp, Homo sapiens
agtgatttgtgcagatgtgaattaacccaatcccatgacttgtctaagtgaaagtgcctacatggaataaactgaaaaggggtgctggatggaagagatgsttagttttagaacataaatctttgtcaagattaagacaggcccaggttttgctgaagaatggaatctggaccagcgttagaggacctgtatgtctagtga

SEQ ID NO: 37980 - DNA, 201 bp, Homo sapiens
ttgtgattgatttttaggaggaagtaatggttctggagagaatcttactgcagaccatcaagtttgatttacaggtagaacatccataccagttcctactwaaatatgcaaagcaactcaaaggtaagaagaaagttttcagaagaattttttcattctgaaatcaagtctttataatttgatgacactcaaattacgctt

SEQ ID NO: 37981 - DNA, 201 bp, Homo sapiens
agtttgaactttttttattccaattagccatgttcaaatcttttcacttaggccaatatggaccatagtcatattgcgctttgtatgaaagtttactcccrtggtacctttcccagcataaatttgggcttataattgagactcaacaaagaccaagaaagcaaaatggaacagaagttgtctatgccatatcactcattc

SEQ ID NO: 37982 - DNA, 201 bp, Homo sapiens
tatgaaagtttactcccgtggtacctttcccagcataaatttgggcttataattgagactcaacaaagaccaagaaagcaaaatggaacagaagttgtctmtgccatatcactcattcttcggttactcctcaagacgtgcattgtgtcttactctctgtgggagatagagtagctttcagtccaggataagtggtatgac

SEQ ID NO: 37983 - DNA, 201 bp, Homo sapiens
gtggtttgccctgaaagttcaggctagaaataatttttgtccgaggctgttcacagtgactgccgtcgctgattctggtggtacctggataatccattttyttctcatcatactcaggatcccagttaacaattgtgtattttcttttgtaacaggttgtttctcccaaagaagagaacaaagcagcaggtaatttcctgt

SEQ ID NO: 37984 - DNA, 201 bp, Homo sapiens
gacgtccaggtcatctgcttcccggcagagggtttccttctgccctgccgtgtcatggtgttgtgaggtgctgaaattttatcaccagtctgaaacataartccaaaacaatacactggagaattttgaaaactaattacttagagcccatttggttttgcaaaaatatacttcctggtatagttttagagccttaacact

SEQ ID NO: 37985 - DNA, 201 bp, Homo sapiens
aggtaccaggcatgctaagcgttctcgtgagggtgttccatgttgagatgattcttccatgtgtaccctgagtcccaagaatggattttcccagatagacrtatgtgagcaatatttcagaagcatcattaattaaattatctaatagtttccactttgtccaaacacatacttttggtaaactaaaaatacacaccagtg

SEQ ID NO: 37986 - DNA, 201 bp, Homo sapiens
agacggccccgcgaccgcggcccaacgcttctcctcccgccccggaccccgcccccgggccgcagccgccgccgttcattggcccacgcttcggacgcatrggcgcggccccgccccgccacccagccggcgttccgttcggggtcctccccagccagtgggctggcagctcccgggggcaagagcggccggctcagccgc

SEQ ID NO: 37987 - DNA, 201 bp, Homo sapiens
aagccagcctgcccccatcctgtgcctgccttggtttcctttggaggacctggttgagttccaaaccagtttgaaactttgaagccttgctgcgtagaacrcacacaggaacccgggggcttggatttgaaaccctttccacttctggcctgtgatgagacagaggcagctggaggagcagcggcctcactgtccaccttg

SEQ ID NO: 37988 - DNA, 201 bp, Homo sapiens
tcctgggtcaaagagcaaatgcatgtgtaattttgttggatatcgtcaacttctctgtgacagttggaccattttgtactcccaccagaagcttataagaycacctgcttctctatagctttgccaacagagcaaattgtcaaactttgggatttttgccaatccagtaggtgagaattgtatctcagtgtgatgtctgat

SEQ ID NO: 37989 - DNA, 201 bp, Homo sapiens
cccgctggagatgagtgggcactcgccacgtggagggggtgtgagtaggcgtggccgtgcatgcatgtgggatgtcatggggcacgtacgtaggaggaagrggggcatgggagtggggactgtgctcaggtgtgcacagcctggaggaaccggagcccatcggactcaccagtctgcacctgcagaggctgggcctggcag

SEQ ID NO: 37990 - DNA, 201 bp, Homo sapiens
cttaactcttcacagttgtagagactgggaggtgtaagatcaaggtgctggcagattctgtgtctggtaagggtttgttcctcataaaagggctccttgcygcatcctcaaatggtggaagggaggaacaagccccttgggcctcttttataagggcagtaatcccattcagaatcatttcccaaaggcctcacttcttca

SEQ ID NO: 37991 - DNA, 201 bp, Homo sapiens
agacggctttagctaactattaccagctgtggaaaaaggcaggaggtgggtccctgaggtgagagtaatagcagttataggatacagaggcaaaaggtagwgtgtgaggtgctgattggtgggtctagggatgggccatggttttggtggcaagatggacgctagaaatgtaggtttgtagttgtccacttagagaggggc

SEQ ID NO: 37992 - DNA, 201 bp, Homo sapiens
tttctctttctcataggattctaacattttcagagaaccttttggaaagaacaagcctacttcaataaatgaaggagaataaagaaaattcaagcccttcrgtaacttcagcaaacctggaccacacaaagccatgttggtactgggataagaaagacttggctcatacaccctcacaacttgaaggacttgatccagcca

SEQ ID NO: 37993 - DNA, 201 bp, Homo sapiens
gtttctaaagggtgttaaaagtataaaacttcagcttgctaattcttgtaccagaattctgacaccctgagattcccatctcattactttgccactaataytgtttactttaccattgattttgttgttgttgtttgtctttttgtttttctacatttaactaagagtataacctgtaaaagttattggttagagtcctta

SEQ ID NO: 37994 - DNA, 201 bp, Homo sapiens
agttgacgtgcaggtctgtcagaggcaggaaacaaactatatatgaccttgaaggaagagttgcatttgagcagcgagagcagagggggaggatggagcartaagttggaagtacgcaagtgagcaaaggaattgagaatcaggggaaatggagaggagtctttctggaatgtgatgaattgaaaggcaatagcttctgat

SEQ ID NO: 37995 - DNA, 201 bp, Homo sapiens
ttggagttttggagagccacgtaacgagggtgcggctaagatgaggaaaaggcacttccgggattagatttcgttcttgcccagacatcgtctttacggasccgctcctggtggttgatttggtttgttatgagagaaattgttctttagaaaattggagcgtaagtctagaggttatgtgacagctcctaaacgattgtc

SEQ ID NO: 37996 - DNA, 201 bp, Homo sapiens
tacctttcccagcataaatttgggcttataattgagactcaacaaagaccaagaaagcaaaatggaacagaagttgtctatgccatatcactcattcttcrgttactcctcaagacgtgcattgtgtcttactctctgtgggagatagagtagctttcagtccaggataagtggtatgacatgcacagaacacgtgatgga

SEQ ID NO: 37997 - DNA, 201 bp, Homo sapiens
atattttcactacatttcatgaattgtttatattctgccttggaacctaaagggaccaggagtttggccagttacagaaggtaaaacaattgaatatactyacgatttatccgcttgtggaccgaggttcttttccattccagtttcatccctactggggtattcctaacactgttccccgttctgcccctttcccctcaa

SEQ ID NO: 37998 - DNA, 201 bp, Homo sapiens
agaaagaaaaggaagcatgggcagtgctgagatggattccacaggactgtgctagaaggaaaaggaagcatgggcagtgctgctgagatggattccgcggractgtgtttagttgtgctctttctttttccacggcaaagcttgctgtttagggagttaatttcagattggaatatgagaagaaaatttatttatgtgact

SEQ ID NO: 37999 - DNA, 201 bp, Homo sapiens; identical to SEQ ID NO: 7977

SEQ ID NO: 38000 - DNA, 201 bp, Homo sapiens
actcttttcctttttggcattttctttgtttacatgactttttttttaagaaagttaaattttaaataatttatgaagctagagtttgggggatttatatrtataaaatttccttcaagcttctagagtatcggagtatttgtgaatgataaaaagaaaggtaggggaatgaggaagaccagtttattacgaaggccaaaa

SEQ ID NO: 38001 - DNA, 201 bp, Homo sapiens
cctggggctaagatggggggcgtgagcctttcccctgagagcaaacgggcagcaagaactgctcagaatagagccgccagctagggagagggacagggcgrccatctccctcctcttgcctgcatccccagccctgggcctgcatgagacctgctgggtaggaagacagcctctctgggctcttcaggtggggctgagcag

SEQ ID NO: 38002 - DNA, 201 bp, Homo sapiens
aggcaggaaaatgaggcagaattttttaaatggactaataaacttagccttggagccaggttttccatacatggtggttcagcgtaggtcatgaggaggargaaggggtaggatgtggacccacatcattcatccttgtttcccacgcaaaagctctttgctgtgtatttgagtggtgctgaacacgtggtaggtttttaa

SEQ ID NO: 38003 - DNA, 201 bp, Homo sapiens
ctaaatttagactgccagttaaacggagctttcgctaagtcatctgaggttaggaactatttctaagagcatttcttaagggtggtcttctgtgtttttargagaaacttggtgatgtttgtgtatctcgatctaaatcgctgtttacagatacctagcacaatgccttgcagttgtaggtgcccgctaaaggtttgtatg

SEQ ID NO: 38004 - DNA, 201 bp, Homo sapiens
cttctgggctcaagggatccttccacctctgcttcctgaatagcaggcataggcccaagctaccatgcctggctaatgtttgtatttttttttgtagaggyggggttttgccatgttgcctaggctggtctcaaactcctgggctcaagcaatccgcacctggcctattgtgaaatttttcaaggcatacagctataccat

SEQ ID NO: 38005 - DNA, 201 bp, Homo sapiens
catgatcacactgcagtcctccttcctctgcctcccaaagtgctgggattacaggcatgagtcaacacacctggcctctgtttggttttcattgtcttttrtgagagaaataattaagggagtcactaatttatctgcatttctggtccttttaaatattatgcccatgtttcttgaaagttccattgataattataggaa

SEQ ID NO: 38006 - DNA, 201 bp, Homo sapiens
acgaaaagagtactgatcagattgcataatttgctaaaataataaccaattttcaaaattgcttttatgtatcaagcattaacatatgtaaaagcagttcktaaaatgctaaaaacagttttgatttagattatgaattattactgaaaatcaattaaaaataaggtagagaaaacattttcatatcctagtaataactaa

SEQ ID NO: 38007 - DNA, 201 bp, Homo sapiens
tcaaagggaagacctttcttgctcctttgataaaagaaaatccgattttttcaccctcatatatttttgcaaatccagttttggcataaaaatcaagtctstttacttgaggaagagagatcctattttagtaatttttactgggaccctggagtagtccctctatatttttaattgaaaaaatttttttattttatcatg

SEQ ID NO: 38008 - DNA, 201 bp, Homo sapiens
cagaaagctggaagctgatgagcacagatgatcaacagaaaatccaagcaggtacgttagccttgagatatttcaattcttatgtaatgatcattgtgacmgcagatattttgagggcattctgataagtgaaaaggttaacatttgtgtgcttctgttggataataggataactgaaactggtgctcatatgtttaggca

SEQ ID NO: 38009 - DNA, 201 bp, Homo sapiens; identical to SEQ ID NO: 7995

SEQ ID NO: 38010 - DNA, 201 bp, Homo sapiens
gatactgtgctaaacttaagtcttcaggaacggaatttgtaacatctaagtttgaatcctgttcagagagcagttgctttagtagtgtccaatcttgtttrgcaaaatgttggtcatcttcaaaatccatatctgtaacatgtgtttctgattccactttctgctcaaatgcttctattacatccatctcatatattggag

SEQ ID NO: 38011 - DNA, 201 bp, Homo sapiens; identical to SEQ ID NO: 7998

SEQ ID NO: 38012 - DNA, 201 bp, Homo sapiens; identical to SEQ ID NO: 8002

SEQ ID NO: 38013 - DNA, 201 bp, Homo sapiens
cccttgaattttaaacacataaaaatgcctcaaaaatcttgtcaattttgtatagatgttatttttcccattctgtgttttttttttttttttgactatcrctgttatattgtgttaatattctacaaaactctgagggtaccaacgtgcaatttttacattgtgtagtattatgaattatttcaggagacatagatgatt

SEQ ID NO: 38014 - DNA, 201 bp, Homo sapiens; identical to SEQ ID NO: 8004

SEQ ID NO: 38015 - DNA, 201 bp, Homo sapiens; identical to SEQ ID NO: 7992

SEQ ID NO: 38016 - DNA, 201 bp, Homo sapiens
acctttttcatttccttgaaaacctttttggcagctaacgtattagagctatttcagtctattagaagttgtttagaactctagacctaattcaatgtctrtttttctaattagcctacttcttaaaaaagaagattttaggctaggcatggtggctcacgcctgtaatcccagcactttgggaggccgaggcggatggat

SEQ ID NO: 38017 - DNA, 201 bp, Homo sapiens; identical to SEQ ID NO: 7993

SEQ ID NO: 38018 - DNA, 201 bp, Homo sapiens; identical to SEQ ID NO: 7994

SEQ ID NO: 38019 - DNA, 201 bp, Homo sapiens
ttcctttgcatgtgcaatatacaaataagcctttaggtgaaatgtatttatccctgccttttgcaacggacttaccctaaaagtcatcatcaaaacactawgtcttttttttttctctttttctattgtagtgaattagatatatgtgcacattctatgtttatgtttaaatgatttatgttttctgtatcacaagttttc

SEQ ID NO: 38020 - DNA, 201 bp, Homo sapiens
cattctatgtttatgtttaaatgatttatgttttctgtatcacaagttttcaaattaaagtatggagaattattgttagttgcctatgttgattttgcttytaaacattacccttgaattttaaacacataaaaatgcctcaaaaatcttgtcaattttgtatagatgttatttttcccattctgtgtttttttttttttt

SEQ ID NO: 38021 - DNA, 201 bp, Homo sapiens
gaattattgttagttgcctatgttgattttgcttttaaacattacccttgaattttaaacacataaaaatgcctcaaaaatcttgtcaattttgtatagawgttatttttcccattctgtgttttttttttttttttgactatcgctgttatattgtgttaatattctacaaaactctgagggtaccaacgtgcaattttt

SEQ ID NO: 38022 - DNA, 201 bp, Homo sapiens; identical to SEQ ID NO: 7996

SEQ ID NO: 38023 - DNA, 201 bp, Homo sapiens; identical to SEQ ID NO: 7999

SEQ ID NO: 38024 - DNA, 201 bp, Homo sapiens
atgtattctctcttatgactcactttttcttaatttatagccataaaatctcgacctgtttcaagagttaccaatggaacttccaataaaaaaagtattcrtgaacaagacactaatgtaaataacaggtaggtcttcattcagtgttttaacctatctgttagctttctctcaaagttaattatatactaactgctagct

SEQ ID NO: 38025 - DNA, 201 bp, Homo sapiens
attgccctacatttgaaatttttaaactgtcgttgtgttaactgttgaattaaaatttaagtgtttggtctgaaagtattacttctgtttctttgaatctygaggtactctaacatttaatgtttatcatatattcagatgagtatggaataagatcatgtatcatctatgttatttaactatgtccatattgtagttttc

SEQ ID NO: 38026 - DNA, 201 bp, Homo sapiens
cagatgatcaacagaaaatccaagcaggtacgttagccttgagatatttcaattcttatgtaatgatcattgtgacagcagatattttgagggcattctgrtaagtgaaaaggttaacatttgtgtgcttctgttggataataggataactgaaactggtgctcatatgtttaggcagttttaataaatcatgctttttag

SEQ ID NO: 38027 - DNA, 201 bp, Homo sapiens
ggaatacgactagggtcccgacaacccttttaaagcatattatacgattccacagaacatactctaggaaatggtgcactaggacatttttttctgtgttycctgttatccccgtgttttttaaaggcccccaggaattagcctacttgccttcctatcccctgctactcaccaggcttttctgccttccttgccttactg

SEQ ID NO: 38028 - DNA, 201 bp, Homo sapiens
ctaggaaatggtgcactaggacatttttttctgtgttccctgttatccccgtgttttttaaaggcccccaggaattagcctacttgccttcctatcccctrctactcaccaggcttttctgccttccttgccttactgcagaatagaacaaagtttcattatttttcctcatcctcctgactttgtggttgtctaagtctt

SEQ ID NO: 38029 - DNA, 201 bp, Homo sapiens
gcttgaacctgggaggcggaggttgcagtcagctgagatcttgcctctatactccaggctgggcgacagagcgagactctatctcaaaaaaaaaaaaaaaattgataatgataataatagtgcagtctaaacaactataatacataaggaggaagaatttcccttccagaatctgtgtgagtccattgtttttcagtgttc

SEQ ID NO: 38030 - DNA, 201 bp, Homo sapiens
gccagccagtgctatactagtatcttatttgtacaaaaaccaagctttgcagatgtagtgtattgatgtgctgtgcttcctaggagcttttaaaaaaaaawttttttaaataaggactccaagaagtaaaggattcttcccacagaggattaagtctttaatgataaaatttctggcacttggaataaggttgaagagaga

SEQ ID NO: 38031 - DNA, 201 bp, Homo sapiens
agaataaattaagtagattcagtgttaagggtgggaaggagttctaaaagcagaagtcagcctggttttaggtattaaaaatagagaaatgttttttttttgagctaagatttgagcaagaaaacaaaaaatgaggaccaagcctatctgaacgttttaaatgttagaatcctagaagactgctgtgaataggaccagtct

SEQ ID NO: 38032 - DNA, 201 bp, Homo sapiens
gagtaagccttctaaaaaatcatggatattatcattcctcagggcatcctgaatctttatagacattaatctctatcaaaacttcatacattaaaaaagcyttccttttatttatttatttactttaatagatagaatagcatgcctttaaaataaacacttatgctgtatttcagatttgattacggtaatctaagacaa

SEQ ID NO: 38033 - DNA, 201 bp, Homo sapiens
cctcttatgattatgtttaatttttcctattttttgagacagggtctcactctgtcacccaggctggagtggagtgacacaatcacaactcactgcagccytgaccttctgggctcaagggatccttccacctctgcttcctgaatagcaggcataggcccaagctaccatgcctggctaatgtttgtatttttttttgta

SEQ ID NO: 38034 - DNA, 201 bp, Homo sapiens
gtttttgttgttctgttgttgttattgttgagacagggtcttgctctgtcacccaggctggagtacagtggcatgatcacactgcagtcctccttcctctscctcccaaagtgctgggattacaggcatgagtcaacacacctggcctctgtttggttttcattgtcttttgtgagagaaataattaagggagtcactaat

SEQ ID NO: 38035 - DNA, 201 bp, Homo sapiens
tccatgttgttcaggctggtctcgaactcccgacctcaggtgatctgcccgcctcggcctcccaaagtgctgggattgcaggcgtgagccaccgcgcccarccccatagcaactctttatagaccgacgatgcatattataccttgaaagtgctgagaaacactaaagaatacttttgaattgttgcatccaaaattttcc

SEQ ID NO: 38036 - DNA, 201 bp, Homo sapiens
gggtttctccatgttgttcaggctggtctcgaactcccgacctcaggtgatctgcccgcctcggcctcccaaagtgctgggattgcaggcgtgagccaccrcgcccagccccatagcaactctttatagaccgacgatgcatattataccttgaaagtgctgagaaacactaaagaatacttttgaattgttgcatccaaa

SEQ ID NO: 38037 - DNA, 201 bp, Homo sapiens
cggaggttgcagtcagctgagatcttgcctctatactccaggctgggcgacagagcgagactctatctcaaaaaaaaaaaaaaaattgataatgataatartagtgcagtctaaacaactataatacataaggaggaagaatttcccttccagaatctgtgtgagtccattgtttttcagtgttctgaaaacgaaaagagt

SEQ ID NO: 38038 - DNA, 201 bp, Homo sapiens
taattttgtatttttagtagagatggggtttctccatgttgttcaggctggtctcgaactcccgacctcaggtgatctgcccgcctcggcctcccaaagtsctgggattgcaggcgtgagccaccgcgcccagccccatagcaactctttatagaccgacgatgcatattataccttgaaagtgctgagaaacactaaaga

SEQ ID NO: 38039 - DNA, 201 bp, Homo sapiens; identical to SEQ ID NO: 8001

SEQ ID NO: 38040 - DNA, 201 bp, Homo sapiens
gtttcgctcttgttgcccaggctggagtgcaatggcatgatctcggctcaccacaacctccgcctcccaggttcaagcagttctcctccctcagcctcccraatagctgggattacaggaatgtgccaccatgcctgcctaattttgtatttttagtagagatggggtttctccatgttgttcaggctggtctcgaactcc

SEQ ID NO: 38041 - DNA, 201 bp, Homo sapiens; identical to SEQ ID NO: 8003

SEQ ID NO: 38042 - DNA, 201 bp, Homo sapiens
tatttgaagagcatagacatgagttctgcaataaattcccatataaacctaacttataaaatgaatttttatttaattataaaaagaatattttgaagatkcttattttattttcagtagaaccttatttttttattttctctttcctccttcctcattatatatctgcaaaaccagaaaatatttttaatttcaagagta

SEQ ID NO: 38043 - DNA, 201 bp, Homo sapiens
aaggtctctacttttgtatatgtttggaattttttataatactaaattttaaaaattccgtttgtctccaaatggacttcttataaaagtttagaaattgrcagtttggctgggtaattttaaatttagtgtgatatttagcaacattatttggcacagcataactctcgtatttctccctggtcctacagtaaattttct

SEQ ID NO: 38044 - DNA, 201 bp, Homo sapiens
ttttctatgcatattactattaaagctaagactgtctagaatttctaaacaacaacaacaacaacaaaaatctaacttaaaatttactttttgcagtattrcaaaatgaatcctaaattattggcttaatcacctgtgttaaagaagtttcaatgcagaaactagacaaaacaactaacaaaatcatcatgtcctttatta

SEQ ID NO: 38045 - DNA, 201 bp, Homo sapiens
ctctgccaaatgaagggggaccacagggattcttactgtagagcaaagaagaccacgggattaaacagaggacccgattactttgtttcagggtattcctrgagaagacggctaccgaggctatcctggtgatgagggtggacccgtaagtaaaaattgttttagtccctaaaatttcaccccctccttgatccttaccca

SEQ ID NO: 38046 - DNA, 201 bp, Homo sapiens
ataatgagatttttcattactgtgaatttcacatttcatgtatgctgatagattataagagcaatgttttttaggggcttgaacaagaaattagttccccrcctcagctaaatttcaagtcaatttgtctgttaacacatccctttcagatttcctctctcgctcatgcactacagtcatggaggattttattttttatct

SEQ ID NO: 38047 - DNA, 201 bp, Homo sapiens
cagctggtggggagcctgagaatggagaaatagtttcctgtggaaacatgaagaagccaggaaaccctcacaaggagagaacatgggccagggcggagggkaggctggtgcccacggccccggccctggaccgtgggagcagtcagggaagggagtggagtgagaggacagcaggtgggttgaaggctggtgaacttgctt

SEQ ID NO: 38048 - DNA, 201 bp, Homo sapiens
atcttgcaatgcagctatcagcaatgatgagcagagacacactgtcattgctgggctaggatcaggtgtcacggaattacgtattcgggtttccctcatgkctgagatgatattgagggaggcatcctatcatttattaccaaaaaatgactaataaactggtaacgagctcaatatgttgctacataaatgtacaaaaat

SEQ ID NO: 38049 - DNA, 201 bp, Homo sapiens
tttggttctgaagattccagaaactaacaactcagtctgtgatagaaattgcagcaggtgtgacctttaatccttgtctttggcagggagacaaaggattrcctggttcttctggagagaaagggaatcctggaagaagggtaggtgtatttccacggtggtgctattatggaaagaatatcaacatttcatttagggaat

SEQ ID NO: 38050 - DNA, 201 bp, Homo sapiens
taacgagctcaatatgttgctacataaatgtacaaaaatattttatggtggaagcaggcaagaacttgcttagaaagtccttctctagcttgaaagctgayaaatacatatctttagacgtttttaaaaaacatttacttaacttgtaattaatcaacaatttaagatggtatagatgcaaagctattcaaatagttatcc

SEQ ID NO: 38051 - DNA, 201 bp, Homo sapiens
gatttctttattgacgatttcagacctgagcctggggaagagggttgttgggaaagggggatgaaaggaagaattctacttttgaaattgctttaaaacaygttgataaaatatgtgctttgtctttttcttgcagtttgggggtttggggagatgtgttggttctcttgctaaccagataatcatttgcaagtcctgtta

SEQ ID NO: 38052 - DNA, 201 bp, Homo sapiens
agggattccagcctcccactccccatcctgtgccctcaatcctgtcttgcggtagggatgggaagctctcattctctctggaatgtcagtgggggcacagytcacctcacctgaaaattgagttgtcttaaactaaagggaaaagtttccgtgttgaaataaggttttagctcctatttagggagtgagagagacagaaag

SEQ ID NO: 38053 - DNA, 201 bp, Homo sapiens
tggtatagatgcaaagctattcaaatagttatccagtagctccagaaacatttattaatttgcactttttcaccatctcttttatgttatttgtgggttgsgtagactgtaccacattttaagagttaatttcatccatcagtttattcattcacctaacaggctttaacatgcccatatgtaccaggtgctcactgtgag

SEQ ID NO: 38054 - DNA, 201 bp, Homo sapiens
cacctggatgatgtattttaagaggtgttggttagggattccagcctcccactccccatcctgtgccctcaatcctgtcttgcggtagggatgggaagctstcattctctctggaatgtcagtgggggcacagttcacctcacctgaaaattgagttgtcttaaactaaagggaaaagtttccgtgttgaaataaggtttt

SEQ ID NO: 38055 - DNA, 201 bp, Homo sapiens
ccccgctgctgctgctgcaaaaccagtggcgaccaagcctgaggtccctaggccacaggcagccaaaccagctgccaccaagccagccaccactaagcccrtgggtaagaaagcccttgctagggctgccatcttgtgacatcctcatttcctgctccagggtgtgttcctcaaagcctgcatgtaacacactcagaatac

SEQ ID NO: 38056 - DNA, 201 bp, Homo sapiens
gtccttgctgccaggaggctccaaggacaacttctgatgtgttgtgttttaaaagaattatttctttaaaaattgtctttgtatttgagtgagtgttttcktttgatgactcagcagacatttctttctttcaaggtcaatttattttagatgaatttaaattagaaccaagtattaaataatctatttttcctttatagg

SEQ ID NO: 38057 - DNA, 201 bp, Homo sapiens
cctttcttctctttgcttcttttctagcttgctgttacggtaagttgattttggtgactttctcctaaggaaaggaagcctcccttttgtagtaagtacartttgtctttaaccctccaccctctactttccacagggcccctggagtgccccgtcttcccaacagaactagcctttgctttagacacctctgagggagtc

SEQ ID NO: 38058 - DNA, 201 bp, Homo sapiens
ggttgcttgtccctaaacttgaatttaagagacattttagctcccttaaagtgagagatttttcgtggtgatggagtcccttgggttagatcacttttacygtaccttccaactataggagccttaaattctccactttctgacacagttgaacaatgtttgttctgctccctctagggaaattcgggacctccagggata

SEQ ID NO: 38059 - DNA, 201 bp, Homo sapiens
tttttctttcatcctccttgggctgttctggctcccgaggctctgtcagccgtctccttaaacagcctcttctgcagagtctagagaaaatggtgcccagyggggacttggggtccaagtgcaggaaacatgactgaggcagtagtgtcccgggcgggcgcctcttccagaacgtgctcacctatctggccatcagcaacc

SEQ ID NO: 38060 - DNA, 201 bp, Homo sapiens
cactttctgacacagttgaacaatgtttgttctgctccctctagggaaattcgggacctccagggatagttggacagaagggagaccctggctacccaggmccagctgtaagtatttatccagttctgacccggccacctggggctgggtgctttacacgtggtccctgaaaacttcccaccatctgctttgctcacaaga

SEQ ID NO: 38061 - DNA, 201 bp, Homo sapiens
aaggtttgtctttagaaaggtagagctttcctgaggacagggaccagccaggcacacatgcccctctccctctttggtcagtctgtctgtccctcctcttyagtactactggttcccactccagcctcccctgttgatcgcggcttggccagtggaatcattgtcccccaacaatccccaccataattcccaccaccatcc

SEQ ID NO: 38062 - DNA, 201 bp, Homo sapiens
ggcatcagtcctgccaaatgacaggaaaagctgggtgtctccaagagcaccccaaaccaaacactcaggttaccaggaaatgacaagagggtatctacaaygaactgcactcctcgctacgatagtctcagtatcattaattccctgatccatcacatttcggaatatcgggataataacaaagacctaccaaaaaatagt

SEQ ID NO: 38063 - DNA, 201 bp, Homo sapiens
cgctgaaggaggggacctgtatgctcttctttctgaagtgggcttgtagctgaggatgaaagcctgggtggggaggcgtggcttttacaaagatcaggatstaggaacagctgcctgtctggacttctttgtttagggggtttcttgctacccagaggtttagttctctcctttcctcactcatggtcgagagaagccagg

SEQ ID NO: 38064 - DNA, 201 bp, Homo sapiens; identical to SEQ ID NO: 8024

SEQ ID NO: 38065 - DNA, 201 bp, Homo sapiens
atatgcctcaggatggaatcctggaaaatctaaatctaccaaaatgcttagattctgcaaggtgtttcacctttggtccctggagatagccccttgtgctyatgtattttgtatagtgagtgcctcaagttcacccatgagttcagcacagaagatggcccttaaacttgctgtgactgcagatgttatcttgcaatgcag

SEQ ID NO: 38066 - DNA, 201 bp, Homo sapiens
tagacatgactgggccaattgtatagccctgaaggaaccatcattttgtgtttactaacgttttacttattgattctaagatgcacaattttcttctcatkgggacacttctgaaactgaaatgtgacttagaattgacaatatatcatggtttattggtagcattttgtgttacttagtggaacataaaataatggtgca

SEQ ID NO: 38067 - DNA, 201 bp, Homo sapiens
ccttccaagtgtccctgggtggaaatcaggggatatgcctcaggatggaatcctggaaaatctaaatctaccaaaatgcttagattctgcaaggtgtttcmcctttggtccctggagatagccccttgtgcttatgtattttgtatagtgagtgcctcaagttcacccatgagttcagcacagaagatggcccttaaactt

SEQ ID NO: 38068 - DNA, 201 bp, Homo sapiens
cccacagaaaaggggccctaagctgtgtgctgtggcaatactgggtgttcagtccagcagcttgaaaagtcagagcctggaccatcagtcattccccaagsctcaaatctatgctcatgctgaccatgagaaaaatattgaaagcaatggcaaaaaccacaatgactctgcaccaacttaatatatttcagactgaattag

SEQ ID NO: 38069 - DNA, 201 bp, Homo sapiens
gtagagaagtacaggtttttgtctttgaatagtgccgggttctcacctcactaatatatttctcttggttttccaaatatcttcttgtccacagtaacagygtccttattttccactagtaaatcttacagggtctcagtagtgactctcactgaaataagggcagaaaacaccagtgccgtggtgtggaactggagggct

SEQ ID NO: 38070 - DNA, 201 bp, Homo sapiens
gctctggtatgtccatggactgagaatcagaatatcttggcattagtcttgggtcagccactcagttaactgggctaccctgagaaagacccttccttccytaaaatactctctcatctgtcaagtggaggtcataatacgtacttgtcctggtgtttatgagatttaaataaaatatgctgcaatcaaagtactctgtaa

SEQ ID NO: 38071 - DNA, 201 bp, Homo sapiens
cgttttcatgcttcagaagtagagaagtacaggtttttgtctttgaatagtgccgggttctcacctcactaatatatttctcttggttttccaaatatctkcttgtccacagtaacagtgtccttattttccactagtaaatcttacagggtctcagtagtgactctcactgaaataagggcagaaaacaccagtgccgtg

SEQ ID NO: 38072 - DNA, 201 bp, Homo sapiens
ccagatgcaggaaggcatttttcatctaggatccttgaatctttaagatttctgtttcccaaaacgaattaaaagcatgggttctaattaactctattaaraatttgatttcagagttttagaaaagtgggaaatgcttcatgcattgcaagctggaaaggactcaggtgggtctccctctccttgacccagagagcttgg

SEQ ID NO: 38073 - DNA, 201 bp, Homo sapiens
atgagccactgggcctggccaacaaccacttatttaatttgcaattctgtgggttagcaatttttgtttgggctcaactgggtggttcttctgttttctcyttggatcccttatgtttgtggtcagctgcttgtcagctatagagctgctggtctagagtggtctcagatgggctggctcatctctgctccatgtggtctc

SEQ ID NO: 38074 - DNA, 201 bp, Homo sapiens
aaaagttccaaaataaaaggggtccctatattggtgtattagtttcccattgctgttataacaaagtaacacaaatttagtggccaaaaacaaaacaggcygggtgcggtggctcacacctgtaatcccagcactctgggaggccaaggcgggcccattgcctgaggtcaggagttggagaccagcctgaccaacatggtg

SEQ ID NO: 38075 - DNA, 201 bp, Homo sapiens
ttgctgtgactgcagatgttatcttgcaatgcagctatcagcaatgatgagcagagacacactgtcattgctgggctaggatcaggtgtcacggaattacrtattcgggtttccctcatgtctgagatgatattgagggaggcatcctatcatttattaccaaaaaatgactaataaactggtaacgagctcaatatgttg

SEQ ID NO: 38076 - DNA, 201 bp, Homo sapiens
aataggaagtcatgtgcatgttctatgaagactgacgggaggggtgggagtgggcaggactgtggcacccatgccgatgctgctgcctggcccatgtgccrtgtttcatgccctgctccatctcgggtgccaaccctaggagcaaagagggcagtgggggcatgtaacagagggctagctggggtgatgtggctgcaagaa

SEQ ID NO: 38077 - DNA, 201 bp, Homo sapiens
aaactgatcattccctttgccctgttttctcttttaggttcatatttggtgcttagacaaattcaaaatgaggaaacatcggcacttgcccttagtggccrtcttttgcctctttctctcaggctttcctacaactcatgcccagcagcagcaagcaggtaagagccagaaacgtccttgattttgtaaaaaggaatatca

SEQ ID NO: 38078 - DNA, 201 bp, Homo sapiens
tagatatttacggaaggtgcttgttaagccaaaggcttgtagaggtgggagtgtactgaagtccggtgcatcctgcaaagtgtgcaactgtcctgcagacrggctcttcctctgtgaatcgacccctttccctgcaatgtcttgtgcagcatttcagagctagacattcttctctgcagatgagaatctcatgctaatttt

SEQ ID NO: 38079 - DNA, 201 bp, Homo sapiens
aaatcctaatactgggggagggagggaataaggggcaagagggctgagggagttgtggatttgttgtttttgtaattatctgtgggtttttggggggatgmtgtaagtgaaataaaaaaactagatttcttctttttctggcatattgcatcttgcaatttcaagacatttcagaaatgtctgtagcagaatagctccttg

SEQ ID NO: 38080 - DNA, 201 bp, Homo sapiens
tgtgtcatgctttggagggaagtgcagattctgcagattctgaacttcgtacacagatgagatgtgaacgcaaatgatccttgaaaaatgactatctggcytacgactagctgactctcaagatggggaaagagagcccatctcttcctactgcagacccttctgtctatcaccacttaagtccttcagctctttcttttg

SEQ ID NO: 38081 - DNA, 201 bp, Homo sapiens; identical to SEQ ID NO: 8037

SEQ ID NO: 38082 - DNA, 201 bp, Homo sapiens
taagttgtttccatcttttggatattacaaataatgctgaaatgaacatgggtgtgcacatatatctttgagatcctgttttcacttcttttggatatacycaaaagtgggatagatgaattatatgataattctgttttcagttttttgaggaacattcatacgatggaggctagcctttccccactgtgtagctttgtt

SEQ ID NO: 38083 - DNA, 201 bp, Homo sapiens; identical to SEQ ID NO: 8042

SEQ ID NO: 38084 - DNA, 201 bp, Homo sapiens
cagtgagtgggaaaagtatgcatcctattcaaacctaattgaatcgaggagcccagggacacacgccttcaggtttgctcaggggtaagtgtgatttctcytctgtttttccaggtttggggctagaaggaaatgctcttaacctgaagtgatcctttctaggtagcgttagtggctcttacgttcatgctgatcgccagt

SEQ ID NO: 38085 - DNA, 201 bp, Homo sapiens; identical to SEQ ID NO: 8087

SEQ ID NO: 38086 - DNA, 201 bp, Homo sapiens
acgtagcctaagattagcagcagagtccccgtgaaggaagtctccgtggggaaccagagtgacccttgccaagtggggcttctcagcagaatctgtgcctsttagatatttacggaaggtgcttgttaagccaaaggcttgtagaggtgggagtgtactgaagtccggtgcatcctgcaaagtgtgcaactgtcctgcaga

SEQ ID NO: 38087 - DNA, 201 bp, Homo sapiens; identical to SEQ ID NO: 8043

SEQ ID NO: 38088 - DNA, 201 bp, Homo sapiens; identical to SEQ ID NO: 8044

SEQ ID NO: 38089 - DNA, 201 bp, Homo sapiens
ctggccgaggaggtcacatctcagttcttatcgcttgtcagatccctgtgttcttctgtttctactggtgatttctgtccagtctcctcctcatcaccaggatgtagctttcctttcctgagttgtccatctacttctaaacagccccagtctgagctgtttagggcacagtgtcctcagcttttaatccctctcttctct

SEQ ID NO: 38090 - DNA, 201 bp, Homo sapiens
tttttatcttcacgctctgatctatctttcagttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacggaccgcgtcat

SEQ ID NO: 38091 - DNA, 201 bp, Homo sapiens
ccagagcctctcctttgattactgggcccattggccgttggcttgggatggtaactccgacatctgggttccgtttcctcccattaacccacttgtgactygcagcaactcaattgaaacctcccatcgataaaatgctagtggttgtgcaggtgctgccatctcatgtctctcctcccatcccaagttttttcttgaata

SEQ ID NO: 38092 - DNA, 201 bp, Homo sapiens
gttacaccagtaggcaactgtgttattgtattaaggacgttggtgcataacatgttacccttctcttagaacatagaccttgtcttgatgctacaggtgakcacccagatgaggcactgctgtcttcatttggcatgtatcagcgattctcaccccaggcatcacgctcccagcttctggtccaaacaactagaaatgaac

SEQ ID NO: 38093 - DNA, 201 bp, Homo sapiens
ttacaccagtaggcaactgtgttattgtattaaggacgttggtgcataacatgttacccttctcttagaacatagaccttgtcttgatgctacaggtgagyacccagatgaggcactgctgtcttcatttggcatgtatcagcgattctcaccccaggcatcacgctcccagcttctggtccaaacaactagaaatgaact

SEQ ID NO: 38094 - DNA, 201 bp, Homo sapiens
tgggattatttaaacgttgaaattgtatttttacatgatttttaaatgttcaacatctgctgtatctagaaaattatttgttataaaacaaacaaagggtrcatcttcatgcaatggtaaaatggtttctaggggaaggctaacttattattattattgcaaattattatggtggtaagatatggttgtatcagatctacc

SEQ ID NO: 38095 - DNA, 201 bp, Homo sapiens
gtccaccccccgacccctccactgcaaaacaaaaacaaaaacaaaaacaaaaatccttattatctgacagttttgaaggctggaaattggaaaccagtgtygctaagctaaaatcaaggtgtcaacaggctgtgttctttctgcaggttctaagggattcttcatctgctcaccttttccagcctccaggggctgcctgca

SEQ ID NO: 38096 - DNA, 201 bp, Homo sapiens
tgattttccctggtaggtttggtagtggacaattcatgctactacttttccctccaaatttagtggaaatttctagaatatgtacccaagattgtcccctsagaaaagtgaatatgatgtttggaaatttaactatgaggatggcacaaatgaaaaattgctataaatgtcccttttttacaccatgatttctaagaggtt

SEQ ID NO: 38097 - DNA, 201 bp, Homo sapiens
aaatatagtagtaacccactggaaaagtgaatcaaaactaaccacttggctgcccgggaaaagtgtgacccacacgtctcctggatgtcttaccccacggrccctcagtgagatcttctgttccaaagcttactgtgccacttctcggctttcttcccagggtaacccaggtgaacctgggctaaatggaacaacaggacc

SEQ ID NO: 38098 - DNA, 201 bp, Homo sapiens
atagtagtaacccactggaaaagtgaatcaaaactaaccacttggctgcccgggaaaagtgtgacccacacgtctcctggatgtcttaccccacggaccckcagtgagatcttctgttccaaagcttactgtgccacttctcggctttcttcccagggtaacccaggtgaacctgggctaaatggaacaacaggacccaaa

SEQ ID NO: 38099 - DNA, 201 bp, Homo sapiens
cgtctcctggatgtcttaccccacggaccctcagtgagatcttctgttccaaagcttactgtgccacttctcggctttcttcccagggtaacccaggtgarcctgggctaaatggaacaacaggacccaaaggcatcagaggccgaagggtaagtttgcgtgggccttggctgcaggtgaggaatgagaacgtatgtctca

SEQ ID NO: 38100 - DNA, 201 bp, Homo sapiens
tttgaatgagacatcttaggaatagaaattattacctcagtaactcgttttttaaatgctatttaaaaatgccccaaaaactcaccaacaataattttgtratgtacatttctacgttacaaaagaataaagaaatctacggtccattgtgactttttccaaaaggagtcatggcacctaacactgtataaaaggaccagg

SEQ ID NO: 38101 - DNA, 201 bp, Homo sapiens
ttgctaagtggtccatctggacactagtctgctgctccattcatggcaaagttacatcactcatcagccggacagactctcctctgctatcaatcttcagrtggcaaggctgagaacattagatcatcctcatccctgatttcattagctgtatggggaaaatggaattcctgtgctacacaacagacaaccatgaagact

SEQ ID NO: 38102 - DNA, 201 bp, Homo sapiens
gcttgggagcattatcaaaccacagcacaagcactggagactgctcttctacattgtgttaacatatatccatgtccaaaaggcagtgaccattgcaaggsaaaaaaaatcgggctgagcttttgcaatactgccgctatcaccactcattgctgtcactttgttgcagaaaaatatctgttctgttgataactggcctcc

SEQ ID NO: 38103 - DNA, 201 bp, Homo sapiens
catctgacagggatgttgtgtaccaggcagcttttccaccctgacttacgggagcaaacttttcatggtgtcctggctgcagcaagcaggcagtaaaaaayacatcactgctacataaatagctgacgatttgaggagggacctgacatttaaagaaaatcctattagctctagctaagaaaatgaaagccgcaaaccctc

SEQ ID NO: 38104 - DNA, 201 bp, Homo sapiens
aagatattcccaatactgccctattgggaagttaatctattttattgatgtagctttgatttactcctctgccatattttcagatattactgatcatgtaygcccctaccaaaattgttcttttgtttaaaccagatcaataacacagcagtggggcatgcgcttgtcctgcctgcagggagagacctcacagacttcctg

SEQ ID NO: 38105 - DNA, 201 bp, Homo sapiens
ttggcatcacactgtaagccagccccaggccacagggtctcagccatgtttctcatgtctagggtgagcccggagagccaggaccaaaaggaggaatcggsaaccggggccctcgtggggagacggtaaggtcacagcgcgcttggggtcaggctgtcgctgactctttgctggaaggtgcaggaagccaggagagggttc

SEQ ID NO: 38106 - DNA, 201 bp, Homo sapiens; identical to SEQ ID NO: 8011

SEQ ID NO: 38107 - DNA, 201 bp, Homo sapiens; identical to SEQ ID NO: 8013

SEQ ID NO: 38108 - DNA, 201 bp, Homo sapiens
tggtgaggtgtgcatctgatcaaactcctctatttggtgttgggatctgtttcctttaaggaaagctccctgttggagagtgcgtgaactgagacgggagygagggcatctgtttttgtgtccagtggactagcagagagcttctctcttctactttacggagttaatttaagagtgttggtagaatcggaattacaagaa

SEQ ID NO: 38109 - DNA, 201 bp, Homo sapiens; identical to SEQ ID NO: 8015

SEQ ID NO: 38110 - DNA, 201 bp, Homo sapiens
gttcccaggtaagtgagtctaccttcctgtattatcagtgaggtgtgaagtgtttagtagcagtatagtgtaaaccaaatttgtttaggaaggctttgcaytgataggaagtaattgcttacatagtagaaaaatctaaaccaatgtctttttttaaagatgtcaaaaatggtgcggctgctgatataatatttctagtgg

SEQ ID NO: 38111 - DNA, 201 bp, Homo sapiens
tggacaaggcttgacatggtcccagctgctgtggttgggttgcatttggtgtaatttgggcaaagcccgttctctccataaactgaaactttcctctgagsttcttttaaacatgacttacaaacttaagctgggtgtcaaaacctgatgccttgtgcctatgagtgcttttactcctgacccatttccattctgctcttt

SEQ ID NO: 38112 - DNA, 201 bp, Homo sapiens
gagaatcagaatatcttggcattagtcttgggtcagccactcagttaactgggctaccctgagaaagacccttccttccctaaaatactctctcatctgtyaagtggaggtcataatacgtacttgtcctggtgtttatgagatttaaataaaatatgctgcaatcaaagtactctgtaagctgtgaaatgctataaccta

SEQ ID NO: 38113 - DNA, 201 bp, Homo sapiens
taaaagaattatttctttaaaaattgtctttgtatttgagtgagtgttttcgtttgatgactcagcagacatttctttctttcaaggtcaatttattttasatgaatttaaattagaaccaagtattaaataatctatttttcctttatagggagaaagaggattccctggatacccaggaccaaaggtaaataatccctg

SEQ ID NO: 38114 - DNA, 201 bp, Homo sapiens
cacatctctttcccactcttagggagatgacgggagagacggagttggcagtgaaggacgcagaggcaaaaaagtacgtatctgctgaggattatccaagygtccttgctgccaggaggctccaaggacaacttctgatgtgttgtgttttaaaagaattatttctttaaaaattgtctttgtatttgagtgagtgttttc

SEQ ID NO: 38115 - DNA, 201 bp, Homo sapiens; identical to SEQ ID NO: 8022

SEQ ID NO: 38116 - DNA, 201 bp, Homo sapiens
atgttctctgtaaaagaaatgagttcctgtgaatccacgatggtctctgcctggagagtgttttggggttttatgctgggctcaatgcccaccgccttccrtgccttcttctcccagttgttactctctcttctcatcagcccgtcccccatgccacgctggtgaaaaggacaaacaaaaccctcctggattcttttccag

SEQ ID NO: 38117 - DNA, 201 bp, Homo sapiens
aaattggcccaaatcctccagatgagctaatagagagactagaattttgaaaataatgttctgaatgcaaatggacattgagaagcaatggaaacagtgtrcaggactacatgcccggtgcctggagctgctcatgctcattccatcatggtgccgttttgtgactctggcaattaagaaaacaatcaagtgaaaatttat

SEQ ID NO: 38118 - DNA, 201 bp, Homo sapiens
aaggaatttgtaggtagaaacactctgaaatgaaaaggttcctagtcctgggcacctaaggcaggggaagaggagaggaccagtgttaccattggttttcrtttgcatatgttaatgtttgcccattttgacagtcacattgaatagatgcttgtttatcaggaatgtgagtcaggcatgtaatgcgagggcagtctggtt

SEQ ID NO: 38119 - DNA, 201 bp, Homo sapiens
ttaagcgtgtgaggaacggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcaggtctgtgctctgtgcgtgctgttggcat

SEQ ID NO: 38120 - DNA, 201 bp, Homo sapiens
tgagattattaaacatcaccgtattaactacttataatccagtcttcctaaaaatgggcttgaggggctcattacagttctgagaaagttactccaggacyatggcattgagctctaaaagtcagtgttagaagtgtgctcatagacagagtatctttccaaaagcaaagatggagtgagggtgtctcctcaaagtcattt

SEQ ID NO: 38121 - DNA, 201 bp, Homo sapiens; identical to SEQ ID NO: 8029

SEQ ID NO: 38122 - DNA, 201 bp, Homo sapiens
ctcttagggagatgacgggagagacggagttggcagtgaaggacgcagaggcaaaaaagtacgtatctgctgaggattatccaagcgtccttgctgccagsaggctccaaggacaacttctgatgtgttgtgttttaaaagaattatttctttaaaaattgtctttgtatttgagtgagtgttttcgtttgatgactcagc

SEQ ID NO: 38123 - DNA, 201 bp, Homo sapiens
cagacatttctttctttcaaggtcaatttattttagatgaatttaaattagaaccaagtattaaataatctatttttcctttatagggagaaagaggattycctggatacccaggaccaaaggtaaataatccctggtcggtgaagcatcatcatgattttgggatggctctggtatgtccatggactgagaatcagaata

SEQ ID NO: 38124 - DNA, 201 bp, Homo sapiens
agcagaaactgctgacgcccatcacgaccctgacctcagagcagatccagaagctcttagccagcactcgctatccacctccaggtgagatgggggcgtcrgaggttctccttggagcattttccatatgaaaaataacaggctcaaaggccatggtactcataataaattaaattaaaataaaggttgtatgcccttacc

SEQ ID NO: 38125 - DNA, 201 bp, Homo sapiens
tcacggtcacggaccgcgtcattggaggcctgctcgctgggcagacataccatgtggctgtggtctgctacctgaggtctcaggtcagagccacctaccayggaagtttcagtacaagtaagtacatgatcagtacaagtcggtacctgatttctatgtagagtatcaaataggacacaaaggagacacttacttattgaa

SEQ ID NO: 38126 - DNA, 201 bp, Homo sapiens
gtcatggaggattttattttttatcttcacgctctgatctatctttcagttaagatgtcccgtgaagtccaggtgtttgagataacagagaacagcgccaractccactgggagaggcctgagccccccggtccttatttttatgacctcaccgtcacctcagcccatgatcagtccctggttctgaagcagaacctcacg

SEQ ID NO: 38127 - DNA, 201 bp, Homo sapiens
tataatgttgccacctacagtcattgaagtcaacaagagagacatagtcttcctggtggatggctcatctgcactgggactggccaacttcaatgccatcygagacttcattgctaaagtcatccagaggctggaaatcggacaggatcttatccaggtggcagtggcccagtatgcagacactgtgaggcctgaatttta

SEQ ID NO: 38128 - DNA, 201 bp, Homo sapiens
ctgttccaaagcttactgtgccacttctcggctttcttcccagggtaacccaggtgaacctgggctaaatggaacaacaggacccaaaggcatcagaggcygaagggtaagtttgcgtgggccttggctgcaggtgaggaatgagaacgtatgtctcaatgtgattaactgctgaggctttgacaattatccttcacttgc

SEQ ID NO: 38129 - DNA, 201 bp, Homo sapiens
tcaaatatactcctccattttaagtgcaatatcaaagtcttgtgaacatgggtaatcattcctcaacttgggccctcagtttccttaagtgtaaaatgaarggcttgagacagcgagtctctcagttttctatcagcagtctgcaacactcctttttagttttcctgggatttgacagctctcttatctgcaggtggtcat

SEQ ID NO: 38130 - DNA, 201 bp, Homo sapiens
gcaacaagggcggtcctggccagccgggctttgagggagagcaggggaccagaggtgcacaggtgagtgcttccgtgtgtgactgtgtgccctctgatatytcacaaatcatttaaaaaatgattgggtggcatttatatccggaaagttaaccattttaaagtgaacaatccagtggcatttggtacttccacaatgctg

SEQ ID NO: 38131 - DNA, 201 bp, Homo sapiens
cgctggcaatttctatcatatcgtcagtcgtccagcaaatgtcacctggagggacttcatctcacaccgtgaaacccccacacatccgattttgacccttraagcgcatttatgattttctgctgggcatttcttgagatctgaacatttggtttctcttcctttcggtaggacaacattgccgagaaagcttgctgtggg

SEQ ID NO: 38132 - DNA, 201 bp, Homo sapiens
ctcatgtttttattaaagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctggtaagtgattcttccttg

SEQ ID NO: 38133 - DNA, 201 bp, Homo sapiens
tttctaactggggctgcagaaaacccatcattcatcagagcccagggcaacagatggaagagagcagtcgcaggactatggcctgttcgagcaacaggcarggagccttcttttacacaaaagggaggctgggagagattggccgaccattgctgacagaggcagtaaggaagtagaatttcccaggttactgcaataaat

SEQ ID NO: 38134 - DNA, 201 bp, Homo sapiens; identical to SEQ ID NO: 8046

SEQ ID NO: 38135 - DNA, 201 bp, Homo sapiens
ttccaggaaactggtttttcacttctggaatcttcattagttgattcagcagcccagggccggtacccagagttagcgccaactcagctaaacccacagcyggcccggcggtgcaccagggtgctctgtttctaactggggctgcagaaaacccatcattcatcagagcccagggcaacagatggaagagagcagtcgcag

SEQ ID NO: 38136 - DNA, 201 bp, Homo sapiens
ggcatctaaaagaattatgctccagccacttttctgtcacacatctgctgcctgtaaatggcagtgagcagcagtggatctttcattcgttaccgtggccycctgaaagcatgggtgtgctgggcctttctgccacctgctttgtcgctgctgattttgacagtgctacgtagttgctaattttggtttcaggcttttgtt

SEQ ID NO: 38137 - DNA, 201 bp, Homo sapiens
agatcgtgctgtctccagcgtttatcctggctgcagagtcgcttcccaagattggagatcttcatccacagatagtgaatctcttaaaatcagtgcacaayggagcaccagcaccaggtatggtagagaaatgctagttgctctgccactcagttctctaatgcatgagttgagggtaggctgctggccactggtccttag

SEQ ID NO: 38138 - DNA, 201 bp, Homo sapiens
attcttggggaatattaaaaaaatgactaagacatagccccctctcttctggttggcaaacatataatttctgtttggctaattgaaatatcaaaaaaackactaccttggtggatggtttctccacgccctttatgcttcagatgaagaaagagagctcagagaggtatgcccagtgacagggccacagagctagtagca

SEQ ID NO: 38139 - DNA, 201 bp, Homo sapiens; identical to SEQ ID NO: 8049

SEQ ID NO: 38140 - DNA, 201 bp, Homo sapiens
aatgactgtagagcaaagagctgacattgacaggaaccatcctgactcctccctgcatcttctcttatttcaaagggcaacaagggcggtcctggccagcygggctttgagggagagcaggggaccagaggtgcacaggtgagtgcttccgtgtgtgactgtgtgccctctgatatttcacaaatcatttaaaaaatgatt

SEQ ID NO: 38141 - DNA, 201 bp, Homo sapiens
cctttggttggtctttgtgttctcatgtttacttaagtttaacaagacctattgtgcatcatggccttgagccctgaggttcagggaggggatatatcccyaatgctaaatgacgagttgatgggtccagcacaccaacatggcacatgtatacatatgtaacaaacctgcatgttgtgcacatgtaccctaaaacttaaa

SEQ ID NO: 38142 - DNA, 201 bp, Homo sapiens
gctggggtgaggggctttcaaaaggagcgactcaccaaaatcaaattgatggactatgggcatcattttgctttgaaaattcagaagaaaatagaaatttkgaaaatatcattttaaaatgtttgagcactatttatttatttatttttaataaattgtaaagacctggatcaactgcttggaagtgagcattatttttga

SEQ ID NO: 38143 - DNA, 201 bp, Homo sapiens
cctgtttggggctaagagtgctttgctgatcccgtgattgggtttcgtaagacctgcatggatgttacctggatgggttgtggccgaagggcttgtccctygaagccttgcatgcaggtccttgctaatatttccctgaccatccagtccagtggcagctgctttccttccatatgtggctcatttccctttcccatgttg

SEQ ID NO: 38144 - DNA, 201 bp, Homo sapiens
acgctggtgaaaaggacaaacaaaaccctcctggattcttttccaggagtttgcacatgaatgttgcaatttagaaaatcattccaccgaaatctcaaagrtgaagtcagcatgttgcagcacccttacctagagcaaaagcatggcttggcatcacactgtaagccagccccaggccacagggtctcagccatgtttctc

SEQ ID NO: 38145 - DNA, 201 bp, Homo sapiens
ttttttctgtgcttcactgcagttcactcaaacaaaagggatatcatctttcttttggatggatcagccaacgttggaaaaaccaatttcccttatgtgcrcgactttgtaatgaacctagttaacagccttgatattggaaatgacaatattcgtgttggtttagtgcaatttagtgacactcctgtaacggagttctct

SEQ ID NO: 38146 - DNA, 201 bp, Homo sapiens
tacattgctcctaagcaaaactatattgaaaactgagtgggtggccgttgatgacattactgggacttctgaggtttttgttgggctaaagataatggaakagatttttggtcagaagccactgatgcagtagtttcctggttttcaaaatgagcaaccaggggctctgagatgcggaattccttgcccaggccagggagc

SEQ ID NO: 38147 - DNA, 201 bp, Homo sapiens
gctggtcctccagggctgataggagaacaaggcatttctggacctcgggtaagcctgtcctaataccagccccctctctagctgaacagagggcacatttycaagcaggctgagagagtttctcggatgatgctattgtagacagacctccctttagctctcctctttggcaacaaaaaccccagatttaacctcaggcct

SEQ ID NO: 38148 - DNA, 201 bp, Homo sapiens
catgacctcctccccagtcctcttctatctcggcagctaccatggggtgctcaggtcagtgtgctctgagctgtgacccttggtgaccaaccctgggatcygccaggcacccaacaccagcctcttgcaggaacttgcggagcagagagctgtgggcccagctcccatagcggtgggctgagtgctccacttcccaaggga

SEQ ID NO: 38149 - DNA, 201 bp, Homo sapiens; identical to SEQ ID NO: 8059

SEQ ID NO: 38150 - DNA, 201 bp, Homo sapiens
tgctggtcctccagggctgataggagaacaaggcatttctggacctcgggtaagcctgtcctaataccagccccctctctagctgaacagagggcacattktcaagcaggctgagagagtttctcggatgatgctattgtagacagacctccctttagctctcctctttggcaacaaaaaccccagatttaacctcaggcc

SEQ ID NO: 38151 - DNA, 201 bp, Homo sapiens
atcagcaacccgcaacttcccggtgtctcggtcctctgctttaggtctaaatgatccctgtttcacaaagctgtccgaggagaggtgaggcaagagtgagraacaattgtagaagtgcagggagacagctggctcctgtgctcagtgtctcacctggggttaccgctttgatcatctgttacctctggaagagctgagttt

SEQ ID NO: 38152 - DNA, 201 bp, Homo sapiens
tgaactaaaggtcacctctggagcatccaggaagatgttgccaagtcgtgagccctacctaagtacacgagacgtttaggtgcacatgtgtgtgcttcagrtattttacttaaccgagtgtgtgttgtgtttggccgggatcacttggagaacctgggactcccttccattataattaatgtatttcatgacttctcagta

SEQ ID NO: 38153 - DNA, 201 bp, Homo sapiens
ataagaccttattcttcattttccttccagagtatgggctcaatgaaaattggtgaatggataccgaggctcctataagactctgattatcatctgcaacmaatcatctaaattttcttgggtgaaataacacattgttacaactcttatttgctaactttataaataaagtctgggtctacaagataaatattgtaataa

SEQ ID NO: 38154 - DNA, 201 bp, Homo sapiens
tgcttatgtattttgtatagtgagtgcctcaagttcacccatgagttcagcacagaagatggcccttaaacttgctgtgactgcagatgttatcttgcaawgcagctatcagcaatgatgagcagagacacactgtcattgctgggctaggatcaggtgtcacggaattacgtattcgggtttccctcatgtctgagatga

SEQ ID NO: 38155 - DNA, 201 bp, Homo sapiens
tgccaaatgacaggaaaagctgggtgtctccaagagcaccccaaaccaaacactcaggttaccaggaaatgacaagagggtatctacaatgaactgcactsctcgctacgatagtctcagtatcattaattccctgatccatcacatttcggaatatcgggataataacaaagacctaccaaaaaatagtgaaaggggctc

SEQ ID NO: 38156 - DNA, 201 bp, Homo sapiens
gatatttcacaaatcatttaaaaaatgattgggtggcatttatatccggaaagttaaccattttaaagtgaacaatccagtggcatttggtacttccacartgctgtgcaatcatcacctctatctaggttcaaaacacagtctcgaaggagacctgtacccattagcagtcactccccatcaccctccaccccgagtccc

SEQ ID NO: 38157 - DNA, 201 bp, Homo sapiens
tttagaaaagtgggaaatgcttcatgcattgcaagctggaaaggactcaggtgggtctccctctccttgacccagagagcttggcctctgagggattcttyctccaggccaggttgctcttagatggagggaagtctagtgtcacttcaatggaagaagaacgtgggttggggcatcaggtcagcctgaggtaagtagagt

SEQ ID NO: 38158 - DNA, 201 bp, Homo sapiens; identical to SEQ ID NO: 8067

SEQ ID NO: 38159 - DNA, 201 bp, Homo sapiens
ttgcaggtctgtgctctgtgcgtgctgttggcatctccctttcttctggggctctgagaaggttctcagacacgtccatgctcctttgtggcttcatgtcvcatagctcctaaaacgtccccaatgaggccatctgcctgagaacttctcttgtgaggtctccaggacaacctcgtggctccagcactacagggacgccta

SEQ ID NO: 38160 - DNA, 201 bp, Homo sapiens; identical to SEQ ID NO: 8068

SEQ ID NO: 38161 - DNA, 201 bp, Homo sapiens
acactcacaggggttgacctgggggcgttacacgccagcattttgaggctgccctgcacacactgttgctagaaaagtaaagcagagaagaagagggatgygggccactgaggtggagtgctgtcagcacacctggaagcagccagcacagctgcaggggagcacagaggcgggccgaggagcaaggtataaacagcatca

SEQ ID NO: 38162 - DNA, 201 bp, Homo sapiens
tcggcatctaaaagaattatgctccagccacttttctgtcacacatctgctgcctgtaaatggcagtgagcagcagtggatctttcattcgttaccgtggsctcctgaaagcatgggtgtgctgggcctttctgccacctgctttgtcgctgctgattttgacagtgctacgtagttgctaattttggtttcaggcttttg

SEQ ID NO: 38163 - DNA, 201 bp, Homo sapiens
attccattaatatacctagggcatcgttagcaaccactcaggattccagctttacaatattacatgatttgattttcagtggttaatatttgtattttttwaaataaaaccaaatgaacccccacaaaaacatctcactccactttttgctttgctcggcatctaaaagaattatgctccagccacttttctgtcacacat

SEQ ID NO: 38164 - DNA, 201 bp, Homo sapiens
ctgccaccaagccagccaccactaagcccatgggtaagaaagcccttgctagggctgccatcttgtgacatcctcatttcctgctccagggtgtgttcctyaaagcctgcatgtaacacactcagaatacagtccttgatctgggcttgtacacctggatgatgtattttaagaggtgttggttagggattccagcctccc

SEQ ID NO: 38165 - DNA, 201 bp, Homo sapiens
ggttacaatgtggtctcattttcatcttgccccattgtgatcacagagtagccttgtctgttgtgggggtcctgtgagatcatgtgtgctcaacaggagarccccaaggccatgtgtgctggaccagctccccaatgcgggggctgattctctctttcttaaacagctccatcacaagagctgctcagcttccactatgct

SEQ ID NO: 38166 - DNA, 201 bp, Homo sapiens
acggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagccctt

SEQ ID NO: 38167 - DNA, 201 bp, Homo sapiens
gacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagccct

SEQ ID NO: 38168 - DNA, 201 bp, Homo sapiens
agacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagccc

SEQ ID NO: 38169 - DNA, 201 bp, Homo sapiens
ttcattaattatttgctcattcattcattcaaactagctatttgttaaatgaataattactaatcgtgtgccaggtacggcgatagacaggactctttgcmcccactgggagtgattttgttacttgctttaaccacacctgagagggtggggaagggatggagctcccatattgttgctaaaaataacgataagattaag

SEQ ID NO: 38170 - DNA, 201 bp, Homo sapiens
catgtgtgcacgtgttgtaggcacacatgataaaactctccgtggttgtgtatgtctcacttttttttctgtgcttcactgcagttcactcaaacaaaagrgatatcatctttcttttggatggatcagccaacgttggaaaaaccaatttcccttatgtgcgcgactttgtaatgaacctagttaacagccttgatattg

SEQ ID NO: 38171 - DNA, 201 bp, Homo sapiens
tcctggacagcagcagaagaggctgtctgggaagtgagaggatttgttcagaagttcagggatcccctcccgtcgcttattagctcatggatccaacttgyagcccacagcataagtcgtggatgtagaggtgtcttggatctgtgtctttcaatcaccactccccaacataagacattaatcacagcaggcaaccttata

SEQ ID NO: 38172 - DNA, 201 bp, Homo sapiens
ccccacccatttaaagtaatgtgcacgccacttagcgtccctgcgtctcagatttttcacctgtaaattgagactggggcaggatgattgctaatgtcttyccttccacattggatattctatgcttttaccacagcctgtgtcggcgaaagacattgggtcatcactgccattcctcagggcttgttctgccgaacacag

SEQ ID NO: 38173 - DNA, 201 bp, Homo sapiens
ggagtgcaatggcgtgatctcggctcactgcaacctccaccttccagttttaagtgattctcctgcttcagcctcctgagtagctgggattacaggcactygccaccatgcctggctaatttttgtatttttctttcttttttttttttttagtagagacgggggtttcaccatattggtcagactggtctcgaactcctg

SEQ ID NO: 38174 - DNA, 201 bp, Homo sapiens
tgcacatgtgtgtgcttcagatattttacttaaccgagtgtgtgttgtgtttggccgggatcacttggagaacctgggactcccttccattataattaatrtatttcatgacttctcagtacagttgggaaggtggaagaaaaatagacaggttgacattcccttttcacattcctcatttgaaactggctgggatcgtgc

SEQ ID NO: 38175 - DNA, 201 bp, Homo sapiens
gcagtgagccaagatcatgccattgcactccagcctgggcaactagagtgaaactccatctcaaaaaaaaaaaaaaaaattctttgtagctatcttatttragaatagaatgggaggcagctctgtctgatgcagttcccagcttgacttttccctttggcttagcgattttggggttctgagatttatttttctttcatc

SEQ ID NO: 38176 - DNA, 201 bp, Homo sapiens
ctggaagagatcgctttcgactcctccctggtgttcatcccagctgagttccgagccgccccattgcaaggcatgctgcctggcttgctggcacctctcasgaccctctctggaacccctgaaggtatggtggtgatggcttcagacacacaatggggtggtctccaggcagggcctttaagaacaaaacaaaatgaagtg

SEQ ID NO: 38177 - DNA, 201 bp, Homo sapiens; identical to SEQ ID NO: 8020

SEQ ID NO: 38178 - DNA, 201 bp, Homo sapiens; identical to SEQ ID NO: 8021

SEQ ID NO: 38179 - DNA, 201 bp, Homo sapiens
ccaaaggcttgtagaggtgggagtgtactgaagtccggtgcatcctgcaaagtgtgcaactgtcctgcagacgggctcttcctctgtgaatcgaccccttkccctgcaatgtcttgtgcagcatttcagagctagacattcttctctgcagatgagaatctcatgctaattttccccacaccagggtgtcccagggagaga

SEQ ID NO: 38180 - DNA, 201 bp, Homo sapiens
ggatatgcctttgtctcccatgagcagagggatgactttcagttctgtctgtcctttgtccacaaggaatttccctgtgggcagaatgtgagggaggtatkcagcttaaaaaaaaaaaaatctggccaggacggtggctgatgcctgtaatcccagcactctgggaggctgagacaggcggatcacctgaggttgggagtt

SEQ ID NO: 38181 - DNA, 201 bp, Homo sapiens
tgttgcttgtatacattttaagctcacttgcctattcacgatctggattgaggcagctgctactgcagctaagacaggataattgtgggttttggtggccrtttttggccagcagaagtgaggttccaggccctgtgggatgggcagatgccatgcagaggcttctcatggaaagtcacctcattagcactcacgatggtc

SEQ ID NO: 38182 - DNA, 201 bp, Homo sapiens
gccccatggtaaggtgctgcacattcctagactctccctgtactgagggcaagagaaaggacacacttctcggctcatcagcagccacagaggccaaagaygtggcctttaacactgcaacgtagcctaagattagcagcagagtccccgtgaaggaagtctccgtggggaaccagagtgacccttgccaagtggggcttc

SEQ ID NO: 38183 - DNA, 201 bp, Homo sapiens
tgtatgccttttgatgaaaaatgaagactccagagcctctcctttgattactgggcccattggccgttggcttgggatggtaactccgacatctgggttcygtttcctcccattaacccacttgtgacttgcagcaactcaattgaaacctcccatcgataaaatgctagtggttgtgcaggtgctgccatctcatgtctc

SEQ ID NO: 38184 - DNA, 201 bp, Homo sapiens
cagaacctcacggtcacggaccgcgtcattggaggcctgctcgctgggcagacataccatgtggctgtggtctgctacctgaggtctcaggtcagagccayctaccacggaagtttcagtacaagtaagtacatgatcagtacaagtcggtacctgatttctatgtagagtatcaaataggacacaaaggagacacttact

SEQ ID NO: 38185 - DNA, 201 bp, Homo sapiens
ctaccctcccagatctcattcccttcagggaaactgcaggttccaggccaggcctcatgcaggggcccaagaggctccctggctcacgtagcctcgatcgrcgttccccatggtgaaatctgctttctgctgcatgctgttcacagtaccctttacgctgctgcaagcccggcagagaaagggtgatgaagggctccagct

SEQ ID NO: 38186 - DNA, 201 bp, Homo sapiens
attgtacctaaaacagccttcatcttcatattcacccaatgcctttatattgttataattccttcattacattcattaaaaattaaaggagtagaagaggyagataactttccaccataaactctgcattaaaatcccccaactgctaattgacactgccatgacttttcatttaacccctttaatttagtgataaaaatg

SEQ ID NO: 38187 - DNA, 201 bp, Homo sapiens
tcatttactaggcagctttgtgtgtgtggcttgacggagcatcatgttcttgagcttcatccacattgcagcatgtagaagcacttcattcctttacatgrtggaaggatactctgttgtgtggctacagcacactttgtttatccactcattggttgatggagatttaggttgttgccatcttctggcaattgtgaatga

SEQ ID NO: 38188 - DNA, 201 bp, Homo sapiens
gtctttgtgttctcatgtttacttaagtttaacaagacctattgtgcatcatggccttgagccctgaggttcagggaggggatatatccccaatgctaaawgacgagttgatgggtccagcacaccaacatggcacatgtatacatatgtaacaaacctgcatgttgtgcacatgtaccctaaaacttaaagtataataat

SEQ ID NO: 38189 - DNA, 201 bp, Homo sapiens
gatctcaggaagttgaagctgcagtaagctctgatcatgccactgcattccaacctggacaacagagctatactctgtctcaaaaaaaaaaaaaaaaaaaagggaaaaaagaaagaaatgtgaaatccaagttgttaaataaacagtaaaaaaacaaaatttgctatatttctttggaggtttcttggagctcttccaaaa

SEQ ID NO: 38190 - DNA, 201 bp, Homo sapiens
ttgatctgggcttgtacacctggatgatgtattttaagaggtgttggttagggattccagcctcccactccccatcctgtgccctcaatcctgtcttgcgrtagggatgggaagctctcattctctctggaatgtcagtgggggcacagttcacctcacctgaaaattgagttgtcttaaactaaagggaaaagtttccgt

SEQ ID NO: 38191 - DNA, 201 bp, Homo sapiens
agactggacaatgacgatgtcacttactctctcggaacttcttttcttttcttcttttcttttcttttctttttttcttttttctcttctcttctcttctyttcttttcatttcttttctttctttcctttttctcttttttggagtctcactctgttgcccaggctagagtgcagtggcgccatctcggctcactgcaac

SEQ ID NO: 38192 - DNA, 201 bp, Homo sapiens
tgcaaggtgcacaccaaacctgggtgagggctacttacacactgaatgtttccctttttcttctttgatctgcagcagttgagagtgatgctgcagacatygtctttctgatcgacagctctgagggagttaggccagatggctttgcacatattcgagattttgttagcaggattgttcgaagactcaacatcggcccca

SEQ ID NO: 38193 - DNA, 201 bp, Homo sapiens
acatcacaggtaatggcaacgccaccaagctacgccctgccctgctgttcttgggagatgagcttggcaactgctggccttaaagcaacagctaggatggygggtgggccagggaagagatgagtgttcacaggtttaaaaacaaaggtttgatttggaatattcttccatagtcttctccccaagtagggcattcaccta

SEQ ID NO: 38194 - DNA, 201 bp, Homo sapiens
aacctttggcctcagctgtttctcttcttgtacaacaaagatatagatcccagtggccttggtctcttctggtagcaacagttcatgattctgtagattayggtagcccaagattgatttctaaatgctccttacattttagaaatcagtagtaacccagaccacaatgccaaaatttaaatagagtaaattcagaaagac

SEQ ID NO: 38195 - DNA, 201 bp, Homo sapiens
gcccacaggtgaggggacatgtggcaaatgtccaaacctggggtctgaatgatatttttgatacgaggtaggcacctttctgaaaaattgtctttacttcmcacttcattttatttctaaagcattcaggactcagcaaattgcactgactttatcatcagtgccttttgtgatttcctatcctagaacttaatacgtccc

SEQ ID NO: 38196 - DNA, 201 bp, Homo sapiens
acaccacaccactgtgcaaagctttcttcagtgaggccccaagggtcagcccatggagaggccaagtgtcgcttgtaattctattaaataactggtttaawtgtggggttttttttttttttttttttttttgagacagagtcttgctctgtcacccaggctggagtgcaatggcgtgatctcggctcactgcaacctcca

SEQ ID NO: 38197 - DNA, 201 bp, Homo sapiens
ctcttctctcggctcctcacctcaccccacccaccccctctctcgacgctcagtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttc

SEQ ID NO: 38198 - DNA, 201 bp, Homo sapiens
atccagggtggccctggaggcctgtagtctctcagtgaggtccccaaaactatgccgactcagcacccccaatctacaccacaccactgtgcaaagctttyttcagtgaggccccaagggtcagcccatggagaggccaagtgtcgcttgtaattctattaaataactggtttaaatgtggggtttttttttttttttttt

SEQ ID NO: 38199 - DNA, 201 bp, Homo sapiens
ctgtcccaatcggccctgaaggtgaatatccagggtggccctggaggcctgtagtctctcagtgaggtccccaaaactatgccgactcagcacccccaatytacaccacaccactgtgcaaagctttcttcagtgaggccccaagggtcagcccatggagaggccaagtgtcgcttgtaattctattaaataactggttta

SEQ ID NO: 38200 - DNA, 201 bp, Homo sapiens
cattcaacagggctgtgataggaagactggggaagggaattttagatcaggtggatggaaggccctgagaaggtgtggaaccgaaggcagatgagcatgcrgagagcagggggaagagtggtccaggcagaaggaagagcaggaggggtggccctgcaacaagaaggcacttagtcccttcccagaactgtcagaaggcag

SEQ ID NO: 38201 - DNA, 201 bp, Homo sapiens
tcttagacatcaggcactgacatagagcttagatatgttcttaaggtagctaagccatttattataggatagtcagataggatagttctaggatttatagrccttttcagatactctttatccagtgagagatgacctatttttattaaaacttgggtttggtatcttggaattggcttgaaaatgatttgtttttacatt

SEQ ID NO: 38202 - DNA, 201 bp, Homo sapiens
ctcaatcactctctgtggctctccctgtacctttgctaagtggtccatctggacactagtctgctgctccattcatggcaaagttacatcactcatcagcyggacagactctcctctgctatcaatcttcaggtggcaaggctgagaacattagatcatcctcatccctgatttcattagctgtatggggaaaatggaatt

SEQ ID NO: 38203 - DNA, 201 bp, Homo sapiens
cgtgacatggtgtactgaggggaaaagcagtaacagggaaagccatgctgagttttagtgctgctctgccaaatgaagggggaccacagggattcttactstagagcaaagaagaccacgggattaaacagaggacccgattactttgtttcagggtattcctggagaagacggctaccgaggctatcctggtgatgaggg

SEQ ID NO: 38204 - DNA, 201 bp, Homo sapiens
cacaggtaatggcaacgccaccaagctacgccctgccctgctgttcttgggagatgagcttggcaactgctggccttaaagcaacagctaggatggcgggygggccagggaagagatgagtgttcacaggtttaaaaacaaaggtttgatttggaatattcttccatagtcttctccccaagtagggcattcacctacata

SEQ ID NO: 38205 - DNA, 201 bp, Homo sapiens; identical to SEQ ID NO: 8050

SEQ ID NO: 38206 - DNA, 201 bp, Homo sapiens
tcacgttggccacagtaaatgagggtgtcctttaaatggagttagctttgttgaaagtcattgttgattgtgcttggtaaggccattctaattgccttatratgttgccacctacagtcattgaagtcaacaagagagacatagtcttcctggtggatggctcatctgcactgggactggccaacttcaatgccatccgag

SEQ ID NO: 38207 - DNA, 201 bp, Homo sapiens
attcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaaggtatgtatcctcttct

SEQ ID NO: 38208 - DNA, 201 bp, Homo sapiens; identical to SEQ ID NO: 8054

SEQ ID NO: 38209 - DNA, 201 bp, Homo sapiens
ttggcttgtgccaatagtgcagcaccctctgagccatcagagcagccgggcagtgcttggtacagtttcagtataatatggaacgagcagtctttaaacaygggcagtgcacgcacagtggctcagctaatcacatttagatcatccaagagccccgaccctgactgtcctggataacagcaagtctgctgtatgaaggct

SEQ ID NO: 38210 - DNA, 201 bp, Homo sapiens
tgcaatcatcacctctatctaggttcaaaacacagtctcgaaggagacctgtacccattagcagtcactccccatcaccctccaccccgagtccctggcarccactaatctctctctctttatggatttgcccactatggatattttgtataaatggaatcatttactaggcagctttgtgtgtgtggcttgacggagcat

SEQ ID NO: 38211 - DNA, 201 bp, Homo sapiens; identical to SEQ ID NO: 8056

SEQ ID NO: 38212 - DNA, 201 bp, Homo sapiens
tgtgcaatcatcacctctatctaggttcaaaacacagtctcgaaggagacctgtacccattagcagtcactccccatcaccctccaccccgagtccctggmagccactaatctctctctctttatggatttgcccactatggatattttgtataaatggaatcatttactaggcagctttgtgtgtgtggcttgacggagc

SEQ ID NO: 38213 - DNA, 201 bp, Homo sapiens
catctgccttgtagctgggagaagaccagtggtgtagaagtttgtaacctctcagaggaaattcaggatgctggtgggtgcctaggggaggtctctgctcrgaaatgaacagagcacaaaggctgcaagctggggctgggtgctgggaactgggccctcagccacgccctgaggggcagtggctcgttcggcccggcactt

SEQ ID NO: 38214 - DNA, 201 bp, Homo sapiens
tcttctctttgcttcttttctagcttgctgttacggtaagttgattttggtgactttctcctaaggaaaggaagcctcccttttgtagtaagtacagtttrtctttaaccctccaccctctactttccacagggcccctggagtgccccgtcttcccaacagaactagcctttgctttagacacctctgagggagtcaacc

SEQ ID NO: 38215 - DNA, 201 bp, Homo sapiens
cttctcttttttgctttgcaagggataagatcaggtttagagggagaggctgtaaacaatcaaggttatccaggggcccctttgtcttgctctgtgtattyctgggggccaaagcctgtttattcgaattccccatctgctgtgcctctcacctttcgttccttggttttacagggtcccaagggcaacaggggcgactcc

SEQ ID NO: 38216 - DNA, 201 bp, Homo sapiens
ctgctgcatgctgttcacagtaccctttacgctgctgcaagcccggcagagaaagggtgatgaagggctccagcttgcaaaatgcctttgtctctcacaayagggtgagcgtggtccgcctggtgtgaacggcactcaaggtttccagggctgcccgggccagagaggagtaaaggtgaggcgtgggtgatggggttgcta

SEQ ID NO: 38217 - DNA, 201 bp, Homo sapiens
atgacatagtaggaaacttagtgtcctgtgtgcattcatccgtgagtccagaaagggctggggacacggaaacccttaaagacatcacaggtaatggcaaygccaccaagctacgccctgccctgctgttcttgggagatgagcttggcaactgctggccttaaagcaacagctaggatggcgggtgggccagggaagaga

SEQ ID NO: 38218 - DNA, 201 bp, Homo sapiens; identical to SEQ ID NO: 8062

SEQ ID NO: 38219 - DNA, 201 bp, Homo sapiens
cgctgctgcaagcccggcagagaaagggtgatgaagggctccagcttgcaaaatgcctttgtctctcacaacagggtgagcgtggtccgcctggtgtgaayggcactcaaggtttccagggctgcccgggccagagaggagtaaaggtgaggcgtgggtgatggggttgctagcgtggggaggggtcaggtgactcgcagt

SEQ ID NO: 38220 - DNA, 201 bp, Homo sapiens
gggcaccagcagctattgagtgcatgggctcaggtccctggttcccaggtaagtgagtctaccttcctgtattatcagtgaggtgtgaagtgtttagtagmagtatagtgtaaaccaaatttgtttaggaaggctttgcattgataggaagtaattgcttacatagtagaaaaatctaaaccaatgtctttttttaaagat

SEQ ID NO: 38221 - DNA, 201 bp, Homo sapiens
gtgaacggcactcaaggtttccagggctgcccgggccagagaggagtaaaggtgaggcgtgggtgatggggttgctagcgtggggaggggtcaggtgactygcagtttctccagatgctgccagggagggaggcgctggtccaggcttcttgacctcagcattcagcagcccgtgacctctcattggaaggcagttctgag

SEQ ID NO: 38222 - DNA, 201 bp, Homo sapiens
ttttacatgatttttaaatgttcaacatctgctgtatctagaaaattatttgttataaaacaaacaaagggtgcatcttcatgcaatggtaaaatggtttmtaggggaaggctaacttattattattattgcaaattattatggtggtaagatatggttgtatcagatctaccagtctgctaacatcacacagatgaatgg

SEQ ID NO: 38223 - DNA, 201 bp, Homo sapiens
gccaaaccttctcccaaaggcaaattgttagtcttgtaggggtctggctgcattcagcatagtatgatcctactgttctcctgaagtttaaactcatgaawtacagagaaacatttgagaattgcaagtggccagggaaaagtacaatgggaaatgtttctgtaaaaccccctgtgtgtgctatacattaggttttcagga

SEQ ID NO: 38224 - DNA, 201 bp, Homo sapiens
tcagatgatccacctgcctcagcctcccaaagtgctgggattacaggcgtgagccactgtgcctggccaaaacgcaggtctcttaagtgaaaaatgtttgyggcacttgctggctttgatgctgatttcctttttatacgttttatgttaagtaattctttcgtctgtcaaatgaagacagggaatatagaactgaagaga

SEQ ID NO: 38225 - DNA, 201 bp, Homo sapiens
ctctgatgtcctgtgtgagttaccaggctgtcctcctcccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggacca

SEQ ID NO: 38226 - DNA, 201 bp, Homo sapiens
gtccatggctctcctcctgtaggtgtattcctcttcctccaactcacctccagggtcgccagcccagctcactccaggcacagcacccacctgcagtctcraatctcattatgggtgactgggaagtctgtgcagtcactttgggccatgcccacccagacggccaggcaatgggagtgaatgaggcatggcaactgcttc

SEQ ID NO: 38227 - DNA, 201 bp, Homo sapiens
caggaagtgtgcctactcctgtaccttagtctgcaaacatttcaggagctcaaggatccacttctcaggggcagcggcagggcagagacggtggttatggygtgccaggcatggcgacctacagtcacatctctttcccactcttagggagatgacgggagagacggagttggcagtgaaggacgcagaggcaaaaaagta

SEQ ID NO: 38228 - DNA, 201 bp, Homo sapiens
ctcaatgaaaattggtgaatggataccgaggctcctataagactctgattatcatctgcaaccaatcatctaaattttcttgggtgaaataacacattgtyacaactcttatttgctaactttataaataaagtctgggtctacaagataaatattgtaataagatactgctttacccattgtatcaattacaattgatca

SEQ ID NO: 38229 - DNA, 201 bp, Homo sapiens
tgtcaattctaagattcttggggttgacgagtctttgattctacatccaaacagaatctttaccaaaagcaaccagcagttctttctatgttagtccgccrgtgccattttgctacgggagtcctttgagcccaccgcctacagaaatggtcttgttcacacttggaagataggacaggagcaggaagtgtgcctactcct

SEQ ID NO: 38230 - DNA, 201 bp, Homo sapiens
caagcctggctcacagctgcagaagggcacctcctggggccactgacagcctgataccctgagctcccacccttgagggagaactgggttcatctggaaaygagatagataatgtttgacatctatggagacttttctggctctgaaaaatatgcagtaactaatagagtacagtttgttcatgctcaaaaaatctggaaa

SEQ ID NO: 38231 - DNA, 201 bp, Homo sapiens
gggtcaacagatctctagttgttgatatctgttgaaaactgtaaattaactaagtggcaattcctacatatgttagagatagtaatgtacaattcacacamgttcttctgattcttctgattcataattaatgacgtccagttctgaatgctcctcatgagagagcaacaggaacagatctgagcatgctggggggaggtg

SEQ ID NO: 38232 - DNA, 201 bp, Homo sapiens
ctgggcagaggggagaccgcgggcccatcggcagcatcgggccaaaggtacggtggctttacccttgcccacgcctgagatgaggtgtcagaagcccgacrttactttggtggggtaatttctctaacagaagagtgtggagatgaaggaggagacgagagaccatttcttatgttagaaggaggagctctgaggggcaga

SEQ ID NO: 38233 - DNA, 201 bp, Homo sapiens
actttggaactggaacatatgtaagttatagttaagatctgatgatggaaacttctagaaataaggtccagcctgcagtgatattgtggataagatctatyttactttggttgttctttactttcctattggtgacctcccatctgcaccccgaccgccaggagctgggccctcctgacttcgctggcaatttctatcata

SEQ ID NO: 38234 - DNA, 201 bp, Homo sapiens
tgctcaagctctcagatgcggggatcacccccttgttccttacaaggcaggaagaccggcagctcatcaacgctttgcaggtctgtgctctgtgcgtgctsttggcatctccctttcttctggggctctgagaaggttctcagacacgtccatgctcctttgtggcttcatgtcccatagctcctaaaacgtccccaatga

SEQ ID NO: 38235 - DNA, 201 bp, Homo sapiens
ctttgattttagatcttagacatcaggcactgacatagagcttagatatgttcttaaggtagctaagccatttattataggatagtcagataggatagttytaggatttataggccttttcagatactctttatccagtgagagatgacctatttttattaaaacttgggtttggtatcttggaattggcttgaaaatgat

SEQ ID NO: 38236 - DNA, 201 bp, Homo sapiens
taaaatcctccgttttcatgcttcagaagtagagaagtacaggtttttgtctttgaatagtgccgggttctcacctcactaatatatttctcttggttttycaaatatcttcttgtccacagtaacagtgtccttattttccactagtaaatcttacagggtctcagtagtgactctcactgaaataagggcagaaaacac

SEQ ID NO: 38237 - DNA, 201 bp, Homo sapiens
gagctgcgaactcagagattctttgatggtagcaacagtggactgtggctatgagaatgggaggaatggaccttcctttcttccatacttctttgcagggytagaatcaggatttttttcctagtggaagtaggttgagttagctcacaaatctgggatatgggagaaagggaaagctcttggaagctcgttggaagaaag

SEQ ID NO: 38238 - DNA, 201 bp, Homo sapiens
cctgaggtctcaggtcagagccacctaccacggaagtttcagtacaagtaagtacatgatcagtacaagtcggtacctgatttctatgtagagtatcaaayaggacacaaaggagacacttacttattgaatctattctgaaataaccacaaattcaaaaaacaacaacagcaacaacaacaaaacaactcagcctgggtg

SEQ ID NO: 38239 - DNA, 201 bp, Homo sapiens
gaagatgtggggctgagctgcgaactcagagattctttgatggtagcaacagtggactgtggctatgagaatgggaggaatggaccttcctttcttccatrcttctttgcagggttagaatcaggatttttttcctagtggaagtaggttgagttagctcacaaatctgggatatgggagaaagggaaagctcttggaagc

SEQ ID NO: 38240 - DNA, 201 bp, Homo sapiens; identical to SEQ ID NO: 8018

SEQ ID NO: 38241 - DNA, 201 bp, Homo sapiens
tcagctggtaatcttgagtcctatttctccaagaaaatgcaagtaaacccaaagagagctgtccccggccacgtcatcccgtggttccttgggtggcctgyctccgcttcctcagctccctttcctctcacctgctcagtggcaccatctgcagttccctttcttgctcttgtgtcaccctttctccactgtgctggatgg

SEQ ID NO: 38242 - DNA, 201 bp, Homo sapiens
gctccagaacagcctccctctttcccccttctccccattcggaggcttctctcacacctctcctgacccacctgactctcagctggtaatcttgagtcctrtttctccaagaaaatgcaagtaaacccaaagagagctgtccccggccacgtcatcccgtggttccttgggtggcctgtctccgcttcctcagctcccttt

SEQ ID NO: 38243 - DNA, 201 bp, Homo sapiens; identical to SEQ ID NO: 8023

SEQ ID NO: 38244 - DNA, 201 bp, Homo sapiens
ctgtttctctaacaggaagatctgctcagctgcaattgcaaaacataatatccatgggagagtgagagaataatgatgatctgtaaaaagagcttgagttyaattgattcacaaagcctcgtatttaccagagtaaatactactgcagcagtttctatattaaaaatggacctcccaaaacagagcttctctttgatggcg

SEQ ID NO: 38245 - DNA, 201 bp, Homo sapiens
gagccaacttggttttgtaaactcggctaccaatatgtctcacaaacaccagccaccaccagaggaaaatatgcagccatctgccatattttacaagatgracatgctttgccatgctgactttctctgtgttctaaatgttggcatgtgtgcacgtgttgtaggcacacatgataaaactctccgtggttgtgtatgtct

SEQ ID NO: 38246 - DNA, 201 bp, Homo sapiens
tacctgatttctatgtagagtatcaaataggacacaaaggagacacttacttattgaatctattctgaaataaccacaaattcaaaaaacaacaacagcarcaacaacaaaacaactcagcctgggtgctttggtggcagcctaagcttataaaacacagaatggaaatgggattccatgtgggatgcagtcctgccctct

SEQ ID NO: 38247 - DNA, 201 bp, Homo sapiens
tcctcgcttaaagaacatgtatttattatatttatttttcacgcaaattacccaaagcattgggggttagtgaatggaaaatagcaatttttacttttccytttttgtcaaggcccggttttgtattccaaactaaagaatgaatttataaaatgatggttggttgtctgtgataagacttccttctggtttaatcaggtg

SEQ ID NO: 38248 - DNA, 201 bp, Homo sapiens
tgatcagtacaagtcggtacctgatttctatgtagagtatcaaataggacacaaaggagacacttacttattgaatctattctgaaataaccacaaattcraaaaacaacaacagcaacaacaacaaaacaactcagcctgggtgctttggtggcagcctaagcttataaaacacagaatggaaatgggattccatgtggg

SEQ ID NO: 38249 - DNA, 201 bp, Homo sapiens
tttactcaggaggctgagaaggaaggattgcttgggcctgggaggttgaggctgcagtgagctgtgatcgtgacactgcactccagtctgggtgacagagkgagaccctgtctcaaaaaaaaaaaattacagtataagtggtgtaataacagtgcaaagtcctaggagaactgtaggaatagcagttaatgaatttaacaa

SEQ ID NO: 38250 - DNA, 201 bp, Homo sapiens; identical to SEQ ID NO: 8026

SEQ ID NO: 38251 - DNA, 201 bp, Homo sapiens
ttgttgacagattaattttaattttcatgttattagcatgcggttcaattgttttctttgttttttttctttaggtgaaaatgctttttacttgtccccasatatcaggaaacagtgtgattggttccaaggggaccaacccacaaagaaccttgtgaagtttggtcacaaacaagtgtaagtgattataattattgtctt

SEQ ID NO: 38252 - DNA, 201 bp, Homo sapiens
aaagccatgctgagttttagtgctgctctgccaaatgaagggggaccacagggattcttactgtagagcaaagaagaccacgggattaaacagaggacccrattactttgtttcagggtattcctggagaagacggctaccgaggctatcctggtgatgagggtggacccgtaagtaaaaattgttttagtccctaaaatt

SEQ ID NO: 38253 - DNA, 201 bp, Homo sapiens
agcactctcctctctccttcctccgggagggtggtgtcggggaatgagcgcggatggctgcctcattccctcttgttgaagagggcgggtggtcatctggkgagatggtgtttgacatcttttaataatctaaatgaaaaagttctccaaaatttgctgccagggaatttcgtttttttataaatggagactccaggacat

SEQ ID NO: 38254 - DNA, 201 bp, Homo sapiens; identical to SEQ ID NO: 8030

SEQ ID NO: 38255 - DNA, 201 bp, Homo sapiens
tgctccctctagggaaattcgggacctccagggatagttggacagaagggagaccctggctacccaggaccagctgtaagtatttatccagttctgacccrgccacctggggctgggtgctttacacgtggtccctgaaaacttcccaccatctgctttgctcacaagaaaatgtgctctctttgtatttgcttggttgtc

SEQ ID NO: 38256 - DNA, 201 bp, Homo sapiens
gtaggacaacattgccgagaaagcttgctgtggggttccctgcaagtgctctgggcagaggggagaccgcgggcccatcggcagcatcgggccaaaggtayggtggctttacccttgcccacgcctgagatgaggtgtcagaagcccgacattactttggtggggtaatttctctaacagaagagtgtggagatgaaggag

SEQ ID NO: 38257 - DNA, 201 bp, Homo sapiens
ctatctatctatcatctatctaactgtctatcatccatccttttgctgctggttcaaagaatgaatcagatacaaagtcttcttggaagtctaaaaaggaygtagaaagcatgggattttgagagattttgcataatgagagtcaaaaactgatcattccctttgccctgttttctcttttaggttcatatttggtgctta

SEQ ID NO: 38258 - DNA, 201 bp, Homo sapiens
tgattttctgctgggcatttcttgagatctgaacatttggtttctcttcctttcggtaggacaacattgccgagaaagcttgctgtggggttccctgcaartgctctgggcagaggggagaccgcgggcccatcggcagcatcgggccaaaggtacggtggctttacccttgcccacgcctgagatgaggtgtcagaagcc

SEQ ID NO: 38259 - DNA, 201 bp, Homo sapiens
acaccttcgccagtgagccaaacgacgtcttcttcaaattagtggacaagtccaccgagctcaacgaggagcctttgatgcgcttcgggaggctgttgccrtccttcgtcagcagtaagtcctgcgtggcacagcatgtgccctggcctggctttatgctcgggccaggagaagtgtaggaacagtcatggaaaagacaac

SEQ ID NO: 38260 - DNA, 201 bp, Homo sapiens
tagttctaagaactgttttaactgagaatgttatttacattacacattgcggtgccatagggcctgtcatctgtgtttcctattgtctcattacaacagawtgggaagcattgacaaggagcctgacccacacagcagtaatgggcactattgtgggtcttggcccgtaacctcaaatttaatgatttgatcattcaatta

SEQ ID NO: 38261 - DNA, 201 bp, Homo sapiens
tgctaacatcacacagatgaatggcaagactaaaccaattgaaacctaatcaaaatagttctaagaactgttttaactgagaatgttatttacattacacrttgcggtgccatagggcctgtcatctgtgtttcctattgtctcattacaacagattgggaagcattgacaaggagcctgacccacacagcagtaatgggc

SEQ ID NO: 38262 - DNA, 201 bp, Homo sapiens
tggctctcagaataggatggcatctttgaaatcagccagtccatgccccactgaatgtgactttgaagttggcccatgcctactggccagatgcccaatayagtccaggtcccctcattccttggcctggtgggaccatcagggagcaccttcctggaagacttgcagtcgtccacctcagcttctaccccgtgctcctgg

SEQ ID NO: 38263 - DNA, 201 bp, Homo sapiens; identical to SEQ ID NO: 8038

SEQ ID NO: 38264 - DNA, 201 bp, Homo sapiens
ttaccctccacaccactgatattcagccagctcctacaaagctctcagaccatcatccaaaggttaaggggcctcttcctattttccaatctgtttctccyagtccttccttgctttgcacctcacacacatctcttcacttccaggaactatttaaaattcttgaccacaaaggaaacttctagtggcatttcctaaaac

SEQ ID NO: 38265 - DNA, 201 bp, Homo sapiens
catcatccaaaggttaaggggcctcttcctattttccaatctgtttctcctagtccttccttgctttgcacctcacacacatctcttcacttccaggaacyatttaaaattcttgaccacaaaggaaacttctagtggcatttcctaaaacacttgagatcacaaatgtcaaagccaggtccctattgaattcttgtcaca

SEQ ID NO: 38266 - DNA, 201 bp, Homo sapiens
tggcccggaggatgcagggtggggctcgggccctctcttgctgaggatggacacgttcgctgacagtggccagcctgtttggggaacctgtttcaaggggmctactatgttagataatgaacgggtattgaagtatgggtggggtcactgggagggactagggagtggttaaagaaaaatctgcttccacaggaagctcca

SEQ ID NO: 38267 - DNA, 201 bp, Homo sapiens
gggcctactatgttagataatgaacgggtattgaagtatgggtggggtcactgggagggactagggagtggttaaagaaaaatctgcttccacaggaagcyccaggagccagtttcgaggccggtgcagaccccaggagcaaacccctctgagcacaggggagtctgctgtgctggatggggaggcagggctgtggccccg

SEQ ID NO: 38268 - DNA, 201 bp, Homo sapiens
aagctccaggagccagtttcgaggccggtgcagaccccaggagcaaacccctctgagcacaggggagtctgctgtgctggatggggaggcagggctgtggycccggctgactggcttctctccccacatacagctcaccccggcgaggaccacagggtgctagagctgcagggtgctcagagctcacggggatggtggatg

SEQ ID NO: 38269 - DNA, 201 bp, Homo sapiens
ataaacaaagtgaaagaggctttctttcttcctaactaaggcgctttgtgtgtctccaacacaagaaaggaaatgcaacatttccaaaatgtatctgcctrcaggaggcctctgtgatgctgtgtcttggccccagattgccgaggatggactttgggaatattgtcacagtgcgggtgcagcttctgttgtcaggaacgt

SEQ ID NO: 38270 - DNA, 201 bp, Homo sapiens
acagaggggctcacgaggaacagtgtggtcaccagggcccagccggcagggctcggctagagaactgggaatcaagcatcacttggaggagctgtcagccyggtgggtcttcccgggattcagcacccacagagacacagtgctgggggccacccacccttgccccacagggcagtgctgtctgcgctgctaccctcccag

SEQ ID NO: 38271 - DNA, 201 bp, Homo sapiens
aagcctgttagctctccttccagggctaagtgcctaaatggccaatggggaaggaatttgacaagtacaatttcaaactctaccataccacagcaactgtratgagtgcccagagcttactcatcagcgatgggcagagcagagggacctccccttgttagaaaatgagtccatgcagccatttgatagttggtagcagag

SEQ ID NO: 38272 - DNA, 201 bp, Homo sapiens
aactaatttacagaattgcaaaatagcttgggaaatcatattcattggaatatgattgaatatgatttcaggttgaagggccatgtagggcaatctttctratgaaaggtatccttttaaatttcaaagggatagaaactaaacggaaaaaggcacctcaaatcctttttagaatgaggcagagtaaacaaaaagatgaat

SEQ ID NO: 38273 - DNA, 201 bp, Homo sapiens
caagtgaaaggaaatcactgcaggatacagtgggtgatgagggaggtgaggatgattatttgggtgcaactgagaggggcttggtttctcctcgctggtgyctggggaagagagcagtgtggcccaccaggtttctgtgggatgttcctgagcatttatgatcaggtaaatttgggcaacagtgggataaacaaagtgaaa

SEQ ID NO: 38274 - DNA, 201 bp, Homo sapiens
gcataattcacttgtgctctttgtcaatgctccctgcacaggtgtctgcagctcttcccatcccagactcaacagtgaggagacagctctcatcttatcaygtcctattttttccacctggattacaaagccgaatgctttacaaagagcctctataatactcttgtgttctcattcacaaacaaaaataccacttaaaat

SEQ ID NO: 38275 - DNA, 201 bp, Homo sapiens
tcattttatttctaaagcattcaggactcagcaaattgcactgactttatcatcagtgccttttgtgatttcctatcctagaacttaatacgtccccgatsagaaagtaggaagaagctcctctcttcagtcgattgttgatttatggttccaatgaggctgctcatcctgaccttagtttcaggaacggaacccatagac

SEQ ID NO: 38276 - DNA, 201 bp, Homo sapiens
ctgggcattggcaggaaggtgaacatcaaggaggtatacaccttcgccagtgagccaaacgacgtcttcttcaaattagtggacaagtccaccgagctcamcgaggagcctttgatgcgcttcgggaggctgttgccatccttcgtcagcagtaagtcctgcgtggcacagcatgtgccctggcctggctttatgctcggg

SEQ ID NO: 38277 - DNA, 201 bp, Homo sapiens
ttaattaacaccaccaacaaagctgactttttaaaatagcttactatttggcacctaacagctaccctcatttctctctgtgagaggggtggatagaattkcttctcaaagctcacacacacaggatctcattttgcacttgagtgcgatgccctggtcctctgcctgggttgtccctactgctggtataagtagagttcg

SEQ ID NO: 38278 - DNA, 201 bp, Homo sapiens; identical to SEQ ID NO: 8057

SEQ ID NO: 38279 - DNA, 201 bp, Homo sapiens
ataggctgccatgcttctttctagacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcatacctggtcagac

SEQ ID NO: 38280 - DNA, 201 bp, Homo sapiens
ctgtgcgtgctgttggcatctccctttcttctggggctctgagaaggttctcagacacgtccatgctcctttgtggcttcatgtcccatagctcctaaaaygtccccaatgaggccatctgcctgagaacttctcttgtgaggtctccaggacaacctcgtggctccagcactacagggacgcctacatgcttgtagcact

SEQ ID NO: 38281 - DNA, 201 bp, Homo sapiens
caagataaatattgtaataagatactgctttacccattgtatcaattacaattgatcaagggaggttttcctttgataaaggagtgaaaataatttaaaartaaccattttggagaatatgccattgtatgaaattaagagtagaagattttaaagtcttaattaaaaacatcactatctatttatttaaggagctgacct

SEQ ID NO: 38282 - DNA, 201 bp, Homo sapiens
ggtggggcaggaaaaagagagttgaggcttggaggcacacatcactctacaggaccacatcggagggacagcagaagaattgcaagattgcaatcagaatrctggagcagttgcagagaagcagtaccagatgtcagtttttcataacaaggattcagaaagcaggagctgaagagagatgacccaacatcagcagaaagg

SEQ ID NO: 38283 - DNA, 201 bp, Homo sapiens
tgggcaaccacatggcataggggaactgatcataggaagcaagatttatgaacagatttttctcctacacttttaaaaatggttaccaccaagatggccaytgggacaggaggtaggaggtgaggtgactgatggagagtcagtctcttgtgaatacacatggatggtggggcaggaaaaagagagttgaggcttggaggc

SEQ ID NO: 38284 - DNA, 201 bp, Homo sapiens
ccttgagatctgggccaaatctggcacagcctctagggtttcccggggttcttcccatgagctttggaaatgctaacttgggttagggttctggttctatsttgtttttatctatgtagctttgaacaatcactttgccttgctggggtttcaatttctcagctataaaatggagggaaatcagccatcggatggttggga

SEQ ID NO: 38285 - DNA, 201 bp, Homo sapiens
attcattttactgatggagcagacggagatctggctgatttacacagagcatctgagaacctccgccaagaaggtaggtgccaaggctttctaaatatgasaagtaaaccctggtgaggcggggtgtactgctctgctggagagaaacctctctgctaatgcagcgccccaagggagcagcgttgtcttgggagactcttc

SEQ ID NO: 38286 - DNA, 201 bp, Homo sapiens; identical to SEQ ID NO: 8063

SEQ ID NO: 38287 - DNA, 201 bp, Homo sapiens; identical to SEQ ID NO: 8064

SEQ ID NO: 38288 - DNA, 201 bp, Homo sapiens; identical to SEQ ID NO: 8065

SEQ ID NO: 38289 - DNA, 201 bp, Homo sapiens
tggaaaccagaggctgcgggactgtgtcatgataatgacagtgcccttttgggtcagtaatgtggcttttcctctcttctctcggctcctcacctcacccyacccaccccctctctcgacgctcagtgctcgccaaacccggagtcatcagtgtgatgggaacctaagcgtgggtggccaacatcatatacctcttgaaga

SEQ ID NO: 38290 - DNA, 201 bp, Homo sapiens
tctttcgtctgtcaaatgaagacagggaatatagaactgaagagaacagggatgtgcaggctctttcagcttttgcacttgacaatgagcattttgaaatsaagactgtgaggcaaagggttctctgagcagacatcagtggtttctttaattattcaagcaatgacttcactctggccaagttgtgtatttacggcagaa

SEQ ID NO: 38291 - DNA, 201 bp, Homo sapiens
atcctccgttttcatgcttcagaagtagagaagtacaggtttttgtctttgaatagtgccgggttctcacctcactaatatatttctcttggttttccaartatcttcttgtccacagtaacagtgtccttattttccactagtaaatcttacagggtctcagtagtgactctcactgaaataagggcagaaaacaccagt

SEQ ID NO: 38292 - DNA, 201 bp, Homo sapiens; identical to SEQ ID NO: 8066

SEQ ID NO: 38293 - DNA, 201 bp, Homo sapiens
gaatggttgtttttaggatgttctaggtaggcacctgtggcttctgggaacaggtgggattcccagaacagggttttaacctaacattgtgcttgcctccrtttcctctcttctatttggttactttcctgaagcccagtgaccaatagtaaggaagtttcagcagacagtggtctgagtcaggcagcctttcccctctct

SEQ ID NO: 38294 - DNA, 201 bp, Homo sapiens
aaccccgtctctactaaaaataaaaaattagctaggtgtggtggtgcatgcctgtaatcccggctactcgggaggctaaggcaggagaattgcttgagccsggtgggtggaggttgcagtgagtcgagatggcatcactgtactccagcctgggcaacagagtgagactctgcctcaaaaaaaaaaaaaaaaaaaaaaaaa

SEQ ID NO: 38295 - DNA, 201 bp, Homo sapiens
cttacgaaccccctgctcccctgagtgggaacatctaggcttccccttcccagcagcagggtggcaggcagcaccacccaggacaggaccctccatttgtrgccggcagccctcaccgggcaaggcgtgactgctttttgaggcccacgaagctgccctgcggtccttgctgcagggagcagccctgggcagcctcacaaa

SEQ ID NO: 38296 - DNA, 201 bp, Homo sapiens
ggtgggtggaggttgcagtgagtcgagatggcatcactgtactccagcctgggcaacagagtgagactctgcctcaaaaaaaaaaaaaaaaaaaaaaaaarggaagaaaggagaagaaaaagaaaaaagaaagaaattggccaggctggttttgaactcctgggctcaaatgatcttcctgcatcagcctcccaaaattct

SEQ ID NO: 38297 - DNA, 201 bp, Homo sapiens
gggaccgccccggccatcctgcccctgcagccctgagccccagccctctgcagctcccacggccctcaggctccctggggccctcaccagccagtgcagascccgcgtggacctgagatgtctgcagtgtggccccaccagccccaggccctgtcccctgtcctccgtcgtggtgctttccagcctctcggggagtgggca

SEQ ID NO: 38298 - DNA, 201 bp, Homo sapiens
tggggcaggggaaggagttgttctcagctgagcaaacagtccagcaagggtgtctctgtgtgcacatgtgtgcatgtgtgtatgcatgtgtgtgggtgcatgtgtgtgtgtgtggtgggcttgaggaggggtatgggaattggttgtcgggtgtgagaggggctggggtgtggactggggggtggctggggctgcatttgg

SEQ ID NO: 38299 - DNA, 201 bp, Homo sapiens
actgagggcccagccagggctcagcatccccttacccacccctgcccctgcgccctgccccaccgggaccccctaggctgggtgcttccgcttgtctcccwggccagttcccagctgacacccccattcccacttggttgtgtggccctcccatagtctcaagctgggtttgctcaggctcttgggctgtgccgtacagac

SEQ ID NO: 38300 - DNA, 201 bp, Homo sapiens
gtcccgcagcccggccagccgcaaccagaggattctctacaccgtgctggagtgccagcccctcttcgactccagtgacatgaccatcgctgagtgggttygccttgcccagaccatcaaggtagtggggctggggaatgctgggtggggctgtggtgtgtgggtggggctgaggtgtgtgggtggggctgtggtgtgtgg

SEQ ID NO: 38301 - DNA, 201 bp, Homo sapiens
ccgcagcccggccagccgcaaccagaggattctctacaccgtgctggagtgccagcccctcttcgactccagtgacatgaccatcgctgagtgggtttgcsttgcccagaccatcaaggtagtggggctggggaatgctgggtggggctgtggtgtgtgggtggggctgaggtgtgtgggtggggctgtggtgtgtgggtg

SEQ ID NO: 38302 - DNA, 201 bp, Homo sapiens
gtcatccacggcaccgacaccatggcctttgctgcctcgatgctgtccttcatgctggagaacctgcagaagactgtcatcctcactggggcccaggtaaycccaggggcccggggctcctaggaacaggggcttcctgaggccacagggcaagtcagcgctgtgggcggccgctgcgggaccccgggcttcctgctcagc

SEQ ID NO: 38303 - DNA, 201 bp, Homo sapiens
tgaccccagcatccacctggactctgcctgcagtgcttgtgcccgggacgggcctggctgccatcctgaggacactgcccatgttccatgacgaggagcaygcccgagcccgcggcctctctgaggacaccctggtgctaccgtgagtgtgggctcctcccagtcccggacagggcatggctgctgaggggcaccgatcct

SEQ ID NO: 38304 - DNA, 201 bp, Homo sapiens
cagactatgcagctggcatggtagtgccgggagatcagggcctagcggggaaggggacagcctgagggcctggcagaggtgggctctgacccacccctcaygggctgggggccgtggtgagtcgcccttcctgcccacacgccccctcctcacaggccatggcgggagccggcgtcatctcaggcttcgacatgacatcgg

SEQ ID NO: 38305 - DNA, 201 bp, Homo sapiens
cactgcagggcaacacgctgggcggtggggtctcctggctcctcagtctgagcggcagccaggtaatggcgtgggacacgggcctgagtggcagctggggrctgtgcaccctcttggtcaccctgggatgcaccaggcaggcacgagcccctgtagccatcactcgagcccaaacagttaggcacacccgggttctggggc

SEQ ID NO: 38306 - DNA, 201 bp, Homo sapiens
agaggcagtcaccatgctgctgcagagaggtgtggacgtgaacacccgggacacggatggcttcagcccgctgctgctggccgtgcggggcaggtaatggrgctagggctgcacagagctgccttggacaggtgggcgcagagaggctgtgggctcctgcactcaaacagcctcccggggctgggctgggagaggtggagg

SEQ ID NO: 38307 - DNA, 201 bp, Homo sapiens
aagcccgacctgctgcaggagctgcgggtggccaccgagcgcggcctggtcatcgtcaactgtacccactgcctccagggggctgtgaccacagactatgmagctggcatggtagtgccgggagatcagggcctagcggggaaggggacagcctgagggcctggcagaggtgggctctgacccacccctcacgggctgggg

SEQ ID NO: 38308 - DNA, 201 bp, Homo sapiens
gggtcacttggcccatccttccgggggcagctgtgcgtgtgagctgggcagggtggggtgcatggaggtgacttggccaagtggtcctttcccagctgccmctcccccttcctgccaccctgcctttgcccaggctggtccctcctccagacaccctctgcccatctccttacctcctgcgccttcattctggagcttgaa

SEQ ID NO: 38309 - DNA, 201 bp, Homo sapiens
cttggagcttgttctcagagactggtgccctgccaggcctcacctgagacgcagggccactccagtggcctgcccggaagtcactccctggcctaccgtckctccgtctggggtgtgctcctgctgagggagcccctgcttcctggactctacccggcccctgcctgttccaggtccacggccagcatggccagtcctgac

SEQ ID NO: 38310 - DNA, 201 bp, Homo sapiens
gcctgcccggaagtcactccctggcctaccgtctctccgtctggggtgtgctcctgctgagggagcccctgcttcctggactctacccggcccctgcctgytccaggtccacggccagcatggccagtcctgaccccacgccagcacccctccctgaggcagcgggagcatcccctccctcctgggagatgcatcctgcct

SEQ ID NO: 38311 - DNA, 201 bp, Homo sapiens
cctgcagaagactgtcatcctcactggggcccaggtaatcccaggggcccggggctcctaggaacaggggcttcctgaggccacagggcaagtcagcgctrtgggcggccgctgcgggaccccgggcttcctgctcagcccagcagctcctgaggtggctgctgcagggcccgtgctggggctcgcaaatgctcaggtcct

SEQ ID NO: 38312 - DNA, 201 bp, Homo sapiens
tagagatgcgtatggaggttttgcgttagagatgcgtatggaggttctacgttagagatgcgtatggaggttctccgttagagatgcgtatggaggttatrccttagagatacgtatggaggttctacgttagagatacgtatggaggttctgcgttagagatacgtatggaggttctgcgttagagatgcgtatggaggt

SEQ ID NO: 38313 - DNA, 201 bp, Homo sapiens
tgaccccacgccagcacccctccctgaggcagcgggagcatcccctccctcctgggagatgcatcctgcctgccctggccccctgctgtttcaaggcagcyccaaacctgccctgtgtctcatcctgactgactgaggtggggtccagccccggggaggctccagggcttggcagcactggccttcctttgggggcatttg

SEQ ID NO: 38314 - DNA, 201 bp, Homo sapiens
gcagagagaggcaggctcccacagggaggcaccgactcaagcctgtgcgctgtctcctgtcctgggctcacaccccgtcccttcttcctgctgttccctcytgtcctgggctcacaccctgtcccttcttcctgctgctccctggagcaccttctagggagtgtgaggcccagaacacatcagtgtgtctactgtgtgtgc

SEQ ID NO: 38315 - DNA, 201 bp, Homo sapiens
ctgaaggaactgaccagacttgagcactgagggcccagccagggctcagcatccccttacccacccctgcccctgcgccctgccccaccgggaccccctaggctgggtgcttccgcttgtctcccaggccagttcccagctgacacccccattcccacttggttgtgtggccctcccatagtctcaagctgggtttgctca

SEQ ID NO: 38316 - DNA, 201 bp, Homo sapiens
attccagggactccgccagcaccgggtgctaagcccgggcaggccacgaggctcaagacacaccggcctcaggcccagggccgtggggcagctcctgggcrcagcactaaggctggtctgggtgggaggctgccctggccccagccccccacccctgagtgtttcccacgtgcgtgtgggtgtgggaacctgatgccgggc

SEQ ID NO: 38317 - DNA, 201 bp, Homo sapiens
gcactaaggctggtctgggtgggaggctgccctggccccagccccccacccctgagtgtttcccacgtgcgtgtgggtgtgggaacctgatgccgggctgycgggccggttctggcacccagtgttgagaaacctcaggccttgcccagggtgtggctgctggggcccctggggaggggcacaggttggcagtgtgcaccc

SEQ ID NO: 38318 - DNA, 201 bp, Homo sapiens
cacaggccatggcgggagccggcgtcatctcaggcttcgacatgacatcggaggccgccctggccaagctatcgtatgtgctgggccagccagggctgagsctggatgtcaggaaggaggtgcgggcgctctcgggctgtgggcaaccctcggtgtgcacaagcatgtcagttggctcccaggggcatgtctggggcgatg

SEQ ID NO: 38319 - DNA, 201 bp, Homo sapiens
ctgagtgtttcccacgtgcgtgtgggtgtgggaacctgatgccgggctgtcgggccggttctggcacccagtgttgagaaacctcaggccttgcccagggygtggctgctggggcccctggggaggggcacaggttggcagtgtgcaccctcagcctctctgagccagctgggggtagcaatgccggcctgggcccgggtg

SEQ ID NO: 38320 - DNA, 201 bp, Homo sapiens
accctcagcctctctgagccagctgggggtagcaatgccggcctgggcccgggtgccagctgccagcaccctgtcgagggcttgtcctgggctttttaccyactgtctgggaagtgaggggctgggctggtccgggagtcatgggcgggcttggtgctcctgtccacagtcggctcggcgccaaggggtggggggatgcgt

SEQ ID NO: 38321 - DNA, 201 bp, Homo sapiens
aggctggaggaggccctgctggccctgtcctttccatgtgtctcaggagaccacactgtcacccccaggcaaatcctgcacccttacccttctgtgctgarccctggccccggcccactctgctggggcccttggagcagaggagggtggagaaggggatatggctgtggggtcaggccaggcctgtcactcaccagccat

SEQ ID NO: 38322 - DNA, 201 bp, Homo sapiens
gaggaggccctgctggccctgtcctttccatgtgtctcaggagaccacactgtcacccccaggcaaatcctgcacccttacccttctgtgctgaaccctgrccccggcccactctgctggggcccttggagcagaggagggtggagaaggggatatggctgtggggtcaggccaggcctgtcactcaccagccatgggtcc

SEQ ID NO: 38323 - DNA, 201 bp, Homo sapiens
gctttatactgagcagctggccccagggaatgagtggtgtggccaggtctccatttaagggacagaactgagatgcagaggctgcaggaaggtggcagagytgctgggggtgggaccagcccgtctgtgcacttgctgtgtgctaggccctccaggtcggggagctggggaaggggacctgggctggaccctgagggagtc

SEQ ID NO: 38324 - DNA, 201 bp, Homo sapiens
cctgctcagcccagcagctcctgaggtggctgctgcagggcccgtgctggggctcgcaaatgctcaggtcctgcccgggtgccagcaccacctgccccgcrggaggggggtcatctcctgctggtggccctgggagctgtgaggccctggagcacccagagccaggcccacctcggccctgggggtgccaggcatcccttc

SEQ ID NO: 38325 - DNA, 201 bp, Homo sapiens
tccatggaggccctcttaggaggtctgcggggagcagtccggggaggtggctcagccaccccactctgcttgcctggcgccgtctcccttgtccctccagrgtctccccagggcccactgcacacacctgttagcggtggagcagtgcctcccgccccagaactcgagaaggagggacagggctccagctggttctcctct

SEQ ID NO: 38326 - DNA, 201 bp, Homo sapiens
agcagtcgccttccaccagagcctgaacctctgagggtgccccgtgcctggtcccaccttccctccccaccctcctcccacacccccagccaggctgcttyggcaagtgtgatgagggcgccccgtctagggatcctgtatatcaggagccagctggcccaggtggccttgcccccagcatagaggtccttccatttctca

SEQ ID NO: 38327 - DNA, 201 bp, Homo sapiens
gaccttcccgagccctgggggagcagaacatcccgtggacctctctaggggatcaagggcacagttatgagcaccgcaggacccacgaacgttcacatgcrtgttgtcctcactctgatgttggcctgtgccgggacatccttatccctgttatacctgtggggaaactgaggcttacaggctaggggctcacccacagcc

SEQ ID NO: 38328 - DNA, 201 bp, Homo sapiens
gccagaggggaacagagcgggtcagggcatttagagcaggaggaggtgcagagcgggagcctgctgttccgcctcctgctgtttctgtcccgcagcccggmcagccgcaaccagaggattctctacaccgtgctggagtgccagcccctcttcgactccagtgacatgaccatcgctgagtgggtttgccttgcccagacc

SEQ ID NO: 38329 - DNA, 201 bp, Homo sapiens
gagatgcgtatggaggttttgcgttagagatgcgtatggaggttctacgttagagatgcgtatggaggttctccgttagagatgcgtatggaggttatacsttagagatacgtatggaggttctacgttagagatacgtatggaggttctgcgttagagatacgtatggaggttctgcgttagagatgcgtatggaggttt

SEQ ID NO: 38330 - DNA, 201 bp, Homo sapiens
gcatggtctgcagccacagctgttggtgggtgggttgaggccctgggtgcaggctggcatcgtctgcagggacagctgttgttggcggccttggagacagscttactgcccagctcctctgagtgccccgttcccccaaggcacccatctccaggctgcctgctgcagtccaagcccgcctgtccttctctttcccacacc

SEQ ID NO: 38331 - DNA, 201 bp, Homo sapiens
tcaaatccgcgcctggatggggggtgcgggctgaggtcgctctcctccggttccggccaccggcgtccccacgcatggagccccgacctggacagaggagrttgcggtgggttctcgccgtcgcggtgctcccgggagcgccctgcgaccctggggccaggccccctgtgctgccgctgcgcccctgagggccagcgtcct

SEQ ID NO: 38332 - DNA, 201 bp, Homo sapiens
cgggagggccccagggcattggcctgccgctcctgctctggacacagaaggcttaggaggctgccctggagaaggcttaggaggctgcgaggacccctcamctgcgacacccaggagggtgtccccgtcccctggggtcctggtcaggcagcagtggttggcacgatactggggctacctggcatctgcggggacgcacgt

SEQ ID NO: 38333 - DNA, 201 bp, Homo sapiens
tctgctggctcctgagtgaggtgcagcggggctgggctggcgagggcagaaggtcagcatgctcattctcacacaggcatccgggtgtcattgggttgctscgggaagccggggcctccctgtccacccaggagctggaggaagcagggacggagctgtgcaggtgagtgcagctagagcacctgctcttccagggatgtg

SEQ ID NO: 38334 - DNA, 201 bp, Homo sapiens
gaccctttcccccatgctgcaacctcccccacacctgcttgcgaggggctggcctgcctgagcatgcgcccctcctgcagaggcactacgagcagtaccayggctttgtggtcatccacggcaccgacaccatggcctttgctgcctcgatgctgtccttcatgctggagaacctgcagaagactgtcatcctcactgggg

SEQ ID NO: 38335 - DNA, 201 bp, Homo sapiens
tcccacacccgcctggggctcctgggctgggcctgggggtttacctggagagatgagccagacatcccaggcttctgggcttcccaggcctcagctactcygtggcctctcccccaggtgcccatccatgccctgtggagcgacggccgtgagaacctgctgggggcactgctcatggctggccagtatgtgatcccagag

SEQ ID NO: 38336 - DNA, 201 bp, Homo sapiens
tgttgttggcggccttggagacaggcttactgcccagctcctctgagtgccccgttcccccaaggcacccatctccaggctgcctgctgcagtccaagccygcctgtccttctctttcccacacccgcctggggctcctgggctgggcctgggggtttacctggagagatgagccagacatcccaggcttctgggcttccc

SEQ ID NO: 38337 - DNA, 201 bp, Homo sapiens
tgctcagcagcccgtcctcgtgtggctgcgaggtcacccccagctgttgctagctgacccatgtggggcatccacttccaggaacctgcaggaatgggctsccccaacccctcgtgaggttggagcagccagactgtcaggcgtcaatgatttactccctccacactgctgacgtgggctctggccttccctggggaggtg

SEQ ID NO: 38338 - DNA, 201 bp, Homo sapiens
cctcagttaaagggcatctcacgctgccatcatgtggggctgactgatgctgtgggctctggtgggggtggaagactcactgctgggggctccgctccccmctctctcatccccagcaccccacatctccccccttcagctccaccatgccaggaaagtcctttttatcgcatgcaagctgctctagcggaagcggccgga

SEQ ID NO: 38339 - DNA, 201 bp, Homo sapiens
gttagagatgcgtatggaggttctgcgttagagatgcgtatggaggttttgcgttagagatgcgtatggaggttctacgttagagatgcgtatggaggttytccgttagagatgcgtatggaggttataccttagagatacgtatggaggttctacgttagagatacgtatggaggttctgcgttagagatacgtatggag

SEQ ID NO: 38340 - DNA, 201 bp, Homo sapiens
cctggcacgggccggactgcgcggaagcccgggaggatttgcctgcgggagaggaggcagggcgagggggctgagccgcgaaggctcagggctctgaaaasaagggaggaggcggcctgtgcagagggccaggcactgggctggggtctcggctggcaggaggcctgaaggcaccacacaggcccttccctgtcctcagtc

SEQ ID NO: 38341 - DNA, 201 bp, Homo sapiens
tcacccttgagactgtgttgcccattgctcggccatcggtctctcgctggccaacgagtgcctcctcccacagccccgtgcacgctgcggagcctggcacrggccggactgcgcggaagcccgggaggatttgcctgcgggagaggaggcagggcgagggggctgagccgcgaaggctcagggctctgaaaacaagggagg

SEQ ID NO: 38342 - DNA, 201 bp, Homo sapiens
tgtcgccaggaaatcctctcctgctctccactcttcctcgagggtggggttcagacacagctggccccagacccttgggttgccagcctctggggctggayggaggcttttggggcccctggagaccctgagctggtagggccagggagtggggctggccttgggaggggacccagcccgctctggcccgagggatgaagc

SEQ ID NO: 38343 - DNA, 201 bp, Homo sapiens
gctccctgaggccgcctgcctggccctgctgtgcctgagtggggtatggggaggccactgcctcatacctattcccaggctccctaaatggggtgatgggrggatctgtggtgctttgcaggggtgggggcacggccagcgattatggcacagtctttaggtcaccctgtacaatgggctgtgtggcctccggcctcgggc

SEQ ID NO: 38344 - DNA, 201 bp, Homo sapiens
cccccacagactccactgtccgggtgccctgcccccactcctacccaagggcagtcggccggattgattcagtgtcccctgcgcctggctgaggaggtcaycacggggtgtgatcagcgtttgggtgtgcagtggggccggtcagctcatgtaaggctgtcctctgaaatgggctgtccccttggaatgggttggggagac

SEQ ID NO: 38345 - DNA, 201 bp, Homo sapiens
gcgcctggctgaggaggtcaccacggggtgtgatcagcgtttgggtgtgcagtggggccggtcagctcatgtaaggctgtcctctgaaatgggctgtcccyttggaatgggttggggagactgccctgggaggagctattctgctagcaccaactaatgccctcccctgggtgctgggtgcggggctgccacagagttgac

SEQ ID NO: 38346 - DNA, 201 bp, Homo sapiens
tgaactcctgggctcaaatgatcttcctgcatcagcctcccaaaattctgggattacaggtgtgagccataaaaaccactgcaaaagcacatatggagtgwtttgcttgagagaagaggacaccaagagagtttagtcttgtctttggctgatttcgcctgtggtgcccacacatgcccccagcagggacagcagggccca

SEQ ID NO: 38347 - DNA, 201 bp, Homo sapiens
ggctagggctgtggggtcttgggccggccggtccctgtccctgtgcacaggacatgagctctgctggctcctgagtgaggtgcagcggggctgggctggcsagggcagaaggtcagcatgctcattctcacacaggcatccgggtgtcattgggttgctgcgggaagccggggcctccctgtccacccaggagctggagga

SEQ ID NO: 38348 - DNA, 201 bp, Homo sapiens
aggcccgctgacctcagtgtgcaccaacctggctgatgggaagaggtgtctaccctggaccatgtcatggggcaggggaaggagttgttctcagctgagcraacagtccagcaagggtgtctctgtgtgcacatgtgtgcatgtgtgtatgcatgtgtgtgggtgcatgtgtgtgtgtgtggtgggcttgaggaggggtat

SEQ ID NO: 38349 - DNA, 201 bp, Homo sapiens
atggggcaggggaaggagttgttctcagctgagcaaacagtccagcaagggtgtctctgtgtgcacatgtgtgcatgtgtgtatgcatgtgtgtgggtgcrtgtgtgtgtgtgtggtgggcttgaggaggggtatgggaattggttgtcgggtgtgagaggggctggggtgtggactggggggtggctggggctgcatttg

SEQ ID NO: 38350 - DNA, 201 bp, Homo sapiens
ccaagcaggccccagccaatctcctgcccaggcaggagctccccctgccgccctcacagacctcacctcttcctacacgtttccaaggccgcgccccgccscgcaccccgccaggccccgccccgcaccccgccaggccccgccccgcaccccgccaggccccgccccgcaccccgccaggccccgccccacccgccaggc

SEQ ID NO: 38351 - DNA, 201 bp, Homo sapiens
ggccagaatgctgaggctcagactagggcctttgtctctgctgacacctcgctgctgtcacgactttgtggtccctgtgccactgactgcaggacgcgcasctgagtctccttggacctgcccaggtggcccccaagcaggatgtgtccaacacaccttgcttccctctgcctggccccaggccccactctggcccctgct

SEQ ID NO: 38352 - DNA, 201 bp, Homo sapiens
gccagaatgctgaggctcagactagggcctttgtctctgctgacacctcgctgctgtcacgactttgtggtccctgtgccactgactgcaggacgcgcagstgagtctccttggacctgcccaggtggcccccaagcaggatgtgtccaacacaccttgcttccctctgcctggccccaggccccactctggcccctgctt

SEQ ID NO: 38353 - DNA, 201 bp, Homo sapiens
aggccccactctggcccctgctttctcagtaaggacatccccactccgtggctgctctggccaaagacaggagagtcaccctttctcttcggcgcgtaccyctcaagctccagcttgtgctcccagcactcccaccttgcacttccccatccccagctcctccccaccctgcccaaagccctcctgaacccattcttgtct

SEQ ID NO: 38354 - DNA, 201 bp, Homo sapiens
gcatagaggtccttccatttctcagctctgggcccagctccctgatgtcccccacagctgggggtgagctgggagttgccctcgtggtggctgaccaccayagccgccacaggcgagcctcctgcaagcatcctctcctgcctggggatggctggtcccagcccccctcttcgagctggtgtgggaagaagactgctggga

SEQ ID NO: 38355 - DNA, 201 bp, Homo sapiens
cagacatcccaggcttctgggcttcccaggcctcagctactccgtggcctctcccccaggtgcccatccatgccctgtggagcgacggccgtgagaacctkctgggggcactgctcatggctggccagtatgtgatcccagaggtacctgcctggtgcacgtggaggcggggcaggtggggtgggggcaggagcccagaca

SEQ ID NO: 38356 - DNA, 201 bp, Homo sapiens
aggagtttcagggagtctttctgtcctctggttccggcgggcagcccagccatccttgtggggctgactcgagcgatcctgtgtcctgaggcttccccctkggggggccaagcccgccccctggccctggctgtaggagcagccttggagcttgttctcagagactggtgccctgccaggcctcacctgagacgcagggcc

SEQ ID NO: 38357 - DNA, 201 bp, Homo sapiens
gggtggaggcagcgtctttggatctcaagacaaggcctgtgtgtgggagtccgggctcggtggctgacttgcttgttgccccagggcccctcagcaggacrggacagaggaaactgcctggttctacaggtgagaaacggaggcagagagaggcaggctcccacagggaggcaccgactcaagcctgtgcgctgtctcctg

SEQ ID NO: 38358 - DNA, 201 bp, Homo sapiens
cctcctgcaagcatcctctcctgcctggggatggctggtcccagcccccctcttcgagctggtgtgggaagaagactgctgggagtggcccatcctgaccyacgtccttgcctctgtggggagctccaggtggaaggggggccgggccccgtacctgggatgctgagaacttgctatgtgcggagcccttggcgtaggggc

SEQ ID NO: 38359 - DNA, 201 bp, Homo sapiens
gtgtgggctcctcccagtcccggacagggcatggctgctgaggggcaccgatcctgaggctgggcactgctggccaggcccacgtgagccatttgctcacycctgtctctaacatcccctcagcttacagggctttaggactgaccagcagtcgccttccaccagagcctgaacctctgagggtgccccgtgcctggtccc

SEQ ID NO: 38360 - DNA, 201 bp, Homo sapiens
gacgcacgtgttcacacccgaggtggcctcagagccctgcttcctctgcccctgtgtggacctggttgaccagagaccagcgattgcgtctggactgagtyctgcctgggtggggtcagggcctgggacaggcaccgagctctgtggtactccagcacagtgctgccagcctgggctgggcacaggaaggatggtagcttg

SEQ ID NO: 38361 - DNA, 201 bp, Homo sapiens
gacgccaccctcggtggaagagcgccggccctcactgcagggcaacacgctgggcggtggggtctcctggctcctcagtctgagcggcagccaggtaatgscgtgggacacgggcctgagtggcagctgggggctgtgcaccctcttggtcaccctgggatgcaccaggcaggcacgagcccctgtagccatcactcgagc

SEQ ID NO: 38362 - DNA, 201 bp, Homo sapiens
ggtgggatcccgggatgatgtcacatgggcctaggcagaggatggggggatgggcccttgtctgaggctagggctgtggggtcttgggccggccggtcccygtccctgtgcacaggacatgagctctgctggctcctgagtgaggtgcagcggggctgggctggcgagggcagaaggtcagcatgctcattctcacacagg

SEQ ID NO: 38363 - DNA, 201 bp, Homo sapiens
ccacactgtggccggtgcagacccctctggaggcccactctgcgcccagcccaggagacaaagcctagtggggctcgtccacgagggactcaggtccccargaacgtggctgtccaggctgccgggagcctcctctgcacttctccttctgcctgtgaatggaacaaagtcattcacagcttggcaaacgcccctgtgtga

SEQ ID NO: 38364 - DNA, 201 bp, Homo sapiens
gttgtacccgctgggtgtggtggcacctgtggggcctctgccaggaccgctgggtgtggtggcccctgtggggcctctgccaggaccgcggccttttggcrtcttggggagctcctggtgcccggtgctgggggcaggtggctcttctgggaaggtgcagccgtgggaacagggccttccttccaggggaggggtctggct

SEQ ID NO: 38365 - DNA, 201 bp, Homo sapiens
gcccccgagtggggacaggacctggggactctgtgtggggcctcgtccgacgcccctgacgctaccccttcaggcttggagtgtggccaactgcagtttcrttgagctcaacatgtagttcttgagtggtccgagctgcaggggcaggtggactctgtaaccccaccacacacccgtctcgcttggcccccgcgtgctcgc

SEQ ID NO: 38366 - DNA, 201 bp, Homo sapiens
ccgaggccaggacgactccgagggacccaaaaaggagagtcggaggcaggagacctgggccgggtgcaggtggtggctggggtgggggtgctgtgagtggyggggtctgtgcgcctgtaagtccagagtcccaggcttggggagtgggtgatggcgggggctcggctcactggctgggagggggtgggtgcaggcgcctgc

SEQ ID NO: 38367 - DNA, 201 bp, Homo sapiens
ggtgggtgcaggcgcctgcccagcaggaggaggactagcagctctggcttctcctctgggaccggcccacaacccctggtcttgcttttgaagggacttcyggggtgacttggtcaagatttgcactccagacaggccttgctggctccattgacagatggggaaactgaggcagtagtcaggtcctgtgggagctgggac

SEQ ID NO: 38368 - DNA, 201 bp, Homo sapiens
gagactgccctgggaggagctattctgctagcaccaactaatgccctcccctgggtgctgggtgcggggctgccacagagttgaccccaccccttgcagamctcagctgccctaagaaggagtactggacaaatggaggtggtgggatcccgggatgatgtcacatgggcctaggcagaggatggggggatgggcccttgt

SEQ ID NO: 38369 - DNA, 201 bp, Homo sapiens
agcccccctcttcgagctggtgtgggaagaagactgctgggagtggcccatcctgacctacgtccttgcctctgtggggagctccaggtggaaggggggcygggccccgtacctgggatgctgagaacttgctatgtgcggagcccttggcgtaggggccccagctctgccagaggggaacagagcgggtcagggcattta

SEQ ID NO: 38370 - DNA, 201 bp, Homo sapiens
gtcccccacagctgggggtgagctgggagttgccctcgtggtggctgaccaccacagccgccacaggcgagcctcctgcaagcatcctctcctgcctgggsatggctggtcccagcccccctcttcgagctggtgtgggaagaagactgctgggagtggcccatcctgacctacgtccttgcctctgtggggagctccagg

SEQ ID NO: 38371 - DNA, 201 bp, Homo sapiens
ggtcagggcatttagagcaggaggaggtgcagagcgggagcctgctgttccgcctcctgctgtttctgtcccgcagcccggccagccgcaaccagaggatyctctacaccgtgctggagtgccagcccctcttcgactccagtgacatgaccatcgctgagtgggtttgccttgcccagaccatcaaggtagtggggctgg

SEQ ID NO: 38372 - DNA, 201 bp, Homo sapiens
ccacagccagaatcgctgccccccaccccatgccttgtgcctggtgacttggcgctgcctcctgtgcccagcctgggctgcccgaggccaggacgactccragggacccaaaaaggagagtcggaggcaggagacctgggccgggtgcaggtggtggctggggtgggggtgctgtgagtggtggggtctgtgcgcctgtaa

SEQ ID NO: 38373 - DNA, 201 bp, Homo sapiens
gcactgtcactgccagacgctggtatttttgtctactatggcccccaccctggctggtacactcagaaggacgggctgcgtcccctgtgcctagagaggcwtctggcacagagccagccttcaacatatattgcatgaaagattccgtccaaggacgctgtagatgtaggtggacgcagacaaaagcaaagcaggacagtg

SEQ ID NO: 38374 - DNA, 201 bp, Homo sapiens
agagtccctaagggccctccagaggagggggcagccccttcctcaccaggccacttcccccagcccctgcacaccatgggtgggtggagccttccctgccrggtccccacctggcctgctcctggcctccccaggtggcgagtgagttcttcccaggagggtggcagggtgaggaggagctggtgagggcctggcaggtgc

SEQ ID NO: 38375 - DNA, 201 bp, Homo sapiens
agtccctaagggccctccagaggagggggcagccccttcctcaccaggccacttcccccagcccctgcacaccatgggtgggtggagccttccctgccggrtccccacctggcctgctcctggcctccccaggtggcgagtgagttcttcccaggagggtggcagggtgaggaggagctggtgagggcctggcaggtgctc

SEQ ID NO: 38376 - DNA, 201 bp, Homo sapiens
agcttccctagcccaggcagctgtgaggaccagctcagaagagaagtcctgaaacagacacttacagatgaggaatattgacatgattgtgcaaatggacmtgaaactggattttcagggggctgtgatgggctggattgtctcccttagattctaatgttgaagtcccccacaccccagtgtcttagaatgcaactgtat

SEQ ID NO: 38377 - DNA, 201 bp, Homo sapiens
gggcttggcagcactggccttcctttgggggcatttgacacctcacccggggctgggtggggctgcctgcccaggaccaaagcagctgttcctgtctgggygggtggggtggaggcgccccctcacccacactgggcttctgtccaggcctgggccatggcgggctggtgggtcaagcccacaaggtcactggacgcctgg

SEQ ID NO: 38378 - DNA, 201 bp, Homo sapiens
tgggtgaaaccaggctccaggctgcccgatggcccccagtgactcctgccccaggaccaggtcgctgctgggtcagctgtttggggctggctttgtaagakcgtccaggccacctgggggacaggcacgtgggcagatggacaggtgcccagcaggccccaacaactcctcctctgcccccacccccaggctggcatacag

SEQ ID NO: 38379 - DNA, 201 bp, Homo sapiens
cagctcctgggcgcagcactaaggctggtctgggtgggaggctgccctggccccagccccccacccctgagtgtttcccacgtgcgtgtgggtgtgggaamctgatgccgggctgtcgggccggttctggcacccagtgttgagaaacctcaggccttgcccagggtgtggctgctggggcccctggggaggggcacaggt

SEQ ID NO: 38380 - DNA, 201 bp, Homo sapiens
agatcttatgttgtggatatttacattagaggtacgtatggaagttctacgttagagatacgtatggaggttctgcgttagagatgcatatggaggttctrcgttagagatacgtatggaggttctgcgttagagatgcgtatggaggttctgcgttagagatgcgtatggaggttctgcgttagagatgcgtatggaggt

SEQ ID NO: 38381 - DNA, 201 bp, Homo sapiens
ccagtgttgagaaacctcaggccttgcccagggtgtggctgctggggcccctggggaggggcacaggttggcagtgtgcaccctcagcctctctgagccasctgggggtagcaatgccggcctgggcccgggtgccagctgccagcaccctgtcgagggcttgtcctgggctttttacctactgtctgggaagtgaggggc

SEQ ID NO: 38382 - DNA, 201 bp, Homo sapiens
ggttgtgtggccctcccatagtctcaagctgggtttgctcaggctcttgggctgtgccgtacagacggggtgcctgggcttgtctctctgccctgccttcrcactctacctgggtgtccttctcaggagccctcatgttttcaggaagtgctgcctggtgtctaacctgaaggcgtcctgctgcagtataagccattcctt

SEQ ID NO: 38383 - DNA, 201 bp, Homo sapiens
aggcgggaggtcagtgcggggtgggtgtgggccctctttgtctctgtgtagccccctctcagccataactctttgccagtggcagcggtgccccctccttycctgtgctgatgccttatctgcttgtccggctgagacacacgccctcagttaaagggcatctcacgctgccatcatgtggggctgactgatgctgtgggc

SEQ ID NO: 38384 - DNA, 201 bp, Homo sapiens
ggggcatctggacaaatgcctggtgcaggtgagaaggggtgggactacctccggcatccctgggctgagcccacctggtctccccggttgctcctgcacayggcagtgcccacctgcttccctcagctcctgaggggctgggcagagcctgttgctcacgccaccccactcagtgctgctccgggttgtgaaagctgcagg

SEQ ID NO: 38385 - DNA, 201 bp, Homo sapiens
caaggaagaggttccaggcagggctggagggttcagattctgcagcccttgaagcttttggagggccctcattgagaaaagtaatacaagttacaaaatcrtagttaggtgtgaaagccggtgtttgtttattttttatttatttttatttttttgagatggagtctcactctgtcgcccagactggagtgcagtggcgcg

SEQ ID NO: 38386 - DNA, 201 bp, Homo sapiens
ggccctcactgcagggcaacacgctgggcggtggggtctcctggctcctcagtctgagcggcagccaggtaatggcgtgggacacgggcctgagtggcagstgggggctgtgcaccctcttggtcaccctgggatgcaccaggcaggcacgagcccctgtagccatcactcgagcccaaacagttaggcacacccgggttc

SEQ ID NO: 38387 - DNA, 201 bp, Homo sapiens
ctcctggggccgtccaggtgcgaaatgaggaatcaccacgggctccaaggcaggaagccatggcttccaaacgcgggtcagccgcctgccctctgaggggkcccaggggcagccatagcccttcctcccagcctctgactgtcataagaccggagccccatcccaccagctctggtcctgcccctcagtgagggaggaggc

SEQ ID NO: 38388 - DNA, 201 bp, Homo sapiens
tggggatggctggtcccagcccccctcttcgagctggtgtgggaagaagactgctgggagtggcccatcctgacctacgtccttgcctctgtggggagctycaggtggaaggggggccgggccccgtacctgggatgctgagaacttgctatgtgcggagcccttggcgtaggggccccagctctgccagaggggaacaga

SEQ ID NO: 38389 - DNA, 201 bp, Homo sapiens
gacttcctatgtcaaactgggaaccccacctgcttgccggcctgtcccaaagtccctcctgagcccggctccttgcaggcacagcagggagggcagagatytggggccaggcagctgagagaagctccctgcccggtgaccacacgggtcccagcagtcgagagtgtcagtggagtgatgcccatggcttcttggttactg

SEQ ID NO: 38390 - DNA, 201 bp, Homo sapiens
gaaagccggtgtttgtttattttttatttatttttatttttttgagatggagtctcactctgtcgcccagactggagtgcagtggcgcgatctcagctcaytgcaagctctgcctcccgggttcacaccattctcctgcctcagcctcccgagtagctgggactacaggcgcccgccaccgtgcccggctgaaagctggtg

SEQ ID NO: 38391 - DNA, 201 bp, Homo sapiens
cccagcactttgggaggctgaggtgggtggatcacttgagatcgggagttcaagaccagccatggacaacatggtgaaaccctgtctctactaaaaatacaaaaaaaaaattagccagatgtggtggcagatgcctgtggtcccagctactggggaggctgaggcatgagaatcgcttgaacccaggaggtggaggttgca

SEQ ID NO: 38392 - DNA, 201 bp, Homo sapiens
cccctgcaggcagaaccaccccccgccccatcagcttttcttctcccttctcccccatcacaacacgctcccatgttaccggagctgcctcccctagtagrgggcctcctgcccgctccagtcccaattctcacctgcttcccttacgaaccccctgctcccctgagtgggaacatctaggcttccccttcccagcagcag

SEQ ID NO: 38393 - DNA, 201 bp, Homo sapiens
tagagatgcgtatggaggttctgcgttagagatgcgtatggaggttttgcgttagagatgcgtatggaggttctacgttagagatgcgtatggaggttctscgttagagatgcgtatggaggttataccttagagatacgtatggaggttctacgttagagatacgtatggaggttctgcgttagagatacgtatggaggt

SEQ ID NO: 38394 - DNA, 201 bp, Homo sapiens
cagttgagctcatgtaattaccatatgttaatttgggggtgatatgttttaggttgatattaactaatatgttttcctatgcagtgagaaatgttttgctkctttcctttcagaacagaacaatccatatgcatgtatactccaaggcaaccccttgacttttctgggaaatttactttcttgggaataacctaagttatt

SEQ ID NO: 38395 - DNA, 201 bp, Homo sapiens
cctgcccgagcgtacccccccggggggttccggggaagggggcgggggtccggatccccggatccccggaaggcgacttgcggggaccccggccggcctckcacgccggcgatcgatcccttttccggctgcccaggatcgggggagagaggcgggatccgggtgccgcggtgcccgagcctcccggggaaagcctccgcg

SEQ ID NO: 38396 - DNA, 201 bp, Homo sapiens
tggggaaagttcccaggccggggaaaaggtggccgcacgctggcttttctcaaggcagccggccctcttggcgtcgtgcttgatttcatgggtgtttaatwcgtgctttgtgggcgctggctccccctccccaccccaccctcaccctcttttctggcttcacttttcagataatgctgtccctggcgttttggtgaccga

SEQ ID NO: 38397 - DNA, 201 bp, Homo sapiens
ggggaaagttcccaggccggggaaaaggtggccgcacgctggcttttctcaaggcagccggccctcttggcgtcgtgcttgatttcatgggtgtttaattygtgctttgtgggcgctggctccccctccccaccccaccctcaccctcttttctggcttcacttttcagataatgctgtccctggcgttttggtgaccgac

SEQ ID NO: 38398 - DNA, 201 bp, Homo sapiens
tcagatttatagtcagttaacggaggcttaagtgatgtaaagttttatttctctctcacatagaaattagttagaggtagtagtttagggctcttagaggscccaggctgtcatattctacctgcttacacatggctttcaggatctaggtcacctcacagtccatgatggctgctggggctccatcccccttgtctgagt

SEQ ID NO: 38399 - DNA, 201 bp, Homo sapiens
atcagatttatagtcagttaacggaggcttaagtgatgtaaagttttatttctctctcacatagaaattagttagaggtagtagtttagggctcttagagsccccaggctgtcatattctacctgcttacacatggctttcaggatctaggtcacctcacagtccatgatggctgctggggctccatcccccttgtctgag

SEQ ID NO: 38400 - DNA, 201 bp, Homo sapiens
ctggttttcacgtgtctcctgaagccacccctaaggagaaggcttcgatgtcatcttctggtcagagccgagcacagtggtcctcttcagagacagatccrtgcagcaggatggcacctctgttgtcctcccagactagcagtaggtacacgtgggcttcgcaggctgttttctgccctggaatgctgctgttttttagac

SEQ ID NO: 38401 - DNA, 201 bp, Homo sapiens
cttttctgccagtcatgtttcttaaaggaaatcggtagaatttataaatgtcatgttttccaaatactgttcttcttttaattacctaagaaaatcttttwaaaaatttttataaagatagtaatgcatattcattatataaaacatagacaagaaaagaataacaagtaaatcattaactggagataaccattgatcact

SEQ ID NO: 38402 - DNA, 201 bp, Homo sapiens
ggccttctctaggggaaaaacatgtagtttatgcaacttttcttttccctttctgctctggatttgaccttttgttccttcaggtgattgaaaaaattcgraaagtcacctgtttcctcagaattgctttaagacaagactaagtgaaccaacaagaatgaagtcagctttttggaaatacctcccaagaggccttgctct

SEQ ID NO: 38403 - DNA, 201 bp, Homo sapiens
acaggtgcgagtcccaccccagaggggccttgagaggctgcaagtgtcctgggtgggctgcctgcttcaggaggacttattattggggaaaaatacccccmctacttattactaagggccgaatgctttatgttcacacaacaactccatgttgtgtgactttggacatgttccttaactttctttatcttggtcttctca

SEQ ID NO: 38404 - DNA, 201 bp, Homo sapiens
tgcccttttataatggcaccaaccccacccatgagggtggagtcctaatggcctaatcagctctctgagatcccatctgttaatactgttacaatggcaaytaaatttcaacatgagttttggaggggacagacattcaaaccatggcaggtggcaagaagtatcaaactactagatccttgggattgtgctttgtactgg

SEQ ID NO: 38405 - DNA, 201 bp, Homo sapiens
tgatacatggaaaaatgtacctgaaatgtgagtcctgcttttgtgactcaccctttcctttacataagcattgatttacatctgttgttttttaagatagkgtgtatgttgaaaagttcagaacaagatcaagtggagacataaaatggtaagatgtgaaaagttgttcttgccagattaaatggttccacctgaagaaaa

SEQ ID NO: 38406 - DNA, 201 bp, Homo sapiens
tcactgccacagagaagtcagaggaagggacttgttgctaaaaaatcctttaaaaggttaaatactttaaaagattaaagcaacataactgtaaacatatygtataaaaatgaaaaacacaggaaccctcttcccttccgcctggtgtgggcttgggaaatgggcaagcggccccagcaatcatgggaggaactcttgcgg

SEQ ID NO: 38407 - DNA, 201 bp, Homo sapiens; identical to SEQ ID NO: 8530

SEQ ID NO: 38408 - DNA, 201 bp, Homo sapiens
ccctgggctgcatcatccttccacattgtctctctaaagtacctgaagccagtagttctcaaactttggagagggttttgagtcacctcgagagctgataagaacagaggcccagattgaagttgaatagtgctgggcctttgtttttaccaagttccctggatggttctgctacctcctagcctgtgagaactactcctt

SEQ ID NO: 38409 - DNA, 201 bp, Homo sapiens
attgtggcagaagggtatcttaaaaaccatttgtttctttaaaaaaactcaaacattagcactttattcttataaacttgttttctgtctttttttccccrtaagagaaatgtttaaaaacattctttaaacaattctattttgtcattatcttttttttggacaaatatcagtgtcttctgtttattacgttgctgctgg

SEQ ID NO: 38410 - DNA, 201 bp, Homo sapiens
ccatgttagccaggatggtcttgatctcctgacctcgtgatccgcccacctcagcctcccaaagtgctgggattacaggcctctgcgcctggccttgcatkgacaattaatttgtttatggaaagccagttatccaatgatggtgaacaaatgcaacttgactgtataatacttattttggttttggaccaaagtcaccat

SEQ ID NO: 38411 - DNA, 201 bp, Homo sapiens
taattatcaataattatgaattgtcaaaattatgtcatgaaacctctttttttcttttttttgagggggagtcttgctctgtcacccaggctggattgcartggtgtgatcctggttcactgcaacctttgcctctgaggttcaagtgattcttctgcctcagcctgggattacaagcatgcgccaccatgcctggctaat

SEQ ID NO: 38412 - DNA, 201 bp, Homo sapiens
tcaggcctttttatggggctgcctctctctctggaggaggaagggagcagatattgatggagcaccaactgtggccactgtctgatggccatctgatgggrttggggctccgaaggaaaatgggggatgtgtccctcttgtggttgatgtctttttgtctcctgtgcttgaaacagatgccagcaatacagagagaagccg

SEQ ID NO: 38413 - DNA, 201 bp, Homo sapiens
aaaaatacaaaaaattagccaggcgtggtggtgggcgtctgtagtcccagctactcgggaggctgaggcaggagaccgcgccactgcactccagcctgggygacagagcgagactctgtctcaaaaaaaaaaaaaaaaaaaaaaaaaagaaaacaggaagtagggaggggcaaggaggcatctggtgcagtgatctgacta

SEQ ID NO: 38414 - DNA, 201 bp, Homo sapiens
cctcttttctggcttcacttttcagataatgctgtccctggcgttttggtgaccgacctttccccttcctggcatttccataggggctgaggcagagcagytgaaggggcattcccatttcacagatggggaactgagggagagaagtgaaatagcggagcacccagcccgtgccatgggagctgagccagcgggcacgtc

SEQ ID NO: 38415 - DNA, 201 bp, Homo sapiens
ccttggctccccaaagtgttgggattacaggcatgaaccactgcacccagccatgtttttattttatctgagagaaaactgaggttcagaacttaactgtrtacttctggaatcttcacagagaaataaaaaaaaagaaaaataatttactatagattcattaactactacgtggcggagccagggctgatgtctccactg

SEQ ID NO: 38416 - DNA, 201 bp, Homo sapiens
ttcatggctcttactggccactgggcaagactcagatagcaccaaccaaccagtcacagttgtgatgtaggatgtgactgtgaatgacatccctgctgccygcttcagagaaagggctgccacttgccagagaaggaatggtgataatgagggacagccagtccctaagtggagatccctgaaagtggtgaatatcttaga

SEQ ID NO: 38417 - DNA, 201 bp, Homo sapiens
gctgaggcatgagcatcacttgagccctggaggtggaggttgcttgagtcctggaggcggagtgagccaagattgcgccactgcacttcagcttgggctgyagggtgagattctgtctcaaaaaaataaataaataaataaataaaataaaaaaacaattgaggtggatgtctccctaggggtaccccaggaagccacagg

SEQ ID NO: 38418 - DNA, 201 bp, Homo sapiens
ggtcagaggcaagaggagggtgcctctgagcttcaacccctcccaggaacaatgagctcaaattggaagagtccagtggaatcggggggatggtgtgagcrcccctgttcagtctttgacaattgcatacagaaaagcagctggtatgggtttgggtgtcaatgaaagggccaaagactggtggccagctggtttggggga

SEQ ID NO: 38419 - DNA, 201 bp, Homo sapiens
tgagaaacattcaccatatctcaataagctctcctcagccagttggtccttttgtggttgaaaaaagtgccatatctttggttgggcatccaataaaatayggtatttaggggctacctgtatggaaaatccatatccttaaaggttagctcaccaggaggatgttgagaaatggcacagggggctgggcgcggtggctca

SEQ ID NO: 38420 - DNA, 201 bp, Homo sapiens
tctttatgcaggactgttatttcaaaggatggtgtcccctccccaaccataagaacgatccaaacctgttttctggggcccagagtttgctgaggataggmctgggctgaagctttcattgctggtctgtggggtagaggtaagcctcccctgtgaagctggtaggttacatgctttggcaacatgaattgttatttctgg

SEQ ID NO: 38421 - DNA, 201 bp, Homo sapiens
aaagcccatgtctactaaaaatataaaaattagccaggtgtggtggtgggcgcctgtaatcccagctactagggaggctgggcaggagaactgctggaacscaggaggcggaggttgcagtgagctgagattgcaccactgcattccagcctgggtgacaggcaagactctgtctccaaaaaaaaaaaaaaaaaaaggcac

SEQ ID NO: 38422 - DNA, 201 bp, Homo sapiens
ctacaaaggacctgaactcatccttttatggctgcatagtattccatggtgaatgtgtgccacatttttcttagtccagtctatcattgatgggcatttcrgttggttccaagtctttgctattgtgaatagtgctgcaataaacatacatgtgcatgtgtctttatagcagcatgatttataatcctttgggtatatacc

SEQ ID NO: 38423 - DNA, 201 bp, Homo sapiens
ctggtcctgcccgcctggtcctgtggccagcactctccactgtgagtcattcaggcccagtccttgtcctggtggtgcatctgcctcatgatgtcaagcaytgtgggaaaggcacccagcctgccccactccaaaggatgagtatggggaggtggtggtgcttctcaaacccaaggctgtttgtcataccacattccgaag

SEQ ID NO: 38424 - DNA, 201 bp, Homo sapiens
agcttcttatggctcttatgttctgcaggacggatgaactaggtacccaggacaggtctgtttgtgcacaaggctgtctccttctccccctccttggtttytctactgaggctttgttgtgcttggctcagggtgatgttagcaaatgcactctccaccctgctgtgccacattaaggaaacgcatgttgtattggcttct

SEQ ID NO: 38425 - DNA, 201 bp, Homo sapiens
gaactcctgacctcaagggatctgcccgcctcagcctcctgaagtgttgggatcacaggcgtgagcccctgtgcctggccagattaggttctgattttggrgggggaaatggatcagtcagtggctggataaaacagttttattgtttcttgttaaaaataagagtaatacatgcttatggcaaaaaatatagaaaagaag

SEQ ID NO: 38426 - DNA, 201 bp, Homo sapiens
tttatgtcttcttttgtactaagtctttgatatctagtctgtattgtgtgcttgtagcacatctgaatgcaaactggtcacctctcaggggcttggcagcygcatgtggctagagggctgctgtatcagcacaggtttagacaattatgttgtggttgttttggagttcagatttctgtctccttgaatcttgaatatata

SEQ ID NO: 38427 - DNA, 201 bp, Homo sapiens
tgacagcatgccctgatgacctctccctccctctgccttggccgttctggttattttgaactcctcttgtgttctcacagatgctattcaggtttttgacrtcaccgctgtgaacatcagtgccacaagcctgaccctgatctggaaagtcagcgataacgagtcgtcatctaactatacctacaagatacatgtggcggg

SEQ ID NO: 38428 - DNA, 201 bp, Homo sapiens
ccacccccattattaaatcctcaactgctttatttctgatttgcattttccatggctgaatgaatctgctgacttccgttttctttttctgtttcagatcytgtgcgcaggtggcagtgagtacccttttcctctctattcttgtgttgttcgctactgccccctaatggacacacagcaacattaacagcaatgtgaaat

SEQ ID NO: 38429 - DNA, 201 bp, Homo sapiens
tgtctgatggccatctgatggggttggggctccgaaggaaaatgggggatgtgtccctcttgtggttgatgtctttttgtctcctgtgcttgaaacagatrccagcaatacagagagaagccgggcagggagccccaccgcccctgtgcatgatgagtccctcgtgggacctgtggacccatcctccggccagcagtccca

SEQ ID NO: 38430 - DNA, 201 bp, Homo sapiens
acagcaaggaccaagtacaatgttcccctgatatttaatttgctaaaacatgtaagaagaagaaagttcttacattgttaggtcccaaagagagtgccacyaagcaaccttgccaaaaccaccttgctggagcttcttattatctttttttagcgaatggcaataaagtcattttgtcaagctaaccaagtaccataatga

SEQ ID NO: 38431 - DNA, 201 bp, Homo sapiens
agcattaactgctgaccttgccatctgtgagcaggtgttgaatgagctcagttccctcccagcccttctttttccctggtgggtcattggctcctgagtargatagatgcatgcaatagaagagctgttaatagcatttactctttcttaatccttattaatcccattcatatttcagtgtctgaaacttggcaggatgtc

SEQ ID NO: 38432 - DNA, 201 bp, Homo sapiens
ggctcatcatacacagtggagatctttgcacaagtaggggatgggatcaagtcactggaacctggccggaagtcattctgtacaggtgagtgtagccccarctgcctcttggactcctccctgagtggtgctgaccttgcaggtcagtcctcccaagtctgtagtttgtctggttttgtgtgatgtgcagtgatggacatt

SEQ ID NO: 38433 - DNA, 201 bp, Homo sapiens
ttatttcaacatgtaatttctgtgaagtattaatgagttattttatgtcttcttttgtactaagtctttgatatctagtctgtattgtgtgcttgtagcayatctgaatgcaaactggtcacctctcaggggcttggcagccgcatgtggctagagggctgctgtatcagcacaggtttagacaattatgttgtggttgtt

SEQ ID NO: 38434 - DNA, 201 bp, Homo sapiens
tttgtttgctcaaattgcctttataaaatagattgatactctataataagcaaatgttgtgaatttggaattttcaaattgaggcttactaataatgttawctattttatccgagtttatttgggtttcttataaaatgtaatttctcaagaagattttgctgccctaaaaaaaaaaaaaagaaaaagaaaaagacaaaaa

SEQ ID NO: 38435 - DNA, 201 bp, Homo sapiens
atgtgagttcattattgataggcagctgtggcaggaagggaaggatctgaatgcagaattggaggatgagggacttctgttgcatctgaaatcagtgttgrggaaatgacttcacttctgtgaatctctgctgcctcatctttaaagggggataataaactctccttcttgagcatattgtgagggtttgatgagcaagca

SEQ ID NO: 38436 - DNA, 201 bp, Homo sapiens
ttattgccagcttaacttgtttttatgacatcttcaggaagaaaacctctgctgtctatttaatggagatgaattgttaaacttttaccatttgcaactayacgtctctatgagtcagacttttattgatcgtgtacaactaaatgaaacccggaaatgaaggaaatgtaacaagcgattttatgtattttttgtttgctc

SEQ ID NO: 38437 - DNA, 201 bp, Homo sapiens
agctggaaagaaaccaaatgggcatgtagaggtctggggcttgatggcagtgtggcctaggatggcttgtgaggctcacttctgaagccctgcacaaggamtttcttggccagtgtctgcctttcagttccccatgctgtgctccaaccagcccaggaaccagccctgctcagagtgaccatgcacactcgtcctcctgtg

SEQ ID NO: 38438 - DNA, 201 bp, Homo sapiens
ggtatgaactcacacaaacaggttacattaaatggctatataacgcaaggggttgttgcgctccaaaccctttgcgtcatactgtcctggatgtctacctyggactactcctgactgaagcacagccactttccttagaaattggcttgtttttcctgaaagttagaaaactgttaacagaaactaggaattcaagtcagg

SEQ ID NO: 38439 - DNA, 201 bp, Homo sapiens
ctactctaggggcaaagggagctggatggggactgtgtcctaggtcaagggacagctgctgctctgctctaaatcaattttcatgctgaaagcagggcctrttgtaggcagatctgatttttaaagagaaaataagtctggatttttatgagaaattttaagagttggcaagaattgtaaattaaaaaaagaaaaaacaat

SEQ ID NO: 38440 - DNA, 201 bp, Homo sapiens
ttgccatgcacccagggtgcagggagacctgtcttgcaggtgttcaaacaacttttgtcagcctcagtgtcagggacttttgttgcgtagagcagtcaccraatcctatggtgagaagagaaatcgttggagatgggggtgcaggggtggaagctcttatttcagaagacctgttgtgaggtaagactcagaccctcagct

SEQ ID NO: 38441 - DNA, 201 bp, Homo sapiens
ttcagctagcagcagacttctcagcagaaacttacaggccaggagagagtgggatgatatattcaccatgctgagggaaaacaacctgccaaccaagattrctatacccagcagaactggccatcaaaaatgaaggcaagataaaagactttaccagagaaacaaaagctgagggagttcatcaccactagacatgtctta

SEQ ID NO: 38442 - DNA, 201 bp, Homo sapiens
ctggtcaagacagagccctgtggactatggaagggattgaagccattctgtggatcctataggcttcttttctaagcgaatgattagtgtttattcagtarccctatgtcaggtggtttctgtatgaatgagaggtttgcctttccagctgcggcggggctttgggcaagttgctgtctctgtgctccttcgtttgctcat

SEQ ID NO: 38443 - DNA, 201 bp, Homo sapiens
aaaatacctcacagggttgcagtgaagatgtaaggatgatgatgatgacaacagcagctcaaatagatcatttaacttaattctcgccaaagcaaggcagrtacaaagatcatcctgttggcagatacagacagggagggacagagaggttaattaagcaagctacctgcccgcagttacatggccagaagcagtggcact

SEQ ID NO: 38444 - DNA, 201 bp, Homo sapiens
agtttccacatttttaaatgggtggagaaaacaaaatctacaaagaataatgtttcatgacacatgaaaattatgtaaaatatacatttaacgcttgtaartaaagttctgttggaactcagctacagtcgttagtttacatatcatcgatggctggtttcgcagtacaagggcacagtttaaagcctgccaggcctaaaa

SEQ ID NO: 38445 - DNA, 201 bp, Homo sapiens
tgcagcttggaactcttgggctgaagtgattcttcttccttagcctccccagtagctaggactatagtgccaccatgcctggctaatttaaattttttttktgtgtgtgtgtgtggtggagatgggttctcactgtgttgctcaggctggtcttgaactcttgggcttaagcgatcttcccatcttggcctcccagagtgc

SEQ ID NO: 38446 - DNA, 201 bp, Homo sapiens
taccatgtctccttttccagcctcattccctgagatgtagccggagttccagttcagccaacctgcccgttgttttctctcctggaactgggtgtttgagyctcctgcatggagtgttcttccttcccagctaaagtcctggtcatcccatttccatctgaaaggcccccttgttcatgaagcctctcatggtccttcccc

SEQ ID NO: 38447 - DNA, 201 bp, Homo sapiens
gtagcaagcatgcagacattctcatgacatcctggcagatatcaagaccaaagaacatcccatgttccctcttgaaggcttgtaataactgccataaattrtcttgtgggaatggagtggccctggcctaagctgtgctgtaccggactctcctggtgacagttttagtggctgcatatgtttgcagaagaaggaagcgtg

SEQ ID NO: 38448 - DNA, 201 bp, Homo sapiens
aatgctgtgtacacgcttggtcactcttccctttcttgagatgacatgtccccttcttggagacccaagatgattgacaacaataacattcctttacaacrttttcttctcatctagagcactgggaggctgccttttaacagagatatcacagagtagcaagcatgcagacattctcatgacatcctggcagatatcaag

SEQ ID NO: 38449 - DNA, 201 bp, Homo sapiens
gctttggttctcctgtgtgccaggaacagcagtaaactttatgtcctaagattagtatggttggaaatgcatgtggcagtggttcccaaacactggtgtgyagatggaacacagcccgtgaagttttcagcggtccttgttaaaaagagataaaggaaagagataaaggataaagtgctgagattctcgtgaagctaaatg

SEQ ID NO: 38450 - DNA, 201 bp, Homo sapiens
tgtaaagtttaatttttagtcattacaactcctggttagtactcaggctctgcttgatttcccctgcctttttgatgttgttaggcagcctttctgtctgkatctaaatcattttctgggcttttagatccagacaagtgagagtcaccctctgagacagttccatttcacctcctggccagaccacggtgttcccgacac

SEQ ID NO: 38451 - DNA, 201 bp, Homo sapiens
tgatacaaagaagagaaagagagggatcagtttttccaagtgtgcatttcatttcagtgtaaatattttgtgaggtggggcatccctgtctcctggagaartatatttttaatctaattgtttactttctttgcatagcccctagtccaattcctgacccttcagtagcaactgttgccacaggggaaaatggcataacgc

SEQ ID NO: 38452 - DNA, 201 bp, Homo sapiens
gctctccagttttataggtgaggaagctgagctcaagtggttttcctgtggcccacctgggtgtcatagcagagtgagccctggaacccaggcctgcctcrtcctgacttctgtgatctcgggcgatcacatagatcgcagtgttcgctcttgcatcatgtgtgtttgacaacttttctgggtgcccctggccctagggta

SEQ ID NO: 38453 - DNA, 201 bp, Homo sapiens
tccagagcctgagcccttgaccacaggagctcacgcctcctctcatttcctgtgaatgattgtgtgcaatgtaagcacagagcttctgcactctcatgatmaagtgctctctccatggccagaaacagcagtttctgaggggctcatgttgtaggtgatgatacaaagaagacagagagagggatcaggtgtcctaagtgt

SEQ ID NO: 38454 - DNA, 201 bp, Homo sapiens; identical to SEQ ID NO: 8514

SEQ ID NO: 38455 - DNA, 201 bp, Homo sapiens
gagatgaggcaattctcatccctccctcttgcttctttctgttcatcagcttcattctcagagcagctccctctgcacacttaaggagcccagctgctccygtttcacaccctgcagctgccccaccagccagctgccccaccaaccagggtctggtccagggaaacgtgtcttgagtggggtctgattagcaaagtctgc

SEQ ID NO: 38456 - DNA, 201 bp, Homo sapiens
gtcagaggtcaaggccagtggtctatcagaacccagttcctgcaggagccagtgccggtactaggtagactcagatgactgaatggtcctcgggatctgarggccagtgggggagatgaggcctggcctcccggaagtgctcagtaaacatttgttaatcatttcctgcctagggaagctctgtggtatgctcaggagaat

SEQ ID NO: 38457 - DNA, 201 bp, Homo sapiens
tacttaataaaacaaaaagacgcatgactgacctgatttagaactctttgcatgagagacatgtgctgtgaagaatcatcttaccgtttcggagctggacrgtgccttagaatcatctaggccgatgtctttaccttcaggcccctgcagccctcaggaggggttttgctctatctgcagcactacctgtgcttttctgta

SEQ ID NO: 38458 - DNA, 201 bp, Homo sapiens
ggagatgaggcctggcctcccggaagtgctcagtaaacatttgttaatcatttcctgcctagggaagctctgtggtatgctcaggagaatcttgcttctcrtgggggaatgggtggttgtcatttgggtggcctgactgccagcctgcttgctggctctctgggagttggggtggtggcatcaacctgcagaggcggggca

SEQ ID NO: 38459 - DNA, 201 bp, Homo sapiens
acttcaaagaaagtgctgccctcccagtggtgatgaagaccttccgctggccccagcctctgggatctggcctttacttgggtattcatgtggccctgggrgttggctttgctgaagttgggcagagcaggtgggttctggaatgtgcaggggcaaccagagtgtccatctgtttgggtgaagccagctgtttaggtctga

SEQ ID NO: 38460 - DNA, 201 bp, Homo sapiens
tggggtttgggagttgggcgggggaatgacctgtttgaaaataattttgggtgctaatttctgggacccatgttcattttctgtctctctctttcgttttyctatcaggaccagtatgttttcctcaatcagtgtgttttggatattgtcagatcccagaaagactcaaaagtagatcttatctaccagaacacaactgca

SEQ ID NO: 38461 - DNA, 201 bp, Homo sapiens
aggataaaaagcaggcatcttgctggagggtctctgttgctcagtagaaattattttgtaatgttttttgaaaaccacaaacatggacatattatggactrgataccacatttgcatcaggatttttttttcaaccagtacagtacataacaaagaaatctctaccctgcagaccctctgggggtgtgagagcgctccttg

SEQ ID NO: 38462 - DNA, 201 bp, Homo sapiens
ccttgctgtaggtaatacttgctttgaagtactggtgtggatggcctatgccctggcagtcttactaggtgggactggctgtcctctcattctcatgggawtggcctcatgctggtagctgacttcctccccgtgagaccgtaggtctaaactaacaaggtttacacatgtgacaaacatccaggttgccagggctcaaaa

SEQ ID NO: 38463 - DNA, 201 bp, Homo sapiens
aacacctggcctcaagtgatcctcctgctttagcctcctgagtagctgggaccacaggcttacaccaccatacctggcaaattttttttttttttttttttggagaggcagagtcttgctccgttgtccaggctggagtgcagtggtgtagtcatggctcgctgcagcctctgtctcctgggcttaagccattctcctgcc

SEQ ID NO: 38464 - DNA, 201 bp, Homo sapiens
gatgggtggggaccatctgtgctctcctggaaaggaaattgtggtttctttcttttcttttttctttcttcttcttttttttttttttttttttttttagyttatgggaaagggagacttgtgtctcaattgagtctttgtggcgttgtattacagagagtcacagaaaatgttctatgtaaatgactatgtgctctgatt

SEQ ID NO: 38465 - DNA, 201 bp, Homo sapiens
tggcagtttctgaggggctcatgttgtaggtgatgatacaaagaagagaaagagagggatcagtttttccaagtgtgcatttcatttcagtgtaaatattktgtgaggtggggcatccctgtctcctggagaaatatatttttaatctaattgtttactttctttgcatagcccctagtccaattcctgacccttcagtag

SEQ ID NO: 38466 - DNA, 201 bp, Homo sapiens
aggaggaaatgaaggctcagagaattgagtaacttgcttgaagtccaaagctgaggagtggagccagaattcaaactcgagtttgtctggcttccgaatcstgctatttcctcagcacagtggccgtcctccaaggctgtcacatgttccttccctggtgattcacggcacctggctacctccttttagactcactttgtg

SEQ ID NO: 38467 - DNA, 201 bp, Homo sapiens
ggatgggtgctattttccaaggaaagcccctcctggtggggggccataggaaacagctggtgcaaaggcctggaagactcactggcatctttctggaatarcaaggatcagcttggtgggaagtggaatgagctgggggtggagtggggtggggtggattttggagtctgagcttgagatacctgcttggagatgctgagc

SEQ ID NO: 38468 - DNA, 201 bp, Homo sapiens
tctattaaggaacatttcaaactttgacagattcagaaggaatgatatgatgagcgccatgttcccttcacccatagtgttctgcatttggccagtcctakttcctctgcgcccccagctgggcgatgttaatgtgctcccagctgtcacatcaggccactgatagacgccacagtgtgggatgctactttcaaatgatat

SEQ ID NO: 38469 - DNA, 201 bp, Homo sapiens
tcatttgcttgtgccgagccgccaagtgccccctcctgctggcgacaggtccggatgtgggccagttctcagcccagggaaaatgaacagtgtcttctccrtggtgcccagaacagtctgagtcagtggaatgtgctggccagtcaggcagaagggaacttccacttcttttttaaaaccttggtggaaactgtgctggca

SEQ ID NO: 38470 - DNA, 201 bp, Homo sapiens
accttgtttgtttaaagaccattaaagaacgtcttcaatttattctggattgagttttcctcaaaccaaaccacccctcagttcaccccccagagctgttsaggcccttcctgggggcttgtggctgtggctgcctcagatcagagcagaccctgggctgcatcatccttccacattgtctctctaaagtacctgaagcca

SEQ ID NO: 38471 - DNA, 201 bp, Homo sapiens
ttctgggttccttccggctgtccaaatcaaatttaattttcacacccagaccttgtccctgctctcatccttcagcccaccctcctgttccccattcagcyagaccccctgccagtcagttcaagtgctaggcatggggtatcgagtctcaggccggtccacagacattccagcacctggtggtaagaggtgagtgctgcg

SEQ ID NO: 38472 - DNA, 201 bp, Homo sapiens
ccggtccacagacattccagcacctggtggtaagaggtgagtgctgcgtggacccactgaggaaggctctggctgtgctgggggaggggagtttatgctcrtcctcatagaaggataagcaggaattaagtgggcaaaggagggagtgaggaagctctcactttctaggtagtaggaccagcatgaaccaaggtaggggat

SEQ ID NO: 38473 - DNA, 201 bp, Homo sapiens
ctgccaggctgggttgggagatgaatgtgtatgcatgtgtgaatggattcatttctgatgataaaaatactttatgcttatttatgtgaaacttggaaaayagaggaaaagtataaaattgaaactaaaagtcatccataatccttctaagtagctttatcatttaatgttttagtatatttccttcctgttttttttttt

SEQ ID NO: 38474 - DNA, 201 bp, Homo sapiens
attcatttctgatgataaaaatactttatgcttatttatgtgaaacttggaaaatagaggaaaagtataaaattgaaactaaaagtcatccataatccttytaagtagctttatcatttaatgttttagtatatttccttcctgtttttttttttttccttaattctgggtgtatgcaaaggattttgtaaccctttacat

SEQ ID NO: 38475 - DNA, 201 bp, Homo sapiens
tgcccagggagggttagatacctgggaggatagagcagaggccctccttctccccgacccctcgcctctgcaggctggtggggaggggggcaggggagtcsagttaccctctctccacgctttcttcttgtgtatgtgtgcgtgtacgtgcgtgtgtgtgttgtgtgtgtgtgtcttgggggatggagaacccctctcagg

SEQ ID NO: 38476 - DNA, 201 bp, Homo sapiens
aaactgtgttcttgaaaaaattatcacgcccattttagagatgaggcacagagaggtggagggacttgcccagatccaggtatgtggctctcctgtaatckcgcttctattgctttgtgatcagcagcaacttagtagctttcaaagcttcaattttcttgtgtgccaaatggggctaataaataccttagaggattgtga

SEQ ID NO: 38477 - DNA, 201 bp, Homo sapiens
gttgtatttttaaaatagagccgatcccagtttctgatctccgtgttgccctcacgggtgtgaggaaggctgctctctcctggagcaatggcaatggcacygcctcctgccgggttcttcttgaaagcattggaagccatgaggagttgactcaagactcaagacttcaggtcaatatctcgggcctgaagccaggggttc

SEQ ID NO: 38478 - DNA, 201 bp, Homo sapiens
acagagtctgaagttcaggaaatacagcaagagccttcctcagggatgaaacatgtgatcttatggtctgactagcctcaagccagctgagctcattgccrtgcaacttggtagttaatgattgctagtaagaagtttaaaaggatcatcccctcaaagaatgtcagagttggaaaagaccttagggacattaggctagga

SEQ ID NO: 38479 - DNA, 201 bp, Homo sapiens
tcttttaaaacccgctcccagcactgaaccccagtcattcttaatgaaggtgactgcatatatcttgttccattaatgcatgttgtatttttaaaatagarccgatcccagtttctgatctccgtgttgccctcacgggtgtgaggaaggctgctctctcctggagcaatggcaatggcactgcctcctgccgggttcttc

SEQ ID NO: 38480 - DNA, 201 bp, Homo sapiens
agatgtgtgccacctctcctgggtaattttaaaattttttttttgtagagatgggggtctcactatgttgccacagctggcctccaagtcctgggctcaarcgatcctcccgtcttggcctcccaaagtgctaagattataggtgcaagccacctctcctggcttgcttctttcccgtaaattgaggtgtgttattccact

SEQ ID NO: 38481 - DNA, 201 bp, Homo sapiens
tttttgtatttttactacaggcagggtttcaccatattggtcgggctggtctcgaactcctgacctcaagtgatccacctgccttgcccttccaaagtgcwgggattacaggcgtgagccactgtgcctggtcttatatttcttttctatttttctaccctgatcaaccttttcttttctatctctctcactgtttctacg

SEQ ID NO: 38482 - DNA, 201 bp, Homo sapiens
agtctacgaagaggggtgcctcaggcccatggtaaattttatgtaagtgttggttgtatataagatgatgaagtccgggcgcggtggctcatgcctgtaaatcctagcactttgggaggccgaggcaggcagatcacctgaggtcaggagttcgagaccagcctggccaacatggagaaaccccgtctctactaaaaatac

SEQ ID NO: 38483 - DNA, 201 bp, Homo sapiens
ttgcagtgagccaagatcacgccattgcactccagcctgggcggcaagagcaagactccgtccctaaaataaataaataaataaataaataaataaataawtaaataaataaaataaaataaataaaaaaagaggttaaggtttatacgcaggccatttctaatagatgttatggaagccccaggttttggggcatcaggg

SEQ ID NO: 38484 - DNA, 201 bp, Homo sapiens
tactaaaaatacaaaaattagccgggcgtgttggcatgtgcctgtaatcccagctactggggaggctgaggcaggagaatcgcttgaacccaggaggcggwggttgcagtgagccaagatcacgccattgcactccagcctgggcggcaagagcaagactccgtccctaaaataaataaataaataaataaataaataaat

SEQ ID NO: 38485 - DNA, 201 bp, Homo sapiens
ccaccatgcccggctaatttttttgtagtttttagtacaaatggggtttcaccatgttggctaggctggtctcgagctcctgacctcaggtgatctgcctkccttggcctcccaaagtggtgggattacaggtgtgagccactgtcccaggccagatggaccattttaaagattaggtaactgagctctaggggtcaagag

SEQ ID NO: 38486 - DNA, 201 bp, Homo sapiens
aaccaattagttacaaagtagggtctagaaatcagatttcctgaatcatattttagtgttttgtgaataatagtactctgaccccctcttgccaaattatrccctgggttttgttgttttgggaagattgtttactgtcatttctagagtatgaatgagtctttctaattgcatattttttctttccctttctatcatgaa

SEQ ID NO: 38487 - DNA, 201 bp, Homo sapiens
cgcaatctctgctcactgcaagctccgcctcccgggttcacgccattctcctgcctcagcctcccgagtagctgggactacaggtgcctgccaccacgccyggctaattttttgtattttttttttttttagtagagatgggttttcaccatgttagccaggttggtctcgatctcctgacgtcgtgatccgcccacctcg

SEQ ID NO: 38488 - DNA, 201 bp, Homo sapiens
ggggacctagttatgagtcctgtttcttttttttttctttttttattttgagactgagtctcgctttgtctcccaggctggagtgcagtggcgcaatctckgctcactgcaagctccgcctcccgggttcacgccattctcctgcctcagcctcccgagtagctgggactacaggtgcctgccaccacgcccggctaattt

SEQ ID NO: 38489 - DNA, 201 bp, Homo sapiens
gtgttcccctttactgtgaccagtggcttcataggggacctagttatgagtcctgtttcttttttttttctttttttattttgagactgagtctcgctttrtctcccaggctggagtgcagtggcgcaatctctgctcactgcaagctccgcctcccgggttcacgccattctcctgcctcagcctcccgagtagctggga

SEQ ID NO: 38490 - DNA, 201 bp, Homo sapiens
atgagcttggtcatttaaaaaaatttattttttcctagttaggtaacagtggtataacaacattaaaagaaatgtagaaactagagaaaggaaaaaaaaaagccctttatcccccccatcacaaaactattataatttcaaaatagttacaagtacaatgtattccaagtggcttcttatttaagataattatattcacag

SEQ ID NO: 38491 - DNA, 201 bp, Homo sapiens
ccccatatcacttcttattatctcataatattcttaccttttgcagtgacagccccaaagtgtgtgtgtgtgtgtgtgtgtgtgtgtgtgtgtgtgtgtgtgtttggggtggggatcataataatcctgcaggtggggtttagctctggtgaaaagagcacagatcctttgatttgggtttgaatcccagcacttcctctt

SEQ ID NO: 38492 - DNA, 201 bp, Homo sapiens
agaaacaaaagtgtaggctgggtgcagtggctcacgcctgtaatcttagcactttgggaagccgaggtggggagatcacttgagcccagaagttcaagatyggcttgggcaacatagtgagactccgtctctattaaaaaaaaaaaaacaagtctaacatcaggtagacttcagggctgtgaaagaagtgacatagggtaa

SEQ ID NO: 38493 - DNA, 201 bp, Homo sapiens
gtttgtgtttgctaaacatatctttagctgcgtaagagaaagaaggaaaatagtaaagatgaacagtactgttttctacttgaagttctagttggcccccmctcccttccatgtaggaaccttagcttgctttccacaccctcccaccactggactcacaaaggcccctgatgagtgcctccggtaagacagggggaaatt

SEQ ID NO: 38494 - DNA, 201 bp, Homo sapiens
tgaaggaggctcctctagtgaaagaaaaaggcatccagtgttaatagtatttcttcccagttgcatggggcttgcatattagagataaaggaaacatcttwgctactactgagccataagtggtctcacctttcttgaaacataaggccgtcttggtttgttgttctgttttgtgcttttcacagaggcatggacactgaa

SEQ ID NO: 38495 - DNA, 201 bp, Homo sapiens
actccaaacagaggatgtcggtatagacaatccctaggatcttgtcccctttatgactgatcacacagttccactgcttgcccttgaggctttggtgtccrcgcatgcctattcagtctgacccacaagaggccaggccagctctgttccaggtgctgaaaatcccattaaaactccactcactagcctgttccctggggg

SEQ ID NO: 38496 - DNA, 201 bp, Homo sapiens
ggtctgtaaaatcccaaacccaggtagataaaaccaagaagtgacagggctggaagggatcttaggaattagttcataaagaacttcaggctcagagaagrcatgtgagttgcctaaggtcacacagcaaatctgaagcaaatcagggctagaaacccatagacgatggtcatgagcactggttttgagtcatccatttga

SEQ ID NO: 38497 - DNA, 201 bp, Homo sapiens
tgactgatcacacagttccactgcttgcccttgaggctttggtgtccacgcatgcctattcagtctgacccacaagaggccaggccagctctgttccaggygctgaaaatcccattaaaactccactcactagcctgttccctgggggtgctgaatcagcatttaatggggaaggccacgagctaggctctggtgggtagg

SEQ ID NO: 38498 - DNA, 201 bp, Homo sapiens
gactgatcacacagttccactgcttgcccttgaggctttggtgtccacgcatgcctattcagtctgacccacaagaggccaggccagctctgttccaggtsctgaaaatcccattaaaactccactcactagcctgttccctgggggtgctgaatcagcatttaatggggaaggccacgagctaggctctggtgggtagga

SEQ ID NO: 38499 - DNA, 201 bp, Homo sapiens
cttggtgactgttcagtggtaggcaaatgtcagaacccagtatgcaaatgtggaagtggacagatttgagtcagttatctcagctggtgttatgaaatacrgaaatttttggcgttggtggtggagggcgttggcataggaggcgtgaatgctctttgtttcttgctgttatgggagtatctcttgattgccccatcatct

SEQ ID NO: 38500 - DNA, 201 bp, Homo sapiens
atttttctctagatagcaatttacactctcattatagtgtgtgagaatgcctgtttctttacagcttcatccacaatgaacattataataatgaacacccygcccccctccttttgtaacttgaataggcaaatgaaaaagaagcaaactgtgctaggcctttcttggattgctgtaaagaaacaccacctgagactgttt

SEQ ID NO: 38501 - DNA, 201 bp, Homo sapiens
tgtaatcgtagctacttgggaggtggagacaggagaatttcttgaaccgggtgggggaagttgcagtgggctgagattgtgccactgcactccagcctggrcaacagagtgagactctgtgtcaaaaaaaaaaaaaaaaaaaggttccattcaagatgtcaagccccacgggactgagggtaacatgagggtaacagacag

SEQ ID NO: 38502 - DNA, 201 bp, Homo sapiens
tggtgctcattgaattgagccacagccccaaggtcatgttttcaaggttggcatttgggaggccttgtcagaaggtcttataccatattccagtcacccaragtgctgcccgccatgcctgttcgttcagcaggatttccctgagcacctgctctgtgccaagccctatgctaagcaccaagggagtaaatatggagggca

SEQ ID NO: 38503 - DNA, 201 bp, Homo sapiens
gcagcaagctgactccaactgtgggttcgcagaggaatacgaagtatgttgctgtaaatactgtttttaattgtgtcaggttccaacccaagctgggatcygaggggagttggtggatgggtggcaggtagctgaaagaacactcgagggactgtaggcagttgggacatggctttattctctctcctacagagtcagcag

SEQ ID NO: 38504 - DNA, 201 bp, Homo sapiens
tgttctttttcttttgttttacagagctgagtttggtgaaacttcaggaggttttagctagtggcgatccaaagacattaaatattgctttgtgggtacgwctccaccttgcgtcttacttggtgactgttcagtggtaggcaaatgtcagaacccagtatgcaaatgtggaagtggacagatttgagtcagttatctcag

SEQ ID NO: 38505 - DNA, 201 bp, Homo sapiens
ttttgttttacagagctgagtttggtgaaacttcaggaggttttagctagtggcgatccaaagacattaaatattgctttgtgggtacgtctccaccttgygtcttacttggtgactgttcagtggtaggcaaatgtcagaacccagtatgcaaatgtggaagtggacagatttgagtcagttatctcagctggtgttatg

SEQ ID NO: 38506 - DNA, 201 bp, Homo sapiens
gtggccccgtttccttctagaagttgagttccctgggcttgtgagaacccttgtacatctgcctccattaaactcacatttggagatctcgtaaatgaacscagtgcagtccgggggcagagtgaaggctcagactgcagccggacatggctcagttaccctaggtgggttagcagctgagcaggtactggtctcaaaacc

SEQ ID NO: 38507 - DNA, 201 bp, Homo sapiens
ggccccatatcacttcttattatctcataatattcttaccttttgcagtgacagccccaaagtgtgtgtgtgtgtgtgtgtgtgtgtgtgtgtgtgtgtgtgtgtttggggtggggatcataataatcctgcaggtggggtttagctctggtgaaaagagcacagatcctttgatttgggtttgaatcccagcacttcctc

SEQ ID NO: 38508 - DNA, 201 bp, Homo sapiens
cctggccccatatcacttcttattatctcataatattcttaccttttgcagtgacagccccaaagtgtgtgtgtgtgtgtgtgtgtgtgtgtgtgtgtgtgtgtgtgtttggggtggggatcataataatcctgcaggtggggtttagctctggtgaaaagagcacagatcctttgatttgggtttgaatcccagcacttc

SEQ ID NO: 38509 - DNA, 201 bp, Homo sapiens
tacctggccccatatcacttcttattatctcataatattcttaccttttgcagtgacagccccaaagtgtgtgtgtgtgtgtgtgtgtgtgtgtgtgtgtgtgtgtgtgtttggggtggggatcataataatcctgcaggtggggtttagctctggtgaaaagagcacagatcctttgatttgggtttgaatcccagcact

SEQ ID NO: 38510 - DNA, 201 bp, Homo sapiens
gctgtgtgaccctgctatctgcacagggacttgagcctctcagaatctgttactgcatctggaaaatggaaatctggaaatgtcactgcatctgtagcaayaaccaggccattttgttactaggtttaagtgagggaaggcatgtaaggcactcagtccagatcatggcacttagtaggcctgagcacatttgctcccacc

SEQ ID NO: 38511 - DNA, 201 bp, Homo sapiens
taagattataggtgcaagccacctctcctggcttgcttctttcccgtaaattgaggtgtgttattccactgcttaaaagcctacatggcttcatatcgctsttagtataaacccaaacagtggtctgcaagactctgaaccttagatcaggatgatcagacccctccctcccctccaccctccgacctcatcctggctacc

SEQ ID NO: 38512 - DNA, 201 bp, Homo sapiens
taaaaagtcatggagaaggttttctgtgtgcagctaagagaggaggtggcagacatttatttatttatttatttatttatttatttatttatttatttatwgagacgaagtctcactctgttgcctgggctggagtgctgtggcacgatctcggctcactgcaacctccatctcccgggttcaagcgattctcctgcctca

SEQ ID NO: 38513 - DNA, 201 bp, Homo sapiens
ggagcaggctgaggtcacccagcaaggtattagagaagacaagatgggaacctgggtcaccggcctgggcctcatattttcaaagtgctatttttttttttcccgtgttttcactttgatcttacttttaatgatagggacgtatcactgtgtcttctcaaaatggtgggtgtgaatggaatttttcaaagttgaatcaat

SEQ ID NO: 38514 - DNA, 201 bp, Homo sapiens
tgaaaggctaaataaagagaactttttattttttccatgttaatacatggatgatattaaccatgatgtttaatagctacagaatactgcatgaaatggakgtactataattcatttagcctttttcgtatttagagatttaagcagtagccaatttttcaccattacaagtggtgcaaggaccaatatcttcatgaatac

SEQ ID NO: 38515 - DNA, 201 bp, Homo sapiens
tcaggattaatttccagatatctttctggtattagacacataccacttgcctaataacgttccaaaaggaattcattgtttacattgctattagaacataygagattgcctgtttcattatgtccgtcccagcactgggtattatcattaaaaaaaaaagattttaaatttatttattgagttatttacttgagacagagt

SEQ ID NO: 38516 - DNA, 201 bp, Homo sapiens
caatttttgcttttgttgctgtgctttttgtgtggtatccaagcaaccattgtaaatactatgtcaagaagctcttccccaatgtgtttttttttttttttaaacaaattttacagtgtacagctttaggtctaatgtttaaggcttgaatctattcagagtttatttttgtgtctggtgtaagatagaggtccagtttta

SEQ ID NO: 38517 - DNA, 201 bp, Homo sapiens
cgtctcagcctcccaaagtgctgggattacagggtgaaccactgcgcggcccattaggtgctcagtaatttgttgaatgaattgaagacatgggacttgarttaggcttttattattattattattttttgagacggagtctcactctgtcacccagtctgggagtgcagtggcgtgatcttggcgcactgcaacctccgc

SEQ ID NO: 38518 - DNA, 201 bp, Homo sapiens
tccagtgtgccacacgctttcttgccactaggtccttgcatgtgatggagtaactcttgtacctctgtctccctaaatagacggggttctccaaggacatygtgccacagggcctggtaacccagtaggtgctcagtaatttatttatttatttattttttttgagacagagtctagctctgtcgcccaggctggagtaga

SEQ ID NO: 38519 - DNA, 201 bp, Homo sapiens
tgtcctcatctgtatgatggggataacaagaatacctactttataggattgctgtggaggattaaatggatctgcatgacaaatgcttagcatgaaaaaawccctcaacagatattggctgctattttattatcttattgtgctgagacactggcataatttacaattcaaaaattaaatttttttaatcttatactgtag

SEQ ID NO: 38520 - DNA, 201 bp, Homo sapiens
tcggcctcccaaagtgctgagattacaggcgtgagccactgtgccaggccccattttttgttttttggttaactccctgttcattaaaaaaaaaaaatctrtatctatagatagatagatatagatataatctttgttatcaatttgtataagctctttggaaattagtccttcgattgtcatttgtattgcaaacacatt

SEQ ID NO: 38521 - DNA, 201 bp, Homo sapiens
gtttcttaagtctgggggacaggcactgagcagaggccgtggtggggaacaggagcctgtcttcatggctcttactggccactgggcaagactcagatagyaccaaccaaccagtcacagttgtgatgtaggatgtgactgtgaatgacatccctgctgcccgcttcagagaaagggctgccacttgccagagaaggaatg

SEQ ID NO: 38522 - DNA, 201 bp, Homo sapiens
tgtgtgtttcccttctaatataatgccactgatgatattataattaataggtaacattatgcatgacaggcactgtgtgctaagggttttaatgcattatytcatttggccatttcagaaataccaagaggtaggtgctgttcttgtttatttgtttgttttttttttttgatagggagtcccactctgtcacccaggctg

SEQ ID NO: 38523 - DNA, 201 bp, Homo sapiens
tggagtgcagtggcatgatcttggctcactgcaacctctgcctcctgggttcaagtgattctcctgcctctgcctcccaagtagctgggattacaggcacrcacaccatgcccagctaatttttgtaattttagtagagacggtgtttctccatgttggccaggctggtctcgaactcctgacctcaagtgatctgcctgc

SEQ ID NO: 38524 - DNA, 201 bp, Homo sapiens
taaataaataaataaataaataaataaaataaaataaataaaaaaagaggttaaggtttatacgcaggccatttctaatagatgttatggaagccccaggktttggggcatcagggttggaaaggaagccaaaaatgggtgtgtccaaaggacagatgcattgagaatgggttgtaaaatttcagccattgtgtagattaa

SEQ ID NO: 38525 - DNA, 201 bp, Homo sapiens
tctaaactaacaaggtttacacatgtgacaaacatccaggttgccagggctcaaaagagggttcacatcgactcccttctcattcactgagtcctttttcrggagctttggccgagtttgtgctgcgtctgggcatctaggtgtcgagttcttccctagtgttttcagcctcggcttcctcctctgtaaaatgggagtaac

SEQ ID NO: 38526 - DNA, 201 bp, Homo sapiens
agatgttttgagtttatcctccaataggcaatgaagttgacaaggttttatgaaggaataaccaagtccctggagtcctgtggctgttgccacagtaatgygtcctgctgtaaacaggacaggtgtgtcctgttgagaatgtgagcgggctcttccagcctcctggtccctcctgactctgccacgcccctcacctcactg

SEQ ID NO: 38527 - DNA, 201 bp, Homo sapiens
gactcaatatagggtgggatagggcggtgggtaaaagccgttacaattttgtccaaatggtatgggctgatttacttattagggaggtacaaatggcttcrtgttataaagtgtcaagatccttatttggataaggcaaccagagtgtagacgagagagtaagagtaagaaaacaaggagaaaaatgagtgtcttaaggat

SEQ ID NO: 38528 - DNA, 201 bp, Homo sapiens
ggatgtgcacacaacctatcaagaatacttcactttgtgaggcccaaaaacagctcctagcacagtgtagagcagacttggtcagaacttcaatccttgayttttttttttttttaacccgaatttcatgaggtttttctgagacatccactggactgtcatataccgtgtgctgggctctcattttatccttacaattat

SEQ ID NO: 38529 - DNA, 201 bp, Homo sapiens
ctttcctttcagaacagaacaatccatatgcatgtatactccaaggcaaccccttgacttttctgggaaatttactttcttgggaataacctaagttattkctgaataaaatgaatcttaagagcatggctctacatcaggaactctttcctttctttccacttccaggtgacttgctcatagattttacagaacaaactg

SEQ ID NO: 38530 - DNA, 201 bp, Homo sapiens
aaaagtgaaaaggaatagccgaaattggtattaatagcattttacttaacttagtatattaaaagtattatttcaacatgtaatttctgtgaagtattaatgagttattttatgtcttcttttgtactaagtctttgatatctagtctgtattgtgtgcttgtagcacatctgaatgcaaactggtcacctctcaggggct

SEQ ID NO: 38531 - DNA, 201 bp, Homo sapiens
aaaaagtgaaaaggaatagccgaaattggtattaatagcattttacttaacttagtatattaaaagtattatttcaacatgtaatttctgtgaagtattaatgagttattttatgtcttcttttgtactaagtctttgatatctagtctgtattgtgtgcttgtagcacatctgaatgcaaactggtcacctctcaggggc

SEQ ID NO: 38532 - DNA, 201 bp, Homo sapiens
tctttctggtattagacacataccacttgcctaataacgttccaaaaggaattcattgtttacattgctattagaacatatgagattgcctgtttcattaygtccgtcccagcactgggtattatcattaaaaaaaaaagattttaaatttatttattgagttatttacttgagacagagttttgcttgtctcccaggctg

SEQ ID NO: 38533 - DNA, 201 bp, Homo sapiens
aaaaaagtgaaaaggaatagccgaaattggtattaatagcattttacttaacttagtatattaaaagtattatttcaacatgtaatttctgtgaagtattaatgagttattttatgtcttcttttgtactaagtctttgatatctagtctgtattgtgtgcttgtagcacatctgaatgcaaactggtcacctctcagggg

SEQ ID NO: 38534 - DNA, 201 bp, Homo sapiens
caccttggctcctcaaagtgttgggattacaggcgtgagccaccgtgcccagccaatattttaaatttaatgtttacatttgcacacatgccaattgggcwtcatggtggctgcctcacaccactttttgtccgtgtgtgagactcacatagaggctgttttctgtgatccttttttaaaaaataattacatttttttaat

SEQ ID NO: 38535 - DNA, 201 bp, Homo sapiens
tggtaggaaacaaaggctcctcccagtggcttctctgtaaggagaatccacttaaaattaaaaaaaaaattaattttggagtagatagtacgtaaacatgrcacaattttttttgttttttggacaaggtgtttgcagtgaaagcatttcccttttttgtcccctacctgcccatttcctctccctggaggtgacgtttgt

SEQ ID NO: 38536 - DNA, 201 bp, Homo sapiens
ataggttatcaagatccaggggagagaagaacttacttaaagtcacaaaaccaattagttacaaagtagggtctagaaatcagatttcctgaatcatattktagtgttttgtgaataatagtactctgaccccctcttgccaaattataccctgggttttgttgttttgggaagattgtttactgtcatttctagagtatg

SEQ ID NO: 38537 - DNA, 201 bp, Homo sapiens
gatacacaaatatatgtgtgagtatacatatatttaatacatatatatttaatatttaatacacacacacacacacacacatatatatatatatatatatwtttttttttttttttttttttttgagacagtcttaccctgtcacccaggctggagtgcagtggcatgatcttggctcactgcaacctccatctcctgggt

SEQ ID NO: 38538 - DNA, 201 bp, Homo sapiens
gccaatattttaaatttaatgtttacatttgcacacatgccaattgggcttcatggtggctgcctcacaccactttttgtccgtgtgtgagactcacatakaggctgttttctgtgatccttttttaaaaaataattacatttttttaatgctcagggaaaatgtcaaataattgtttatgttttgtactgaaatctgcac

SEQ ID NO: 38539 - DNA, 201 bp, Homo sapiens
ttttaaacatatacatatagatacacaaatatatgtgtgagtatacatatatttaatacatatatatttaatatttaatacacacacacacacacacacayatatatatatatatatatttttttttttttttttttttttttgagacagtcttaccctgtcacccaggctggagtgcagtggcatgatcttggctcactg

SEQ ID NO: 38540 - DNA, 201 bp, Homo sapiens
ttataccctgggttttgttgttttgggaagattgtttactgtcatttctagagtatgaatgagtctttctaattgcatattttttctttccctttctatcrtgaagacctaaaaagtgagtaatctctttattttttttaataacttgtacttttctattgaatatggacttcactgaatgtaaaaaatcctgataagttt

SEQ ID NO: 38541 - DNA, 201 bp, Homo sapiens
aaaaaaaaaaaaaaaaaaaaaaaaaaaaaagcaagctcatacctccagcctgggttttgagagcctgtctgaaaaaaacaaaacaaaaccctcaagtaaayaacctaatgtagcacgttaaggaactagaaaaataagaacaaactaatcttcaaattagtaaaaggaacaaaataataaaggtcaaagctgaaataaatg

SEQ ID NO: 38542 - DNA, 201 bp, Homo sapiens
cctctgctcatgcttcgttgagcaaaacttagtcacattgcaacatctagctccatgggagctgggaaatgtggtctttgtttccaacaggtatgcacacacagggctaaaaatctgggtgggtatgatgaagggaaaatgggggaatggattttgggggtcaagactggtctctctctgctgtccctccctgaacagagg

SEQ ID NO: 38543 - DNA, 201 bp, Homo sapiens
aaaactctgtgattggaaagtcacttctggaaactagacatatagagcagacctcactcttacatttctttttgaagtgcaataattttttttttttttttaacaatatagggcccagtcctgtgtttgacattaaagctgtttccatcagtccaaccaatgtgatcttaacttggaaaagtaatgacacagctgcttctg

SEQ ID NO: 38544 - DNA, 201 bp, Homo sapiens
taaaactctgtgattggaaagtcacttctggaaactagacatatagagcagacctcactcttacatttctttttgaagtgcaataattttttttttttttttaacaatatagggcccagtcctgtgtttgacattaaagctgtttccatcagtccaaccaatgtgatcttaacttggaaaagtaatgacacagctgcttct

SEQ ID NO: 38545 - DNA, 201 bp, Homo sapiens
ataaaactctgtgattggaaagtcacttctggaaactagacatatagagcagacctcactcttacatttctttttgaagtgcaataattttttttttttttttaacaatatagggcccagtcctgtgtttgacattaaagctgtttccatcagtccaaccaatgtgatcttaacttggaaaagtaatgacacagctgcttc

SEQ ID NO: 38546 - DNA, 201 bp, Homo sapiens
gagctcttagatgaggatattgatgtccagagaagacagggagcaggctgaggtcacccagcaaggtattagagaagacaagatgggaacctgggtcacckgcctgggcctcatattttcaaagtgctatttttttttttcccgtgttttcactttgatcttacttttaatgatagggacgtatcactgtgtcttctcaaa

SEQ ID NO: 38547 - DNA, 201 bp, Homo sapiens
cccagaagaagcatcttcaaaatccacattcagcagttcattttgataatggatatttcagggaatcagtgcatttttgagctggaccagactttcaagayagctgaaacccctcagagctcttagatgaggatattgatgtccagagaagacagggagcaggctgaggtcacccagcaaggtattagagaagacaagatg

SEQ ID NO: 38548 - DNA, 201 bp, Homo sapiens
aaaaataaactttcacatcatgttacccctggatacatttttgtggccatgcatctgcacgaatattcaatccctgctacaggcaagacactgagtgggaygttgcagggctaccaaggtgaggaggtcccaacccctgtcctcaaggagttgatgtaacacctacccaggattaatttcatttctctcagaggtcattaa

SEQ ID NO: 38549 - DNA, 201 bp, Homo sapiens
aatagaactggtaagcaaataggcttttctgttaaaccatcatgtttcttaaaggaaatcagtataattaataaacataatgtttccaaatattgtttttsttttaattatctaagaaaaaactttaaaaattttcataacactaatgcttatttattatatgaaatacagacaagtaagtagaaaaaacttacatggaaa

SEQ ID NO: 38550 - DNA, 201 bp, Homo sapiens
tgagattacaggcatgaggcactgcacctggcccaaatcttctcagttctaaatggctgtgataaaaactacattgacaatttttttttttttttttttttggagatggagtctcgctctggtgcccaggctgaagtgcaatggcgcaatcttggctcactgcaagctccgcctcctgggttcacgccattctcctgcctc

SEQ ID NO: 38551 - DNA, 201 bp, Homo sapiens
atcctcttggaaaaccccacgcttatcaggaaaaggagatggaagtgaaaaaataaaaatatatataaaaaaaggaaaacctagtgttagcaccccttatscagcaggccccccacctggacccccacctgtattcacattcctcccacacttacagtcagtggcttcattaatctctaaggttccatgttctgctcccca

SEQ ID NO: 38552 - DNA, 201 bp, Homo sapiens
ctcatagagcttttttcttcttttttgtatatccaggatttctttagcggtcttttgtaattatagtaaaagcactgaggttagatttatgggttttttttgaggaggatagactgaatccctttcccgcctcaaggctatagtgggtcggcacagtttgtgtttgctaaacatatctttagctgcgtaagagaaagaagg

SEQ ID NO: 38553 - DNA, 201 bp, Homo sapiens
gtatatgggaataagtggggtgctggatcttgtgggcaggctatgggatctgggaaaggggttagcacctgggcctggagggacctggaatctaggggggscatacatctaagctaaatgtggctgtggcttgcaaactcagaggcctttcgggcagcctggtgaaatgataaatgggcagttgctgtttattctcagtcc

SEQ ID NO: 38554 - DNA, 201 bp, Homo sapiens
tttcctgaatcatattttagtgttttgtgaataatagtactctgaccccctcttgccaaattataccctgggttttgttgttttgggaagattgtttactrtcatttctagagtatgaatgagtctttctaattgcatattttttctttccctttctatcatgaagacctaaaaagtgagtaatctctttattttttttaa

SEQ ID NO: 38555 - DNA, 201 bp, Homo sapiens
ggtgctctcattttatttttagagctatattttagctctaacgtgattgttgggtgaacacttgcagaatgaaatatgactgacacctaccagctgtctayacattcctggttatatcttaggaaggcagtgtgtgctagcaccttgggaagagaatgttgagttcaaatcctagttttgccccttgcaccaataccttga

SEQ ID NO: 38556 - DNA, 201 bp, Homo sapiens
tttcttcaacttcacaccttagtttctttacttgtaaattgggttgatagtgggctgctgtcagaattaaggacatcgttttgtcaaggattttgcatacrggaagtcatggtgacagctgttgttactgttgtcctgaggagtggggacaggagaggaggaaaacaggctggtccaggtgtctttccttaaaggaggctc

SEQ ID NO: 38557 - DNA, 201 bp, Homo sapiens
ccagcttggccaacatggtgaaacaccatctgtactaaaaataccaaaaaaattagccaggtgtggtggcatgcacctgtaatcccagctacttgggaggytgaggcaggagaatcgcttgagcctgagaggtggaggctgcagtgagccgagatcactccattgcactccagcctgggcaacaagagtgaaactccatct

SEQ ID NO: 38558 - DNA, 201 bp, Homo sapiens
gggtatgcgtgctttcagttttgatacatactgccaaattaccttccagaaagtttttcttaaataccaatgcagagttgagtcaacagtgcaggagtgtrcagatgcctcaccaacttgccagttccggatctgatatgttttttggtttattgcattcatttatcagaaaagctttctcaaaaacaaagtatgaaataa

SEQ ID NO: 38559 - DNA, 201 bp, Homo sapiens
gcccattcagagaagctctgaaccctgcaaaagctcccacgtggaggccagtgagctggttataatccagagactgtcagtttttcctagtacatatttgracctgagcctttgtttctgcaaagagtctggtactgactcacacagtgtcagcagcccccttccatcccctggcacacccctccctcattcctactgagc

SEQ ID NO: 38560 - DNA, 201 bp, Homo sapiens
ggaaaattttagaagttttaggtgtaaatgcagctggtaagatccttatgacttagtttcttttttttcttcttttcttttctttctttctttcttttttyttttttttttttttttaagacagagtctcactctgttgcccaggctggagtgcagtggcgcgatctcagctcactgcaacctccgtctccccagttcaag

SEQ ID NO: 38561 - DNA, 201 bp, Homo sapiens
tggggaaaattttagaagttttaggtgtaaatgcagctggtaagatccttatgacttagtttcttttttttcttcttttcttttctttctttctttctttytttttttttttttttttttaagacagagtctcactctgttgcccaggctggagtgcagtggcgcgatctcagctcactgcaacctccgtctccccagttc

SEQ ID NO: 38562 - DNA, 201 bp, Homo sapiens
tgtaagtacatgtaggattttcatgtagaggagttggggaaaattttagaagttttaggtgtaaatgcagctggtaagatccttatgacttagtttctttyttttcttcttttcttttctttctttctttctttttttttttttttttttttttaagacagagtctcactctgttgcccaggctggagtgcagtggcgcga

SEQ ID NO: 38563 - DNA, 201 bp, Homo sapiens
tttgttcaaagccaaatgttgctacttctgaagacgagtgcaccttatgggtatagccagctataatgtttatcaaacatatactttttttttttttttttgagatggagtttttgctctgtcacccaggctggagtgcagtggcatgatctcagctcactgcaacctccacctcccaggttcaagtgatttctcctgcct

SEQ ID NO: 38564 - DNA, 201 bp, Homo sapiens
gtggatctcaaactttagcatccatcagcatcaccaggagggtggttctaccctcagagtttctaattcggaattgcgtttctgccagtttctgggtgatyctactgctgtggcaccagggtgcacacttggagtggtactgtccccaggatagtgggagcccttcaggcatcatttcttttattgttctttaattcatgg

SEQ ID NO: 38565 - DNA, 201 bp, Homo sapiens
tccctcttgcttctttctgttcatcagcttcattctcagagcagctccctctgcacacttaaggagcccagctgctcccgtttcacaccctgcagctgccycaccagccagctgccccaccaaccagggtctggtccagggaaacgtgtcttgagtggggtctgattagcaaagtctgcttcacagagctgtccctggaaa

SEQ ID NO: 38566 - DNA, 201 bp, Homo sapiens
cctgggaggcgggggttgcagtgagccgacatcgcgccactgcactccagcctgggccacagagcaagatttcatctcaaaaaaaaaaaaaaaaaaaaaaagaaaaagaaaaaaagaaatgcaggtaggtgcttctagctactgctgtgggatagcaaggtagttaccaaactgataagggtagcatcttacttactgctg

SEQ ID NO: 38567 - DNA, 201 bp, Homo sapiens
atttatttatttttattttttatttttttgaaacggagtttcactgtgtcacccagccacccaggctggagtgcaatggtacaatcttggctcactgcaamctccgcctcccgggttcaaaggattctcctgcctcagcctcctgagtagctgggattacaggcacccgccaccacacttggctaatttttgtatttttag

SEQ ID NO: 38568 - DNA, 201 bp, Homo sapiens
gcagaagcaaatatgagaatccagctgtttcttactaagcagacattaaagagatttgcaaatatctaaaataatgctatctctctcacttttttttttttgtattggaaacatcattttccatacaatgtcatttatgttaacaggtgacagatttatttatttttattttttatttttttgaaacggagtttcactgtg

SEQ ID NO: 38569 - DNA, 201 bp, Homo sapiens
gattccagggcatatgcacatggcctcccttcccctcaaaatttacaaaagcaaatccaattaaattgtgcaggcattctaggaagtcaagtttatgtgcyttttttctttttcaaggatgctttgaaaatagaggcagtgccatgaagcagcattggtatctgttgatgggtgtgtgcattggcataactctctgctgtt

SEQ ID NO: 38570 - DNA, 201 bp, Homo sapiens
aagccattctcctgcctcaccctttgagcctccttaattttttatttatttattttttttttgtagagacagggtctcattatgttgtccagcctgatatkgctatttttttttttttaatggcgatgtagtaatcttgctttgttgcccaggctgttctggaactcctggcttcaggtgtgtgccactgtgcctggccca

SEQ ID NO: 38571 - DNA, 201 bp, Homo sapiens
ttatttggttagaaatatggcatcaggagcggccacttgctgttaggagtaattgataacagttacattaataggattccagggcatatgcacatggcctyccttcccctcaaaatttacaaaagcaaatccaattaaattgtgcaggcattctaggaagtcaagtttatgtgccttttttctttttcaaggatgctttga

SEQ ID NO: 38572 - DNA, 201 bp, Homo sapiens; identical to SEQ ID NO: 8533

SEQ ID NO: 38573 - DNA, 201 bp, Homo sapiens
ggttttcacatatatgggcagtgtcccaacaggctgctggggggtggccgtttgtgatggcctcaccagtctttcccagagagggaagtgcacatttttargctacttttgctctgactgatacacttggctgcctaacaaaaagccagagaagaactaagatttttagcatcattcaaaatgcttgccattccttttgct

SEQ ID NO: 38574 - DNA, 201 bp, Homo sapiens
tgtaagggagagtggttgaggtcaagatctgggttctggttcttgtgcctcctctctggctgtgtgtccttcaacaagctgcttactgtctctgggcctcygtgccctctgcaactgggttgttggtctatttaaatacttggagaaaaaagctgggcatggtggctcatgcctgtaatcccagcactttgggaagccaag

SEQ ID NO: 38575 - DNA, 201 bp, Homo sapiens
ccagggaggttgagactgcaatgagctgtgattgcgccactgcactccagtttgggtgatgcagtgagatcccatctctaaataaaaaaaaaataaataawgcccctagcatggtgcctggcacatggtaggccctcaaaagatgaccctccaaagtggccaggactcaccatgcattcagggaatatggattcttttggt

SEQ ID NO: 38576 - DNA, 201 bp, Homo sapiens; identical to SEQ ID NO: 8520

SEQ ID NO: 38577 - DNA, 201 bp, Homo sapiens
gttctgggaagcctctgtggaagggaggttttgttaagtgaactcccctggtaaacggagtgattggcccccaattagcttgctgttcggattaactgtartacatcacactttcgaaagtgaagatatgcctattttttcccctctaggtctataaagtagatttttgccattagtaaaatttaaagtgattgggggcta

SEQ ID NO: 38578 - DNA, 201 bp, Homo sapiens; identical to SEQ ID NO: 8521

SEQ ID NO: 38579 - DNA, 201 bp, Homo sapiens
ttccccaatcctgcttcctggaggtagccaatgtttatagtttggtgtacatctttataagactctttatgtacatctgtaaacacacacacacacacacrcacacacagtactttgaaaaaattggatgctgttttttttttgagatggagtcttgctctgttgcccaggctggagtgcagtggtgccatctcagctcac

SEQ ID NO: 38580 - DNA, 201 bp, Homo sapiens
atgcaggagcctgtgctagcagttgaccattaacatgggaacgccacctcccagcgggcactgctgccgcatacttgcgaggttgctgaagcttgtagttyagagcaggaccatcccactagatgtgcaatgtgagcctcaggtataatttaaagttttctagaagccacactgaaaaaaaagtgaaaaggaatagccgaa

SEQ ID NO: 38581 - DNA, 201 bp, Homo sapiens
atacaatcatttcagtagatgcagaaaaaacatttgaccaaaaaatattgttaactgtgctttcttttctgaacttaagaacttgcttttccaaaaccttmccagaatccctgtatgaatcaacaaaatttagttcttaacacatttctccttctttaaaatggtgacattagctgggcatgatggtgtgtgcctttaatc

SEQ ID NO: 38582 - DNA, 201 bp, Homo sapiens
ttccctgcgggccttggccattcctgtcctggcctttactggcagtctctattctaaaatgtgggcatcccacatgaggtccagcttctcctgagatcccyggaggtgcagctgctgtgatggtgaccttgtttagcagatgctccctgcagtccaaactcccacccatcgtcctgccctttgatccatttcccatgaact

SEQ ID NO: 38583 - DNA, 201 bp, Homo sapiens
ccttccccaatcctgcttcctggaggtagccaatgtttatagtttggtgtacatctttataagactctttatgtacatctgtaaacacacacacacacacrcgcacacacagtactttgaaaaaattggatgctgttttttttttgagatggagtcttgctctgttgcccaggctggagtgcagtggtgccatctcagctc

SEQ ID NO: 38584 - DNA, 201 bp, Homo sapiens
gtttagagcaggaccatcccactagatgtgcaatgtgagcctcaggtataatttaaagttttctagaagccacactgaaaaaaaagtgaaaaggaatagcygaaattggtattaatagcattttacttaacttagtatattaaaagtattatttcaacatgtaatttctgtgaagtattaatgagttattttatgtcttct

SEQ ID NO: 38585 - DNA, 201 bp, Homo sapiens
cattcagagaagctctgaaccctgcaaaagctcccacgtggaggccagtgagctggttataatccagagactgtcagtttttcctagtacatatttggacytgagcctttgtttctgcaaagagtctggtactgactcacacagtgtcagcagcccccttccatcccctggcacacccctccctcattcctactgagcatt

SEQ ID NO: 38586 - DNA, 201 bp, Homo sapiens; identical to SEQ ID NO: 8524

SEQ ID NO: 38587 - DNA, 201 bp, Homo sapiens
taagtctgcagaactgaccccctggagagtcaccaccttggtcacagacagcagagggaggaatcaggaagtctctgctgtagttgcgggatccaggggtstatgttctgagctgtgatcctgggatcaggaagctgcagccaccgctgaggttttggttctagagccaggcagcgtgagctccagtcattgcatccacac

SEQ ID NO: 38588 - DNA, 201 bp, Homo sapiens
taagccattctcctgcctcaccctttgagcctccttaattttttatttatttattttttttttgtagagacagggtctcattatgttgtccagcctgatattgctatttttttttttttaatggcgatgtagtaatcttgctttgttgcccaggctgttctggaactcctggcttcaggtgtgtgccactgtgcctggccc

SEQ ID NO: 38589 - DNA, 201 bp, Homo sapiens
acatgctttccttgcactggcacattgtatgctcacaatagccctgtgatgtggttggaagtagccttattttatagataggaagccaaggctgagagagktgctagacaggtatcacagctggaaagtggcagaggtgagattaagcctctggtatttctcacctggagcctgcgcttgtaactctctttccagtgtgga

SEQ ID NO: 38590 - DNA, 201 bp, Homo sapiens
agctaaagatggattcagtgttttttttttctttttctttttttttttttgaggcggagtcttgctctgtttcccaggctggagtgcaatggtgcgatctyggctcactgcaacctctgccgcccagattcaagcaattttcctgcctcagcctcccaggtagctgggatgacaggagcccaccaccacgcttggctaatt

SEQ ID NO: 38591 - DNA, 201 bp, Homo sapiens
ggagaagaaatctctctgccatcactttcttatgattctccttctgtgtacctttcttagctggtcacccttctgcagatgtcctgaaatacacgtatgasgatttcaaaaagggagcctcagatacttatgtgacatacctcataagaacagaagaaaagggacgttctcagagcttgtctgaagttttgaaatatgaaa

SEQ ID NO: 38592 - DNA, 201 bp, Homo sapiens
gacacaggatgcatgatgtagtaatggtgactgttggctgaccacacgccaagcttcgtgtgacatgctttccttgcactggcacattgtatgctcacaayagccctgtgatgtggttggaagtagccttattttatagataggaagccaaggctgagagaggtgctagacaggtatcacagctggaaagtggcagaggtg

SEQ ID NO: 38593 - DNA, 201 bp, Homo sapiens
gctataggaattgagactaagttggagctgggtgatcagggaaggttttaaggaagagatctgggacaaatagctaaagatggattcagtgttttttttttctttttctttttttttttttgaggcggagtcttgctctgtttcccaggctggagtgcaatggtgcgatctcggctcactgcaacctctgccgcccagatt

SEQ ID NO: 38594 - DNA, 201 bp, Homo sapiens
agcattatttatttatttatttagttagttagttagttcttgagatggagtctcactctgtcacccacgctggagtgcagtggcatgatctcagctcactrcaacctctgcctcctgggttcaggtgattttcctgcctcagcctcctgagtagctgggattacaggggcccgctaccacgcccagctaatttttgtattt

SEQ ID NO: 38595 - DNA, 201 bp, Homo sapiens
aaattgaggtgtgttattccactgcttaaaagcctacatggcttcatatcgctgttagtataaacccaaacagtggtctgcaagactctgaaccttagatyaggatgatcagacccctccctcccctccaccctccgacctcatcctggctacccactccctgttcacagactacagtcacctggctctagtacaacagac

SEQ ID NO: 38596 - DNA, 201 bp, Homo sapiens
tgttttcttatatatattttacatgacaaaattatatttaaaacatattaaactttaaaaaaccatagtttataatttataagccatgtagcatatttctrtttttgagacaggatcttactctgtcacccaggctggagtgcagtggctcgatcatggctcactgcagccttgacctcctgggctcaagtaatcctcctg

SEQ ID NO: 38597 - DNA, 201 bp, Homo sapiens
tggtctgcaagactctgaaccttagatcaggatgatcagacccctccctcccctccaccctccgacctcatcctggctacccactccctgttcacagactrcagtcacctggctctagtacaacagacacttgaacctaccccgcccctctccctcagggcctggtactatcctcctcgctccttcttatcactcaggccc

SEQ ID NO: 38598 - DNA, 201 bp, Homo sapiens
ccctctccactgtgactgtttcctgggaaactagtcaggggctggttttataggaattatccagtcgtattattattattattattattattattattattattattattattgagactgagtctcgctgtgtcgcccaggctggagtgcggtggtgccatcttggctcactgcaacctccgcctcccaggttcaagcaat

SEQ ID NO: 38599 - DNA, 201 bp, Homo sapiens
cccctctccactgtgactgtttcctgggaaactagtcaggggctggttttataggaattatccagtcgtattattattattattattattattattattattattattattattgagactgagtctcgctgtgtcgcccaggctggagtgcggtggtgccatcttggctcactgcaacctccgcctcccaggttcaagcaa

SEQ ID NO: 38600 - DNA, 201 bp, Homo sapiens
aatgagaagacaattactgttgtgcatcaaccatggtgtaacatcacaggcttacgtccagcgacttcatatgtattctccatcactccaggaataggcartgagacttggggagatcccagagtcataaaagtcatcacaggtaagatgactggctcccagggatgatgacaaaccatttcttattatggtgtattctag

SEQ ID NO: 38601 - DNA, 201 bp, Homo sapiens
tcccctctccactgtgactgtttcctgggaaactagtcaggggctggttttataggaattatccagtcgtattattattattattattattattattattattattattattattgagactgagtctcgctgtgtcgcccaggctggagtgcggtggtgccatcttggctcactgcaacctccgcctcccaggttcaagca

SEQ ID NO: 38602 - DNA, 201 bp, Homo sapiens; identical to SEQ ID NO: 8534

SEQ ID NO: 38603 - DNA, 201 bp, Homo sapiens
tcagggacctctttttgctctttgttatcccacagggcttgtgtggctggcttcaccaacattaccttccaccctcaaaacaaggggctcattgatggggytgagagctatgtgtccttcagtcgctactcagatgctgtttccttgccccaggatccaggtagggagaagacaacagtcctggcactggttcagtggcat

SEQ ID NO: 38604 - DNA, 201 bp, Homo sapiens
atgccactctgactctgtgaacttgtcactttataaagaggaaattcaagcttggaggggccttctggcatgacgtttattgaattgtggggcacaagatrcttccctgcttgttccattttcctttctcttgtttattctcctgccttatttatttattttttcttttgagacagagtcttgctctgttgcccaggctgg

SEQ ID NO: 38605 - DNA, 201 bp, Homo sapiens
ctaggagagattcctagaaatgagttcactgagaatatgagcttaagagaaagtgaggatttaaagccagatctgtctgccttcaaatccagcgctctttmtactgatgtgagttctcctgtcttttttacctatcagaattctagaactctcccagagaaaccaggcagatactgctccacaccggtgagctgcttctca

SEQ ID NO: 38606 - DNA, 201 bp, Homo sapiens
cccactggctctgtttggttcctctgggctcacacacagggagctacgtatgtctctctcatttcctttggtatgttctctgggttaaatgtccccagctrtctgatctgttccctgcgggccttggccattcctgtcctggcctttactggcagtctctattctaaaatgtgggcatcccacatgaggtccagcttctcc

SEQ ID NO: 38607 - DNA, 201 bp, Homo sapiens
aatgttacgtgggttgtaaatgtaattgttaatattatttaaaaatttttgaaaagtgatttttagtggtggccttatcatatctacatattattactccmccattttgggatgtttaggtcgaatcctggttttttcttcttttgctgttgtaagtcatgtatattggcaattagcctaggagagattcctagaaatgag

SEQ ID NO: 38608 - DNA, 201 bp, Homo sapiens
catggtttcttggatagtattacatagggtgaagctaattttatttcagtaaaaaatatgcaggtcaatttaaataaaaaaatagataatagtataaatgkcttgtggctacagtaaaaatgatgatggtacttgaatgtccaaattaatttaagtgatatatgtgttcatagataccatttcattttaacgtggttctgc

SEQ ID NO: 38609 - DNA, 201 bp, Homo sapiens
aagtctctcaaattatgagctttattttaaatcctccaatctgttcggtgactatctataaataatttttgatggaacttgctgtcatttttcctgattgrcacattttgaccatgaccatctggaagtttttgctagctctgttttctgcaaggaatctatgttttattagtctcctgaagttggcttccttgtcatgtt

SEQ ID NO: 38610 - DNA, 201 bp, Homo sapiens
ctgatatttcgttgaaagtcattgtcttactcatccttgtataagataagtcacacaatgagtggtatcagggttgcagggtttccccctgtgaggacacratgggatgaaccgtgtgtgggatggtctgttaaagaaaaacaagaagccatgtgttggaaacaacctaagtattgagcggtggaggattgctgaaattgt

SEQ ID NO: 38611 - DNA, 201 bp, Homo sapiens
agggtttttctgtgtggctcaggctggacttgaattcctgagcccaagtcatccttccgcttcagccaattgagtagctgggattacaggtgcactgtccstcccagcaagttgggtctttaaataaagagtggggtttggtgagcagggtgggtgcactgttctaggaggtgggcaggacagaggtcagtggtggtccct

SEQ ID NO: 38612 - DNA, 201 bp, Homo sapiens
ggggtttcaccatgttgtccaggatggtctcgatctcttgacctcatgatctacctgcctcagcctcccaaagtgctgggattacaggtgtgagctaccaygcctggccattttttttttttttttttttttgagacagagtctcactctgtcacccaggctggagtgcagtggcatgatcttggctcactgcaacctccg

SEQ ID NO: 38613 - DNA, 201 bp, Homo sapiens
gaatacagagtagagaagggtcaccttgtcatgttggtattggaagatactgcccagatgaggagcttcgcctgcaacagttagggaggtgttttgcgaayatttgaattaaatacatggtaaagatgttagtttgtaatatgtttttagtatatttttctccatctattagatttaaaaaacagattagaaattaaatgt

SEQ ID NO: 38614 - DNA, 201 bp, Homo sapiens
ggtcacagcccatgtggcaagaccccccatgatgccttgcacaaggtcagcctcctgggcccagagcaggtgagggaagggcagtggatatgtcgggaggrtggagtgggcaggtggtgaataactggcactcgggttatcttttcttgaggttaggattgctctccagttttataggtgaggaagctgagctcaagtggt

SEQ ID NO: 38615 - DNA, 201 bp, Homo sapiens
tgactttggacatgttccttaactttctttatcttggtcttctcatctctgtaaaattgggatcataatggcaccaacttatagttttttttttttttttwtttcttttgagtcaggatctcaccctgttgcccagactggagtgcagtggtgtgatcttggctcagcccttgggctcaaacgatccccccacctcagcct

SEQ ID NO: 38616 - DNA, 201 bp, Homo sapiens
aaagcaaggcagatacaaagatcatcctgttggcagatacagacagggagggacagagaggttaattaagcaagctacctgcccgcagttacatggccagmagcagtggcactgaacgacttccttcaggcggtctgagtccaggtctcagctcttagccatcactccatggttctgtgctgagacaagggatgtagaaag

SEQ ID NO: 38617 - DNA, 201 bp, Homo sapiens
aaaaaaaaaaaaaaaaaaagaaaacaggaagtagggaggggcaaggaggcatctggtgcagtgatctgactagtttcagttctttgttactccctgaaggycctttcctgagaaaggaactcagataaaacaaatacaagtttcaggctttaatagcagaagggtaaatttctatgtttattcaaaaacaacttgtctatg

SEQ ID NO: 38618 - DNA, 201 bp, Homo sapiens
tgaacattagagcatgcagtttgctgagatgtcttgtacttagaaaatccaatttataaaaaacctcaaatagaacagtaaatttagggaattttttttttctgatgataaaattagataactctgttgcatggattctgtaaaacacagctccctcctgttacgccatgaattgggttcaatttacaacacccctttagg

SEQ ID NO: 38619 - DNA, 201 bp, Homo sapiens
tcaaccaatttgtggagagtccattttgcaaagccttagcacagtgccaagcacaagctacacacccgggatgctgctgaatgcagatgagagcatgccarctctgctgaagttgggggctgggggcagtggatggctgtgagtggtgtgaagccccgggccacagtgaagaccctggaatggctgagagactgggattcc

SEQ ID NO: 38620 - DNA, 201 bp, Homo sapiens
tttcaccattacaagtggtgcaaggaccaatatcttcatgaatacagcattttctgtaaagcagaaattctttcttcaggattaatttccagatatctttytggtattagacacataccacttgcctaataacgttccaaaaggaattcattgtttacattgctattagaacatatgagattgcctgtttcattatgtccg

SEQ ID NO: 38621 - DNA, 201 bp, Homo sapiens
atgtttgttcacagagccattcaaagtgcagtggatacattataaattgtacaattatttgtaattaaaaaaagaacaacagcaaaaaacccaaagtgcartggatgcaaagaccaatggattttcatgtaacagaatatgaaaagttcaccgacacagtttcacattccacgatgcagagaagtttttaataactgccat

SEQ ID NO: 38622 - DNA, 201 bp, Homo sapiens
cattttgaaaacgaggcagtgtcagctcccacagaaggtctaattttaaacatgcaaataattttcagttccacttttccttcttcctgttagagggaagytgtcccctgttgccatttctgaaacttgggcggacaatgtcgttattgtgttacaaacgatttgcgtctccagggcaggagttgggtgatatttttctgg

SEQ ID NO: 38623 - DNA, 201 bp, Homo sapiens
tacgtagtgtgacctctagtcagcaaatggccacttggctgtattttaaatttaggtacactttgctgcttggggtccatcttgaggggattgcctttttyaggttcatgtttgttcacagagccattcaaagtgcagtggatacattataaattgtacaattatttgtaattaaaaaaagaacaacagcaaaaaacccaa

SEQ ID NO: 38624 - DNA, 201 bp, Homo sapiens
cttttccattaaagtgtggatggtgtactgtaaacaaagactagctctcttgagctgccacgtttctataacttatagaaacagaagctgttttttttttctaaagatccaaactcatgttgccacacaaacaacaaaataaaccagtgtgttccaaaaacaagcatttgctctacccacacgcacagttggaaagatgca

SEQ ID NO: 38625 - DNA, 201 bp, Homo sapiens
caatggcgtgatctcagctcactgcaacctctgcctcccgggttcaagcaattctcctgcctcagcctcccgagtagctagaacacaggtgcccgccaccacatccggctaattttttgtatttttagtagaggtggggtttcatcatgttggccaggctggtctggaactcctgacctcaggtgatccacctgccttggc

SEQ ID NO: 38626 - DNA, 201 bp, Homo sapiens
caaaaataaacataaaaataaacactttatgtacacaatctcacatcactttcacagtcttggaaggcagatatttctgttatcctcattttacagctgaygcctatctaaggcttgtataaaagtcagtcactgtccaggctcacacagccaatgctggagggctgtgtggcacccagagagcacagttgctgcttggaa

SEQ ID NO: 38627 - DNA, 201 bp, Homo sapiens
ttaaatttaggtctgtcttgttctgcagtccatataccatataactttgccaaatacaacactatggtgtgtgtgtgtgtgtgtgtgtgtgtgtgtgtgtgtatgcacatgtgtggcctttattgaacactgtggtgtgtgtgtatgcacgtgtgtggcctttattgacttattgaattgatcctgaatcttccctactcc

SEQ ID NO: 38628 - DNA, 201 bp, Homo sapiens
tccgtgagtccacgtgtgcccttgtctctgcttgctgtgcctttctctttcctccacgttgctaaattccgtccatttttcaaggctcagttcagatcatycttctttgctttatcattttacatactgtgtatggtttggcctcttggtctgctgctctctgtgtctgttgtatggagcgcttttctatctggtattacg

SEQ ID NO: 38629 - DNA, 201 bp, Homo sapiens
ccatgtccctacaaaggacctgaactcatccttttatggctgcatagtattccatggtgaatgtgtgccacatttttcttagtccagtctatcattgatgkgcatttcggttggttccaagtctttgctattgtgaatagtgctgcaataaacatacatgtgcatgtgtctttatagcagcatgatttataatcctttggg

SEQ ID NO: 38630 - DNA, 201 bp, Homo sapiens
cctggccagcatggcgaaacaccatctctactagaaatacaaaatttagccgggcatggtggtgtgtgcctgtaatcccagctactaggggagctgaggcwggaggatcgcttgaacctgggaggtggaggttgcagtgagccgagattgtgccactgcactgcagcctgggcaacagagcgagactctgtctcaaaaata

SEQ ID NO: 38631 - DNA, 201 bp, Homo sapiens
gtcagtactagacttagcattgttatgttattttgtccagaggagggtgaggtagtacaatcagagacggggaaactgaggtggtgctgcttctggctcakcctgacacttgcagttctaaggttattatttcatctcttaagttgggcaagtttgtgtgtatgcttttgagatgacaataatatttataaaacataattc

SEQ ID NO: 38632 - DNA, 201 bp, Homo sapiens
agctgctcaggaggctgaggcgggagaattgtttgaacctggcaggtggaggtgcagtgagcagagatcatgccactgcactctggcctgggcaacagagygagactctgtctccaaaaaaaaaaaaaaaaaaaaaaaaaaaaaaaaatcttcagtgcagggcctgtctgctctccagggaaggctgcagtattgtcaggt

SEQ ID NO: 38633 - DNA, 201 bp, Homo sapiens
attggaagccatgaggagttgactcaagactcaagacttcaggtcaatatctcgggcctgaagccaggggttcaatacaacatcaacccgtatcttctacmatcaaataagacaaagggagaccccttgggcacagaaggtggcttgggtgagttacaaagggtaccttccgtctcccttactggttcttactttcagtaa

SEQ ID NO: 38634 - DNA, 201 bp, Homo sapiens
ttaatagagatggggtttcaccgtgttagccaggatggtcttgatctcctgaccttgtcatccgcatgcctcggcctcccaaagtgctgggattacaggcrtgagccaccgcgcccggcccggaatacccttaaaatatagccagaaagggctgaggatgggtaagaacccaggatatagagtcttcccataaaagggagg

SEQ ID NO: 38635 - DNA, 201 bp, Homo sapiens
aaagtccactggctttcgtctctctctgccgtgacacatatcggaatctactgtatatatatatatatatatatatatatatatatatatatatatatatrcactaagctctcaaaaacagtcattcctatgaattgaggtgtacaaagtttgaatttgtatcaaagatgtaattattatttttaaaaccttttcactata

SEQ ID NO: 38636 - DNA, 201 bp, Homo sapiens
actcctctgctcacctctaaccaaagagccacctaattgttctgcatggtgaccattgcctgttagattcttggtgaatagattcctagcctcatcttttkttatttttatttttttaataaatggtagaatgaggatgcaggaaacttggaaaagcagagtcaaagttcaactagcacaggagcagaaggtaaattctgt

SEQ ID NO: 38637 - DNA, 201 bp, Homo sapiens
cacatcagtaagatggggaatgacaacccttatgggactgcagtgaggcttagccaagttggtgctgtggaaggccctactggattccaaagcatgatacrgatgatgaatactttatgtggctgaggtgcttccagcaggcacgtgggaagcatccatgtaagattggggtcatgcaaaatggggtgggatcacatcgcg

SEQ ID NO: 38638 - DNA, 201 bp, Homo sapiens
ttggggtcatgcaaaatggggtgggatcacatcgcgggatgaagcacttggatgcaaaggcctgtgtggtccagcctgagtctggctcaacacacagggtyggatcctggctgcgctccttactgctgtatgtacagatttggctcagagggaatgcaggattggcaacatgcatctagtctttcttgtggtctcctggtg

SEQ ID NO: 38639 - DNA, 201 bp, Homo sapiens
tcctggccagaccacggtgttcccgacaccactgacctgctcatcaacttccggtacctcgttcgtgactacatgaagcagagtcctcccgaatcgccgaytctggtgcattgcaggtacgcagatggcacgtcacgtgtgacagatttcaaatgtcattatatatttatgagcactttacaaaagcaaagcctaagaggg

SEQ ID NO: 38640 - DNA, 201 bp, Homo sapiens
gtgctctgtgcacctgggatagagcaggagcaagacacatcattcctgccctcacagggttatggtctcctaggtgacaaggtagtgcacacttccatagstcttactctgggacaagtactgtgccaaatgcttcctcccagccgcctgatgaggtagctactgttagttatcaagtctgatttacaggtgaggcaaaga

SEQ ID NO: 38641 - DNA, 201 bp, Homo sapiens
tgtgatggtaggtggtacccacaatgatggcccttcaggggatttgaagattgtgaaggaggaccaagaggagctgtttggaccacctgtgatccaaggcrggaactaggaagacacctaccggaagtctttgtggatcttttgggattggattggattagcagatacagagcgtttgacctatagtaaccagctgactgt

SEQ ID NO: 38642 - DNA, 201 bp, Homo sapiens
agctgtttggaccacctgtgatccaaggcgggaactaggaagacacctaccggaagtctttgtggatcttttgggattggattggattagcagatacagarcgtttgacctatagtaaccagctgactgttcagcaaacgcttcacttcctaaaaggcttcttctttccaaggcaaactggggcatgtgaggaacaggaac

SEQ ID NO: 38643 - DNA, 201 bp, Homo sapiens
ttaaaggatacctctattccccaggtcctttattgattcatcttatttttatttgtataataaatcattagaatagtgcctggtgctctattgcactcacktgcatatactgtataaagctttgtacatattacttgtttagtcctcacagcagccctaggaggtaggtactattattttgctcattttgcaggcaagaaa

SEQ ID NO: 38644 - DNA, 201 bp, Homo sapiens
ggtcatcccatttccatctgaaaggcccccttgttcatgaagcctctcatggtccttccccctaccccagccaggtatactttctctcctcttggaattaycctataggaagaacatggtggcttgacctgggttccagtctcacccatctgtttacctggggagtgatcttgagtgggtcaatttatgttctcagtgcct

SEQ ID NO: 38645 - DNA, 201 bp, Homo sapiens
ttttgcacattcattgttgtattagagtttgtttttttgtcttaccttgttttaataaattataatcttatgggagatgacactgtcttttctttgtttcrtatataaaaagtgttttgctgatatacgtagaatcaagttggtctggagttactctggataagggatgaaatcagggagctcttgtgttcaaaggggcct

SEQ ID NO: 38646 - DNA, 201 bp, Homo sapiens
tttctcctcattttttagcttccatttttacttcctttagtattgagaaagtaccaggctcacttcaaagagttgacttcaaagctcccaccagctcagamatacttgccactgaagcctgtaggaattggcatcaatggaagaccctgtggcggttgcatttaagattttttttgggacttctatttttataattctttt

SEQ ID NO: 38647 - DNA, 201 bp, Homo sapiens
attttttagcttccatttttacttcctttagtattgagaaagtaccaggctcacttcaaagagttgacttcaaagctcccaccagctcagacatacttgcsactgaagcctgtaggaattggcatcaatggaagaccctgtggcggttgcatttaagattttttttgggacttctatttttataattcttttaaatggtaa

SEQ ID NO: 38648 - DNA, 201 bp, Homo sapiens
aaaccccgtctctactaaaatacaaaagaattagctgggtgtagtggtgcatgcctataatcccagctactcaggagacagaggcaggagaatcgcttgamtccgggaggaggaggttgcagtgagccgagattgtgctatagcactccattctgggcgacaagagcgaaactctgtctcaaaacaaaacaaaacaaaact

SEQ ID NO: 38649 - DNA, 201 bp, Homo sapiens
gaagcctgtaggaattggcatcaatggaagaccctgtggcggttgcatttaagattttttttgggacttctatttttataattcttttaaatggtaaaggrggagggttacaaaatatctgcgcctttaagatatcaaacataagccagtgaagttccaaaaaaaaaaaaaaagatgtcttagagaaatgaaaaggatttt

SEQ ID NO: 38650 - DNA, 201 bp, Homo sapiens
gaacaactcttttttctttttctttttctttttttgtttttgagatggagtttcgctcttgttgtacaggctggagtgcaatggcgccatctcagctcacygcaacctccacctccccagttcaagtgattctcctgcctcagcctcccgagtagctgggattacaggcacgggccactatgcccggctaattttgtattt

SEQ ID NO: 38651 - DNA, 201 bp, Homo sapiens
agaccagagatctcatgggtttgtgtttcttcattgatacttttaaggggagcaacttaatcagtgggaaaccagatctcaaaggatgggacagataaacscagggtacagagaagagcttgggggagtgtcaagcttatttgcccaaaagggctgaccctaccttaccgccattaatacatgtccttcatgcatccctgg

SEQ ID NO: 38652 - DNA, 201 bp, Homo sapiens
aagttattctggtttgcagactgggagacaggtttaatgacacagtcatgtcagagagaggggaagaggagaatacgtagggggtctgttttgatgtgtawgtacatgtaggattttcatgtagaggagttggggaaaattttagaagttttaggtgtaaatgcagctggtaagatccttatgacttagtttctttttttt

SEQ ID NO: 38653 - DNA, 201 bp, Homo sapiens
ttcaatacaacatcaacccgtatcttctaccatcaaataagacaaagggagaccccttgggcacagaaggtggcttgggtgagttacaaagggtaccttcygtctcccttactggttcttactttcagtaactaaatgttctaaaaaataaattgctcttccatgtgtatggagatttagaatttataaagggcttttcct

SEQ ID NO: 38654 - DNA, 201 bp, Homo sapiens
atgtaaatgatgagttaatgggtgcagcacaccaacatggcacatgtatacatatgtaacaaacctgcacgttgtgcacatgtaccctagaacttaaagtrtaataaaaacatatatatatatataaaagaaatgggacagattccttgaaacacacatgaaatgagttacgcttttgagattctccttgaagaagcttct

SEQ ID NO: 38655 - DNA, 201 bp, Homo sapiens
gagttactgagtatcaagtggtggggctggaacccggagtctaactctagaccactgtggtgcagtgatgttcataacagctatccacagtcaccgagctrggaatttattggttctgcattacttaataaaacaaaaagacgcatgactgacctgatttagaactctttgcatgagagacatgtgctgtgaagaatcatc

SEQ ID NO: 38656 - DNA, 201 bp, Homo sapiens
gaggattgcttggcccaacagttgcagactagcaccagcctgggagaccctgtctcaaaaaaaaatttttttttatagaaacagtttaaattattaaattrtttctaggcctacaggagaaacttctgggaaatcctagagagtaatgttcattattgttgttttaaaattttgaaataattgttttttggaaaggttgaa

SEQ ID NO: 38657 - DNA, 201 bp, Homo sapiens
ttctaggtcacacagctaatggatggagcaggtctttaatcccagatctgggttccaagaccagtccttttctctttacgctgctctgtccctgctatctktatgtcagaaaaccactgagcttccttctagatgtcagggtttggcaaaaaagttatcatgtgcttctgcgtcatgcagcgttttctgagaatggggaga

SEQ ID NO: 38658 - DNA, 201 bp, Homo sapiens
aggaaatgcatactttgatagaaaatggacaaaaaagttgtattggtagaattaaatgaactaatgcatgtcaagcactgagcactttgactcaatagtamtaataataataataacacaatgtatcattatgatagtgttatatctctttagcaatcttgatagttgacttgtataattcacagtacagaagcttattct

SEQ ID NO: 38659 - DNA, 201 bp, Homo sapiens
aatagaggcagtgccatgaagcagcattggtatctgttgatgggtgtgtgcattggcataactctctgctgtttatatcacaggcctaaacattaggcatrtgctggcttgaagtctgagactatcctaaggaaataatctgaaatgcaaccaaaggcttattcagaaagacgagtctcagcattatttataatagaggaa

SEQ ID NO: 38660 - DNA, 201 bp, Homo sapiens
ccaggctggtctcgaactcctgacctcaggtgatccacccgtctcagcctcccaaagtgctgggattgcgggctgggattgcgggcatgagccaccatgcycaacaacagatttattataagcaaaagctctttggggtcctcaataattttaagagcataaaggagaccaaaaagtttaagatgtgctggtcaagacaga

SEQ ID NO: 38661 - DNA, 201 bp, Homo sapiens
tgttggccaggctggtgtcgaactcctgacctcaagtgatctgatctgcctgcctcagcctcccaaagtgctgggattacaggcatgagccagtgtgcctrgcttcctgcagtttttttattgattggatgaatgtttgtatatcccatgagccagatgaggcacactgtccatgcacatagcaagatggtaacacttaca

SEQ ID NO: 38662 - DNA, 201 bp, Homo sapiens
ggggtctcctagattctttcaaggtatttctgggtattgttttcataatactactaacatgttatttggcttctttactctcattgtatcatgagtgtacrgtggagtcttgcagattctatatgatttgggatgacactgtcactcttacagctaatggaatgtatgctttcatattgtttaaaaaactttatctttttt

SEQ ID NO: 38663 - DNA, 201 bp, Homo sapiens
gtgtgatcttggttcactgcaaactctgcctcctgggttcaagtgattctcctgcctcagcttcccgagtagctgggatcacaggtggctgccaccatgcscaattaatttttgtatttttggtagagacggggtttcaccatgttggccaggctggtgtcgaactcctgacctcaagtgatctgatctgcctgcctcagc

SEQ ID NO: 38664 - DNA, 201 bp, Homo sapiens
aaacctggagagctttgtcacttgctgaaatccaagctgccctgtgaatttatccccaaacactgctccttttgagaaacttgtacaagctgccttaattyagtcaattcaaatgggttgatgggggctgttcccaaggcccaggacaggcaggggtttgtgacctgcagccctggaactgcctttgggtttcatggtctc

SEQ ID NO: 38665 - DNA, 201 bp, Homo sapiens
gctgaagggctagaggaggacagggtgtttctggagcccagtgagagctggggcagtggtggacacagctgtgtcaggacaggaggcccagagcaggaggygatggaggaaggcactgactcctttctcctgtggcccttcaggggcctgcccattggctcatagtggaacccggtcacagcccatgtggcaagacccccc

SEQ ID NO: 38666 - DNA, 201 bp, Homo sapiens
tgaagggactaattctaggtcacacagctaatggatggagcaggtctttaatcccagatctgggttccaagaccagtccttttctctttacgctgctctgyccctgctatctttatgtcagaaaaccactgagcttccttctagatgtcagggtttggcaaaaaagttatcatgtgcttctgcgtcatgcagcgttttctg

SEQ ID NO: 38667 - DNA, 201 bp, Homo sapiens
gtgtggacagatgatgctggtcagcaggcaggaaaacgatctgccaggcgctgggggtggggcagaggattgttcttcctgaccttggtatgaaaaccgtrtggagttcttagtgaggaaaatcactcttagcccaaattcctgcgaaggccgatgggattgtttttaagatttgttggattgctggatttgttgaaggga

SEQ ID NO: 38668 - DNA, 201 bp, Homo sapiens
ttgaggttaggattgctctccagttttataggtgaggaagctgagctcaagtggttttcctgtggcccacctgggtgtcatagcagagtgagccctggaayccaggcctgcctcgtcctgacttctgtgatctcgggcgatcacatagatcgcagtgttcgctcttgcatcatgtgtgtttgacaacttttctgggtgccc

SEQ ID NO: 38669 - DNA, 201 bp, Homo sapiens
tataagaaggaggaagggcagaaggttgtgccccacccttaaaggacacttcctagaagtcacccagtacctctgctcatgcttcgttgagcaaaacttaktcacattgcaacatctagctccatgggagctgggaaatgtggtctttgtttccaacaggtatgcacacacagggctaaaaatctgggtgggtatgatgaa

SEQ ID NO: 38670 - DNA, 201 bp, Homo sapiens
gggttaaacagcccatgagtgatgcagtgaccagagctttctctgtgcccactgaggcatgtgagtaatgcagacacacgcctgtcttctcactgcagccyatgctgtgtactcagacagagaaggagggtgaggtatttgcctgatggttgacaaactttctggaaagggccagattgccaatattttaagctttgcagg

SEQ ID NO: 38671 - DNA, 201 bp, Homo sapiens
agggtgaggtatttgcctgatggttgacaaactttctggaaagggccagattgccaatattttaagctttgcaggtggtatagagtctgttgcaagcattygactctgccattgtagtgtgcaagcagtcacagaagatacagaaggaatgagtgggaccattcccactagatgttatttaccatggcaggtggatttggt

SEQ ID NO: 38672 - DNA, 201 bp, Homo sapiens
aaatacatggtaaagatgttagtttgtaatatgtttttagtatatttttctccatctattagatttaaaaaacagattagaaattaaatgttaaaaatatrtttgaaataaacttgaagtattaaaagaagcctaaattaaacttcttttgagacttaatctgtataattattttcttgatgtgtttttgggaagttttcc

SEQ ID NO: 38673 - DNA, 201 bp, Homo sapiens
ctccgtctgtgtcaccctcctgctcctcctccacctggctagttcctgttggccacttttggaaattcatgccagtccagtccaccctgagtacatcctckttctgtgtcactgagctcactatgctgggttttatctatgtctccctcgcaactagatcattcacgtcttgaagttaggcatcatgcgttcttcatttct

SEQ ID NO: 38674 - DNA, 201 bp, Homo sapiens
aaggtaatgcatttacatgttacataaaattcatatcatacagaaaggcagaaggaaaacagggagaattacttgttcccttttctctcttcccctcccarttcctttaacaggaagaatgtctcactagtcatgtgatctacagcaaatcctttaacctcttcaaacccgcatctcttatatgttacaggacagtaataa

SEQ ID NO: 38675 - DNA, 201 bp, Homo sapiens
aagctacacacccgggatgctgctgaatgcagatgagagcatgccagctctgctgaagttgggggctgggggcagtggatggctgtgagtggtgtgaagcyccgggccacagtgaagaccctggaatggctgagagactgggattccaggagaccgaggtttgaggggaggcttttcattgtttgattagctctttttttc

SEQ ID NO: 38676 - DNA, 201 bp, Homo sapiens
ttttagatagtacaaaagaaaataacttcacaaatttgtaattagcatttgcagcttgggtcattaagtttagtattagggggcaggatttggtgtcagckgtgaactaatgcctgaggaaaaggtgtaacacctttatttcatagatgacatcaactccagatacacaagggaaaagcacaggaaggaatccttttttgt

SEQ ID NO: 38677 - DNA, 201 bp, Homo sapiens
ggaattggatcaccctggaacctagctggggctaggatggttgttgcatgtgattttcagcaggactctaagggatctccaaagctggttggctggctagygaggttgggcgagggaataactcatttgcttaacttttcatatgtaacaactgggttttgggtttcacaagagacaaggtaggcaggcaggctcaggtgg

SEQ ID NO: 38678 - DNA, 201 bp, Homo sapiens
ccgacctttccccttcctggcatttccataggggctgaggcagagcagctgaaggggcattcccatttcacagatggggaactgagggagagaagtgaaakagcggagcacccagcccgtgccatgggagctgagccagcgggcacgtcctcttagcctctggagcctgttggggtttgaacccgcaggggaagcggtcta

SEQ ID NO: 38679 - DNA, 201 bp, Homo sapiens
tgagcctcccgagtagctgggactacagctgtgtaccactatgtctggctaattttttgtatttttagtagagatggggttttgccatgttgcccatgctrgtcttgaactcccggcctcaagagatcctcttgtctccaaatcgcttcgcagaagtgctgggattacaggtatgagccaccatgcccagccaagttagtt

SEQ ID NO: 38680 - DNA, 201 bp, Homo sapiens
agcaaggacctggggatggaccttctctggccagctacagggtatagagctggtgggaaatgcaggagcctgtgctagcagttgaccattaacatgggaaygccacctcccagcgggcactgctgccgcatacttgcgaggttgctgaagcttgtagtttagagcaggaccatcccactagatgtgcaatgtgagcctcag

SEQ ID NO: 38681 - DNA, 201 bp, Homo sapiens
gcatttctttaccttttactcttttactatttattagttaggattaggttcagccacgaataacaccaccaaaaacaacaacaacaaaacccaagtatccrtggcttaaacaagacaggggtttatttctctctcctgtaacagaagcccagtgctaggcaggatggggatgatagaggttatccaaggctcagttgtatg

SEQ ID NO: 38682 - DNA, 201 bp, Homo sapiens
cagagtcattggaagggccgctgtattagtttgccagggctgctgtaataagatcaaggtcttgggggttaggacttcaacatatgaatttgggggtggcrgagcacaagtcagctcataacagctggggaggaggctttaggcctggccctgagaaattactcccagactaaggctgcagaactgaccccctagagagtc

SEQ ID NO: 38683 - DNA, 201 bp, Homo sapiens
aagaaaaaattttaattaattgtgcaatcatgatgaaaatttatattttctgtaatttttttctagcctcatctgtgggcgatttaacttagttgaaattrtaatacattatttgtatattgtttatgtgctgttatcctttaagtattttcttgtgttgctacattgcccttttgttgctacattgctacatttaaagaa

SEQ ID NO: 38684 - DNA, 201 bp, Homo sapiens
gaggaggctttaggcctggccctgagaaattactcccagactaaggctgcagaactgaccccctagagagtcaccaccttggtcatagacagcaagcagaragggaggaatcaggaagtccctgctgtagttgctggatccagcggtgaatgttctgagctgtgatcctgggatcaggaagctgcagccactgccacagtg

SEQ ID NO: 38685 - DNA, 201 bp, Homo sapiens
gagggtgggctccttaccctcttgttgaatcaggagaataggctgtaatagaaataaaagcgtttttaaaatgaatgctgataggctgggtgcagtggctyacagctgtaatcccagcactttggaaggccatggtgggcagaccacctgaggtcaggagtttgagaccagcctggccaacatggcgaaacccatctctac

SEQ ID NO: 38686 - DNA, 201 bp, Homo sapiens
agggaagccggcctgttctcatcttgctgtgcctgatgccttgtgcttggggcactgttcactgtgctgcctgctggcctgcttgtctctgccttttggaygggagataggccaccccacagtgccacacctgccttcagggaagcttttgggtgttccttgtctggcttctgggttcagtgggagggcccacccagcctg

SEQ ID NO: 38687 - DNA, 201 bp, Homo sapiens
tttcctgaaagcacacaaagcaaagcacggctctgcagtgtgacccaccgtgtgctgtgtggacagatgatgctggtcagcaggcaggaaaacgatctgcyaggcgctgggggtggggcagaggattgttcttcctgaccttggtatgaaaaccgtgtggagttcttagtgaggaaaatcactcttagcccaaattcctgc

SEQ ID NO: 38688 - DNA, 201 bp, Homo sapiens
ccacctcggcctctgaaagtgctgggattataggcatgagccaccatgccctgcctcaagcatctattttgtgcaagagcttgcagaagttctttcctgcyacagccgtggttggccacattgctcccccatgaatatgtggaaactgacacttcaggagaattggtggctcacccatggcattcagctagtgggttatgg

SEQ ID NO: 38689 - DNA, 201 bp, Homo sapiens
tgtcatttttcctgattggcacattttgaccatgaccatctggaagtttttgctagctctgttttctgcaaggaatctatgttttattagtctcctgaagytggcttccttgtcatgttctactcttctaccaataaatacggatttcttgattaaaaaaacgtcaaataggttatcaagatccaggggagagaagaactt

SEQ ID NO: 38690 - DNA, 201 bp, Homo sapiens
taaaaataaaaaactggagagaaaagagccaaagaaatgggagtcacgggcaccctgacaaaactcctggagctcctcagagcactattttaggggggaamacctgccataaaggtttgctctgttacattgtgaaagagagggaaaggagagcacagagagatgacagaagagaagagaatgagagaaaagagcatagaa

SEQ ID NO: 38691 - DNA, 201 bp, Homo sapiens
gggggttgcagtgagccgacatcgcgccactgcactccagcctgggccacagagcaagatttcatctcaaaaaaaaaaaaaaaaaaaaaaagaaaaagaawaaaagaaatgcaggtaggtgcttctagctactgctgtgggatagcaaggtagttaccaaactgataagggtagcatcttacttactgctgaaaaattcag

SEQ ID NO: 38692 - DNA, 201 bp, Homo sapiens
gatttagaatttataaagggcttttcctccacattttagtttgatcccccacctgcatgaggaaggaaggaaacgtgttctgattttacaggggaacacaytggggctgagaacagcaataggaattgaaactttttagagtctggcacccaggaaagttagaggcccctttagctttctatctaacagctgtgtcaaccc

SEQ ID NO: 38693 - DNA, 201 bp, Homo sapiens; identical to SEQ ID NO: 8523

SEQ ID NO: 38694 - DNA, 201 bp, Homo sapiens
acagagcaagattctgtctcaaaaaaaaaaaaaaaaaaaaaaaaaaaaaaaaagcaagctcatacctccagcctgggttttgagagcctgtctgaaaaaaacaaaacaaaaccctcaagtaaacaacctaatgtagcacgttaaggaactagaaaaataagaacaaactaatcttcaaattagtaaaaggaacaaaataat

SEQ ID NO: 38695 - DNA, 201 bp, Homo sapiens
gttcagagatctctaggggtctcctagattctttcaaggtatttctgggtattgttttcataatactactaacatgttatttggcttctttactctcattktatcatgagtgtacagtggagtcttgcagattctatatgatttgggatgacactgtcactcttacagctaatggaatgtatgctttcatattgtttaaaa

SEQ ID NO: 38696 - DNA, 201 bp, Homo sapiens
agtaggggcgacagggcccctggagcataggactgagaagagcattgagagggagaggatttccaggtctggtggtgggtgagctagcatgctgctgccarttttgcagcaaggacctggggatggaccttctctggccagctacagggtatagagctggtgggaaatgcaggagcctgtgctagcagttgaccattaaca

SEQ ID NO: 38697 - DNA, 201 bp, Homo sapiens
ccttccttaaggacctgaaggtctcttctcctaagggctaggttggttcagaaagtgagaagggctggaccttttgtggggagaggatacagcagggtccraacagctgggctgacaccgggcagcagcccagcagcagtcggagctgcagggtcagctcaccatgggctgaacttgggcattgcctgtttaggcagagtc

SEQ ID NO: 38698 - DNA, 201 bp, Homo sapiens
tgaaggtctcttctcctaagggctaggttggttcagaaagtgagaagggctggaccttttgtggggagaggatacagcagggtccgaacagctgggctgayaccgggcagcagcccagcagcagtcggagctgcagggtcagctcaccatgggctgaacttgggcattgcctgtttaggcagagtctgcccgagcctttcc

SEQ ID NO: 38699 - DNA, 201 bp, Homo sapiens
tgcaggccaagtcaagtgaccaaagctaaaggggaaggaagggctggctggacttagcagtgaccacagacagagttgaagccttcacggttggcgttggycttgttcactgctgtgtgccaagctgctgacagcatctggctatcgcaggttcgtaataagtgtttgctgagtgaatgaaagaatattggtgttggggat

SEQ ID NO: 38700 - DNA, 201 bp, Homo sapiens
tatcccacagggcttgtgtggctggcttcaccaacattaccttccaccctcaaaacaaggggctcattgatggggctgagagctatgtgtccttcagtcgytactcagatgctgtttccttgccccaggatccaggtagggagaagacaacagtcctggcactggttcagtggcattttgctccacgtgtccatagaaggc

SEQ ID NO: 38701 - DNA, 201 bp, Homo sapiens
aatttgaaacagctgcttttatccaggtgtatacacggtgtatacatacacagatatgtatgaaatgtggaactctatacccgtatgtatggagttcctcmtaagagtctttttgagaaaatagttccattgctaaaaatacccaatggaaacttctggcctgggatttccaagttcaccctcggctgtgcatctcaaagt

SEQ ID NO: 38702 - DNA, 201 bp, Homo sapiens
gcacaggtgcccagccttctggaataaagacaggaactaagcattaaaaatagcacgccattcatttgcttgtgccgagccgccaagtgccccctcctgcyggcgacaggtccggatgtgggccagttctcagcccagggaaaatgaacagtgtcttctccatggtgcccagaacagtctgagtcagtggaatgtgctggc

SEQ ID NO: 38703 - DNA, 201 bp, Homo sapiens
gacaaaagcctcttctcacctttagagaaattaagtcttattggtagaaaatattttagagaggttctggtctaagcctctcattttgcagatgagaaacyacccaaggcccaagatggatggatttatcaaagccggttggtgctggaacttggatttaatttcaggtcttttattattactatggaacaaatcttaact

SEQ ID NO: 38704 - DNA, 201 bp, Homo sapiens
tactgaaacagattgtagaactttgtaaactggctgcctttctactcctctgctcacctctaaccaaagagccacctaattgttctgcatggtgaccattrcctgttagattcttggtgaatagattcctagcctcatcttttgttatttttatttttttaataaatggtagaatgaggatgcaggaaacttggaaaagca

SEQ ID NO: 38705 - DNA, 201 bp, Homo sapiens
tttttcattcctggactaaaacattaagttctttttaaattcagcattttctagttcttgggttctttctctccatttatttccttgtacttgacaaggartattggcccatgttctgagggaaatgcttttaaaactaggctgggggtattgcccttgtaagggtaatttgggattattggcccctttttgtgaatgtct

SEQ ID NO: 38706 - DNA, 201 bp, Homo sapiens
tcttattgggaagcctttaggctgagactcaggtcagtactagacttagcattgttatgttattttgtccagaggagggtgaggtagtacaatcagagacrgggaaactgaggtggtgctgcttctggctcagcctgacacttgcagttctaaggttattatttcatctcttaagttgggcaagtttgtgtgtatgctttt

SEQ ID NO: 38707 - DNA, 201 bp, Homo sapiens
gacgggaaaactcggctttgtactaggtctgtctgtctcagtaagggaaaaggccagagtctgtgttcttaacccctctgtctcacaactatttatttcarttctataattctggaatgaaagtgagcagagggagacggggagtcacactctctgtgtccagacacatgggctgagtgaattccacagctaagtatgact

SEQ ID NO: 38708 - DNA, 201 bp, Homo sapiens
tttgtatcaggctatcgtcctgtaccgatttagaactctatgaatatgtgctgtgtttttgagtctagcagggaatgttctagatgcctgggtacattgcrtgctctggggtgagcttggtggttgttgtggaaagagtgaaattcaactcctgtgttggtcaaaagagagattttcttttttctgctataattatataaa

SEQ ID NO: 38709 - DNA, 201 bp, Homo sapiens
ttatcatagctacagaagggtggctgaccagcggagaaaaggaacacttaatatctatggtatagtttctgtactactgctggatttggttttacccaaamtgttactgagaagtgtttttgaggcatgttttcaacagaacatattgcaaagttgctttcctcaaaggggtgaatgttccttgaccaggatgagagcaga

SEQ ID NO: 38710 - DNA, 201 bp, Homo sapiens
agcaatttatcctcacccagacttgtacattttaaagactatcaattatcatagctacagaagggtggctgaccagcggagaaaaggaacacttaatatcyatggtatagtttctgtactactgctggatttggttttacccaaactgttactgagaagtgtttttgaggcatgttttcaacagaacatattgcaaagttg

SEQ ID NO: 38711 - DNA, 201 bp, Homo sapiens
actcataaaactggtattttccagtctttgtttctaagaaggtctgaccatctttaaaataagctaatgaaacaaactcatcaaacattaatgatgtgacrtatcataatgctgcttaaatgttaatacagcaatttatcctcacccagacttgtacattttaaagactatcaattatcatagctacagaagggtggctga

SEQ ID NO: 38712 - DNA, 201 bp, Homo sapiens
caggctggtcttgaactcctgacctcaagtgatccacccgccttggcctcctaaagtgttgggattacccacgtgagccactgcgcctggtcgtcttttarcccacatctgttggtggcttactgtgtgctatggtgagggatactatggtgagtaggggcgacagggcccctggagcataggactgagaagagcattgag

SEQ ID NO: 38713 - DNA, 201 bp, Homo sapiens
gggcaccttatataacatcaccatctctccagaagtggaccacgtctggggggaccccaactccactgcacagtacacacgtaagtctcttaggatgcccytctaaggaacagcctctctaactgtctcttggaggaggcactggttaaatgatggccagtgtgcttctgggatccaggttgactctgaaactgctgaagt

SEQ ID NO: 38714 - DNA, 201 bp, Homo sapiens
agaagtatatttttaatctagttgtttactttctttgcatagcccctgttccagtttctgacttccgagtgacagtggtcagcacgacggagatcggcttrgcatggagcagccatgatgcagaatcatttcagatgcatatcacacaggagggagctggcaattctcgggtagaaataaccaccaaccaaagtattatca

SEQ ID NO: 38715 - DNA, 201 bp, Homo sapiens; identical to SEQ ID NO: 8535

SEQ ID NO: 38716 - DNA, 201 bp, Homo sapiens
gagttcctcataagagtctttttgagaaaatagttccattgctaaaaatacccaatggaaacttctggcctgggatttccaagttcaccctcggctgtgcrtctcaaagtccacacagcctcaccaaaatagcccttctgggtacttttttctgtgtgttcttggaggaggccatcgtgcctccagctccctaaggcggaa

SEQ ID NO: 38717 - DNA, 201 bp, Homo sapiens
tgggtgcccttggtctccagcttccagtgggccagtctggcgagagaccctagctggagatgaggggaggtagccttggcctctctccttgcccttcctcrctgctgctaccccaggattcttgcccatcccttactggttttccttaaccccaccctcacccttgaaaacagactctttaaaactctcctcactcaccct

SEQ ID NO: 38718 - DNA, 201 bp, Homo sapiens
atgtttactgtctggcctattacagaagacgtttgctgacccctgatttagggcattcatgaggcttgatgagatgttgaaaatcagctgtctcctcccgycactctcttctgattgtgggtaggctctggtgcaccagctctccagtgatctcctatctgatgctcagagttctttttccattgcatggatgtcaaataa

SEQ ID NO: 38719 - DNA, 201 bp, Homo sapiens
gtgtagaccaaccagggtgaatgagtgtatgactggaaatgcaaagacgggcaggatcaagggacagtttagagcaggggtgtccaatcttttggtttccytgggccacactggaagaagaattgtcttgggccccacataaaatacaccaacactaacaatagctgatgagctaaaaaaaaaaaaatcacaaaaaatctc

SEQ ID NO: 38720 - DNA, 201 bp, Homo sapiens
aatgttttaagaaagtttatgaatttgtgttggtctgcattcaaagccatggtgggctgcatgcgggccatgggttggccaagcttggtttagaggcggaygcagtacgggagagttttcccttctcttctgatgtaactccatgtcttggtggcggtgttctagatgtaggcatctttaggcaggggagtgtgcgtggaa

SEQ ID NO: 38721 - DNA, 201 bp, Homo sapiens
atgggcatctcagatgctgtgagtctgagggcagatgcccatcagtccaggacagttcctggggacaaaagcctcttctcacctttagagaaattaagtcwtattggtagaaaatattttagagaggttctggtctaagcctctcattttgcagatgagaaaccacccaaggcccaagatggatggatttatcaaagccgg

SEQ ID NO: 38722 - DNA, 201 bp, Homo sapiens
gtagaaaatattttagagaggttctggtctaagcctctcattttgcagatgagaaaccacccaaggcccaagatggatggatttatcaaagccggttggtrctggaacttggatttaatttcaggtcttttattattactatggaacaaatcttaactttttcaagtgcataccatgtgcccggctatgtgctggatgtag

SEQ ID NO: 38723 - DNA, 201 bp, Homo sapiens
gctacttgggaggctgaggcaggagaatggcgtgaacccaggaggcggagcttgcagtgagctgagatcatgccactgcactccagcctgggcgacagagygagactccatctcaaaaaaaaaaccaaaaaaaacagtgcttgttgttcttttgttgttattgttaaaggatcattatctcattatcaacaacattggcag

SEQ ID NO: 38724 - DNA, 201 bp, Homo sapiens
cgcgctgtcatccccggactccgctccagcaccttctacaacatcacagtgtgtcctgtcctaggtgacatcgagggcacgccgggcttcctccaagtgcrcacccgtgagttcatgcctggctctcaccaccctttcctgctgtcctgctccgtgccaggcccagacacaggatgcatgatgtagtaatggtgactgttg

SEQ ID NO: 38725 - DNA, 201 bp, Homo sapiens
catatacagaacattccatccaacagctgtagaatacacacttttcaactgcacctggaacattctccaggtagatcatatgttagaccacaaaacaagtsttaacagatttaagaagtgtgaaatcatatcaagtatcttttctgatgatggcatcaaactagaaataaataacaggaggaacttaagaaaattcacaga

SEQ ID NO: 38726 - DNA, 201 bp, Homo sapiens
atcttgagtgggtcaatttatgttctcagtgccttacaaaatggggcagaggatacctaacccccaggagctggtgtggctggggtaccttacacagggcctgactgtagtagcttctctccaagcattggtgtcttacctcttctgtttctctaatggtgttttgcacattcattgttgtattagagtttgtttttttgt

SEQ ID NO: 38727 - DNA, 201 bp, Homo sapiens
cagagtggaccactgatgtcatagctgcaggtttggctgaattgggatggtgcagaaagccgtgttaaccatttctttttctctgaggcctggaggaggakccttgtgactggaaccacagttgggactggcagtggtttttcctgctggcaaggaaaaaaaaaaagagaaaagaaagagttcgacttatcagcacaaaga

SEQ ID NO: 38728 - DNA, 201 bp, Homo sapiens
cgttccgcaccttctaccatgtctccttttccagcctcattccctgagatgtagccggagttccagttcagccaacctgcccgttgttttctctcctggarctgggtgtttgagcctcctgcatggagtgttcttccttcccagctaaagtcctggtcatcccatttccatctgaaaggcccccttgttcatgaagcctct

SEQ ID NO: 38729 - DNA, 201 bp, Homo sapiens
ggggcccgctaccacgcccagctaatttttgtattttgagcatgttggccaggctggtcttgaactcctgaccttgtgatccccctgcctcggcctcccaragtgctgggattacaggtgtgagccactgtgcctggccttatttatttatttttgagacagggtctcactctatcacccaggctggagtgcagtggtgca

SEQ ID NO: 38730 - DNA, 201 bp, Homo sapiens
ggtactctccatgtggccagaaatggcagtttctgaggggctcatgttgtaggtgatgatacaaagaagagaaagagagggatcagtttttccaagtgtgsatttcatttcagtgtaaatattttgtgaggtggggcatccctgtctcctggagaaatatatttttaatctaattgtttactttctttgcatagcccctag

SEQ ID NO: 38731 - DNA, 201 bp, Homo sapiens; identical to SEQ ID NO: 8528

SEQ ID NO: 38732 - DNA, 201 bp, Homo sapiens
cttctagccaatattgagaaggtgtcagaaaagcaactggatcccaaattccaggaacaaacaaacattttctgttcttacatcttcactcatgcaagaaycaagaccctcagggagggaatcacagtcactgggaatcgtgagtctcctttttacttttctgtggggcctcatgtgtgttgaatatattgtataatgtgt

SEQ ID NO: 38733 - DNA, 201 bp, Homo sapiens
cccagcgagtgaagttccccacagacacgctccaggagctgctggacgtgcatgcggcctgtgagagggaagccattgcaatcttcatggagcactccttyaaggatgaaaatcaggaattccagaagaagttcatggtaatttgccttagtcattactgttcatcatccttccccttgaagaatgaagcctatagttgcc

SEQ ID NO: 38734 - DNA, 201 bp, Homo sapiens
catcattctactttctactgctatgagttcaactcttttagatttcacatataagtaaaatcatgcagtgtttgtctttctgtgcctggtttatttaactwagcttaacatcctctagattcctccaggttgttgccaatgacaggatttccttctttttgaaggcttaatagtatttcattgtgtatagatttcacattt

SEQ ID NO: 38735 - DNA, 201 bp, Homo sapiens
aattgtgggcagacagttgcttttccttacctaagtcctagttatgtgacggagctcacagaactaattaaggcaaagtcctccccaaggcctgatggagyagaagattccacagagtttgtgagtttcttcccagactttctttggacagtacgggatttcactctggagctgaagttgaacggtcaccctatcacagaa

SEQ ID NO: 38736 - DNA, 201 bp, Homo sapiens
gaggtagatccatgctgacatacaactcttagaaatttccagacttaaaaggacaggaaagggacagtttctaaacttgctgcagttgtcaccctgtatargtagcctgcccaaattagcacacagtgtagggagaattcttgcattgtccatctgaaagttctctcataagggatttctacatcagcttataagtttttg

SEQ ID NO: 38737 - DNA, 201 bp, Homo sapiens
tctgcaggctgtacaagcatggcaccagcatctgcttctagtcaggaccccaggaagcttttattaatggtggaaggtgaagggggcagctggtgtgtcamatggtgagaaagggaacaacagaggggggtggtctcagacttttaacaaccagatcttgtgtgaactcattaccacaaggatggtaacaaggtattcatg

SEQ ID NO: 38738 - DNA, 201 bp, Homo sapiens
ataaagaaaagaagtttatttggctcatagttctgcaggctgtacaagcatggcaccagcatctgcttctagtcaggaccccaggaagcttttattaatggtggaaggtgaagggggcagctggtgtgtcacatggtgagaaagggaacaacagaggggggtggtctcagacttttaacaaccagatcttgtgtgaactca

SEQ ID NO: 38739 - DNA, 201 bp, Homo sapiens
tagattttcaaagaaatctaagtgctttttcttgcttccataggcaaaagaggtcttccagaggttcctggagtcacagatggtgatagaggaatccatcytgcagtcagataaagccctcactgatagagagaaggcagtagcaggtatggggcagggctcagcttacacaggaggggtacatttatacaatgccctcta

SEQ ID NO: 38740 - DNA, 201 bp, Homo sapiens
acccaaaggaacgcaaatcattctcttataaagacacatgcatgcataagttattgcagcacctttgctcatttttaatgaggtataaggattttttttttgctattgagttatataagttcctcatgtattttggatattagacccttatcaaatatatggtttgcaaatatttttctcctattccattggttgcatttt

SEQ ID NO: 38741 - DNA, 201 bp, Homo sapiens
gccagacaggcagagcctttcccatcacattctcaaatgcgctcttaatggtgtggacctgggtgaattctgtgatttctcaccctgcctttcagatttgrtttagtctcagctcagaaaagtggagatgaatcttcacctattattttcttctctttctaataccttcatggagcagtggatcgggccaagaaggaggca

SEQ ID NO: 38742 - DNA, 201 bp, Homo sapiens
tctgtaagcatagaagatggcaaaaagacaatacaccctatcaaaaatacctttagctcccttataccaagactgttttcactatattctctgtttttttwatccctcaggcaataatcccagagttcaaacatccaattttcccagggagtgcatcaggcgtttctttccaaaacggaagtgtttcgtctttgaccggcc

SEQ ID NO: 38743 - DNA, 201 bp, Homo sapiens
catggagcagtggatcgggccaagaaggaggcagctgagaaggaacaggaacttttaaaacagaaattacaggagcagcagcaacagatggaggctcaagwtaagagtcgcaaggaaaacatagcccaactgaaggagaagctgcagatggagagagaacacctactgagagagcagattatgatgttggagcacacgcag

SEQ ID NO: 38744 - DNA, 201 bp, Homo sapiens; identical to SEQ ID NO: 8611

SEQ ID NO: 38745 - DNA, 201 bp, Homo sapiens
tttgataagaaagagaagaggtattgactccaatctcaggagatgaggagaggcctctcacccaccttctgagctaccatgtgaagagtacatttgagggytggaattaggagagttcagtttatatttctcatgatgaagctcatcaattacccacagagcattctggaaggctttgagacatttctgattgtgctcatc

SEQ ID NO: 38746 - DNA, 201 bp, Homo sapiens
tgagaactcagcggccgtgcagagggcatctgactactacagccagcagatggcccagcgagtgaagttccccacagacacgctccaggagctgctggacrtgcatgcggcctgtgagagggaagccattgcaatcttcatggagcactccttcaaggatgaaaatcaggaattccagaagaagttcatggtaatttgcct

SEQ ID NO: 38747 - DNA, 201 bp, Homo sapiens
tgtgtatggtgtgcaataggatcaaatattgctcttctgcatacatgtggatatctgttttcccagcaccatttattgaggggaccatcctttcttcaatrtaagttctcagcacattagtcaaaaatgagttcgctgtggatgtatacatttatttctgcattgtctagtttgttccattgatctatatgtctgttttta

SEQ ID NO: 38748 - DNA, 201 bp, Homo sapiens
tttattgaggggaccatcctttcttcaatgtaagttctcagcacattagtcaaaaatgagttcgctgtggatgtatacatttatttctgcattgtctagtytgttccattgatctatatgtctgtttttatgccagcatcatactattttgactactgtggctttgcaatatatattgaaatcaagaaatatgatgccccc

SEQ ID NO: 38749 - DNA, 201 bp, Homo sapiens
tgggctgtgggtggtccactgggtgtgtgatctgctaaacactgcccatcatctctggggtttcatttgtatttgagactagattgaggtctgtagaaacrgggactgaggggtatgttgaagagctctaggaatggagcctagttcacttaagaaaagtagagtctaaagtgcagataaattattcaagacagatttgtt

SEQ ID NO: 38750 - DNA, 201 bp, Homo sapiens; identical to SEQ ID NO: 8615

SEQ ID NO: 38751 - DNA, 201 bp, Homo sapiens
gaattcttctctatattctctatacttagattctggagaggtaaggttgactatgatccctacaagtccttggggaatataaatagggtcgaagctgctgwtttgggagattttaaaagtaatctcaagaagttaaacatatgttccacacagtgtatttgatgtgaacagcagctggtttccttcaccaagaccacatat

SEQ ID NO: 38752 - DNA, 201 bp, Homo sapiens
tggactggagatccataaaattgaagagtcattatgaaaataagagtgataatagcagaaggaggtagggatgtgggtgtatgtgtttgcatgtgtgcacrcgcgtgtatgtaagtgcatgtgtgtgctcagaaatgtagcctaggatcccactgagctttaatttcatatttagcccctaaatctcctggttcatttagg

SEQ ID NO: 38753 - DNA, 201 bp, Homo sapiens
tatccatgctagaatttcataataattgttttaatgggttacatttatctgagtgtgtatctgataaaaccttatgagaaatatcaattccagtgaactcrttgttgctttcatttttctatttatgctttcttgaaacatttcttaaaaattcataggcagaagagcaatactgtcaaatcgaatacagtcttttaagag

SEQ ID NO: 38754 - DNA, 201 bp, Homo sapiens
atgggtgaaataaataatttctctcttttattgtcttactttgagagttatttgggaatgggttctaaatttctatacactttatttttgcccaaacaggygttagaaattctgtttatttttctgctttagtgttgtataattgacaaataaaaattatatataattaagctgtacaacttaatgttttggtatgtgtat

SEQ ID NO: 38755 - DNA, 201 bp, Homo sapiens
agaattttaggcataaagcaaaagttacaagaccataattgttcttgcaacactaatacccagaacatagattttcaaagaaatctaagtgctttttcttscttccataggcaaaagaggtcttccagaggttcctggagtcacagatggtgatagaggaatccatcttgcagtcagataaagccctcactgatagagaga

SEQ ID NO: 38756 - DNA, 201 bp, Homo sapiens
gttatatcatctacaaaaatgattttgttttctaaagcaacctgaagaagcacgtctttacaatctgtgccttttcaaaatttctgataattgtcggaatrttcattttactttctatgttatgatttttctcttaaacccaacatatgtatccatgctagaatttcataataattgttttaatgggttacatttatctga

SEQ ID NO: 38757 - DNA, 201 bp, Homo sapiens
gtgatagaggaatccatcttgcagtcagataaagccctcactgatagagagaaggcagtagcaggtatggggcagggctcagcttacacaggaggggtacrtttatacaatgccctctaacagatctaacaggaaaaccttcccaaaatgaggaatttcctcttctgtggaacacacactctgctaaatctgaaaataaca

SEQ ID NO: 38758 - DNA, 201 bp, Homo sapiens
gaggggtacatttatacaatgccctctaacagatctaacaggaaaaccttcccaaaatgaggaatttcctcttctgtggaacacacactctgctaaatctkaaaataacaaggggagctatgattgtacatcagccagacaggcagagcctttcccatcacattctcaaatgcgctcttaatggtgtggacctgggtgaat

SEQ ID NO: 38759 - DNA, 201 bp, Homo sapiens
tagctaaaccttttcttttctcccgttgtggattgaaagtatgattgaattggataaaaatgtgggttttctcatattctttcaatgcatccaaattgtgrccccgatctggaaaggctctttttaatatgctgtgttttcatgctggagccttacagtgcacacagaccacacacttctaaaactacaaagtcccgaaaa

SEQ ID NO: 38760 - DNA, 201 bp, Homo sapiens
gtgagaccagataggagggaaaaatatgatccaacatatatagatagaacatctgcaatctagtgaaaagaattttagaggcttcaagttgaagctgtgargaaaggagaccaaccctggtgtgttcctagaaagcaagaaatggtcagtgaaaatggaccgtatccttcccatagtgactaactgtggcatatcctctgt

SEQ ID NO: 38761 - DNA, 201 bp, Homo sapiens
ggtacactgtaacagaagtaggtgtgtcttgctttgaggaaacccactatatgaaaaagccaagcttgactggaaagataaattgatgagtcatttttcawtaatcttgatataaaatttgccctttttactttaaaaaagccttctctttgggtagaatccctttaattagctaaaccttttcttttctcccgttgtgga

SEQ ID NO: 38762 - DNA, 201 bp, Homo sapiens
ctgtgctgtaaagaaagcagctgccccactttctgtaatcagaaaatccaagcattttgatgtgagaccagataggagggaaaaatatgatccaacatatrtagatagaacatctgcaatctagtgaaaagaattttagaggcttcaagttgaagctgtgaagaaaggagaccaaccctggtgtgttcctagaaagcaaga

SEQ ID NO: 38763 - DNA, 201 bp, Homo sapiens
tggttgacggttttcaatgggctatggaagggtggcagagccaacagtcccagagaaactctccccagggaatccaggtatctcacggacattttcaacaytagaaacacatcttccaccatcaagttgtttcttcaatcatgtttatcttgggtgaagcaaaaagaaataacaaatggaaaatgtaaaaaaatccctgtt

SEQ ID NO: 38764 - DNA, 201 bp, Homo sapiens
tggccttgcttactctcctgattctactcacactttttggaagttccttcatgggctgcacattgactatcccctaggtttctttcttctttctttctttcttttttcttcttcttttttttttttttttttttttgagacggagtcttactctgtcgcctaggctggagtgcagtggcgcaatcagctcactgcaacctc

SEQ ID NO: 38765 - DNA, 201 bp, Homo sapiens
caccgggtccctcccacaacacttgggaattatgggagctacaagatgagatttgagtggggacacagagccaaaccacatcagtcccattgggtacagtrtgggaaagaaattggaagatgcacaagtggatgtggaggcactcactgctccaggtaagagacaggacattgacttagcaagacttaacagcaggagagt

SEQ ID NO: 38766 - DNA, 201 bp, Homo sapiens
attcttctggaacgcatcccctgaaatggatatttttattcattttaatagtactttatttatcttattttgttgacattgagtactatttgccaagcacyatggtaagcgcttcatttctgggtctcatttatcctcctgcagccctataaggtagatgctattatgggtatcttcaagttgccaacgaggacgctgaag

SEQ ID NO: 38767 - DNA, 201 bp, Homo sapiens
atcccagcactttgggaggctgagggtggtggatcacctgaggtcaggagatcgagcccattctggctaacacggtgaaaccacgtctctactaaaaaatmcaaaaaaaaaaaaaaaaaaaaaaaattagccaggcgtggtggcgggcgcctgtagtctcagctactcgggaggctgaggcaggagaatggcgtgaacccg

SEQ ID NO: 38768 - DNA, 201 bp, Homo sapiens
gattttgaatcagcactgaatgccagtatggataacctattgtcctttccatccaggagcatacaatcttttgggggagataagacagaagaaacacatagacatacaaagaacagaattagaaaacatgctgagctcagcgagagagagaacattttggattgggaaagaagaggtgcctgcacctaaaaccaattatgt

SEQ ID NO: 38769 - DNA, 201 bp, Homo sapiens
atcccaagaacttgaacagctcctgagaatgaagaatgaacagcccttgatcttgaagatctgttttccaggctccaaaatctaaactgggctctatctayatctgccttcctgggccaaacatttataagcatcagtgagagaagattgcctggatttgtttactttgtggtcctgaattttcagacaagcgcaaattcc

SEQ ID NO: 38770 - DNA, 201 bp, Homo sapiens
acaccaaatacaatctatataaaaattggtatgcttggtgtgtaaatacaactcgacaagccacccctaaacccctcctatggacattctggaactgcccraacataggcttttattctcatcacaaccacacctggaaactgctggaaggtgaaatgtcactgtgttgagtcaggacgtttcaatactttcccccaccat

SEQ ID NO: 38771 - DNA, 201 bp, Homo sapiens
atcccgcccgctcctctgctattctcggctaggactggcgcttcccgctggctcggagcccgacactgtggggcaagggtggcgagagcacccatccccctggggcgtcaggttggcagatctcagcaggcgggtgccaatcttttctccccgccccctagtttgccttggttccgaactcctgccctttgcgcggcctgc

SEQ ID NO: 38772 - DNA, 201 bp, Homo sapiens
ttagataatgattagcaattagttggagcacatagtccttcagtacctgcaaattttaaaatctggtgtatttcttttctggaagagattctgattcttgstagataaaatgtagtattgcaactaagtgtgttagacattcattttcagtgtattttcaaaatatgctgagcaggtatgtttgcagaagcaaaattaaag

SEQ ID NO: 38773 - DNA, 201 bp, Homo sapiens
gaggaaatctaaaggaaggataattattaccacagattttgacaaaagtcagtgctcctttctcattttctttaatacccactgtgcccataagctgattyttggagggcttttcagcccactgagctaaatggagatcattttattttttttccctttaccatactttatctggtgcatttatgggttataagtttctct

SEQ ID NO: 38774 - DNA, 201 bp, Homo sapiens
aagctgcagatttttattaaataaaatcttttcttgtccaacagattattactattatttttttgtccatctgcctgttgtcttggtgttgtttctgagckgtgactctggatgtattgatgttaaagagtgtgttctggatttcttctcctagatcggtcgcttggttatcggacagaatggaatcctctccacccctgc

SEQ ID NO: 38775 - DNA, 201 bp, Homo sapiens
ctcccggggcgcggggaggtgcgggcgcggagcctcccaaggtcacgcccgactctccgtctctagccgctgccttccctctccccgtcccccgcccctcycgaggcgtctgacatttgccctaaccttgcagccttggaagatacgattacggcgcagagtgctgtcgccttaagcaggaaaggttagactgccgccgcc

SEQ ID NO: 38776 - DNA, 201 bp, Homo sapiens
gtttggaccactctgaaagagtatactttgaggtgccttccaaagtgaatttgatgtacaccacgtagcctataaggaatttttacgattttataggttcmatcagctgttgtaacagacactcaaaacaacagtggattaaacaagatgtttttctgtcttgtggaatattgtgggtcagcaggccaagactagcatgat

SEQ ID NO: 38777 - DNA, 201 bp, Homo sapiens
tctgcctgttgtcttggtgttgtttctgagcggtgactctggatgtattgatgttaaagagtgtgttctggatttcttctcctagatcggtcgcttggttrtcggacagaatggaatcctctccacccctgctgtatcctgcatcattagaaaaatcaaagccattggtgggatcattctgacagccagtcacaacccagg

SEQ ID NO: 38778 - DNA, 201 bp, Homo sapiens
cctgcatcattagaaaaatcaaagccattggtgggatcattctgacagccagtcacaacccagggggccccaatggagattttggaatcaaattcaatatytctaatggaggtgagtttgctgtcattttgaggacaggtaagtttacattcagtaggacaaatcaatacctggagccttgggagaccagggttttggttc

SEQ ID NO: 38779 - DNA, 201 bp, Homo sapiens
aaggcaggatataaccaatatattaggggagctacaacaaaaattgttcggagattgacatatgagagccaagaggtaactgaagggaaccaggtgctccytgggaggtggttggtagtggagtggttgacggttttcaatgggctatggaagggtggcagagccaacagtcccagagaaactctccccagggaatccagg

SEQ ID NO: 38780 - DNA, 201 bp, Homo sapiens
tcgcgctcgctcttctggcctggaggcccgacggaggtcgccgggctggggaaagtggccacgggacccggcagacctgctcgcctgactcccggggcgcsgggaggtgcgggcgcggagcctcccaaggtcacgcccgactctccgtctctagccgctgccttccctctccccgtcccccgcccctcccgaggcgtctga

SEQ ID NO: 38781 - DNA, 201 bp, Homo sapiens
ggtctgaaaagatgaagagaggaaggaaaaacaccacgtgcctcctgcatacccagcatggtgctagatactctaacaattccaagaagaataagaccagygggaagtgcagtagggcaggcacataaagaattcaacataggataatgtgagagcatgattatagagcaattgtgtacagttctattcagaaatcagaaa

SEQ ID NO: 38782 - DNA, 201 bp, Homo sapiens
aggggagctacaacaaaaattgttcggagattgacatatgagagccaagaggtaactgaagggaaccaggtgctccttgggaggtggttggtagtggagtrgttgacggttttcaatgggctatggaagggtggcagagccaacagtcccagagaaactctccccagggaatccaggtatctcacggacattttcaacact

SEQ ID NO: 38783 - DNA, 201 bp, Homo sapiens
taaaaagcagcctactgacagcatccaccctggtggttaccatttcctggggaaggcaggatataaccaatatattaggggagctacaacaaaaattgttyggagattgacatatgagagccaagaggtaactgaagggaaccaggtgctccttgggaggtggttggtagtggagtggttgacggttttcaatgggctatg

SEQ ID NO: 38784 - DNA, 201 bp, Homo sapiens
gtgttaatgttatgtctcgaggtatttcctgcacatgggccaggcccatttgtcatttgaaggggctcccttgccagtggcctactttctgcttgtgagcytgttattcctgctggtcttgtgcagagcagccccggaacacagcggcattcttgacagagggcagttggcagctaccagtgcctgtctactttcggatgc

SEQ ID NO: 38785 - DNA, 201 bp, Homo sapiens
gtgtccattgtacatgcagaaaggagccccagaatctaagaaagagggagaactgtgggaacttagatgtcaactcctctcttttctgtcagcagattatrgcagagtgacagcatgtaagtggcattatacttatacgtttctctcgtatgttctaatttctaaaggagagaaaaatagatgaggcattcccagacttag

SEQ ID NO: 38786 - DNA, 201 bp, Homo sapiens
aataacctaagaaaataccaagccctgttttcaattaaaaggaatatttaaagtttactccctgccatgtttgactattagatgtttggagaacaatgagrtacccattttggtggggaggcgtgagttttaaggaaggaagtcgtgggaaaggaaggcaggcaggggaggccatttgaggatggactcttagtgcctggc

SEQ ID NO: 38787 - DNA, 201 bp, Homo sapiens
ccaagtgaagttgtttgtgcagtggaagaccaagaggacaggactgcagacacagcaggtcagctgagcctcccagccagtcaactggggcccggccattstttgggcagactgtcttaacaactgactttgggccaacccctgtttggggagtacaactcatagtctaggatacggcgtgatcacagggagtggtagaag

SEQ ID NO: 38788 - DNA, 201 bp, Homo sapiens
ctgaagaatgtggaagaagtggtaggaatgtgtaattcaggcacaccctacagactttctcagatttgccctctgaaggtttgctaaataatacatttaartgataattgactaaatatggtagctgcctatttgttagagctgttggcagcccaagcaatattttcaagtcttttcaaggtaagcttagaggtgagagcc

SEQ ID NO: 38789 - DNA, 201 bp, Homo sapiens
tcattgctaagtggaaggcctgacagttcctggggccagcctcctggggactggagtggtctggagaaggctttctgaggagctcaccttcctttccaagygaagttgtttgtgcagtggaagaccaagaggacaggactgcagacacagcaggtcagctgagcctcccagccagtcaactggggcccggccattctttgg

SEQ ID NO: 38790 - DNA, 201 bp, Homo sapiens
acatcactaatcatcagggaaatgaaaatcaaaaccacaatgagctgtcacctcacacctgttaggatggctgttctcaaaaagacaaaagataacaagtrttgggaaggatgtggagaaaagggaaccatcagacactattggtgggaatataaattggtatagctattttggaataaccaaaatatggaggttcctcaa

SEQ ID NO: 38791 - DNA, 201 bp, Homo sapiens
tcctttaagagacatcattaaggtttgtttaaccaaaccttaatggttaaagaacagtgtcttggagttgctggatccatgagtaggtccaatttgaaggstttgatccttttttgccaaattgatgtccagaaggattgtgccagcgtccactcccaccagctctttggtggaatcccgtttcccttttattctcctggc

SEQ ID NO: 38792 - DNA, 201 bp, Homo sapiens
cctgggaagcaattataagctttcagcctcaaccatgcagactaactggctctacttccttcactattgcagtttctagttctgttcgtaattgttgcacragactttgtgctattgcaactacttggaatgccagttccaggcagagtgccctctgttgtagacaccttgtgctttgggaagttgtctgtgattagggga

SEQ ID NO: 38793 - DNA, 201 bp, Homo sapiens
attggaacattctgaatttgggatttttggatttgggatgcacaaccattgtaatgcaaacattccaaaatccggaacaatctaaaatctgaaacatttctggtaccaaacatttcggataagggatactcaatctgtaatacaaggggattgcataaaggcatgattatcaggaggcaaggaacatggggatcatgttag

SEQ ID NO: 38794 - DNA, 201 bp, Homo sapiens
accattagatctcatgagacccattcactatcatgagaacagcacagaaaagacccacccccatgattcaatcatctcccaccgggtccctcccacaacayttgggaattatgggagctacaagatgagatttgagtggggacacagagccaaaccacatcagtcccattgggtacagtatgggaaagaaattggaagatg

SEQ ID NO: 38795 - DNA, 201 bp, Homo sapiens
accaaaaatagaaagagaaagtgttggagtaaattgattggttgattcattcacacagtctttcataattagttatttaccgtattccttgtgctatgctrgtcaccagacttaattacaaggataaataagagatgcccgtaagaagcacacagttagtggggagaaaggctcacaaacagatggttgagactcgaggag

SEQ ID NO: 38796 - DNA, 201 bp, Homo sapiens
aaaacaaattaagagcccaaaataagctataaaaagtagtcgtcttttggctgactggttttcaacataatagatgtgttttgtgaattgtgttaatgttrtgtctcgaggtatttcctgcacatgggccaggcccatttgtcatttgaaggggctcccttgccagtggcctactttctgcttgtgagcctgttattcctg

SEQ ID NO: 38797 - DNA, 201 bp, Homo sapiens
ggtgtggctcggccaagggtctggatgtggaggcaccgagtccagaataccagcgccaaaagggattctccagtggcttgtgttcccagcccctgttcccrattctcaggtctgatgaatctgcaagccctacctacgtgagaagattcatctaacctattttctgcttgatactatttcgaattcttttctgattcttcc

SEQ ID NO: 38798 - DNA, 201 bp, Homo sapiens
taaactttttaaggaaagtccaactttttatatccctaaagccttgctctcactgaagccttgattgaggccaagagagaatgccttgctgctgcccccaygagccactgcccatctaaggaattcccacagatgcccacatttacccacatgctttaaaagctcttgtttattgagtctttgctgttcacctggctgcat

SEQ ID NO: 38799 - DNA, 201 bp, Homo sapiens
cctttgggagtcacttgggatctatttcctcttaattttcttcaagtttaaacaaatttgatcatccaaaggagccatacatagcccaatgatgagaaacrtgagctttggctttaaaactggtgttgaagcctgcctttccaatttattgtgagtcctggagcaactcgtgtaacttctttaatcctcagtttccttatc

SEQ ID NO: 38800 - DNA, 201 bp, Homo sapiens
attacatctgcaaagaccctatttccaaataaggtcacatccccaggttcctgggttaagacttcaatgtatctttttttttttttttttttggagggggygggagtagtgcaccattcaaccatgacatctatactctgtccaccaaatgcaggtgggttttgtacagacaccaaagcacatatactttgcacttgggca

SEQ ID NO: 38801 - DNA, 201 bp, Homo sapiens
ttcatgtttgcagtggtacttgggaagagcaaatgtgggaatggatcaaaagtaccatgggatgtagaaagcactctgtagctcagtaacaatcatcggtwttgatttcacactatctgcaggttcctgtagtctaaaaagcagcctactgacagcatccaccctggtggttaccatttcctggggaaggcaggatataac

SEQ ID NO: 38802 - DNA, 201 bp, Homo sapiens
cctgtctttaaaggttctagtgctaatgtatcatacaggagtgataacttaaagaaatacagcattaacactttgcaaatttcttttaatttttagtttcwtatgaaaagtccttcatgtttgcacattttgcattgattcattcctcaaatatttattgaactttgattttatcctggatactgagttagactctgggac

SEQ ID NO: 38803 - DNA, 201 bp, Homo sapiens
tttttaagcacttagcagtttcctagggctgctatctgctgtaacaaactgtgtggcttaaaacaatggatatttattctcttgcacttctggcagcttaraagtctgaaatcgaggtgacagcaggaccatgctccctctgaaggctctaggggagactctttccttgcctcttcctagcttctggtggtggctagcaat

SEQ ID NO: 38804 - DNA, 201 bp, Homo sapiens
ttcttcatgtttgcagtggtacttgggaagagcaaatgtgggaatggatcaaaagtaccatgggatgtagaaagcactctgtagctcagtaacaatcatcrgttttgatttcacactatctgcaggttcctgtagtctaaaaagcagcctactgacagcatccaccctggtggttaccatttcctggggaaggcaggatat

SEQ ID NO: 38805 - DNA, 201 bp, Homo sapiens
cgatgggaaaccaggttgatgatgaacttggtatcacttagagatatgtaagttatgatctggtcaggtctagaggctagcaatattttttccctgtcctrtctttaaaggttctagtgctaatgtatcatacaggagtgataacttaaagaaatacagcattaacactttgcaaatttcttttaatttttagtttcatat

SEQ ID NO: 38806 - DNA, 201 bp, Homo sapiens
tccattaatgcttgttattattgctgctggatggaggcaagaatgaatgaatgggcaggatcatgataactctggacctcagcttcttcatgtttgcagtkgtacttgggaagagcaaatgtgggaatggatcaaaagtaccatgggatgtagaaagcactctgtagctcagtaacaatcatcggttttgatttcacacta

SEQ ID NO: 38807 - DNA, 201 bp, Homo sapiens
aattacttatggttatttgattaatgtctgttggctgtatatgccatgaggacagagatcttatgtgtcttatcctgcattgtgtccctcgagcctcccgyagagcccagcatagaacaggtgctcagtaaacgcttgttgaatgagttcatgaacactattcacttggcaccttccatttagacagattcctgctattgg

SEQ ID NO: 38808 - DNA, 201 bp, Homo sapiens
tcagttcatagtagtgggttggaagtgaagactttgagattttgcttcaaatttcagtttcataattaattgtacaatatcatgtatactgcttaacttayctaaaactgttttctcaccagtaaagtgggattaattccaatatatgctatatcagagaattttatgaggatagaatgaaataatgtacatacaaaggtt

SEQ ID NO: 38809 - DNA, 201 bp, Homo sapiens
tgtgtggccttgtcgtgtcatctacgccagtgtctgccatagtacctttccattaatgcttgttattattgctgctggatggaggcaagaatgaatgaatkggcaggatcatgataactctggacctcagcttcttcatgtttgcagtggtacttgggaagagcaaatgtgggaatggatcaaaagtaccatgggatgtag

SEQ ID NO: 38810 - DNA, 201 bp, Homo sapiens
gcaacttccatgctagtcactggttaaccaagaactctttcaaaaagtgttagaggctgcaagtgagaaagcacccaggagaggcgggcaggagggtactkgcaatagatgggagttatgtgtcatggtcactttgaagaaaatgtttaatttaaatgataaaacacattttatctcccactgctacaaaattaattggga

SEQ ID NO: 38811 - DNA, 201 bp, Homo sapiens
aatactttcccccaccatggccgctaatgtgctgtgtggccttgtcgtgtcatctacgccagtgtctgccatagtacctttccattaatgcttgttattaytgctgctggatggaggcaagaatgaatgaatgggcaggatcatgataactctggacctcagcttcttcatgtttgcagtggtacttgggaagagcaaatg

SEQ ID NO: 38812 - DNA, 201 bp, Homo sapiens
tagagataataactcctgtaagactatagtatgaggcggctctgctaaacctctgcatcgtgaaaaaccgtgttggctggattaagcaaatgagaaggaayattgtaccagaacgcattgatcttgataatctaacaattcgtgcagcccactggtttccaggaaggtgggcatcaggacattgatgtttttgctctgcaa

SEQ ID NO: 38813 - DNA, 201 bp, Homo sapiens
caagttgcccaggctgatctcgaactcatgggctcaagcgatctgcctgcctcggccttgcctcccaaagtgctgggattacaagtgtgagccatcgtgcygggcagagtatttttatttttaagtgaataaaacaaaatacaaaccattacaaaggaagcaaaattatattgaagtataatcaaaatattaaaaaaccag

SEQ ID NO: 38814 - DNA, 201 bp, Homo sapiens
cctacatttataataaaaggaggtgctaaatttcagttagatgttagtgaaaataaagattgttttgtttattttgtcattcatattcatggatcccattraattctacccaaggacctcttgaggtaggggaaggggatgtaagcatcccaagttaagaaccccacactaaacaatgatccttttttagcatcaggtgat

SEQ ID NO: 38815 - DNA, 201 bp, Homo sapiens
atcatgaggataatcacaagctctttctctctctctctcttcaaaaaaagaaaatttttgtgtaatatttctgagataaacatttaaacagccaggctgcrtagccatagatcgctgttgtgaacgagtgcagctgggcttatttaactgaactcctgatcttcttatttatagaggagttaatttttagcaaccacgccc

SEQ ID NO: 38816 - DNA, 201 bp, Homo sapiens
acccttaaagtttttacctagaactatttgccaagggaagtctctcatgttatgtttgtggaattgatttctttgaaccaaagtattagactttagactaytgttaaagtttgttctcatttattaacacattcaacaaatacctagtaccaatcatggttttagcttctccttggtatatttcatgtccaaagagagaat

SEQ ID NO: 38817 - DNA, 201 bp, Homo sapiens
gggaataactgttaaggatccctcattctgacccgaggtcagaactaaattattagaagcccctcttgaacaggaataggagtcattgaaatgaaacccayacatttaatttcagacatccatacttgctaacaatggcacgatgattaggttctgattatgatagaatgactggtatttcctgagctgggtgagttctag

SEQ ID NO: 38818 - DNA, 201 bp, Homo sapiens
atgggaaagaaattggaagatgcacaagtggatgtggaggcactcactgctccaggtaagagacaggacattgacttagcaagacttaacagcaggagagwggagagaaaagggggccatggagagagatttagcggggaaaagtcattgaggcctgctcatggactgggcatggggaaaatgcagaggaagatgtcagga

SEQ ID NO: 38819 - DNA, 201 bp, Homo sapiens
atctcccaccgggtccctcccacaacacttgggaattatgggagctacaagatgagatttgagtggggacacagagccaaaccacatcagtcccattgggwacagtatgggaaagaaattggaagatgcacaagtggatgtggaggcactcactgctccaggtaagagacaggacattgacttagcaagacttaacagcag

SEQ ID NO: 38820 - DNA, 201 bp, Homo sapiens
ggaacacttttgtatgccaggcactgtgcacagtggttgggggtacaggatgagtaagacaaagtccttgtgcttagggtgctcatgctggtggaggagayaggcactccatgggtagttacaacagggtgcgaattctattacagtcagtccttgacttaccatggaatgatgaattacagttgtccaactttacagtgg

SEQ ID NO: 38821 - DNA, 201 bp, Homo sapiens
cattgcggaacacttttgtatgccaggcactgtgcacagtggttgggggtacaggatgagtaagacaaagtccttgtgcttagggtgctcatgctggtggrggagacaggcactccatgggtagttacaacagggtgcgaattctattacagtcagtccttgacttaccatggaatgatgaattacagttgtccaacttta

SEQ ID NO: 38822 - DNA, 201 bp, Homo sapiens
taaagagaagattctgatgattctatgattattatgattattccaaatactgaggccattggaaggcagagggaggggataagaagatgggcctagggagrgtctttgtgcctcttaccaccctcactttttggctgtcctatcctgcctctgtccacacattatcccttggactttttctgtcaggcagaggttcacagt

SEQ ID NO: 38823 - DNA, 201 bp, Homo sapiens
atgaagcaaaagggaaatcagtgtagaaaactcagatggaatcagggataagactggcacctgtcatgaaagcccagcttcctctctgggctgggccacayagttcactctaaccgctttgtggtcaaatccatgagaaaatcacttaccccacagtttgccatagacagctcctccatatgtagaagtggtattcgaaag

SEQ ID NO: 38824 - DNA, 201 bp, Homo sapiens
ttgaaacccaaatgctaagccagtgcccacctcgactgtgtgaaattgtcccctgacttcagaggccagaaaatggatctgggatggtataactgggtggrgacagggaaaggccttttgatttagcaataaaactattaggttataccacctccatggggactttgaaaaatgcattctgtggaacaagatgaagtgctt

SEQ ID NO: 38825 - DNA, 201 bp, Homo sapiens; identical to SEQ ID NO: 8628

SEQ ID NO: 38826 - DNA, 201 bp, Homo sapiens
aacgtttaaacctgctttggtgaggcatttaggagctgtacaaaatgggaaggtttgttaaaatataaaccgacaaaatggccaaatacccggccctgacygaggaagagagtcctgtcagctctaaaccatagaacttgaaacccaaatgctaagccagtgcccacctcgactgtgtgaaattgtcccctgacttcagag

SEQ ID NO: 38827 - DNA, 201 bp, Homo sapiens; identical to SEQ ID NO: 8629

SEQ ID NO: 38828 - DNA, 201 bp, Homo sapiens
ctggcataactgtttaaagggagttactgtattttatactgttcaagcacattgacctgtagagaggagcttaagagacagttcttgctgaggcagagtcyggcattctgctttctgcagcctaccgcagtggcctggggatacagttctcttccattctggtaaacgtttaaacctgctttggtgaggcatttaggagct

SEQ ID NO: 38829 - DNA, 201 bp, Homo sapiens; identical to SEQ ID NO: 8631

SEQ ID NO: 38830 - DNA, 201 bp, Homo sapiens
tgtaacttgattacatctgcaaagaccctatttccaaataaggtcacatccccaggttcctgggttaagacttcaatgtatctttttttttttttttttttggagggggcgggagtagtgcaccattcaaccatgacatctatactctgtccaccaaatgcaggtgggttttgtacagacaccaaagcacatatactttgc

SEQ ID NO: 38831 - DNA, 201 bp, Homo sapiens
ttcgtgagggtaagcaatcagatttctttttttataaacatatttgaacttatatatccaaattagtatcgtaccctgccaaatcgccactctgggaaccrtgcacgcactccagtgatgcgtgtagtgctcaaagcatttgaaactcctctatgggaattatctttcagccagtcagtttatgggtcacctaggaaaacc

SEQ ID NO: 38832 - DNA, 201 bp, Homo sapiens
agtcattgaggcctgctcatggactgggcatggggaaaatgcagaggaagatgtcaggagcaactcctagttgttcactttacatgaaagactgtagtgtygatccactgaaatagaaactgctggaactaggtattgggggaaataacatgtgtttgtttttggatttgtggagtttgaggagccttggagacctggaag

SEQ ID NO: 38833 - DNA, 201 bp, Homo sapiens
acatttctccagaatagcttcttcattttcgtgagggtaagcaatcagatttctttttttataaacatatttgaacttatatatccaaattagtatcgtamcctgccaaatcgccactctgggaaccatgcacgcactccagtgatgcgtgtagtgctcaaagcatttgaaactcctctatgggaattatctttcagccag

SEQ ID NO: 38834 - DNA, 201 bp, Homo sapiens
ctccaggtaagagacaggacattgacttagcaagacttaacagcaggagagtggagagaaaagggggccatggagagagatttagcggggaaaagtcattkaggcctgctcatggactgggcatggggaaaatgcagaggaagatgtcaggagcaactcctagttgttcactttacatgaaagactgtagtgttgatccac

SEQ ID NO: 38835 - DNA, 201 bp, Homo sapiens
gccaaggcaggcagatcacctgaggtcgggagttcaagaccagcctgaccaacatggagaaaccccatctctactaaaaatacaaaattagccgggcgtgrtggcgcatgcctgtaatcccagtcactagagaggctgaggcaggagaattgcttgaacctgggagccagagattgtggtgagccaagatcgcagcattgc

SEQ ID NO: 38836 - DNA, 201 bp, Homo sapiens
aatggacctcaaacacatgacccagaggttaagggtctcatgttctcagagcaaactagtgggactttgcaaacttcgccttatagtggaggaactccackgtctcccgcttgaagtgaaccacccttttctgaactttcatgagatccatctgcaaacactgctgaaggaacatgtttctggctatagcagttcacattt

SEQ ID NO: 38837 - DNA, 201 bp, Homo sapiens
agtgactctatgaactttgaaacatttgaattctatagcttaattgagcacagagtgctttatttctgtatttttccaggcgataggagagacaatttctyaaaaacgtttccttgacctttcagagtgggccaaatcccctgattattggctcttgtggcaccatgtacctcttctttgttgtacttgttgcagctgtga

SEQ ID NO: 38838 - DNA, 201 bp, Homo sapiens
ctgcacctaaaaccaattatgtcttgaagagcggatagtgtgcgatagaagatggggctacccttcaggaaggggacctgccgagagaagtgagaaagagrgaataggcaggactcttttttagagccggacacttagtcactaaacaatctttgttacataaaatacttaaatcagcttgcttgggactttttctttctt

SEQ ID NO: 38839 - DNA, 201 bp, Homo sapiens
tgctcatgaaattttgtagaagaaaaagaaaaacgttctccctttctgagatagagggtttgttttgtttttgtaaacaagataacagggaagagtgctcyactgttttggaaagagtgactcattcaataaatatttattgagcacctattaggttctcggtactacggatacaacagtgaattgaacaaagtttctgct

SEQ ID NO: 38840 - DNA, 201 bp, Homo sapiens
tagaagcttttctagggcaaggattatgttcttttggtatagttttgcatattgacaaacaccatgcctggcatgtgtcgttgcttaaaatgttgctctcrtaattctgccctcagaaagaacttcaccgagagactgggaggctgccagcagagactatgctggagtgtggtgtattatgtgggcagagaggctttggta

SEQ ID NO: 38841 - DNA, 201 bp, Homo sapiens
aaatagggttatcaggctcatcccttatgcccactcctgggacattagctaagaaagaattcttggtgtgaagaggtgaacccattcaggccagccctcayatggggcctgggacaccattattaactgtccattaaatattttttaaagaaacatagaaaagaaagagtgaataaaggattggtaagtctacggtttctg

SEQ ID NO: 38842 - DNA, 201 bp, Homo sapiens
aaaacatcattcttctcttctttatagattgattatagatgcagtctgtatccaaaatgtggatttaaatagcttaaacagcagccctgaacattttactrcggatgcttcttctaaaatattaaactccatgatctgaattaattctttcttcttccgccttctctgaatccacatataatagcccattgtgcacaaggt

SEQ ID NO: 38843 - DNA, 201 bp, Homo sapiens
aaagggtcccaatatactatgacattttgcatatagattataagtattattctattataaatttatcttgggataataagatgtgtaatcaacattgatcraatatttaacaataatttttttctctcttggactctagggtagggaaaacttttcatctaccctcctaggttatatactgggggcttgcaaattaaatgt

SEQ ID NO: 38844 - DNA, 201 bp, Homo sapiens
cggacacttagtcactaaacaatctttgttacataaaatacttaaatcagcttgcttgggactttttctttcttggcttcactaatgctcttggtgaaacmtctttttcctttttcttttttaatcaaatctaatgctcatgaaattttgtagaagaaaaagaaaaacgttctccctttctgagatagagggtttgttttg

SEQ ID NO: 38845 - DNA, 201 bp, Homo sapiens
ggccctgtcccatgtatcagtctccggccaggttataaggtagttaagtgactgcatctcttctccttttattccctctacccaatatttttaagtaaatrtgctgatcttggtcctatagtactctactgtcaccctttagtgaagaaaagaagatcaaaatcaagcattctctcagctttgcaattgagttgcaattca

SEQ ID NO: 38846 - DNA, 201 bp, Homo sapiens
ctgaacccttttagtgatgcaattcggggattcctgtgacactgcaaaccacagaaagtcttctgctggtgaactaaaaccttccatccttgaaacttctycccttgggtcctagctggcctctggactcccatagaatggatctacttccttactcagacaaaagcgattctgtcattttaaaccattcaacagatgtgt

SEQ ID NO: 38847 - DNA, 201 bp, Homo sapiens
atgtgtaatcaacattgatcaaatatttaacaataatttttttctctcttggactctagggtagggaaaacttttcatctaccctcctaggttatatactrggggcttgcaaattaaatgtaaaagacaaatgagcaacaaaaagacatttgtgggagtttacagaaaaatgtgacaggaggcagttagacttgggggcct

SEQ ID NO: 38848 - DNA, 201 bp, Homo sapiens
ttttttaaagctatttatccagttatccaaacgccatttaaaaagtaatctactcttttcccacagccttgcagtgagacctttgtcatactcaagcctcwtgtgtgcttggatctctttccagatgcactcttgttctattaagctaccagactatttgaattattgaaattttgtaatggtcatgttcttctgctgttt

SEQ ID NO: 38849 - DNA, 201 bp, Homo sapiens
tttctgggagggttttggagtcagaaaagggacacagaattatgatttagaaagataaactagatgggtttgagtaggtcagatggatccagccagggtcragtaagagagaatcatgtgggacagaggcaggggagattgagttaggagctgttgcagtggtccaggcatctttaagggaaggagggtaatagagcagtg

SEQ ID NO: 38850 - DNA, 201 bp, Homo sapiens
ctgagagtttgtaaaaggaccccaaacagaagaattttgggaaataccaatctataccatgctgggttgataggaccatctatattatacaagaatcttckcagatttaagtttcttctttttaaactgccattaagggcatgcagggaaggtgaaattttgttttaatatccatgtataccatatggcttattttggcaa

SEQ ID NO: 38851 - DNA, 201 bp, Homo sapiens; identical to SEQ ID NO: 8634

SEQ ID NO: 38852 - DNA, 201 bp, Homo sapiens; identical to SEQ ID NO: 8640

SEQ ID NO: 38853 - DNA, 201 bp, Homo sapiens
actttacatgaaagactgtagtgttgatccactgaaatagaaactgctggaactaggtattgggggaaataacatgtgtttgtttttggatttgtggagtktgaggagccttggagacctggaagtaggcagtcagacgtacgggtttggagctaagcatctgtgtttagaggaagtgatggaaaagcttctctctatgtc

SEQ ID NO: 38854 - DNA, 201 bp, Homo sapiens
catggctcactggagcctcgaattctcaggctcaagtgatcctcccacctgagcctcagcctgggactacaggcatgcaccactacacctggctaattttytgtatttttgtaaagatgaggttttgccatgttgcccaagctggtctccagcttctgagctcaagcaatccacccaccttggcttctcaaagtgtcagaa

SEQ ID NO: 38855 - DNA, 201 bp, Homo sapiens
ttggagaacaacatgtaacacaacaggtatgtctttaaatagcagaagtgcactcaagatacccatactttgagaagcacgtggggactaagactgagcargggcctgtggtcactgggtgaaatggtggcagaattgcccatgctgtttaaatttcactcttgtcttctttgtctccctggaagttctatatacaacagt

SEQ ID NO: 38856 - DNA, 201 bp, Homo sapiens
gacatagccagttattctgctgactttgaagctgtgctcacagttgggatccacctttgaaaaatggctcctgagtgtgttaagtaagtaatggctagccragggcttcagttgggaggactgcggagaagacttttctcccctggggtcctcaaaggggaaagaaatcacaagggggcagcatagggagttgtttggaaa

SEQ ID NO: 38857 - DNA, 201 bp, Homo sapiens
ttttaaatgactggctcaaaataatttttatgtcacagtggtgtagtctggacccctttagactttagaagagctttcagcagattgatttgagtgagctrcacttctaagaaagtgaagcaggaaagtttgaactgatccctttattctcctccaagttcccttgaggcccacacagacatagccagttattctgctgac

SEQ ID NO: 38858 - DNA, 201 bp, Homo sapiens
gaaaaataaaacccagtaaaggggacagcattagaggatgggctgctctttttagtgcagcaattgggatgtctgataaacctcatgagagcagagacctraatgaagtgaaggagtgagccatgcagatatccgtgaaaagacttccagacagaggaagagttagatggaaaggataaacacatataatcatttaatgtt

SEQ ID NO: 38859 - DNA, 201 bp, Homo sapiens
cagtagaaaatgtactactcctggctctgctattgagtcatttagtcaaatcacttcatctctttgggtatcagttttctcatctgtaaaatgggcagttmaaccagattagtagttttttttttttttttaatattgaaagcatttattaagcaacagaattctctcttttttttttttttctttaagcgagaagtagat

SEQ ID NO: 38860 - DNA, 201 bp, Homo sapiens
ccaagccctaaggggaaatgtggtagtttcagcaggtggagttgattctccttttccaggtataatggatcagtggagatttagataagaaaaagtagcaktcagcagtagaaaatgtactactcctggctctgctattgagtcatttagtcaaatcacttcatctctttgggtatcagttttctcatctgtaaaatgggc

SEQ ID NO: 38861 - DNA, 201 bp, Homo sapiens
ctaggccatcagcactttgtggggactgcccaagccctaaggggaaatgtggtagtttcagcaggtggagttgattctccttttccaggtataatggatcrgtggagatttagataagaaaaagtagcattcagcagtagaaaatgtactactcctggctctgctattgagtcatttagtcaaatcacttcatctctttgg

SEQ ID NO: 38862 - DNA, 201 bp, Homo sapiens
agttcacatttcttgaaaaggaaataaaagaacactgagcaggaaggggaaggttttgagactcttgggtagttggagttaggtggagacaccttgctacyttaactttaaaccttatatccctggggcagggatgacttggcagagaaacaccttcaagtcacttttttttttgagacactgtcttgctctgttgcccta

SEQ ID NO: 38863 - DNA, 201 bp, Homo sapiens
attataaccatttttaagtatatagtttagtaatgttgtacatattcatattgttgtccaacgtatctctaaaacttttttcccccaaaactaaaactctrtacccattgaacagcacctccctgcttctcccttttcacaatccctggtaccacctttctccttcctgtgtctgtgaatttgaccattgtaggtacctca

SEQ ID NO: 38864 - DNA, 201 bp, Homo sapiens
tttcagaataagcagcactcttagtttttttagtctaactttaagtgtaacataatgctattataaccatttttaagtatatagtttagtaatgttgtacrtattcatattgttgtccaacgtatctctaaaacttttttcccccaaaactaaaactctgtacccattgaacagcacctccctgcttctcccttttcacaa

SEQ ID NO: 38865 - DNA, 201 bp, Homo sapiens
gggtttaaggagataataaatgtaaaatgtttaaacactgtggctggcatataggattaacttttcagaataagcagcactcttagtttttttagtctaaytttaagtgtaacataatgctattataaccatttttaagtatatagtttagtaatgttgtacatattcatattgttgtccaacgtatctctaaaacttttt

SEQ ID NO: 38866 - DNA, 201 bp, Homo sapiens
aggcaaatactgcatgatttcacttgtatgtgggatctaaaaaaagtgaatctcatagaaacagagcagaaaggggcttactagggggtagtgaatggggraaatggagagatattggtccaaagggtacaaaatttcagttatgtaggatgtagcagttctagagatggaatgtacaacatgatggctataatgaataac

SEQ ID NO: 38867 - DNA, 201 bp, Homo sapiens
tggatttgtggagtttgaggagccttggagacctggaagtaggcagtcagacgtacgggtttggagctaagcatctgtgtttagaggaagtgatggaaaakcttctctctatgtcttcctcaggtcatgttggccccccttatttccattgctctgaaagtgtcccagctgcaggagaggacgggacgcactgcacccact

SEQ ID NO: 38868 - DNA, 201 bp, Homo sapiens
tgtgacaaatgctgtatgacaaatttcacttagcataatgtcctcaaggttcatccatcttgtggcatatggcaggacccccccccccccacacacacacrcacttttaaggctgaataatattccactgtatgtatacacaatattttgtttatccattcacttgatgatagacgttagcgttctttccaccctttgact

SEQ ID NO: 38869 - DNA, 201 bp, Homo sapiens
aagttggggaagtgttgtggtatattagccccttcttggtgattcacagcatacaatgcaatgcaccataaaggctccaagatttcggacatggtggcctrcacctgtggtcccagctactcaggaagctgaggcaggaagatcacttgagcgtaggagttctgggctatagtgtgctatgcctgtcgggtgtctgcacta

SEQ ID NO: 38870 - DNA, 201 bp, Homo sapiens
tctctgttgctcaagagtgaattgaaatggctactacattgtgtgagtccagagggcttaatctgcatggtgtcatagccatttgggggctaaaccgacargtgtgaggattgtaaactggcagggagctcaaaatgagctgattggtgaaacttcatggtgatctcgtaggttgcagcagagaacaatacaggcccagtc

SEQ ID NO: 38871 - DNA, 201 bp, Homo sapiens
acattgttgtgcagcatatctctagaaagttttcatcttgccaaactgaaagtctatgtccattgaacaactccccatctttccctcttctgagcccctgmcaaccaccattgtattttgtgtttctatggtgttgacttctttaaatacctcatgtaagtggaatcatacagcatttgtcttttgtgacaaatgctgtat

SEQ ID NO: 38872 - DNA, 201 bp, Homo sapiens
agaccagatggcttcccaggatcaatgggggcaagccattaactatcatctagttaatagaggaaattgcattttacagtgggatgggttctagagttcgrgtggaagatgaaacttcagtcaaaatcatccttaaagtcccataggaaagtaccacattggagaacaacatgtaacacaacaggtatgtctttaaatagc

SEQ ID NO: 38873 - DNA, 201 bp, Homo sapiens
cagtttcagaatctgaatgcctctcatgtaaaagttgctgataaagcactcaaatatgaaattattatgaagcatacacatttttaagataaaatgtgacrtgccataaattttttctttgaggagagctgcaaagggaacagtattaagatgcttttaatcttttgagagggaacgaatggaacattatttctccacata

SEQ ID NO: 38874 - DNA, 201 bp, Homo sapiens
ggctctgctaaacctctgcatcgtgaaaaaccgtgttggctggattaagcaaatgagaaggaatattgtaccagaacgcattgatcttgataatctaacarttcgtgcagcccactggtttccaggaaggtgggcatcaggacattgatgtttttgctctgcaaattcctcagtgggaccagaaatacatttttagtgttt

SEQ ID NO: 38875 - DNA, 201 bp, Homo sapiens
ggtgaaatggtggcagaattgcccatgctgtttaaatttcactcttgtcttctttgtctccctggaagttctatatacaacagttacatttgtgcaagatraatacttgtatgatgtgactacactgcacattcttgatgctactcagagtgcacatatgagaatcatctcaatcatgattcatcacctgcaacttggagc

SEQ ID NO: 38876 - DNA, 201 bp, Homo sapiens
ttttttcttttaacacctaattaaaatcctgtgaaactcatttggaaacccctggcatagtggttttgagcaaagttaaagagatcttgttttaaattctwttcctgccacttaataactgtgtgtccctgggtaagttgttacaattttatgaatcttggtttccttgtctgtcaaatggcagagtaatacctacttcat

SEQ ID NO: 38877 - DNA, 201 bp, Homo sapiens
cctgtccccactacataactatgtataactatatatatagggagggagttacataactctgtgtgtgtgtgtgtgtgtgtgtgtgtgtgtgtgtgtgtgtktaaagagaggggatatagttgtatatttacatatgtagaccagtcactagccataggagtgttcacattgtcgcattgtcctggctgggaatgcacactc

SEQ ID NO: 38878 - DNA, 201 bp, Homo sapiens; identical to SEQ ID NO: 8635

SEQ ID NO: 38879 - DNA, 201 bp, Homo sapiens; identical to SEQ ID NO: 8639

SEQ ID NO: 38880 - DNA, 201 bp, Homo sapiens; identical to SEQ ID NO: 8636

SEQ ID NO: 38881 - DNA, 201 bp, Homo sapiens
gactgagcggcactgggagtgccggggccaccattcggctgtacatcgatagctatgagaaggacgttgccaagattaaccaggacccccaggtaacgccyagccctgtgccctggttagttctttctgttcaagggaatgatagtttcccattgagcctgtgtttcaatgcccatttctcaaatgactcaacaaggtacc

SEQ ID NO: 38882 - DNA, 201 bp, Homo sapiens
cataatttgccagccttcagtctcccagcatttggggaaaaaaatctctgcttatcttttccagggcttgcgcctcattttcacagatggttctcgaatcrtcttccgactgagcggcactgggagtgccggggccaccattcggctgtacatcgatagctatgagaaggacgttgccaagattaaccaggacccccaggt

SEQ ID NO: 38883 - DNA, 201 bp, Homo sapiens
ttttagtagtttggataacatttattgagtgtctactatatggccaggcattgtgagaagcatttcacacatacctttcctcatttactttcagaaccttytaaaggaggcttcactctctgcattttatggaaactctggcttacaaggaccccatcgaaaaggatgttccctctttgtggccaccttctttcatgtcct

SEQ ID NO: 38884 - DNA, 201 bp, Homo sapiens
atctgtaaaatgggcagttcaaccagattagtagttttttttttttttttaatattgaaagcatttattaagcaacagaattctctcttttttttttttttctttaagcgagaagtagatgtggggaggggttgttgcatttttaaagattcctgtattaggccgggtgcggtggctcacgcctgtaatcccaacactttg

SEQ ID NO: 38885 - DNA, 201 bp, Homo sapiens
tcataatttgccagccttcagtctcccagcatttggggaaaaaaatctctgcttatcttttccagggcttgcgcctcattttcacagatggttctcgaatygtcttccgactgagcggcactgggagtgccggggccaccattcggctgtacatcgatagctatgagaaggacgttgccaagattaaccaggacccccagg

SEQ ID NO: 38886 - DNA, 201 bp, Homo sapiens
catctgtaaaatgggcagttcaaccagattagtagttttttttttttttttaatattgaaagcatttattaagcaacagaattctctcttttttttttttttctttaagcgagaagtagatgtggggaggggttgttgcatttttaaagattcctgtattaggccgggtgcggtggctcacgcctgtaatcccaacacttt

SEQ ID NO: 38887 - DNA, 201 bp, Homo sapiens
gtcaaatcacttcatctctttgggtatcagttttctcatctgtaaaatgggcagttcaaccagattagtagttttttttttttttttaatattgaaagcayttattaagcaacagaattctctcttttttttttttttctttaagcgagaagtagatgtggggaggggttgttgcatttttaaagattcctgtattaggcc

SEQ ID NO: 38888 - DNA, 201 bp, Homo sapiens
tattgagtcatttagtcaaatcacttcatctctttgggtatcagttttctcatctgtaaaatgggcagttcaaccagattagtagttttttttttttttttaatattgaaagcatttattaagcaacagaattctctcttttttttttttttctttaagcgagaagtagatgtggggaggggttgttgcatttttaaagat

SEQ ID NO: 38889 - DNA, 201 bp, Homo sapiens
aggagcttacagcagagtgggaattttaggtgcccagatggaaatttgtccatttgggagtagtgtggggtgggaaggaaagaattagttaagactaaaaraaaaagttcttaaaacttcatcaccctttagccattgccctattgctcttctctcagccaacctttgtaaaagctttctgcattcactatttctcattct

SEQ ID NO: 38890 - DNA, 201 bp, Homo sapiens
aatattattcacaatagtcaagatatggaaccagcctaagtgcccatctacagatgaatgaagacattgtggtgtgtgtgtgtgtgtgtgtgtgtgtgtgtgtgtgtataccacaatggaaaattattctgccttaaaacaacaaaaaccaaaatcttgccaatcttgccatttgcaataacatggatgaacctggaggac

SEQ ID NO: 38891 - DNA, 201 bp, Homo sapiens
tcattcattcattcatttattcagtcagtcattcaacagatcctgttgaataccatgttcagagaaatgtgtggactaaaaggatgatgcagacccaagasttgtccttaaggagcttacagcagagtgggaattttaggtgcccagatggaaatttgtccatttgggagtagtgtggggtgggaaggaaagaattagtta

SEQ ID NO: 38892 - DNA, 201 bp, Homo sapiens
caatattattcacaatagtcaagatatggaaccagcctaagtgcccatctacagatgaatgaagacattgtggtgtgtgtgtgtgtgtgtgtgtgtgtgtgtgtgtgtataccacaatggaaaattattctgccttaaaacaacaaaaaccaaaatcttgccaatcttgccatttgcaataacatggatgaacctggagga

SEQ ID NO: 38893 - DNA, 201 bp, Homo sapiens
tgtttacatagcatttgctgaaggacatttctccaaagaaaacatacaaatggccaacaggcgtatgaaaaggtggtccacatcactaatcatcagggaartgaaaatcaaaaccacaatgagctgtcacctcacacctgttaggatggctgttctcaaaaagacaaaagataacaagtgttgggaaggatgtggagaaaa

SEQ ID NO: 38894 - DNA, 201 bp, Homo sapiens
tcaatattattcacaatagtcaagatatggaaccagcctaagtgcccatctacagatgaatgaagacattgtggtgtgtgtgtgtgtgtgtgtgtgtgtgtgtgtgtgtataccacaatggaaaattattctgccttaaaacaacaaaaaccaaaatcttgccaatcttgccatttgcaataacatggatgaacctggagg

SEQ ID NO: 38895 - DNA, 201 bp, Homo sapiens
gagtcctcaggcaacttctgtcccagccttcttccctcaggttgggaaatatctaccccagagttcccacacatttttccccaagtgagaagataattgaygtccagagataccgctggggaggaaaaagagagggcagcagagagaaggatgggcttggcacttcacacggacctcgctttgggtccatcagggattggc

SEQ ID NO: 38896 - DNA, 201 bp, Homo sapiens
ccagctcatcgctcgcatcgctgccgccaacggggtaagggatgcgcggccccgcgccgctgtgcaccctggcgcgtgtgcgacgtgcggcccgcggcgcyctccctcgctcggggccggccgcttccgcgcgctgccgcctcggtttccacctcccgctcctccctctccttcgcgctcgctcttctggcctggaggccc

SEQ ID NO: 38897 - DNA, 201 bp, Homo sapiens
gatgtggacagaattgttagtgcttcccttactgtgtgccgggtaccctaggctgcaggctgggtcaggctttctcctggcttctcatgaacacttacgcmccagggttctctcacctctgcttctgttgcctgttgtcacagagtaaactcatctctcacaattcataatagaataaagagcaggatgaagattctgtta

SEQ ID NO: 38898 - DNA, 201 bp, Homo sapiens
ttataagcattttaaatgtgtccattgggtggacatgatcataacattggatttggattcagagaaatggattagaattttatttcttccccttactagaytggggagccatttagcttttctctgtactcagttttgtcatctgtagaaatgggaataacagtccagctgttgagaggattaaatgaataatgagtctga

SEQ ID NO: 38899 - DNA, 201 bp, Homo sapiens
ccacagcccagctggggtacaaggtaaggtggggaagtgggcagagagaattcttgcgcatccacagcctctcctgtcttaagtgctaataaaaccctagktcatccagcctctctcaattggagactttaaaaataatctggtcagggatgaaatgaagtcaatttttatgtcagccataaagagtgaggctttaaaagt

SEQ ID NO: 38900 - DNA, 201 bp, Homo sapiens
gccgggtaccctaggctgcaggctgggtcaggctttctcctggcttctcatgaacacttacgcaccagggttctctcacctctgcttctgttgcctgttgkcacagagtaaactcatctctcacaattcataatagaataaagagcaggatgaagattctgttacaacctcccagtttacttttttccaattgacccagat

SEQ ID NO: 38901 - DNA, 201 bp, Homo sapiens
tcagcaaatgacaaagtttacactgtggagaaggccgataactttgaatacagcgacccagtggatggaagcatttcaagaaatcaggtagaaacagacckgtgtgtaagtgagagagagacctcagagcttcatctctgacatctcaagggaaaaattaaaaagttcctgttggctatttttcttttgctgctgtgtttt

SEQ ID NO: 38902 - DNA, 201 bp, Homo sapiens
ccgtgagaaagatggactgtgggctgtccttgcctggctctccatcctagccacccgcaagcagagtgtggaggacattctcaaagatcattggcaaaagyatggccggaatttcttcaccaggtgagccacagcccagctggggtacaaggtaaggtggggaagtgggcagagagaattcttgcgcatccacagcctctc

SEQ ID NO: 38903 - DNA, 201 bp, Homo sapiens
gtacaggaaccatggctgggaggcctcaggaaatgtacaatcatggcagaacaatgaagaggcagccggcaccttcttcacatggctgcaggagagagagwgtgaagggggaagtgctatatacttttaaacaaccagatctcatgagaactcacttactatcaccagaacagcaagggggaactttgtcccccatgatcc

SEQ ID NO: 38904 - DNA, 201 bp, Homo sapiens
aagaactacctgagactgggtaatttatgaagaaaagaggtttaattgactcacagttctgcaggctgtacaggaaccatggctgggaggcctcaggaaaygtacaatcatggcagaacaatgaagaggcagccggcaccttcttcacatggctgcaggagagagagagtgaagggggaagtgctatatacttttaaacaa

SEQ ID NO: 38905 - DNA, 201 bp, Homo sapiens
cactgccagccagtcaactttccaaaaacatattggtttatattctttttgcttacaaatttccatagttccccagcactttcaaaataaagtttagcacrgttcacaaggctccatagacttgccccaactatttctccagtctcatccctgtcactgcaacctcttcagagccgcagctctgtaaacacaccttcagga

SEQ ID NO: 38906 - DNA, 201 bp, Homo sapiens
caagggctaacctaatctggctagtacacttttgagtcccaattctagattccaaggagagaaaacatgagtggtccagctttagtcaggggtctaccccwtttgctcatggcctggagtcagggtcctggagtagacacctggcctcaggccttcactctcatggaatagttgggggacagttctcagagaagagaggag

SEQ ID NO: 38907 - DNA, 201 bp, Homo sapiens
acttacgcagggcttgcaaagcactagaaccagctggtgctaagctctttacatttgtaaactcctgtctcttaatacaacaaatctatgcagtagctacyactttcaatccctgtttcaaaggtgagaaaatagaggcacaaagagcctacatcccttgcccacggtcccctagtcagaaaatggtactcggcctgtctc

SEQ ID NO: 38908 - DNA, 201 bp, Homo sapiens
tgtgcacagtggttgggggtacaggatgagtaagacaaagtccttgtgcttagggtgctcatgctggtggaggagacaggcactccatgggtagttacaayagggtgcgaattctattacagtcagtccttgacttaccatggaatgatgaattacagttgtccaactttacagtggtgtaaaagtgatacacattcagta

SEQ ID NO: 38909 - DNA, 201 bp, Homo sapiens
agtaagcaaaattgatcctgagtagcttaagtactggttacggtgtttggtgtttgtatgccaggtctaccccttatggttttaggatagtggttctggtraatagttgattaggtccacttgctccagaaatctccgtgaataagatttgatggggtgctttccatccctgaaacatttactgaatgttttcttattgct

SEQ ID NO: 38910 - DNA, 201 bp, Homo sapiens
tgaacatgggattctgtagagctctaagccatctggcccttgtaattcttctgaccttgtaccttcttccaattttaatgtaatttctccttttctttagrgaacatttcctaactctactaaaatgcacatagccaatggcccgtcccaattgttgggtatgaaacacgcctgcttgttttcagattcagagcagtgcta

SEQ ID NO: 38911 - DNA, 201 bp, Homo sapiens
ggaagtcaaggaaaagtaaatcccagctctgcagtgcctctggcatctgccaggagggagaagaggtgtaaaggtgtgtataggagacagtggcctaagcycgagagctgccctctgtgctgtaaagaaagcagctgccccactttctgtaatcagaaaatccaagcattttgatgtgagaccagataggagggaaaaata

SEQ ID NO: 38912 - DNA, 201 bp, Homo sapiens; identical to SEQ ID NO: 8633

SEQ ID NO: 38913 - DNA, 201 bp, Homo sapiens
gtccaactttttatatccctaaagccttgctctcactgaagccttgattgaggccaagagagaatgccttgctgctgcccccatgagccactgcccatctmaggaattcccacagatgcccacatttacccacatgctttaaaagctcttgtttattgagtctttgctgttcacctggctgcatattacattacaaggcaa

SEQ ID NO: 38914 - DNA, 201 bp, Homo sapiens
tttttttagaaggaggggagtattgtattttgttttcatgtcctagtcagaaaatgaaatggtctctaggctaggttgcaaatccttagactcaagaactrtaattttttttattgtcctgaatattctaaaaagtaacataaattttaagagaattgtaatttaaaatcttagcagggtcaactgagctctggattcttc

SEQ ID NO: 38915 - DNA, 201 bp, Homo sapiens
aggagccatacatagcccaatgatgagaaacgtgagctttggctttaaaactggtgttgaagcctgcctttccaatttattgtgagtcctggagcaactcrtgtaacttctttaatcctcagtttccttatcagtaaaatgggaatagtgagaatacctacaccactgagttgttattaagcctgcatgaaaacctacatg

SEQ ID NO: 38916 - DNA, 201 bp, Homo sapiens
ttcaatattattcacaatagtcaagatatggaaccagcctaagtgcccatctacagatgaatgaagacattgtggtgtgtgtgtgtgtgtgtgtgtgtgtgtgtgtgtgtataccacaatggaaaattattctgccttaaaacaacaaaaaccaaaatcttgccaatcttgccatttgcaataacatggatgaacctggag

SEQ ID NO: 38917 - DNA, 201 bp, Homo sapiens
attcaatattattcacaatagtcaagatatggaaccagcctaagtgcccatctacagatgaatgaagacattgtggtgtgtgtgtgtgtgtgtgtgtgtgkgtgtgtgtgtataccacaatggaaaattattctgccttaaaacaacaaaaaccaaaatcttgccaatcttgccatttgcaataacatggatgaacctgga

SEQ ID NO: 38918 - DNA, 201 bp, Homo sapiens
ggttgcataaggaggggtgaaccggcccaagttggaaacagagcaggtcaaaactcccatgccgatgagtagtgggattgcacctgtgaatacccactgcrcttcagcctggtgacatagcaagaccccatctctaaaaaaagaaaaggaaagaaaaaaagagggtgctgagaagacttgcagtaaaggtgcctgtttaca

SEQ ID NO: 38919 - DNA, 201 bp, Homo sapiens
cgtagctaagcccccatcagctggatgcagagagggtgacggaaggcaggctcacaaggtgcagctgctgccatttatcaaggatttaaccctccaatgawcaagtatggatgaaattacatccccaaatagacccctcataatttgccagccttcagtctcccagcatttggggaaaaaaatctctgcttatcttttcca

SEQ ID NO: 38920 - DNA, 201 bp, Homo sapiens
ccaccgtagctaagcccccatcagctggatgcagagagggtgacggaaggcaggctcacaaggtgcagctgctgccatttatcaaggatttaaccctccartgaacaagtatggatgaaattacatccccaaatagacccctcataatttgccagccttcagtctcccagcatttggggaaaaaaatctctgcttatcttt

SEQ ID NO: 38921 - DNA, 201 bp, Homo sapiens
gggcagggtagaggaatagtctacccagactgcctgtcactcagaccagccactctgctgcaaaaggagttggcttatctttttttttttttttttttttttaagcacttagcagtttcctagggctgctatctgctgtaacaaactgtgtggcttaaaacaatggatatttattctcttgcacttctggcagcttagaag

SEQ ID NO: 38922 - DNA, 201 bp, Homo sapiens
ttgcctggctctccatcctagccacccgcaagcagagtgtggaggacattctcaaagatcattggcaaaagtatggccggaatttcttcaccaggtgagcyacagcccagctggggtacaaggtaaggtggggaagtgggcagagagaattcttgcgcatccacagcctctcctgtcttaagtgctaataaaaccctaggt

SEQ ID NO: 38923 - DNA, 201 bp, Homo sapiens
cacctcccagtccaccacgcggtcccgagggtaaacgaccaataatgtacaatacagggtactgtatttaataaattacacgagatcttccaacattttawtataaattaggctttgtgttcaatgattttccctaactttaggctaaggtaagtgttgtgggcccatttaaggtaggctaggccaggccatgatgtttgg

SEQ ID NO: 38924 - DNA, 201 bp, Homo sapiens
aaaagagttagagaggtgtcagcattgtttgaataaatatgttgtttcccaaggtgattgttttgaaagagataatgctaattgagatgaatgtactcaactggcataactgtttaaagggagttactgtattttatactgttcaagcacattgacctgtagagaggagcttaagagacagttcttgctgaggcagagtct

SEQ ID NO: 38925 - DNA, 201 bp, Homo sapiens
gaagtacaggggtacttcgggagctttattctcagggtgcctaacttggttctgtggtgtaggagatcagattttctttctggctttctgcccattctaayttgcatagctactgagtacatttccctgtaggcaaagcccacaggggaagattgtagcaccccatgtctggggatagcctagacagaatacgccagtaga

SEQ ID NO: 38926 - DNA, 201 bp, Homo sapiens
gatactgagttagactctgggacacatggtgaacaaggccttctcatagagggctccatgaattacaggtgtgcaaagcaatagaaggtgaagtacagggrtacttcgggagctttattctcagggtgcctaacttggttctgtggtgtaggagatcagattttctttctggctttctgcccattctaatttgcatagcta

SEQ ID NO: 38927 - DNA, 201 bp, Homo sapiens
taaaagagttagagaggtgtcagcattgtttgaataaatatgttgtttcccaaggtgattgttttgaaagagataatgctaattgagatgaatgtactcaactggcataactgtttaaagggagttactgtattttatactgttcaagcacattgacctgtagagaggagcttaagagacagttcttgctgaggcagagtc

SEQ ID NO: 38928 - DNA, 201 bp, Homo sapiens
gggaagaaatgcacttttacaaaagaaaagaagtttgcttgcaaagaggtgcaaaggagtctaacttcaggactggtccaccgagtaaaacaaaccactarcatctgcagaacaatcttggaatattactaacattatacattagtctgtttgtatacattatacattagtctgtttgtgctggaggagcagcagctttct

SEQ ID NO: 38929 - DNA, 201 bp, Homo sapiens
ttgaatgagttcatgaacactattcacttggcaccttccatttagacagattcctgctattggaaaagaaagaactttaaaaggtatctgatgtaaattcytgtatgatgctggaaccatagtgactggtcactgctttctggctgaaccacccacctcaatggagaatccacacctcacctcttgccgtagtctgggacc

SEQ ID NO: 38930 - DNA, 201 bp, Homo sapiens
ttttggatattcacaatgatattagcatttgaagattccagaacattctgccataaagaatcctgttagtacagttttgcctaaatatagtttaccactayatataataattatgatgatatgatacaatatcatcaccacaataatgattattattattatcatttcgtagtatgtacagtaacttctttttccacagac

SEQ ID NO: 38931 - DNA, 201 bp, Homo sapiens
ttgtgggtgtttaaatcagagattacaaggccactgcttagtccttttctacttcatataatgggcatggtgccatgctattctgagggatactacatgartgcccaatgagcctatgaggtggtcttctcccatgaaactccccacagggtcatctagttcaggcctggcttcagtcattctttatgaatgaagatgtct

SEQ ID NO: 38932 - DNA, 201 bp, Homo sapiens
atgattttccaccaatcttagaattatgtatgactctgagcaatgctaaatgggacccttgattacaataacgattgcccttttccgtccctcacatggcyacgctaacagtcctgctgtgatgtaactttgatttcatgcctttgaagggtggctagtgctacaaagattgctttgtatgagaccccaactggctggaag

SEQ ID NO: 38933 - DNA, 201 bp, Homo sapiens
ctcttatgattttccaccaatcttagaattatgtatgactctgagcaatgctaaatgggacccttgattacaataacgattgcccttttccgtccctcacrtggccacgctaacagtcctgctgtgatgtaactttgatttcatgcctttgaagggtggctagtgctacaaagattgctttgtatgagaccccaactggct

SEQ ID NO: 38934 - DNA, 201 bp, Homo sapiens
aataactgttaaggatccctcattctgacccgaggtcagaactaaattattagaagcccctcttgaacaggaataggagtcattgaaatgaaacccacacrtttaatttcagacatccatacttgctaacaatggcacgatgattaggttctgattatgatagaatgactggtatttcctgagctgggtgagttctagatg

SEQ ID NO: 38935 - DNA, 201 bp, Homo sapiens
ttcctgttgtttctcatgccattcttctccccagaatgcatccacctcacccctgaatcctcacatactttaaggagttttattttctgattctgcatacwtttattccatgctgtatatagttgtgggaccgtatgtaaagaagatcctctgtgaagaactcggtgcccctgcgaactcggcagttaactgcgttcctct

SEQ ID NO: 38936 - DNA, 201 bp, Homo sapiens
tccgcggctttgcacggagcatgcccacgagtggtgctctggaccggtaggtgtctccattcccttggccttcctgtcttaggtcgtcccagtcttcaccrtacccttcactgtgcctggaacacgtgtccttccctttcagcatgggcatctgatgcatagagtgtgctgagcgattcttgtgtgaggggatggttggct

SEQ ID NO: 38937 - DNA, 201 bp, Homo sapiens
acaaggccactgcttagtccttttctacttcatataatgggcatggtgccatgctattctgagggatactacatgaatgcccaatgagcctatgaggtggycttctcccatgaaactccccacagggtcatctagttcaggcctggcttcagtcattctttatgaatgaagatgtctttgaaggcagcaactgtgtcaaaa

SEQ ID NO: 38938 - DNA, 201 bp, Homo sapiens
aattttcttcaagtttaaacaaatttgatcatccaaaggagccatacatagcccaatgatgagaaacgtgagctttggctttaaaactggtgttgaagccwgcctttccaatttattgtgagtcctggagcaactcgtgtaacttctttaatcctcagtttccttatcagtaaaatgggaatagtgagaatacctacacca

SEQ ID NO: 38939 - DNA, 201 bp, Homo sapiens
aaaaaaaattttgacatacagtgtggttgtgttgtatcctactgctctaatattaggaaaggggctgggatgctaggtcagctgggaccctctttttctcrcttgcattcatctctttttctctcttactctcaccacttttctacctcatgttgagtagcgccatgaagacccctccttcatcactctgcctgcagttat

SEQ ID NO: 38940 - DNA, 201 bp, Homo sapiens
aagcatttcacacatacctttcctcatttactttcagaaccttctaaaggaggcttcactctctgcattttatggaaactctggcttacaaggaccccatygaaaaggatgttccctctttgtggccaccttctttcatgtcctttacagccggacatcctattttggccagaccatataattgaaaatgatcttaataat

SEQ ID NO: 38941 - DNA, 201 bp, Homo sapiens
gaccccatcgaaaaggatgttccctctttgtggccaccttctttcatgtcctttacagccggacatcctattttggccagaccatataattgaaaatgatyttaataatgagacagacagaaaataacctcaccatttctctcctcttcttcttcttcttttttttttttttttttttttttttttttgagacagagcctt

SEQ ID NO: 38942 - DNA, 201 bp, Homo sapiens
aattgtggattcggtagaagcttatgctacaatgctgagaagcatctttgatttcagtgcactgaaagaactactttctgggccaaaccgactgaagatcygtattgatgctatgcatggaggtatacaatcatttcttttcaattcccatctcttgaggataggaagttgccctcttctgtgtgtatcatgatgcttcaa

SEQ ID NO: 38943 - DNA, 201 bp, Homo sapiens
gtgacagtgaaatgcttctcatttgactgtacctgaatatgaagagccatgcgcaaatcttccttaacatgatattttcttttagaaaaatcctgctactytgctgactgaatgatgaaatggtagatgtgctagtgaagaggaactgatgagctttggattctttgtatttccatgtgagctgcacgaagtaacccactg

SEQ ID NO: 38944 - DNA, 201 bp, Homo sapiens
ctaaaagagttagagaggtgtcagcattgtttgaataaatatgttgtttcccaaggtgattgttttgaaagagataatgctaattgagatgaatgtactcaactggcataactgtttaaagggagttactgtattttatactgttcaagcacattgacctgtagagaggagcttaagagacagttcttgctgaggcagagt

SEQ ID NO: 38945 - DNA, 201 bp, Homo sapiens
gcctcggcctcacaaagtgctgggattacaggcgtgagccaccacacccggcccaagtcactttttaacatgctgtaacccccactttaaaaaaaaaaaaaccactttttaattatggtggggccgggcatggtggcttaccgcacttgagtgggtcacttgagcccaggagttccaaaccagcttggacaacatggtgaa

SEQ ID NO: 38946 - DNA, 201 bp, Homo sapiens
ggactacaggcgtgcaccaccatacccagctaatttttgtatttttagtagaaacgaggtttcaccatgttggccaggatggtctggatctcttgacctcrtcatccgcccgcctcggcctcacaaagtgctgggattacaggcgtgagccaccacacccggcccaagtcactttttaacatgctgtaacccccactttaa

SEQ ID NO: 38947 - DNA, 201 bp, Homo sapiens
tttggaagttccttcatgggctgcacattgactatcccctaggtttctttcttctttctttctttcttttttcttcttcttttttttttttttttttttttgagacggagtcttactctgtcgcctaggctggagtgcagtggcgcaatcagctcactgcaacctctgcctcccaggttcaagcaattcgcctgccttagc

SEQ ID NO: 38948 - DNA, 201 bp, Homo sapiens
ttttggaagttccttcatgggctgcacattgactatcccctaggtttctttcttctttctttctttcttttttcttcttcttttttttttttttttttttttgagacggagtcttactctgtcgcctaggctggagtgcagtggcgcaatcagctcactgcaacctctgcctcccaggttcaagcaattcgcctgccttag

SEQ ID NO: 38949 - DNA, 201 bp, Homo sapiens
tgcttactctcctgattctactcacactttttggaagttccttcatgggctgcacattgactatcccctaggtttctttcttctttctttctttcttttttcttcttcttttttttttttttttttttttgagacggagtcttactctgtcgcctaggctggagtgcagtggcgcaatcagctcactgcaacctctgcctc

SEQ ID NO: 38950 - DNA, 201 bp, Homo sapiens
tttgtggggaggagagcttcgggaccggtaagtcacactcctgtgctagcattttcctccctgtaaccactatttccagtaaaagcttagactgctaaggyagcactgaaataccaacggtagccgatgtgtcctaaatcaaggcacaaattatttataacaaccctgatgaaatgtgcacatttgaaaaggggtgagcac

SEQ ID NO: 38951 - DNA, 201 bp, Homo sapiens
attcctgttgtttctcatgccattcttctccccagaatgcatccacctcacccctgaatcctcacatactttaaggagttttattttctgattctgcatayatttattccatgctgtatatagttgtgggaccgtatgtaaagaagatcctctgtgaagaactcggtgcccctgcgaactcggcagttaactgcgttcctc

SEQ ID NO: 38952 - DNA, 201 bp, Homo sapiens
ttgcttactctcctgattctactcacactttttggaagttccttcatgggctgcacattgactatcccctaggtttctttcttctttctttctttcttttttcttcttcttttttttttttttttttttttgagacggagtcttactctgtcgcctaggctggagtgcagtggcgcaatcagctcactgcaacctctgcct

SEQ ID NO: 38953 - DNA, 201 bp, Homo sapiens
cttgcttactctcctgattctactcacactttttggaagttccttcatgggctgcacattgactatcccctaggtttctttcttctttctttctttcttttttcttcttcttttttttttttttttttttttgagacggagtcttactctgtcgcctaggctggagtgcagtggcgcaatcagctcactgcaacctctgcc

SEQ ID NO: 38954 - DNA, 201 bp, Homo sapiens
ccaccgtaaccatttttaggtgtatggttcagtgatggtaacaaaacattgttgtgcagcatatctctagaaagttttcatcttgccaaactgaaagtctrtgtccattgaacaactccccatctttccctcttctgagcccctgccaaccaccattgtattttgtgtttctatggtgttgacttctttaaatacctcatg

SEQ ID NO: 38955 - DNA, 201 bp, Homo sapiens
ctggaaataaggcaaacattctgggaagcaaatctcgctcaaacagtgaatggaacttatcaggtaacttttcatgttcaaagggaaaggaatttttttttaagtcactcagaggttttaaatagtttaaagatacctagagagaaataaaagacgtgttagaagggaaggggaaccactaatcagtgtgggtgaagccag

SEQ ID NO: 38956 - DNA, 201 bp, Homo sapiens
tgatgaaaatactctctcagcatttcagagatgcgtgttcttggtagttatataaaatgtcactgtaaacatatgtaactggcttctcctgttgtttgttkttggtggtgggttttttattttcttttttttttgagacggagtcttgccctgttgcccaggctggagtgcagtggtgcaatctcagctcactgtaacctc

SEQ ID NO: 38957 - DNA, 201 bp, Homo sapiens
atgatttgttggcttatctatctctccttctgcaccaaaagtttcttggcaacttgagtcttcctgaggtgtacagtgcctggtgaaatgaatacaacacrtcggtctatataggacatattgggtagatggatgggtgaacagatggacagccaactgacgcgtgctaaaggttgtacactctctgaggcagaggcagct

SEQ ID NO: 38958 - DNA, 201 bp, Homo sapiens
aaggtttcctggaagaagtggcatccaactcagttcttatgaaagaaagatctagagtgatgaaaaatcaagcaatggtcattctcatggagtcggtggcygtggcaaaggcatgaaggcttaaaaatggatgtcacattagggaaacgagaggcctgggctggctggataatggggcatgtgaggagggcattgggtaag

SEQ ID NO: 38959 - DNA, 201 bp, Homo sapiens
tctagggtagctgttcttacctggttttctgctgtcccacgtgactctcacatgcactcgttgggacagtggtttatgcccttgttctgtgcactgtccartaccctcattctgggattcttaacctggactccagagggatttttgcactctctggaatgatatgcaagatgatgtgtccattgtacatgcagaaaggag

SEQ ID NO: 38960 - DNA, 201 bp, Homo sapiens
ggaggctgaggcacgagaattgcttgaacctggaaggcagaggttgcagagattgcacaactgcactccagcctgggagacagagtgactctgcctccccmcaaaaaaaaaaaaaaaaaaaaaaaaaaaaagaccctgaaacaagaggaacccaggcagcgtctcctggttgtctcagcacatctgtttcattttcctctc

SEQ ID NO: 38961 - DNA, 201 bp, Homo sapiens
tgaccaacatggtgaaaccccatctctataaaagtctctataaaaatacaaaaaattagtcgggtgtggtggcacatgcctgtaatcgcagctactcaggrggctgaggcaggagactagcttgaatccggaaggcggaagttgtagtgagcggagatcacaccactgccccccagcctgggcgacaaagcaagactccgt

SEQ ID NO: 38962 - DNA, 201 bp, Homo sapiens
atcctatgtgatatatttcatcatctgtacacttaattttaagagagtatgttttaaaatgcctacttaaaaaaccattctctcacctcaagtgatgaggrgttacctttccagttgaattggggtgacaccagctgggtgaggtgtggctcggccaagggtctggatgtggaggcaccgagtccagaataccagcgccaa

SEQ ID NO: 38963 - DNA, 201 bp, Homo sapiens
atgcatgcctggggaataggcaggaactgggcagattactttcttcaaagaatgtgcaatgtttggggagacgaagtgggtaaaaaactaaccccggggtygggcgcggtggctcacacctgtaatcccaacactttgagaggccaaggcaggtggatcatggggtcaggagttcaagaccagcctgaccaacatggtgaa

SEQ ID NO: 38964 - DNA, 201 bp, Homo sapiens
agagagggcagctatcactgtgaaccagaaccacgagggttttctcagacatgtaggtatatgagaatccctgaaacctatacacatacatctgcctggtyggagaagcctttctgcctgcaactgaacccttttagtgatgcaattcggggattcctgtgacactgcaaaccacagaaagtcttctgctggtgaactaaa

SEQ ID NO: 38965 - DNA, 201 bp, Homo sapiens
accctgtgggcctgtgggaaatgcatggactgggtgtctggcaggtctgggtttgaagctcagcttcatgagcagtgggccttggccttgctgcgcctcatttccccccactcacagggctgtcttgaggctgggtggagtagtcctctggaagccctgaaggtttgaccgttctaaagcagtgtttcaggtgaatttata

SEQ ID NO: 38966 - DNA, 201 bp, Homo sapiens
gccttgggggcttacccctcatatcagtgtgccctgtatgtagtacatagagtcaaaagagatgagtttggagctttaagatttaatgactgcccttctgygttctggacttgtgtggggcctgtagcccttttcttttgactgatttctcccctttggaatgggaatgtgttgcgggaagtcagggaccccaaatggagg

SEQ ID NO: 38967 - DNA, 201 bp, Homo sapiens
agaataaccctgtggcagcttgtaggagagatttgaggccaaaggtgtgtaggtttatccttgttttttgtttggttggttttttttgtttgtttgtttgktttttttttgtttgtttgtttttgtctagctcctcttctctaagaatggccctacctcttccacatggcaatgatgctcatacaggggtaggggactgac

SEQ ID NO: 38968 - DNA, 201 bp, Homo sapiens
cagtcccgggctcctgtcaggcgctcttctcagacccccgggaacttggcttcggccgccccgcccctccgtggatcccagtagcccccgccccggactckgctttccccggctgctcgcttgtcaggaagcgcctggggtgccccgcttgtgggaagcgcgatcccggggcgatagggtggggatctgggggagaagctc

SEQ ID NO: 38969 - DNA, 201 bp, Homo sapiens
gaataaccctgtggcagcttgtaggagagatttgaggccaaaggtgtgtaggtttatccttgttttttgtttggttggttttttttgtttgtttgtttggtttttttttgtttgtttgtttttgtctagctcctcttctctaagaatggccctacctcttccacatggcaatgatgctcatacaggggtaggggactgaca

SEQ ID NO: 38970 - DNA, 201 bp, Homo sapiens
cgatgtaggtcgctcgtccctggtgggctcggctgctcgcctagctcttttccaaggggctggggcgggggcctgaagcccggagatgagcagaccaggcrcgggggtggggggtgcccggcccaaagcctcagggcgcgctcctgggcgcacagccgggaaccagaggcggccacgacgcttttaattagggctggggcg

SEQ ID NO: 38971 - DNA, 201 bp, Homo sapiens
gatacaagaggcttagagatccccaaatagatataatgcaaagttcttctccatgacatattatagtcaaactgtcaaaaacagagagagaattctaaaarcagcaagagaaaaacatctggttccctataaagggacccatatcagactaatagtggacttctcagcagaaactttacaggccaggagagtatagtatat

SEQ ID NO: 38972 - DNA, 201 bp, Homo sapiens
cctcccactttggcttcccaaagtgctgggtttgcatcctggatggcctcttaggagctgtgtgcccttgggcaagttgtttaaccttcctgagctcctgygtccctatctttaaagtgaaaataataatagcacgttttactacttggaaggaggctggaccaggttttctacagccagaccatctacgctttccaaagg

SEQ ID NO: 38973 - DNA, 201 bp, Homo sapiens
ccaaataagcttataatggggcttccagacactagcagtgaggcagtttctgtagaggttgagtggcggctcttcaccgactaactgggtttgcgtccccygcctttttgttttccttttttaaaatacattttttaaatatcatggagtgtcactatgttgcccaggttagtgtcgaactcctgagctcaagggatcctc

SEQ ID NO: 38974 - DNA, 201 bp, Homo sapiens
ttatattattggaatactaatgttttacattttgttttttctctaagcaaatggttatgagccttagagtttctgaactccaagtactgttgggctacgcygggagaaacaagcacggacgcaaacacgaacttctcacaaaagccctgcatttgctaaaggctggctgtagtcctgctgtgcaaatgaaaattaaggaac

SEQ ID NO: 38975 - DNA, 201 bp, Homo sapiens
tggcttaaccaagcaggagtttggatttctctaatgagaggtctggggtgggtgtagcgtctccactgtatcatcaatgtcccggcttctatccatgtttctactcagttacgcttaatgtaactgagtagttacgttatcttgcttattaagtcttacggtcacggtcacgagttgactgctccaccttcactctcacat

SEQ ID NO: 38976 - DNA, 201 bp, Homo sapiens; identical to SEQ ID NO: 8648

SEQ ID NO: 38977 - DNA, 201 bp, Homo sapiens
acataacaaggtgttgttatgtcatccaacagcaggactgttggaaaatgtatttctcaaaccatcaaattcatgaaggaaacagtctcttttgattttcyctattgaaatataacttcaccagaccaatctggttcaactgtaacaaaggttaagtaacctgagcatacccagtgtgcatgaaccaagcgtgcaatcacc

SEQ ID NO: 38978 - DNA, 201 bp, Homo sapiens
actcaacagcaccatcaatcaacaggatataattgacatctatagactacttcatccaaaacagcataatacacattcctcacatgtaccgttcaccaaartagaccacattctgggccacaacctgcaccctacctaatttaaaggaacagaaatattacaatgtatgctctcagactacaatgggattaaacagaaaga

SEQ ID NO: 38979 - DNA, 201 bp, Homo sapiens
gtggtgtgtgcctgtagatctaactatttgagtggctgaggtaggaggatttcttgagcccaggagatcaaggctgcagtgagctgtgattgagccactgyactctagcctgggtgacagagcaagaccctatctcagaaaaaaaaaagactcaattatattgttgtgtaaaatatacccactttaaatataaagatccat

SEQ ID NO: 38980 - DNA, 201 bp, Homo sapiens
ggcaatgccccacccaggcctcccttgaccacactacctgttgcaggagatggcctgcccacttggcccacccatgctgagtatggcttgcacacctgttyctgagttcttgtcctgtgcccaagaagaatgaggatgcactgacagtcaaagaatgagcaaggcagggaattttattgagtgatgaaacagctttcagca

SEQ ID NO: 38981 - DNA, 201 bp, Homo sapiens
ctcagaaaaaactggttatatagcaaaaacttaaagcaaacactacacttaatgaagaaactaggagcattcactttaacatctggaacaaaataaggcayccaactgtactgctatcatttactatataataatagaagttccagacaaagctatgaatgaagaaaaatgtaagacatacaggatgagaagaaataaaat

SEQ ID NO: 38982 - DNA, 201 bp, Homo sapiens
tattggtatttttctttctggttggtttctttctctacaaaatgtgaataacggtattaactgtacaggaatgttgtgaggattgagtgagagaacgtatrtaatagttaacattccagaagtgttagctatttttatatgtaacaaaatcagcaccagactgtatctactgtttctgtgctgccgtcttcacagccaaca

SEQ ID NO: 38983 - DNA, 201 bp, Homo sapiens
tctagaatatataccagttaattaaagacatgtgtgttttttttttttgcttttgtctttactggcgaatttaaaggtaattgaaagtataattcttgtcktctttagcatcagacaacagtcagcgctttcgagaaacctgttttgcatttgccttgacaccacaacaagtgcagcaaatcagtagttccatgtaagttg

SEQ ID NO: 38984 - DNA, 201 bp, Homo sapiens
tataaggttgtttggaaaaataataacacaagaaacttgtaaatgtttgcttctctactttttaatgaaaacattcatattttctagtatgcagtttgtarggggttttttcttaaggaatggaagtcaaaatgattgtggaaataataagtataaataaattacatttcatttttagggttaccttccacctacaaaaaa

SEQ ID NO: 38985 - DNA, 201 bp, Homo sapiens
tcacaggaaatgtgtttaatgttcttctacattgatgaaaagtcaacactgtatgctttaaatcagcatgcctacctgttgtgttctaggaaatttttgtyaaagcttaaatgttgaatagcaattatctaatatttactttttctccctttttaaagcttggtaaaatgcggctgacaattccgtgtcgggcccttacat

SEQ ID NO: 38986 - DNA, 201 bp, Homo sapiens
cactgaggcacactggcagagctatgtggcaccaactcaagtcgtttaacttcacgaacacccacacaatattagagggaaagaaattttaaaagcaaaaraaaaaaaaaatccggttaattgccatacatgtttttgcaatcctgacacagtaataacttgcctgtaaacacctcccttgaagaattggctaataggatg

SEQ ID NO: 38987 - DNA, 201 bp, Homo sapiens
gattgcttgagcttgggaggctgaggctgcagtgaaccatgatcactccactgcactccagcctgagcaacagagcgagacccaatctcaaaaaaaaaggaagaagaaaaagaaactagctgggcgccatggctcacgcctgtaatcccaacactttgggggccaaggcgggtggatcacaagatcaggagttcgagacca

SEQ ID NO: 38988 - DNA, 201 bp, Homo sapiens
attgcttgagcttgggaggctgaggctgcagtgaaccatgatcactccactgcactccagcctgagcaacagagcgagacccaatctcaaaaaaaaaggaagaagaaaaagaaactagctgggcgccatggctcacgcctgtaatcccaacactttgggggccaaggcgggtggatcacaagatcaggagttcgagaccag

SEQ ID NO: 38989 - DNA, 201 bp, Homo sapiens
ttgcttgagcttgggaggctgaggctgcagtgaaccatgatcactccactgcactccagcctgagcaacagagcgagacccaatctcaaaaaaaaaggaagaagaaaaagaaactagctgggcgccatggctcacgcctgtaatcccaacactttgggggccaaggcgggtggatcacaagatcaggagttcgagaccagc

SEQ ID NO: 38990 - DNA, 201 bp, Homo sapiens
tcctgggttcaagtgattcccctgcctaagcctccctgcttcagctgggattacaggcatgcaccaccacacccagctaattttttttgttttgttttgtwtgtttgtttgtttagtacagacagggtttcatcatgttggccaggctggtctcgtactcctaacctcaagtgatcaacctgtcttggcctcccaaagtgc

SEQ ID NO: 38991 - DNA, 201 bp, Homo sapiens
ctccccttccttccttcctctctctcttcctccctttctccctttccttcctccctccctctctctttctccctttctgtctctctctttctctctttctttctctctctctttctctctctctctcctttctttctttctttccttctttctttcctttctttctttctttctttctttccttctttctttctttctttt

SEQ ID NO: 38992 - DNA, 201 bp, Homo sapiens
tccccttccttccttcctctctctcttcctccctttctccctttccttcctccctccctctctctttctccctttctgtctctctctttctctctttctttctctctctctttctctctctctctcctttctttctttctttccttctttctttcctttctttctttctttctttctttccttctttctttctttcttttt

SEQ ID NO: 38993 - DNA, 201 bp, Homo sapiens
ttccttccttcctctctctcttcctccctttctccctttccttcctccctccctctctctttctccctttctgtctctctctttctctctttctttctctctctctttctctctctctctcctttctttctttctttccttctttctttcctttctttctttctttctttctttccttctttctttctttcttttttttga

SEQ ID NO: 38994 - DNA, 201 bp, Homo sapiens
ccttccttcctctctctcttcctccctttctccctttccttcctccctccctctctctttctccctttctgtctctctctttctctctttctttctctctctctttctctctctctctcctttctttctttctttccttctttctttcctttctttctttctttctttctttccttctttctttctttcttttttttgaga

SEQ ID NO: 38995 - DNA, 201 bp, Homo sapiens
cttcctctctctcttcctccctttctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacaggg

SEQ ID NO: 38996 - DNA, 201 bp, Homo sapiens
ttctaggtttgttacttgaaaattgcaaaattagggcaagttcttttacttctctgtacttcagtatcctcatccataaaaacaggtttatgatcatctcrgcagctttttggtcaggattaaatgaattactgttcatgaaaacacctaagactgcttgacacacagtaggtgttttaagaagtgttagttttctttccc

SEQ ID NO: 38997 - DNA, 201 bp, Homo sapiens
agttttagtagtcaagccagacactcttatgttcttgaaagaataaagttggtattatttagacttttcacagagaactccattctctgaatcatttgatktagtaggattttgtcttgcagtttctgcctttgtgtagagttgtcccctcacaactatgaaaaacagtcttttaccaactcttaatcaagtttctttctc

SEQ ID NO: 38998 - DNA, 201 bp, Homo sapiens
tgggtttgttacacatcagatttgggatgaaaattctaagttatatatttgtaggatttttgtgagtctgcaaaccaatattttcaaagtaatttatttcmaattagtgttatgaatattttatctttttaaattgatgttcccttggtttgaaaatgcgtgtgttactgtcagtgcctcctggcatttgtcgttgaaagc

SEQ ID NO: 38999 - DNA, 201 bp, Homo sapiens
accatatcatatatatatatatacgtatatatatatattcatatatatatatactatatatatattcatatatatatacatatatattcatatatatacatatatatatgaatatatatattcatatatatattcatatatatatgaatatatatatgaatatatatatatatagcaatgtcatattttaaaatgtgcatg

SEQ ID NO: 39000 - DNA, 201 bp, Homo sapiens
tatgtttatagagatttacctcttgaatttatcagtgtatatggttaaaagttcttaacaacttgttttgatggttttgctatacactactggtttttttaaaaaaataattgccacatttaatgtaacctctgtagtattaatgctggagtttcacttaacaataggaatgaaaacatcacaggtaagggttgtatagct

SEQ ID NO: 39001 - DNA, 201 bp, Homo sapiens
gaggcaggagaatggtgtgaacctgggaggcggagcttgcagtgagccgacattgtgccactgcactccagcctgggtgacagagcaagactccgtctcaaaaaaaaaaaaaaaaaaagaaattacattctagtactcctgtaactatatgaaaaatagtttggttctcttgtacctttccatatttgaatttttatagag

SEQ ID NO: 39002 - DNA, 201 bp, Homo sapiens
ttcctctctctcttcctccctttctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacagggt

SEQ ID NO: 39003 - DNA, 201 bp, Homo sapiens
tattgagaacttgaaatatggttagtcctaattaagatttgctgtaagtgtaaaacatactggatttcgaagacatagtatgaaaaaaagaatggaaaatatctcattaatgattgatattgattgcatgttgaaataatattttgtttattggattaagtaaatatatatcattaaaattaatttcacctacttgtaatt

SEQ ID NO: 39004 - DNA, 201 bp, Homo sapiens
tcctctctctcttcctccctttctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacagggtc

SEQ ID NO: 39005 - DNA, 201 bp, Homo sapiens
attgagaacttgaaatatggttagtcctaattaagatttgctgtaagtgtaaaacatactggatttcgaagacatagtatgaaaaaaagaatggaaaatatctcattaatgattgatattgattgcatgttgaaataatattttgtttattggattaagtaaatatatatcattaaaattaatttcacctacttgtaattt

SEQ ID NO: 39006 - DNA, 201 bp, Homo sapiens
ttgagaacttgaaatatggttagtcctaattaagatttgctgtaagtgtaaaacatactggatttcgaagacatagtatgaaaaaaagaatggaaaatatctcattaatgattgatattgattgcatgttgaaataatattttgtttattggattaagtaaatatatatcattaaaattaatttcacctacttgtaatttt

SEQ ID NO: 39007 - DNA, 201 bp, Homo sapiens
cctctctctcttcctccctttctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacagggtct

SEQ ID NO: 39008 - DNA, 201 bp, Homo sapiens
cctccctttctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaag

SEQ ID NO: 39009 - DNA, 201 bp, Homo sapiens
tgagaacttgaaatatggttagtcctaattaagatttgctgtaagtgtaaaacatactggatttcgaagacatagtatgaaaaaaagaatggaaaatatctcattaatgattgatattgattgcatgttgaaataatattttgtttattggattaagtaaatatatatcattaaaattaatttcacctacttgtaattttt

SEQ ID NO: 39010 - DNA, 201 bp, Homo sapiens
gagaacttgaaatatggttagtcctaattaagatttgctgtaagtgtaaaacatactggatttcgaagacatagtatgaaaaaaagaatggaaaatatctcattaatgattgatattgattgcatgttgaaataatattttgtttattggattaagtaaatatatatcattaaaattaatttcacctacttgtaatttttt

SEQ ID NO: 39011 - DNA, 201 bp, Homo sapiens
ctccctttctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagc

SEQ ID NO: 39012 - DNA, 201 bp, Homo sapiens
gcccccccgcccctacctcccttccctccatggagtggctaaccccagggagtttgcttcattctttttttttttttttttgacagagtctcactctgtcrcccaggtttaagcaattctctgcttcagcctcctgagtagctgggattacaggtgcatgccaccatgcctggctaattttttgtatttttagtagagacg

SEQ ID NO: 39013 - DNA, 201 bp, Homo sapiens
tccctttctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagct

SEQ ID NO: 39014 - DNA, 201 bp, Homo sapiens
aaggagacattataacagatactcagaaatacacaagatcatcagatactatcatgagcaactatatacagtaaactggaaaatctagagaaaatggaaarattcaatatatataacctaccaagattgaaccaggaagagagaaaacctaaacagtccagtaacaagtaatgagatcaaagaagtaataaaagtctccca

SEQ ID NO: 39015 - DNA, 201 bp, Homo sapiens
cctttctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctgg

SEQ ID NO: 39016 - DNA, 201 bp, Homo sapiens
ctttctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctgga

SEQ ID NO: 39017 - DNA, 201 bp, Homo sapiens
tctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctggaggg

SEQ ID NO: 39018 - DNA, 201 bp, Homo sapiens
ctccctttccttcctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctggagggc

SEQ ID NO: 39019 - DNA, 201 bp, Homo sapiens
gaaccagaggcggccacgacgcttttaattagggctggggcgccccgaccgcggcagctccggcagtatccgggtcacggtttctttgcctctcttgaaaytcggtttgttgccttcaagagccagataaggaagacaatcactcgcccgccgatgatttggaaacgaggaaatcctatccagaccaaaggagtatctccc

SEQ ID NO: 39020 - DNA, 201 bp, Homo sapiens
taaactgaaactatctcaaattgaaaatgtatttaatccacctaatctaccaaacatcatagcctaccctagcctaccttaaatgtgctcagaacacttayattagcttacaattgggcaaagttgcctaacacaagcctattttatcataaagtgtttaatatcttatgtgttaatttattggatagtttttgaaagtga

SEQ ID NO: 39021 - DNA, 201 bp, Homo sapiens
agagtagggaagaatggtattcttcctcttattgccctatcctgtcatctctgaggttaattgatgtctttgaaatttaatatactccatttaaaaaaaawtttccctaattacaaaaatgttatgtttaatgtagaatccatagaaattataattacttgcttactttacagataaacttttaaaatacttctgtggtat

SEQ ID NO: 39022 - DNA, 201 bp, Homo sapiens
ttatgtttaatgtagaatccatagaaattataattacttgcttactttacagataaacttttaaaatacttctgtggtattctttttgttagtcatttacrggtgtgtgtgtgtgtgtgtgtgtgtgtgtgtgtgtgtgtgtgtgtatttctggtttcattttgaaggagaggagaacctcactagctcacgtaacctggc

SEQ ID NO: 39023 - DNA, 201 bp, Homo sapiens
gtcatttacgggtgtgtgtgtgtgtgtgtgtgtgtgtgtgtgtgtgtgtgtgtgtatttctggtttcattttgaaggagaggagaacctcactagctcacrtaacctggcagccgcatgtattattgatccatataaataatggaagaaaattttaatcttgataggatgttgagcacatgtgttaaggggtactttgttt

SEQ ID NO: 39024 - DNA, 201 bp, Homo sapiens
tccttcctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctggagggcaatggca

SEQ ID NO: 39025 - DNA, 201 bp, Homo sapiens
ttttgaaggagaggagaacctcactagctcacgtaacctggcagccgcatgtattattgatccatataaataatggaagaaaattttaatcttgataggaygttgagcacatgtgttaaggggtactttgtttgaaataccttattgcttagtgtgccaatattggtgttgatgaggtgtgaaatttacataattatgaaa

SEQ ID NO: 39026 - DNA, 201 bp, Homo sapiens
ccttcctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctggagggcaatggcac

SEQ ID NO: 39027 - DNA, 201 bp, Homo sapiens
tcctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctggagggcaatggcaccat

SEQ ID NO: 39028 - DNA, 201 bp, Homo sapiens
tttcaccattaagtataatgttagctgtggattctttcatagatgcccttcctgttgagttttttaattataaaagcatgttgtaattaattaattaattwatttatttatttttgagacggagttttactcttgtcacccaggctggagtgcaatggcatgatctcagttcactgcaacctctgcctcctcagttcaagt

SEQ ID NO: 39029 - DNA, 201 bp, Homo sapiens
gctaatgatgttgaacatccttttatttgtttatttgccatctgaatatcctcttcagtgaaatatctttttatgtcttttgtcttttctaattgcagtgtttttttttttttttaacttatgagttttcagagttctttctagattctagattctagtccttcgttgggtttgtggtttgcagatcttttctcctgtggt

SEQ ID NO: 39030 - DNA, 201 bp, Homo sapiens
cctccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctggagggcaatggcaccatc

SEQ ID NO: 39031 - DNA, 201 bp, Homo sapiens
tgttttggacatctcatatgaatggaatcgtatggtatatgaccttccgtgactggctgttttcatttagaatgatgttttcaagttcataaagttgtatrtgccgaaactttgttctttttaatggccaagtaatattccgttatatggatataccacattttgtttatacattcatcagttgatgggcatctgagttgt

SEQ ID NO: 39032 - DNA, 201 bp, Homo sapiens
ccctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctggagggcaatggcaccatctca

SEQ ID NO: 39033 - DNA, 201 bp, Homo sapiens
tttattgtgaaatatttgcaaccttgaaaattcagaaatctagcaataggatctctctctgtctctctcttgctctagcaaacgactgcatatatttcatmcacacacacacacacacacacacacacacacatatacatgtatagtatattggttttgtataaggtataaaaagcaaattattataaaaacaatacatat

SEQ ID NO: 39034 - DNA, 201 bp, Homo sapiens
cctccctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctggagggcaatggcaccatctcag

SEQ ID NO: 39035 - DNA, 201 bp, Homo sapiens
cctctctctttctccctttctgtctctctctttctctctttctttctctctctctttctctctctctctcctttctttctttctttccttctttctttcctttctttctttctttctttctttccttctttctttctttcttttttttgagacagggtctctgtcactcaagctggagggcaatggcaccatctcagctca

SEQ ID NO: 39036 - DNA, 201 bp, Homo sapiens
ttattgtgaaatatttgcaaccttgaaaattcagaaatctagcaataggatctctctctgtctctctcttgctctagcaaacgactgcatatatttcatacacacacacacacacacacacacacacacacatatacatgtatagtatattggttttgtataaggtataaaaagcaaattattataaaaacaatacatatg

SEQ ID NO: 39037 - DNA, 201 bp, Homo sapiens
ttgaacctggaaggcggaggttgcagtgagccgggattgcaccactgcactccagcctgggccacagagcgagactctgtctcaaaaaaaaaaaaaaaaagaagaagaagcattcttagtttccagatacatgagagtattccaatttcctttttgttattagtttctagcttaattgaagtgtagtcaaatttactcctt

SEQ ID NO: 39038 - DNA, 201 bp, Homo sapiens
aagctgaggcagaatagcttgaacccgggggcaaaggctgcagtgagctgagatggtgccactgcactccaagctgggcgacagaaagagactctgtctcaaaaaaaaaaaaaaaaaaaaaaggaggttagacccctcattttctgattcctatactggtcttgttgatgatttgtcgggaagtagtagtgcagaattact

SEQ ID NO: 39039 - DNA, 201 bp, Homo sapiens
tcgtatagggtaacttctggacattgccatggcatttataaactgtcatgacgctggtgggagtgtcttttggcatactaatgtattatcgtataatgagyagtgaggacaaccagaggtcacttttgctaccatcttggttttggtgggtttgggctggcttctttaccgcattgtttcatcagcaggttctttatgact

SEQ ID NO: 39040 - DNA, 201 bp, Homo sapiens
tgatgtaacagcactttaaaagggcgacaactgactcacgagatggcaaccacctggagcctgtttggggagaccaccctgtacccgtgactttcgtttttaataataataataataataataaaagatgtcacttctggggctacggaggtgggagtgcaccggcggagcggggcggcggaacaccgtgcaacaggtggg

SEQ ID NO: 39041 - DNA, 201 bp, Homo sapiens
gatgtaacagcactttaaaagggcgacaactgactcacgagatggcaaccacctggagcctgtttggggagaccaccctgtacccgtgactttcgtttttaataataataataataataataaaagatgtcacttctggggctacggaggtgggagtgcaccggcggagcggggcggcggaacaccgtgcaacaggtgggg

SEQ ID NO: 39042 - DNA, 201 bp, Homo sapiens
atgtaacagcactttaaaagggcgacaactgactcacgagatggcaaccacctggagcctgtttggggagaccaccctgtacccgtgactttcgtttttaataataataataataataataaaagatgtcacttctggggctacggaggtgggagtgcaccggcggagcggggcggcggaacaccgtgcaacaggtggggg

SEQ ID NO: 39043 - DNA, 201 bp, Homo sapiens
atacacattgtcatgtgatttttttaagtgccataatcacaattttaaaagatatttcataaacctctggatatataaatacttttgggctaaatgcatcrtaatatatatatttgttctgttctttagactattaatagtaatatgtatttatgtaaactatgcaatagtattactgactatatattttttctttaaaga

SEQ ID NO: 39044 - DNA, 201 bp, Homo sapiens
ttcagaaatctagcaataggatctctctctgtctctctcttgctctagcaaacgactgcatatatttcatacacacacacacacacacacacacacacacwcatatacatgtatagtatattggttttgtataaggtataaaaagcaaattattataaaaacaatacatatgctcaatgtgaagaattttgtaaataaaag

SEQ ID NO: 39045 - DNA, 201 bp, Homo sapiens
tcagaaatctagcaataggatctctctctgtctctctcttgctctagcaaacgactgcatatatttcatacacacacacacacacacacacacacacacayatatacatgtatagtatattggttttgtataaggtataaaaagcaaattattataaaaacaatacatatgctcaatgtgaagaattttgtaaataaaagt

SEQ ID NO: 39046 - DNA, 201 bp, Homo sapiens
taagacatgagaatcacttgaacctgggaggtgaaagttgcagtgagccaagattgcgccactacaccccagcctggatgacagaacgagtgtctgtctcaaaaaaaaaaaaataataataataaataaataaagagtcacagtcttgctctgtctccgaggctagagtgcggtggcacaatcatagctcactgcagcctt

SEQ ID NO: 39047 - DNA, 201 bp, Homo sapiens
aagacatgagaatcacttgaacctgggaggtgaaagttgcagtgagccaagattgcgccactacaccccagcctggatgacagaacgagtgtctgtctcaaaaaaaaaaaaataataataataaataaataaagagtcacagtcttgctctgtctccgaggctagagtgcggtggcacaatcatagctcactgcagccttg

SEQ ID NO: 39048 - DNA, 201 bp, Homo sapiens
tccaacaccatatatttgtttttaagaaacccacaaaaccttagacaaatttaatttaacagattttatttatttatttttttgatagagtcttgctctgytgtccaggctgcagtgcagtggtgcagtctcagctcactgcagccttgacctccccagactcaggtgatcctcccacctcagcctccagagtaactggaa

SEQ ID NO: 39049 - DNA, 201 bp, Homo sapiens
atatttgtttttaagaaacccacaaaaccttagacaaatttaatttaacagattttatttatttatttttttgatagagtcttgctctgttgtccaggctrcagtgcagtggtgcagtctcagctcactgcagccttgacctccccagactcaggtgatcctcccacctcagcctccagagtaactggaactgcatgtgct

SEQ ID NO: 39050 - DNA, 201 bp, Homo sapiens
tcacttgaacctgggaggtgaaagttgcagtgagccaagattgcgccactacaccccagcctggatgacagaacgagtgtctgtctcaaaaaaaaaaaaawaataataataaataaataaagagtcacagtcttgctctgtctccgaggctagagtgcggtggcacaatcatagctcactgcagccttgacctcctgggct

SEQ ID NO: 39051 - DNA, 201 bp, Homo sapiens
aattcttttaccttttgtatgtctcagagtttttattttacctttgtttttgtaagatgtttttgctgagtaaagtgttaacagttgacatgtttttttgtttttttttttcttttggcacttcaaaaattttactccacttcttactctgttttctgcttgcattatttttgacaagaaatctgctgttatctgtatgct

SEQ ID NO: 39052 - DNA, 201 bp, Homo sapiens
ggtggaagatttatggacagagaaaggaaagtgacatatagaaaaccgaagtagggtacagaaacagctggattggttacagctcagtaagtttgccttaktagagcatggtttgaacagttagccacctttgattggccgaaacttggttattggcactggagtaggttacagtttatttatttatttacacatccagtt

SEQ ID NO: 39053 - DNA, 201 bp, Homo sapiens
ggatcatcccatttatactttattatgactatgtaaacactatttgtaagtgagcaatgtagtgaactatttttcatttcttgaatacctttttattttcyctgttctggtcattttcttttctttttttttccccctgtgtacttatttctcattcattgccaaaatttttttgccactgtgtaaatctccagatggata

SEQ ID NO: 39054 - DNA, 201 bp, Homo sapiens
cttccaggttggtgaatgaatccacttgctggagagtggtgcaccccaactctgaaaccaccattgcaaaattataactgagacagcaaaagagatctgasctaaccaactctatcttgcttgtaacctccaagccatccttgtttattcctgggtataggttgaactaactttgggaataacttagtttatagtttaaaa

SEQ ID NO: 39055 - DNA, 201 bp, Homo sapiens
tgtaacagcactttaaaagggcgacaactgactcacgagatggcaaccacctggagcctgtttggggagaccaccctgtacccgtgactttcgtttttaawaataataataataataataaaagatgtcacttctggggctacggaggtgggagtgcaccggcggagcggggcggcggaacaccgtgcaacaggtgggggt

SEQ ID NO: 39056 - DNA, 201 bp, Homo sapiens
cctgagtaactaggactgtaggcacataccaccacacctggctgatattttaaagttattttttgtagagacagggtctcactatattgcccaggctgctstcaaattcctggcctcaagtgatccttctgcctcagccacccaaagcactgggttgacagacctgagccactgcacctggcccagttacttttcaagtgt

SEQ ID NO: 39057 - DNA, 201 bp, Homo sapiens
ttgcagaccttgcacttgatggatcagctggcaccacccagatcgataaactggctcatccaatgttgtggcggtcacacaggaactgactcagcgaaagyggacagcgtctaatttctataatttcatctctgacctgaccaatcagcactcccgacttactgcccccaccacccgacccaccaaatgaaccttaaaaac

SEQ ID NO: 39058 - DNA, 201 bp, Homo sapiens
tgtgcagacgaggagtcccgctgcgcggtacagccaggaagccagtccctagagtcctttgcgctgggggtcggagccttggagtcccaggatgttccgasggctaagaccagagcggacacaaaggagataacaatgaagagggcgccggcaaatggcgaagcatcgcctccggacaggccatctccgggcagggcccct

SEQ ID NO: 39059 - DNA, 201 bp, Homo sapiens
ggctcatacctgtaatcccagcactttgggaagccaaggcaagtggattgtctgagttcaggagtttgagaccagcctgggcaatgtggcaaaacctcctytaaaaaaaaaaaaaaagaaaagaaaagaaaaaaagaaagaagaaccctagaggtagttactaataatggaggtgcatcagaattattcccagtgggggct

SEQ ID NO: 39060 - DNA, 201 bp, Homo sapiens
taatctttcctgtatctctgtgctttcatctggtatctttccccatttgcctgaagaatacaaaatttcctttgaatcaaatctgctattaattgattctyttaaatttattcttctctctttctttttctttctttctctctccctctttctctctccccccttctttctccctctttctctctccctcttctctctctc

SEQ ID NO: 39061 - DNA, 201 bp, Homo sapiens
tcttggctcactgcaatctctgcttcctgggttcaagagattctcctgcctccacctcccaagtagctgggactacaggctcactatcatgctgggctaatttttttttttttttttttttgagtcagagtctcgctctcttcagcaggctggagtgcagtggcatcatcttggctcactgcaacccctcctcccaggttc

SEQ ID NO: 39062 - DNA, 201 bp, Homo sapiens
tttaaacgtaaaaattaactagaaaactattaaaattcttcctatttcttatcccattctctgtctctcataggtaatcatttttaattaatttcagtttwtccttctggttttcttttcttttctttttttttttccgaaaaaagccagtagctttatgtattattacttcctctcttacacagaaagtagtagcatact

SEQ ID NO: 39063 - DNA, 201 bp, Homo sapiens
ttgattctcttaaatttattcttctctctttctttttctttctttctctctccctctttctctctccccccttctttctccctctttctctctccctcttytctctctccctctttctctctctccctctttctctctctccctctttctctctctccctctttctctctctccctctttctctctctccctctttctctc

SEQ ID NO: 39064 - DNA, 201 bp, Homo sapiens
ttttcagcattgaaatgctggcattcttgcagctggataactgaaggacgtttttggataattgtaattttctgatattctgcattctcccagtaccatgaaaaaaaataataattagcaagatgtaaaaattcaagagggtttttgttttctctttgagaagggcgaagcaaactggtcatcctggagccatggagggcc

SEQ ID NO: 39065 - DNA, 201 bp, Homo sapiens
tagggactgggtaaaataaggctgagaccgactgggctgcattcccaggaggttaggcattctaagtcacaggataagataggaggttggtacaagggacrggtcacaaagaccttgctgataaaacaggctgtggaaaagaagccggctaaaacccaccacagacaaggtggcaataaaaatgacctctggtcgttgtca

SEQ ID NO: 39066 - DNA, 201 bp, Homo sapiens
tttcagcattgaaatgctggcattcttgcagctggataactgaaggacgtttttggataattgtaattttctgatattctgcattctcccagtaccatgaaaaaaaataataattagcaagatgtaaaaattcaagagggtttttgttttctctttgagaagggcgaagcaaactggtcatcctggagccatggagggccc

SEQ ID NO: 39067 - DNA, 201 bp, Homo sapiens
gcatgctaaaagacactcccacgagcaccatgacagtttacaaatgccatggtgacgtcaggaacataccttatgtggtttaaaaaggggaggaaccttcrgttccggaaattgcccacccctttcccagtaaactcatgaataatccaccccttttttagcatataatcaagaaatcaccataaaaatagccaatcagca

SEQ ID NO: 39068 - DNA, 201 bp, Homo sapiens
attgaaatgctggcattcttgcagctggataactgaaggacgtttttggataattgtaattttctgatattctgcattctcccagtaccatgaaaaaaaataataattagcaagatgtaaaaattcaagagggtttttgttttctctttgagaagggcgaagcaaactggtcatcctggagccatggagggccccaggatc

SEQ ID NO: 39069 - DNA, 201 bp, Homo sapiens
ctggtctctagctgagagggcctaaggaggagataggtgctgacagagacaacatggtctttggcacataaaatcttcattcttcgggagatagagctatygtaggagtgaggagaacctaggcaacattgaactcagggttaagagacttgaatttgagttctgactctggaacttgctaattacaaggaagtcactggc

SEQ ID NO: 39070 - DNA, 201 bp, Homo sapiens
aggctgaggtaggagaattacttgagctcaggagtttaggactgcagtgagccctgatggagccactggactctagcctgggtgacagaatgagaccaccycttaaaaaaaaaaaaaaagagaatacatttgacacacctaacctaccaaacatcatagcttagtctagcctaccttaaacatgcttggagcacttacatt

SEQ ID NO: 39071 - DNA, 201 bp, Homo sapiens
gcaagatgtaaaaattcaagagggtttttgttttctctttgagaagggcgaagcaaactggtcatcctggagccatggagggccccaggatcagcccccaggggcggctgtggatctagggcctgggacctgctgaaccgtatcacaacatgcctctgagctccaaaggccagtacagacgaagcgggaggctggtgaagg

SEQ ID NO: 39072 - DNA, 201 bp, Homo sapiens
ccacatttcctgcaggctccacttactatggctgcaaaacaaattagccccaaacagtggccaggtgcaatggctcgtgcctgtaatcccagcactttagragaggccgaggaaggccaatcacttgaggccaggagttggagaccagcctggccaatatggcgaaacctcgtctctactaaaaacacaaaaattagccag

SEQ ID NO: 39073 - DNA, 201 bp, Homo sapiens
ctcaaatggtgaagaaaaagcagcatattgataaagtttttcacctattttttatttatgaataactcagcatatgacttccttgaacttatgaaaatgaaaaaaaaaaaaaaacttagcaaactggaaataggaaaggtgtgtttaatttgataaaggttatatagggccaggtgcagtggctaacacttgtagtcccag

SEQ ID NO: 39074 - DNA, 201 bp, Homo sapiens
ctgttttatgctgctgtaacagataccacagattggatgatttgcaatgagccaagatttatttcttacatttctggagatgggaagttcaagatcatggygccggcatctggcaagagccttcttgctgctgtatcataagatggcagaaagcatcagatggcagtagagcaaagagagggttagagagggccaaattca

SEQ ID NO: 39075 - DNA, 201 bp, Homo sapiens
aatccaagcactttgggaggctgaggcaggcggatcacttgaggtcaggagttcaagaccagcctagccaacatggtgaaaccccatctctactaaaaacaaaaaaaacaaaaaaacaaaacacacacacacacacacacacacacacacacacaaaaattagctagatatggtggtgcacacttgtagtcccagttactt

SEQ ID NO: 39076 - DNA, 201 bp, Homo sapiens
acaaacttttccaaaaaattgaagaggaggagattctccctaactcattctatgaggccagcattacccagatgccaaaaccagacaaggatgcaacaaaraagaaaactacagaccaatatacctgatgaacatagacacaaaaatcctcaaaaatactagcaaatcaaatccaacagcataccacaaagataatacacc

SEQ ID NO: 39077 - DNA, 201 bp, Homo sapiens
ctgaggcaggcggatcacttgaggtcaggagttcaagaccagcctagccaacatggtgaaaccccatctctactaaaaacaaaaaaaacaaaaaaacaaaacacacacacacacacacacacacacacacacacaaaaattagctagatatggtggtgcacacttgtagtcccagttacttgggatgctgaggcaggagaa

SEQ ID NO: 39078 - DNA, 201 bp, Homo sapiens
tgaggcaggcggatcacttgaggtcaggagttcaagaccagcctagccaacatggtgaaaccccatctctactaaaaacaaaaaaaacaaaaaaacaaaacacacacacacacacacacacacacacacacacaaaaattagctagatatggtggtgcacacttgtagtcccagttacttgggatgctgaggcaggagaat

SEQ ID NO: 39079 - DNA, 201 bp, Homo sapiens
tctgggtattcatataaatggaatcatatagtgtatggccttttgtgtctggcttctttcacttagcatgttttcaaggtcattgattttttttttttttrtatgtgctgttttctttgtctaaatattctacagttactgttttgatttcttctttgactcaaagcatttaggagattgtttttacatgttctattttta

SEQ ID NO: 39080 - DNA, 201 bp, Homo sapiens
gaggcaggcggatcacttgaggtcaggagttcaagaccagcctagccaacatggtgaaaccccatctctactaaaaacaaaaaaaacaaaaaaacaaaacacacacacacacacacacacacacacacacacaaaaattagctagatatggtggtgcacacttgtagtcccagttacttgggatgctgaggcaggagaatc

SEQ ID NO: 39081 - DNA, 201 bp, Homo sapiens
aggcaggcggatcacttgaggtcaggagttcaagaccagcctagccaacatggtgaaaccccatctctactaaaaacaaaaaaaacaaaaaaacaaaacacacacacacacacacacacacacacacacacaaaaattagctagatatggtggtgcacacttgtagtcccagttacttgggatgctgaggcaggagaatca

SEQ ID NO: 39082 - DNA, 201 bp, Homo sapiens
aaaaaaaaaaaaaaaaaaaaaaagatgagatctcactatgtttctcaggctggtcttgagctcctaagctcaagtgatcctcctgtcttggcctctcaaartgctaggattacaggtgtggaccactgtacccagtcaatcccatttatttaattaatccatctatttgtctccttatttggtgttaataatacagtcatg

SEQ ID NO: 39083 - DNA, 201 bp, Homo sapiens
ccatgccctccagctgatttgatggtgtccgccaagattgagggcacatcttcctcactcatccacagactgacacaccagtctcctttggaaacacactygcagacactttcagaaattatgccttgccagctatgtaggtagcccttcgtttagttagttgacacctaaaattagccaacacagtgagtaatcacatta

SEQ ID NO: 39084 - DNA, 201 bp, Homo sapiens
cttgagctcctaagctcaagtgatcctcctgtcttggcctctcaaaatgctaggattacaggtgtggaccactgtacccagtcaatcccatttatttaattaatccatctatttgtctccttatttggtgttaataatacagtcatgtggcttgaaaattttaaattccagtgaaaagatgtcttctcttctactcttcca

SEQ ID NO: 39085 - DNA, 201 bp, Homo sapiens
ttgagctcctaagctcaagtgatcctcctgtcttggcctctcaaaatgctaggattacaggtgtggaccactgtacccagtcaatcccatttatttaattaatccatctatttgtctccttatttggtgttaataatacagtcatgtggcttgaaaattttaaattccagtgaaaagatgtcttctcttctactcttccac

SEQ ID NO: 39086 - DNA, 201 bp, Homo sapiens
tccataaaaatccaagaggactgggttcagagagatccagatagctgaacacatgcaggctgacaggaagaacgcattcatgggcctggagggtggtgtaycccaactccatggggacagaagctcctgtgctggagacccttccagaactcgctagaggtctcttcatctggctgtttatttgtatcctttaaaatatcc

SEQ ID NO: 39087 - DNA, 201 bp, Homo sapiens
tgagctcctaagctcaagtgatcctcctgtcttggcctctcaaaatgctaggattacaggtgtggaccactgtacccagtcaatcccatttatttaattaatccatctatttgtctccttatttggtgttaataatacagtcatgtggcttgaaaattttaaattccagtgaaaagatgtcttctcttctactcttccaca

SEQ ID NO: 39088 - DNA, 201 bp, Homo sapiens
cgaaggtaccactcaaaggtgggcatgacggtgtaaaatcccaattgaggaagggtagatacatgtaaaataggtgaagggtagggatcaatcaggggaargcacaccaaatgggaagagaggttctcaatctggtccaaggatttacccaggacttgtagctagggttcaaacagtctttggcttgaaggtcaggtttca

SEQ ID NO: 39089 - DNA, 201 bp, Homo sapiens
ccttttttttttttttcctgagatggagtctcgctctgtcgcccaggctggagtgcagtggtgcaatcttggctcactgtaacctctgcctcccaggttcmagcaattctcctgcctcagcctcctgagtagctaggatcacaggtgtgtaccaccaggcccggctaatttttgtattttttatagagacagggtttcacc

SEQ ID NO: 39090 - DNA, 201 bp, Homo sapiens
aagcctctggaagacagggctacatctttagatatgtaaagagctgtcatatgggagaagaattaaatttgctctagataatgcagcaggaaataccaggwccagcagctaaatatttttaggaaaaaaagttaattcaggaggaaggaaaatgtagaggccccagaagcagcctagaggtactgtagtgaagtggaagtg

SEQ ID NO: 39091 - DNA, 201 bp, Homo sapiens
ctcaattttcctgggtttcaatcccctcatgtataaaggaaggataatgatactttattttggggagtctcgctctgtcacccaggctggattgcagtggygcaatcttggctcactgcaacccctgccttccaggttcaagcgattctggtgtctcagcctcctgagtagctaggattacagacgcgcatcaccatgtct

SEQ ID NO: 39092 - DNA, 201 bp, Homo sapiens
aaatggttggtttaagtggttggacccttaaatggtttttaagtacaaggagagattagtgagagaggtgtgtttttttgttgttgtttgttttttgagayggagtctcgctctgttgcccaggctggagtacagtggcgtgatctcagctcactgcaacctccgcctcccgggttcaagcaattctcctgcctcagcctc

SEQ ID NO: 39093 - DNA, 201 bp, Homo sapiens
gtttgctctaattcagtaatttattattttgaaaaataatttactattattaaataatagttttaaacttagaagaacagagccactgttggttttctacyctctggctccaacaatattgtgaatctaaactgtaactgataaactgtagtgacactgagaaaagagagatgtcatagctcttcccttgccttgtatttt

SEQ ID NO: 39094 - DNA, 201 bp, Homo sapiens
ggtttaagtggttggacccttaaatggtttttaagtacaaggagagattagtgagagaggtgtgtttttttgttgttgtttgttttttgagatggagtctygctctgttgcccaggctggagtacagtggcgtgatctcagctcactgcaacctccgcctcccgggttcaagcaattctcctgcctcagcctcccgagtag

SEQ ID NO: 39095 - DNA, 201 bp, Homo sapiens
tacatgtgtatgccaccatgcctggctaatttttgtatttttagtagagacagggttttgccgtgttgaccgggctggtctcaaactcctaacctcaagtraaccacctacctcagcctcccaaaatgctgggattacagttgtaatttctttataaaatagcaaccacagaggtatgaggagtgtaagtgaaacttttaa

SEQ ID NO: 39096 - DNA, 201 bp, Homo sapiens
tgaggcaggagaatcgcttgaacccaggaggtggaggttgcagtgagccaagatcgtgccattgcactccagcctgggcaacagagcgagactttgtctcaaaaaaaaaaaaaaaaaaagaaagaaaaaatttgtatttctagttaagttcccaggtgatcctgctcctgctcacaggatgtagaacatttgttcaaactg

SEQ ID NO: 39097 - DNA, 201 bp, Homo sapiens
acatatctcatgaggatcctgcagggtttttgttgttgttgttttatgagacaaggtctcactctgtcacctaggctggagtgcagtggtgtgatcatggytcactgcagccttgaccttctgggttcaagtgatcctcccatctcagccccctgactagctgggaccacaggtgcatgccactgcacgggcctaattttt

SEQ ID NO: 39098 - DNA, 201 bp, Homo sapiens
ctgggaccacaggtgcatgccactgcacgggcctaatttttaaaatgttttgtagagatcaggactcaccatgttgctcaggctgatcttgaactcctggyctcaagtaatccttctgcctcagcctcccaaagtgctgggattacaggcatgagccaccataccaagcctctgcagttatttttgttgagaattatatag

SEQ ID NO: 39099 - DNA, 201 bp, Homo sapiens
caccatgttgctcaggctgatcttgaactcctggcctcaagtaatccttctgcctcagcctcccaaagtgctgggattacaggcatgagccaccataccargcctctgcagttatttttgttgagaattatatagggcccgttcaattgtatttttctcaaattcaagccaatcagaatggcacctttcacctcaatttta

SEQ ID NO: 39100 - DNA, 201 bp, Homo sapiens
agcctgggctcctggccttaatggggcagggaggggaccatcggggcacagagccagggatcctgttactctctacatagaggtgccaagtaggctacttwttcaagttttcttttttaaaaaaactttctttccattctatgactctttaagggaagaaattccattgtgcactgtaacactgaggacttttacaccaga

SEQ ID NO: 39101 - DNA, 201 bp, Homo sapiens
tcctagaaggtggatagtactggattcctgtaactgtctcctctaaaggcagaaggtctagggtaggtccctgattcgatgtggttcctgggaagctcacycctcccctctcaagggctttcctaggacagaacccctcttacctgcccctgtatcccaggcgaagatgggcttaccttggatgtcacaggaactcatttg

SEQ ID NO: 39102 - DNA, 201 bp, Homo sapiens
gcctgggctcctggccttaatggggcagggaggggaccatcggggcacagagccagggatcctgttactctctacatagaggtgccaagtaggctacttattcaagttttcttttttaaaaaaactttctttccattctatgactctttaagggaagaaattccattgtgcactgtaacactgaggacttttacaccagag

SEQ ID NO: 39103 - DNA, 201 bp, Homo sapiens
cctgggctcctggccttaatggggcagggaggggaccatcggggcacagagccagggatcctgttactctctacatagaggtgccaagtaggctacttattcaagttttcttttttaaaaaaactttctttccattctatgactctttaagggaagaaattccattgtgcactgtaacactgaggacttttacaccagaga

SEQ ID NO: 39104 - DNA, 201 bp, Homo sapiens
ctgggctcctggccttaatggggcagggaggggaccatcggggcacagagccagggatcctgttactctctacatagaggtgccaagtaggctacttattsaagttttcttttttaaaaaaactttctttccattctatgactctttaagggaagaaattccattgtgcactgtaacactgaggacttttacaccagagag

SEQ ID NO: 39105 - DNA, 201 bp, Homo sapiens
agatacttagtcaaatttatagaaataacaagtagaatggtggttaccaaggacttaggggagggggaaaaggggaggggttgtttaatggtgatatggtytggctgtgtccctacccaaatctcatcttggattgtagctcccacaattcccacgtctcatgggagggaccctgtgggaggtaattgaatcatgaggagt

SEQ ID NO: 39106 - DNA, 201 bp, Homo sapiens
gatcccctgagctggagaagtcaaggctgcagtaagctgagatcataccactgcactccagcctgagtgacagtgtgagaccccaactcaaaaaaaaaaamcagaaaaacccattacagacacagtgaaaatttccttaaaacacatcccccctccattattgaggtatagcatagatggttaatttatttttaacaaata

SEQ ID NO: 39107 - DNA, 201 bp, Homo sapiens
atgcttattgtgggcaatttagaatatgcaaaaaagtataaagaagaaaaataaatactcatgaaggtatcacccagaggtaactactgtctatatactaytcacacagaattttatttttgaaatgaagctttcttttgttgacgttttctcactttttgtgaacattttcccatatgattaaaaatctttgaaaatgtc

SEQ ID NO: 39108 - DNA, 201 bp, Homo sapiens
gatgatactgtttgtttctaaattaacgaactttagttgttagagcagttttcagttaacagaaatttgggaagctagtgcagcgttcccatataacctcycaccgctccctcagtttcccctgttattaatatcttgcatttgtcacaattgataaaccagtattgatatattagtattcactacatttcatggcttata

SEQ ID NO: 39109 - DNA, 201 bp, Homo sapiens
gcctcgcccacccaaagagctaggattacaggtgtgagccactctgcctgacccttctttgattttgatcttagggggaaagcttcaagataaaatgatattttttttttctgtgtttaggcttttgcccttgaatctaccatgttttgtattattatccttttttttttttaagcttttcgttagcatttgtctgacata

SEQ ID NO: 39110 - DNA, 201 bp, Homo sapiens
ttttgggaggccaaggcgggagaatcacttgagcccaggagttcaagaccaccctgggcaacatggtgaaaactccatctctacaaaaaaaaatacaaaamttagccaggcatggtggtgcatatgtcaccagctactcaggagctgaggccagaggagcctgggaggttgaggctgcagtgagctgtgactgcaccactg

SEQ ID NO: 39111 - DNA, 201 bp, Homo sapiens
tactcaggagctgaggccagaggagcctgggaggttgaggctgcagtgagctgtgactgcaccactgcactccagcctgagtgactaagcaagaccctgtytcaaaaagaaaaaaaaaaaatgaaaagggaaattaaaataaaaaaaaaaaaccacacacactgcaaagtctcactttcattccatcctgttcttgtcgaa

SEQ ID NO: 39112 - DNA, 201 bp, Homo sapiens
caatattgctattgtgacatatggtggttttaaaatacgcctaaaaattctttactactctgctcttcaagtgatgaaattagctgagcatggtggcatgyacctgtagtcctagctactcaggagactgaggcaggaggatcacttgagtccaggagttcaagtctgcagtaagctatgatcatgccactgcactccagc

SEQ ID NO: 39113 - DNA, 201 bp, Homo sapiens
gaactggagtgacctggtgcctggattctttcatctctaaaatgggaaaaataattgttgcacatatatggtgttgaaattatggccctcaattggtgataattatcattacttagtattaataattattatttgtgaaacttctcccagaattgctgcatggattgcaatgtccaaataagcttataatggggcttccag

SEQ ID NO: 39114 - DNA, 201 bp, Homo sapiens
ctggagtgcagtggtgtgatctcacctcgctgcaacctccgcctcccgggttcaagtgattctcctgcctcagcctccagagtagcggggtttacaggcaygtgccaccacactcagctaacttttgtacttttagtagagacgggttttcaccatgttggtcaggctggtctctaactcctgacctcgtaatctacccgc

SEQ ID NO: 39115 - DNA, 201 bp, Homo sapiens
ggtgtgatctcacctcgctgcaacctccgcctcccgggttcaagtgattctcctgcctcagcctccagagtagcggggtttacaggcacgtgccaccacaytcagctaacttttgtacttttagtagagacgggttttcaccatgttggtcaggctggtctctaactcctgacctcgtaatctacccgcctcaggttccca

SEQ ID NO: 39116 - DNA, 201 bp, Homo sapiens
aaaatacaaaaattagccaggtatggcggtgcgtgcttgtagtcccagctcccagctactcaagaagctgaggtggaaggattgcttgagcccaggaggtyaaggttttagtgagccctgatcacatcagtgcactccagcctgggcaacagagtgagactttgtctcaaacaaacaaacaaacaaacaaacaaaacgaac

SEQ ID NO: 39117 - DNA, 201 bp, Homo sapiens
tgtgtctgtaaaattgcctcttctggacatttcacataaacagaaacatataaaatgtggccttttatgacttgttcttttacttagtataatgttttttwttttcgagacagagtctcactctgttacccaggaggctgcagtatagtggcatgatcttggctcaccacaacctccacctccccagttcaagcaatgctc

SEQ ID NO: 39118 - DNA, 201 bp, Homo sapiens
ctgtaaaattgcctcttctggacatttcacataaacagaaacatataaaatgtggccttttatgacttgttcttttacttagtataatgtttttttttttygagacagagtctcactctgttacccaggaggctgcagtatagtggcatgatcttggctcaccacaacctccacctccccagttcaagcaatgctcatgcc

SEQ ID NO: 39119 - DNA, 201 bp, Homo sapiens
gcttgctatgagcatttgtggatgcatttttgctcgagcacctgtttcaattctttcagttatattatttttatttatttatttcttattgagacagggtstcaatccgtcacccaggctggagtgcaatggcatgatcttggctcactgcaacctcagcctcctgggctcaagtaatcctcctgcctcagcctcctgagt

SEQ ID NO: 39120 - DNA, 201 bp, Homo sapiens
tgacttatgtaccagatactttgtttcgaggacttaggggtgtctcctggaactgcacaccagtcagcttcatgaagaactggaagcagtgcagaaagccrggaatacaggggcctcttttttctctctggggcttaccatctacttctccctgcctcctctagtcttctcttctttggctgactgaccttggtgtgcaca

SEQ ID NO: 39121 - DNA, 201 bp, Homo sapiens
tcctggaactgcacaccagtcagcttcatgaagaactggaagcagtgcagaaagccgggaatacaggggcctcttttttctctctggggcttaccatctamttctccctgcctcctctagtcttctcttctttggctgactgaccttggtgtgcacactccatgtggctgccctcccttgctttgtattactccccaactc

SEQ ID NO: 39122 - DNA, 201 bp, Homo sapiens
gaaaagtgggaactgattttaacgggaagattattctaggatggtgggggtaaaaagaaagagccccttgggctttggacgtcagaaaaatctgccttctrttaccaattctggctttgagcaggttgactcctctcttactgtgcctcagtttccttttctgtaaaatggggctactgaaccagagcagtggttctgaat

SEQ ID NO: 39123 - DNA, 201 bp, Homo sapiens
agtagagacaaggtttcaccatgttggccaggctggtcttgaactgctgacctcaagtgatctgcccacctcagcctcccaaagtgctgggattacagatstgagccaccatgcccagcctctaattttttcttttgttgcttgtgttttttgtgtcatttcttaagccaatgccaactctgaggtcatggacatttacct

SEQ ID NO: 39124 - DNA, 201 bp, Homo sapiens
tgcccacatggtccctttgggcccagtaatgctgttatcttcatgtcatgtttgggattcaggcactgtttgtgagtctgcttgtagtcacaagccagcamcgattccttcctggggacgtgccacctctcaggaagcagaaccatgctccctgctgatcagagaccctcaggcctctctcttcttcttccccaccaagat

SEQ ID NO: 39125 - DNA, 201 bp, Homo sapiens
agaagcgttccgcggaccgcagagagatggggctcaggccagcatccctctcgctccggcccttcccgggaggagctggccgagctaggatggggggcagrgagaccgagggggcagtaactgtcaaacctcgccgcttggcgccattatttaaatggaacgtgcctgtctcgcagctgtacgtgcccggggcggggcttc

SEQ ID NO: 39126 - DNA, 201 bp, Homo sapiens
accttggcaactacatgttgaaggtggcagagtttctatcagcttgaattcctggcagagacccttcctccgtgccccacaaccaaacattgaactttacrtgaaaaagaaattaacctcgattgtctaagtgttcagctactcttagttaaaagtttatttgctacagttgctagtgtgacttaaactaatactgttttg

SEQ ID NO: 39127 - DNA, 201 bp, Homo sapiens
ttgcaccactttactccagcctgggtgacagagtgagactccatctcaaaaaaaaaaaaaatacacagacacacacacacacacacacacacacacacacrcacacacagacacacacagctatatgattccaattgtatacaaattataaattatttagtaatccataaactcttgctgtatatttcaaagctatgttgt

SEQ ID NO: 39128 - DNA, 201 bp, Homo sapiens
gtttgagtcatgggggcagatgacttaagaatggcttggtgccctccttgccataaggagtgagttctggctctgagagttcatcgagatgggattgtttraaggagtgtggccccctccctccatcccttgcttccattcttgccatgtgatgtgcctgctcccacttcaccttgtgccatgagcggaagcttcctgagg

SEQ ID NO: 39129 - DNA, 201 bp, Homo sapiens
tggccactgccactcctaacccaagcattccaccagaggcctggaagttgccccatctctgcctatcatgacagacacctgcacacaccactggggaaccctgaggacaaactcacatggcaccagcttcacctcacccttgccagagcatgcagttcagggcactgaagattacccagtccactaccattgacacctgac

SEQ ID NO: 39130 - DNA, 201 bp, Homo sapiens
ggccactgccactcctaacccaagcattccaccagaggcctggaagttgccccatctctgcctatcatgacagacacctgcacacaccactggggaaccctgaggacaaactcacatggcaccagcttcacctcacccttgccagagcatgcagttcagggcactgaagattacccagtccactaccattgacacctgacc

SEQ ID NO: 39131 - DNA, 201 bp, Homo sapiens
agaattttttctttatctttgatgttgtgcagtttcactatgatgagtccagatgtgggttaaaaaattattttattggtacctagtgaaacctttcaatytgagaacctactttttaaaaaatactggaaaatctctagttattatttctttaaatgatactttctccctgttatctctggcctgtaattctagaactct

SEQ ID NO: 39132 - DNA, 201 bp, Homo sapiens
ccttgacacttggggattattacaattcaaggtgacatttggttggggacacagacccaaaccatatcatatatatatatatacgtatatatatatattcatatatatatatactatatatatattcatatatatatacatatatattcatatatatacatatatatatgaatatatatattcatatatatattcatatat

SEQ ID NO: 39133 - DNA, 201 bp, Homo sapiens; identical to SEQ ID NO: 8644

SEQ ID NO: 39134 - DNA, 201 bp, Homo sapiens
ctgttatctctggcctgtaattctagaactcttattagatgaatattgaatctattcgctatatctttaccttttgtttctttttaaaatccatctctctwacttcgtgttgcattctgaaagaattcccataccacatcttccagttccctgattcaccctttaactgtgttcattctgctactagcccatgtatttttt

SEQ ID NO: 39135 - DNA, 201 bp, Homo sapiens
cttgacacttggggattattacaattcaaggtgacatttggttggggacacagacccaaaccatatcatatatatatatatacgtatatatatatattcatatatatatatactatatatatattcatatatatatacatatatattcatatatatacatatatatatgaatatatatattcatatatatattcatatata

SEQ ID NO: 39136 - DNA, 201 bp, Homo sapiens
cttctagcacagagtgtgtgtcaactgccctggcagcccctgaaggctcagtattcagaaaagagaaagtagctgggagataccagggctgacatgtgctstctgttttctagaaggctatggagcttccataaagatatatttcatgtgaaacctttccccttttagatttcataagttattttatttacatacacttat

SEQ ID NO: 39137 - DNA, 201 bp, Homo sapiens
gattattacaattcaaggtgacatttggttggggacacagacccaaaccatatcatatatatatatatacgtatatatatatattcatatatatatatacwatatatatattcatatatatatacatatatattcatatatatacatatatatatgaatatatatattcatatatatattcatatatatatgaatatatat

SEQ ID NO: 39138 - DNA, 201 bp, Homo sapiens
gatgcaggcccacatcttaggacttcagtgccaggagttcacaaaaggcctctgcagcacctcctctcccattatcatgccctctctacccctccaagccmctttgtccaaatactcaactgcttgctattctgcagacacacagtcctttttgcctacaattccccatcactggagtgcccgtcatcactgcccttcttg

SEQ ID NO: 39139 - DNA, 201 bp, Homo sapiens
aaccatatcatatatatatatatacgtatatatatatattcatatatatatatactatatatatattcatatatatatacatatatattcatatatatacatatatatatgaatatatatattcatatatatattcatatatatatgaatatatatatgaatatatatatatatagcaatgtcatattttaaaatgtgcat

SEQ ID NO: 39140 - DNA, 201 bp, Homo sapiens
ccgctcaagtccagcgggcgcaccaacctttgccactccgtcggctttccctcttggccgcggggtagggctgggcgtctttgggccgccgcagggcgccmccctaatcgcctgtcatttctcggccgtcgcaggtgttcgcgcccgagagggatgagcacgtgaagagcgcggcggtggcgctggggcccgcggcctcct

SEQ ID NO: 39141 - DNA, 201 bp, Homo sapiens
aatttcagttaaggaactctgattgaaaattaattgcattgtacccaatctgggagttgtaagaactctcggagtttggacagctggggtgagaaggctcrgagagcaagaatttggccatgtgtctccaacactatccaggggagaaggtaggctcactataaatccccttcaagccttcccccaaaggggagtgaatgc

SEQ ID NO: 39142 - DNA, 201 bp, Homo sapiens
ttgttggctgtcccttcactctcccaactccaagagaattgattcagggcaactcccttttgctcacattaaaaagaaataataagcttttttttcttctyagacagagtctcgctctgtcacccaggctggagtgcagtggtgtgatcttggctcagtgcaacctctgccccctgggttcaagcaattctcctgcctcag

SEQ ID NO: 39143 - DNA, 201 bp, Homo sapiens
ggaatattatagttcttttccttgtatttttctaacgccactacattttggggggcttatccaccttagtacctactaagttcaaatttggactaagtctktagctcggttgtgcattttgaacttcatcttaaattggtcatggcccattgctactgcttcacatttcctccgtcgtgttttctcttttattgcttctat

SEQ ID NO: 39144 - DNA, 201 bp, Homo sapiens
atgaccctggtgcagctaaacaatccagacttcctccatttccttcctggggccattcctcaggcccatccttttctctgtccctcttgtccaccggatcyttctgctccctgccatggcttctggagcacaagagagatgagggaactcaagcaaatgtataaatgattgaaggcattgagagctcatggtatctaatag

SEQ ID NO: 39145 - DNA, 201 bp, Homo sapiens
ttttttgaggaataaacaatttctgtatactacaaaatgttctcagttattaaaaagtaagcaggccaaagaggaatacaaagaaacaaaggtaacacttaaaaaaaaaaaaaaaaaagctatcattcagtttcactttttgaatatagttgtgttccttaaaatattaactggtagaatttatcagaatattggaggaat

SEQ ID NO: 39146 - DNA, 201 bp, Homo sapiens
tactttcaagttacggtaagcatatgatagtccattttaaaacataattttaaaactgcaaactacccaagaaattattactttctacgtcacgtattttrtactaatatctttgtgtttacagtcaaattaattctaattatctctctaacagccttgtatcgtatatgcaaatatgaaggaatcatgggaaataggccc

SEQ ID NO: 39147 - DNA, 201 bp, Homo sapiens
actttctacgtcacgtattttgtactaatatctttgtgtttacagtcaaattaattctaattatctctctaacagccttgtatcgtatatgcaaatatgawggaatcatgggaaataggccctcttcctgcccgaccttggcgcgcgctcggcgcgcggtcacgctccgtcacgtggtgcgttttgcctgcgcgtctttcc

SEQ ID NO: 39148 - DNA, 201 bp, Homo sapiens
tattggagatacttggctatttgtacctcacctgcccatgaaggctaaaaatggatggttaaacacctgtctctgtgctcatgatgaaaatgacctttgcaaaaaaaaaaaaaaaaaaaagaataaacaaaagaaacacaaacaaaaaaactttagaaaataacctttgcttctagaccttctaaatttttctgaatggag

SEQ ID NO: 39149 - DNA, 201 bp, Homo sapiens
aattatggcagcatgatttgtaatagccaaaaagtaaaaacaacccgaatgcccaacaataggaaactggataaataaatggagtattgtcatagaatggwatgcttaacagctgtgaagataaatggattccagttacagcagtggttctcaaacaggggtgattttatcctccacccgggggacatttggcagtgtctg

SEQ ID NO: 39150 - DNA, 201 bp, Homo sapiens
gaacctattaaatccagccaaaccatatcagttacccagtctcaggtatttcttgatagcaatgcaagtatggcctaacacaggctcttacccccatctcrctcagtttaaccatagggcacctataagccgccacagggcatgcccacagttgaggtgactctctgcagctgaggcaaggactctgctttgggaagaata

SEQ ID NO: 39151 - DNA, 201 bp, Homo sapiens
aggtatgcaggctgggctgggcagtgcacatgatgggtacggtatgcaggtcaccatatctgatagtgatggttatcttgagtaatgggccacctgatcgyatggccagaggcaacaaggctgtaaatcaattgttcagcattcctgccctaggtgggacttggcgccaccttgatgagatatctgggtcttctgaggcca

SEQ ID NO: 39152 - DNA, 201 bp, Homo sapiens
tagcagatctggtaaggtaggtgtattagtctgttttcatgctgctgataaagacatatccgagactgggtaatttataaagaaaaagaggtttaatggawtcacagttccacgtggctgtggaggcctcacaatcatggtggaaggcgaaaggcatgtcttacctgatggcaggcaagagagaatggaagctatacaaaa

SEQ ID NO: 39153 - DNA, 201 bp, Homo sapiens
aaggtaggtgtattagtctgttttcatgctgctgataaagacatatccgagactgggtaatttataaagaaaaagaggtttaatggattcacagttccacktggctgtggaggcctcacaatcatggtggaaggcgaaaggcatgtcttacctgatggcaggcaagagagaatggaagctatacaaaagggaaaacccctt

SEQ ID NO: 39154 - DNA, 201 bp, Homo sapiens
tacaattcaagatgagatttgggtgggggcacaaatcctaaccatatcagtggggtcactaaggtatataggtatatagtgtagtaagatggtgtcacctkaatcacatttacactctgccccggcacagaaccctgggagctgaatattgaggagcagagaggaacagggatcagaggcacaaaatttggcttgctcttg

SEQ ID NO: 39155 - DNA, 201 bp, Homo sapiens
tcagaaaattgatccattcatttccagtgacaaagatcctttgcttgaccaaacttttagtcaggctcctgaacctcctcctaagcccatccatgcacttycttgtacaatccagtttcagcaaagaaccctgctaagtcaatttagcaagaaccccctaccctatccagtcaacctcagtatctgatctggtttcgtttc

SEQ ID NO: 39156 - DNA, 201 bp, Homo sapiens
agagttgagccccatctctcttccccactgcaaaaccctgttgcagtggtccctatacctatcatgatagtcctgaataaagccttctttaggccggacgkggtggctcatgcctgtaatctcagcactttgggaggccaaggcaggtggctcacttgaggtcaggagttcaagaccagcctggccaacatagtgaaatcc

SEQ ID NO: 39157 - DNA, 201 bp, Homo sapiens
aaatgtatttctcaaaccatcaaattcatgaaggaaacagtctcttttgattttccctattgaaatataacttcaccagaccaatctggttcaactgtaasaaaggttaagtaacctgagcatacccagtgtgcatgaaccaagcgtgcaatcaccagaggaacctaagtgctcaaacccaaggagcggggagtgaattaa

SEQ ID NO: 39158 - DNA, 201 bp, Homo sapiens
ttgtatcacaaattctaggaacatgaagataatgggtgaggccagctagtcaggaacaaaatgcctttaaacaattgcccccagggcatgggcgggatgcrgaggtgggggtgagggatgagagtaggggcctgactgaagtcccaggtctctctgagccaagtaaattttgcatacctctcatagcttacagcagtctga

SEQ ID NO: 39159 - DNA, 201 bp, Homo sapiens
gctttaggtggggtttcaccggggacctgcccctgtctgcctaggctgccccctgttgctgtcactgtcatccctccatatccattggggatgggttctasgctccccctcaggtaccaaaatccaggactgctcaagttccttattaaaaatggcgtagtatttgcacaaaacttgtgcgcaacgtcctggatactttaa

SEQ ID NO: 39160 - DNA, 201 bp, Homo sapiens
ttttgaagtaaggttgtctagatagatgagctataattcagagattccaagggtatcttgatgactgctattttaattgaaatgtatctccaggacttggaaaaaaaaaaaaaaaagaaccatgttgtgttatatttggtaattgttaggtggttctttgtgttttaataaaacagttcatctctctccctgccccacgtt

SEQ ID NO: 39161 - DNA, 201 bp, Homo sapiens
gggctgggtgcagtggctcacgcctgtaatcccagcactttggtaggctgaggtgagtgaatcatttgagatcaggagtttgagaccagcctgaccaacakggtgaaacccaaattagccaggtgtagtggtgggcgcctgtaatcccagggactcgggagggtgaggtatgagaattgcttgagcctgggaggtggaggt

SEQ ID NO: 39162 - DNA, 201 bp, Homo sapiens; identical to SEQ ID NO: 8649

SEQ ID NO: 39163 - DNA, 201 bp, Homo sapiens
tcaaaaaaatgttatactaatctgatgttaggctctttggtaggggtggtggttgaatatggccatatgaaaatatgtgaaaaatttaataattaattacsttgacattttggttactttttgttctataattaatcaaactaatcatattttaaattggggagaaagaatgaaaggacatgtctgtttcctgatttgtct

SEQ ID NO: 39164 - DNA, 201 bp, Homo sapiens
gagattatctgggtaccaacctgggctctgataaaatccacattggtcactgtgttgagtatgtatttctttgtattttattcttcttccatggtgcccaratttaatcagctcctgctagacactgcatctggtttctgttgagtatgatgcactgaggggaaggctctggccatgcttggggctgagtggccaccatac

SEQ ID NO: 39165 - DNA, 201 bp, Homo sapiens
ggcattggagggcactagacgtgttctgtctcagctgagaggcaaggtggggtcctctgaaggaggggccagagagcaaaagtgggcacagtctgctgcckcgtctcctggacagattgacatgcaagaggcccacggtggaatatactcctagccaactaattgtaaaaatatgcagaattatagatacagagagagcct

SEQ ID NO: 39166 - DNA, 201 bp, Homo sapiens
acttggtttccgcaatcctttattttaacctgaacatttcctttctattgatcccagatcttcagataaactcaaccaattgtcaaccagaaaatgtttayatttacctatagcctggaagcccccaccttgacttgtccctcctttctgaaccaaaccaatgtatttcttaaatgtatttgattgatgtttcatatctcc

SEQ ID NO: 39167 - DNA, 201 bp, Homo sapiens
tggaatggccagggaagctattctctccccttcccttccttccttccagttctaggcattgggggatacagtggtgaagaaaacagaaagaaatcctgccmttctggaatttacattctaatgggggcaagacagacaacaaatgaaataaatacaaataacagtgtgtaagacagtgatacgtgctatggaaaaaataaa

SEQ ID NO: 39168 - DNA, 201 bp, Homo sapiens
aaatctggaaatgttcaggctgatgtcacattagccacactcataagacactattgggcatcaaaaatgagcaattacttgatattaaatggaggtagttstttagatttagtgaaatcctcgtgtctgctgcctaagacattgccttcccagaaggtaagccttgcccaggggaaatggataattctgacacatatttca

SEQ ID NO: 39169 - DNA, 201 bp, Homo sapiens
ggtaagccttgcccaggggaaatggataattctgacacatatttcatccagacatgacaggttcctgttcctaaaccaagtatgcctctccttttatcggraagcttgtgttcactaggatcaccatttcctgtgcagcattttcccctgggccatctttgcacagatgcctgggaaactattcctcttctgccagctctt

SEQ ID NO: 39170 - DNA, 201 bp, Homo sapiens
aatggataattctgacacatatttcatccagacatgacaggttcctgttcctaaaccaagtatgcctctccttttatcggaaagcttgtgttcactaggaycaccatttcctgtgcagcattttcccctgggccatctttgcacagatgcctgggaaactattcctcttctgccagctctttcttcaggcagtacaccgtg

SEQ ID NO: 39171 - DNA, 201 bp, Homo sapiens
gaaaatcaccccactttaataaaggacaaaaatcacatgaaaaaaatcacatgagtatctcaaatggtgaagaaaaagcagcatattgataaagtttttcmcctattttttatttatgaataactcagcatatgacttccttgaacttatgaaaatgaaaaaaaaaaaaaaacttagcaaactggaaataggaaaggtgtg

SEQ ID NO: 39172 - DNA, 201 bp, Homo sapiens
cacctgtaaccccagcactttgggaggctgaggttggcggaccacttgagatcaggaatttgagaccagcctggccaacatggtgaaaccccatctctacyaaaaacacaaaatttgttgggtgtgatggcgcatgcctgtaattccagctactcgggaggctgaggcaggagaatcacttgaacctcggaggcggagttt

SEQ ID NO: 39173 - DNA, 201 bp, Homo sapiens
gtttgaaggagtgtggccccctccctccatcccttgcttccattcttgccatgtgatgtgcctgctcccacttcaccttgtgccatgagcggaagcttccygaggccttcaccagaagcagatgccggtgctatgcttcttgtacagcttgcagaactgtgagccaaaataaatctcttttctttatatattacccagcct

SEQ ID NO: 39174 - DNA, 201 bp, Homo sapiens
gccatgtgatgtgcctgctcccacttcaccttgtgccatgagcggaagcttcctgaggccttcaccagaagcagatgccggtgctatgcttcttgtacagsttgcagaactgtgagccaaaataaatctcttttctttatatattacccagcctcaagtatttctttatagcaatatgaaacggaccaacacacatcaaat

SEQ ID NO: 39175 - DNA, 201 bp, Homo sapiens
ggatttctttgaaataggcagtagagacaattttaaagtacttagttgtctttaaccatcaatttcagaagtagtattaattgccactgcactttttgctrgatgtttatgactatatttccccttccatgttaaaaattgtgcaactcctgttacttttgattccctctactcttggtttcagtagtgtcacatgaaaag

SEQ ID NO: 39176 - DNA, 201 bp, Homo sapiens
taaatgattaaatttgaagtttgaaataataggattataagtgagctggcctttatttgcttaagtaaaccataagaagggggttataataaagtgtcatwtaatagtgtaaattatattattggaatactaatgttttacattttgttttttctctaagcaaatggttatgagccttagagtttctgaactccaagtact

SEQ ID NO: 39177 - DNA, 201 bp, Homo sapiens
cttgagctttgatgtatgctagttaaatttcagctgatttttttcaagtggagaagtgcatgctttacaggcatgcacatgcacatgcacactcatgattrcggttatataatataagtgcttgaaatttattttactgtgttgttccatcatttgatttgtagtctagcatatagaattcaatatattaatcaacttgta

SEQ ID NO: 39178 - DNA, 201 bp, Homo sapiens
agtttattggctcaataaatatttgttgaagggcaatgcttattgaatgtgaaaaatatttattgaaaaaagattttatgtaattagtcttcagggtgtargatgagtatattttaaggctctgtttttataaattctttaacattattaagactttttctgtacttcattaaatgaagtggctacatttgtcacataact

SEQ ID NO: 39179 - DNA, 201 bp, Homo sapiens
gcgaaccctgtctctactaaaaatgcaaaaattagccaggcatggtggcacctgcctgtaatcccagctacttgggaggctgagacaggagaattgcttgygagactgtttctcaaaaaatacaaagattaaaattgagtagaaatgcagtaagggagtctaatgaagctgtttaatactttgtgagcccagagtaaaaga

SEQ ID NO: 39180 - DNA, 201 bp, Homo sapiens
catgcttttgcttcattcaatccactgaaacttctcttgtcaagaacacctgtgatgccaaaccccatgatctgttcctagtctccaggttccttgatctrttagtacttgacacagttgatgaggttctcctgcttgtgcactttgtcacttgacttccaggattccacactctcttgattttcctcctatcatgctagt

SEQ ID NO: 39181 - DNA, 201 bp, Homo sapiens
cccctttccccaccgcggattgcacctttggaagctgcacttttcttctctgtaaaatgggcataaccattaccacccaggcaggaagttccgtggctgcrgctcgacagaggagccaggcaaatgctccttcccacccttccttcccaactccccccaaagtggaaaagctcctaggcagctggggccctccggaaggga

SEQ ID NO: 39182 - DNA, 201 bp, Homo sapiens
gttccaagtctgaaactagaggtaaagatacaaacaaaaatgtctattcagggaattagaagctactgaataagcacacaagaaatgtctactcacttttrtataccattggtttacaactgtgatccttggttactggctgcatgggatgttagtaggtgctctttgaccatgccccattaagttaaaaaacttaaattt

SEQ ID NO: 39183 - DNA, 201 bp, Homo sapiens
catctgttttgtttgcttatggttatctgctcttagtccccatactccatactccaaatcttgaattaaactgctttgggttgattttagttaatctgtcrctaatggatggatccttttaggccttctcattttattgattgtccagaagccagtagatgggctatccctgggaaaattatgctccctgatcctgtcagc

SEQ ID NO: 39184 - DNA, 201 bp, Homo sapiens
caatttactgtctttgatttctttcctcctttctctcatgaaccctttccaggtaggtttttgactagctcatgccaaagaaactgttgttatctaggtcrtcagtgaccattataccaccaaaaaaaagtagtcatttcccagtttggaagaattaaatctttttaaaaaatgtaaagaatgcctactacagcctaatag

SEQ ID NO: 39185 - DNA, 201 bp, Homo sapiens
cactgtccagtgtcggcaaggaaatctagaactctcatataccatttggttatgcaaatgaaaattggtacatttctggaagcaatttgacaatttttacragagctttaaaattgtgttcgtcttttgacttgcccattctgtttctaagagtatgtctcagggaaataacacacaaatgcatgatgcatccacccacat

SEQ ID NO: 39186 - DNA, 201 bp, Homo sapiens
tgcttgggagtctttatagactcctttgattaagtctaccaggagaccagctactaactcagtaaactaatctgaggaataatgtaaagttagaataactrggataggtagagttaaactccagagaaaaaaggtgatgaaaagtataaggcaagcttattaaggatgggcttattaggaacctgataaaaggatgtgata

SEQ ID NO: 39187 - DNA, 201 bp, Homo sapiens
tatactaattattgctgattgcggggctcgtagctactttaattagtttaccagattctaattaagttaaatgaaacattaatagggaaaatatgctttgaaaaaaaaaacccaggatttaaaaaaagtctatttctcgccacaatgttgccaccttgcgacagattttaagcattacagccaacgcccgaaggcccagac

SEQ ID NO: 39188 - DNA, 201 bp, Homo sapiens
taggtggcaactattggatggtttagaactctgccaagctaaaaggataatgtgagatttacctgaactcatgaagtgaaatgcaatcctagaggctagtragttgctgctaggaaataacaatgaaaaaaatcctttcacagtggttctaaaacactttataaatcctatttcttttaattatttaatcattttattttg

SEQ ID NO: 39189 - DNA, 201 bp, Homo sapiens
cattcaacacgtttcttaaccttgctaagtcttattttcccacctgaaaagtgagaacagtacctgcctgataattatgacaattgatgatgaatcctgtaaaaaaaaaaaaaaacacccagttactcaggaggccgaggcaggatcacttgagcctaggtgtttgagaacagtctgggcaacatagcaagaccctatctc

SEQ ID NO: 39190 - DNA, 201 bp, Homo sapiens
tgggactacaggcgcaccatgctgggctaatttttgtatgtttagtagggatggggtttcactatgttggccaggctggtcttgaactcttgaccttgtgmtctgcccgccttgacctccgaaagtgctgcgattacaggcttgagccaccgcgcctggtcattttttaaacctgaatgtgacatcaagctttatagaccc

SEQ ID NO: 39191 - DNA, 201 bp, Homo sapiens
aatgtgacatcaagctttatagacccagttccagttttgaatttctttttttttgagcagttctatctgacttttgcaggatgaaggaagggcagttgtcyagctaactagagaggatgaatggacctggggatctgataacttcataagcaggttttcaagaaattccccttgctttagctatattctgttagccccact

SEQ ID NO: 39192 - DNA, 201 bp, Homo sapiens
gattttatttgaaaagtgaatgatgattgttctcatgatcaagtacagtactaatttttaaaagacctacctgtttgtagaatattgaacatggcctgtastttttctttgcagtatttcttggtcctgtctcctgtatttccactgcacagttccttcttaccttacatgtagataaatcctgcgtgttgccatgtcttt

SEQ ID NO: 39193 - DNA, 201 bp, Homo sapiens
taagtacctcttagcaaagtacttgtacatactatatatgtagcttatacataaactattgtactcatatgttgtaaagcatataggacattcccagtacraagaaatggtaaacatttgggatgatgtgtgtgctaattcccttgatctgatcgctatatactgtatgtgtcaaaacatcaccgtgaaccccattaatat

SEQ ID NO: 39194 - DNA, 201 bp, Homo sapiens
gtgaaccccattaatatgtataattattatttgtcagttaatttttttaacctataggaaaaataagagtttaaaaagattaagattttatataacatttyagtttttttataaattagatttcaggttttatgtaaaatctcatctttataaaactttgttttgcagatagatacttttttctgtatccctgtggattgt

SEQ ID NO: 39195 - DNA, 201 bp, Homo sapiens
tcagaggcacaaaatttggcttgctcttgtagatagcaatagagatgggcacaaggcagagtgaaatctcatcagagtagtgagtgcttagcacatataargcactgtccttagtgccgtaagagataacaagagaaggtaagatagattaaaatgtattgtgtttgttttatgttactcactttatacatactagcagtc

SEQ ID NO: 39196 - DNA, 201 bp, Homo sapiens
ggctgatctcaaactcttgggctcaagcaattctcctgcctctatctcctgaagtgctagaattataggcatgagccattgtgcctgcccccaagaatttrcctttcttaaacagctctcctctctgcagttgtttaccctcccaactcatcctaatagagttatattgtaattatcagttacattaatattcaatgttta

SEQ ID NO: 39197 - DNA, 201 bp, Homo sapiens
atgctgggattacagttgtaatttctttataaaatagcaaccacagaggtatgaggagtgtaagtgaaacttttaagttgtcaagtgttatgcaaacatgmgggcctctcagcatctggggcattggagggcactagacgtgttctgtctcagctgagaggcaaggtggggtcctctgaaggaggggccagagagcaaaag

SEQ ID NO: 39198 - DNA, 201 bp, Homo sapiens
aatttgggatccaaattttagccatgtttatcattatttatttgatactctgtgtttaaatggtttccacatttcctgcaggctccacttactatggctgyaaaacaaattagccccaaacagtggccaggtgcaatggctcgtgcctgtaatcccagcactttaggagaggccgaggaaggccaatcacttgaggccagg

SEQ ID NO: 39199 - DNA, 201 bp, Homo sapiens
agaaagtgaagagattaacaaattttaaaaagacattagaaaagctagcaaaagacttgaacaggtgcatcgcaaattaggagctccaaatggtgaatgtraaaatgtcctcaacatctttaatcatcaggggaatacaaaaccacctcacaattaacactgagaagtctgataatgctgttaactaaaaactcaatcaat

SEQ ID NO: 39200 - DNA, 201 bp, Homo sapiens
cctaaaattagccaacacagtgagtaatcacattagaattctatttgcatgtttatttcatatggcgattatttgttgcctttaacaaagatactactttktaaaatcatatttataagaaaggattgactaagatttggtgtataatgacaaaggcatactttttgtaatttatatatggtattcattagcatagtgtta

SEQ ID NO: 39201 - DNA, 201 bp, Homo sapiens
gaaaaataaatactcatgaaggtatcacccagaggtaactactgtctatatactactcacacagaattttatttttgaaatgaagctttcttttgttgacsttttctcactttttgtgaacattttcccatatgattaaaaatctttgaaaatgtcatttttcatggtcacatgatattttcttacataaatgtgacataa

SEQ ID NO: 39202 - DNA, 201 bp, Homo sapiens
gtgtgagtaggtctggtctgtccattttttcccgagaggaattctataatctcttgttgaggctacttacctggctgataatgtttggggaacaaggcagkataaaggtgtcccacttatgagtatgcagactttgcttaatctccacttttagatttgtgcctcacccttgatcttagttccatgctggtctgagtctgg

SEQ ID NO: 39203 - DNA, 201 bp, Homo sapiens
cctagtttcgcctcatatgacattgctgtggagataaagaggtcaggcagaggaggagagtggcctctccctcctgtgagaaaaggcacttgctcccaacrggatcaggagtgaggactcagatggtcctcgcaagccatcagggggagcatgtggtgttgaagagaccctgccgttcaaacctccttgctggtagtgaca

SEQ ID NO: 39204 - DNA, 201 bp, Homo sapiens
ctgtgggcctgtgggaaatgcatggactgggtgtctggcaggtctgggtttgaagctcagcttcatgagcagtgggccttggccttgctgcgcctcatttycccccactcacagggctgtcttgaggctgggtggagtagtcctctggaagccctgaaggtttgaccgttctaaagcagtgtttcaggtgaatttatacat

SEQ ID NO: 39205 - DNA, 201 bp, Homo sapiens
gcctgtgggaaatgcatggactgggtgtctggcaggtctgggtttgaagctcagcttcatgagcagtgggccttggccttgctgcgcctcatttccccccmctcacagggctgtcttgaggctgggtggagtagtcctctggaagccctgaaggtttgaccgttctaaagcagtgtttcaggtgaatttatacattgatgg

SEQ ID NO: 39206 - DNA, 201 bp, Homo sapiens
agaggcagtgaaatggcagcaaacaactcccttctatttcctggtggcttgttctctgggacacggagaagagcatggtgactgccaggtttcaggcctayctagcagggcaatgagagctcctgggcacctgaggattcagaaccacttctttctttctttttaattttttttttttttttttttttttgagacaaagtc

SEQ ID NO: 39207 - DNA, 201 bp, Homo sapiens
ttacttttgcaccaaccaatacctccagtgttaggggctgaattatatcccccacttctacctccaaatttgtatgttgaaatcccaacccctagtactgyaaagtgtgaccatatttggagattgggtctttaaaggggtaattaaattaaaatgaggttattggatggaccctaatccaatatggctgatgtccttatt

SEQ ID NO: 39208 - DNA, 201 bp, Homo sapiens
taattaaattaaaatgaggttattggatggaccctaatccaatatggctgatgtccttattagaagaggaaatctggacacagacatgcacagagaaaagrccatgtaaaaacagagaaaatgtagctgttgacaagccaaggagaggaccttaggggaaaccaaccctgccaacaccttgatcttgggcttctagcttcc

SEQ ID NO: 39209 - DNA, 201 bp, Homo sapiens
caggaagccttccctaatgatcttttgaaaatagcacctcttggctgggtgaggtgggtatgcacctgtggtcccagctatttgggagcctgaggcaggasaatcgcctgagcccaggaggctggggttgctatgagtcatgattgcaccactgcactccagccttggcagcagagcgaaaccctgacaaaaaaaaaaaaa

SEQ ID NO: 39210 - DNA, 201 bp, Homo sapiens
ggcctcaggtagttctttatagcactgtgaaatggactaagtacctcctttcattctttttccatttatttttctttacagtacttaatactgttgataartatttatcactgaaattatgtcaagtatttgtgcatgaggaggagcaggatttttgttttgctccccattgtattcctagtgcctgaaacagtatctgac

SEQ ID NO: 39211 - DNA, 201 bp, Homo sapiens
ctgaggcaggagaatcacttgaacacgggaggtggaggttgtagtgagctgagatcacacgactgcacttcagtctggtgacaaagtgagactccatctcaaaaaaaaaaaaaaaaaaaggcgaaagaaagagaaaacctttctcctacaaggagaggggtcctgagcaggtttccagtccacagtgaaatgcagggtttt

SEQ ID NO: 39212 - DNA, 201 bp, Homo sapiens
gttagcttaccgttattgaaagattgagatgtcgaaaggggacactgaggtaagggaggagctacaggaggtggcttccacccctagggctgggagaaaasggaattagccaggctcatttgaacccagaaacgtggaggacagaccctgtggaactgggacccagacctctgaggagtgggcactggcatactggtgctc

SEQ ID NO: 39213 - DNA, 201 bp, Homo sapiens
ttaacagagatcattttatctaggatggggtggaatattaaggacagctgccaaattctacccattgcgtatttttgtaactaaagctttaccagaatacygcatgctcattcatttctatcttgtctatggctccttatacgttacaacagcaaagttgagtggttgtgacagacactttatggcccacgaagcctaaaa

SEQ ID NO: 39214 - DNA, 201 bp, Homo sapiens
gtagatagcaatagagatgggcacaaggcagagtgaaatctcatcagagtagtgagtgcttagcacatataaggcactgtccttagtgccgtaagagatawcaagagaaggtaagatagattaaaatgtattgtgtttgttttatgttactcactttatacatactagcagtcaatcaataataataacaatgataagtgc

SEQ ID NO: 39215 - DNA, 201 bp, Homo sapiens
atattaatttggatcccaccagtaagaaatttgttgtaatttactaaaaaacaggttatctacctttacctgtatgctgcctgtaaaaaaaaaaaaaaaamaaaaaaccaaaaactttcccaacaaattatgtaattaaaattctgtttacaataacttgacaaaaggaaatgtcaggtattttaaaagagtcaaatcagt

SEQ ID NO: 39216 - DNA, 201 bp, Homo sapiens
tagagagagccaagaagggctgggtgcagtggctcacccttgtaatcccagcacattggaaggccgaggcgggtagatcacttgagtgaggtcaggagttccagaccagcctgaccaacatggtgaaaccctgtctctactaaaaatacaaaaaaattatcctggcatggtggcatgtgcctgtagtcccagctactcgga

SEQ ID NO: 39217 - DNA, 201 bp, Homo sapiens
gaggcacgagaatcgcttgaacccgggaggcagaagttgcagtgagctgagatcgcaccactgcactccagcttgggcaacagagagagacactgtctttaaaaaaaaaaaaaaaaaaaagagagagagagagagagcgccaagaaggagggtgaccagagagttggacaggtataagttgacatagacgatatgaagata

SEQ ID NO: 39218 - DNA, 201 bp, Homo sapiens
tcgtgaacctcagccgtcttttctttctcttacccaaccatgtacccttcacttagtcttagcttgttgattaactgtttttttttggttttggcttttcttttttttttttttttttggtccccttctacctctgtcatctctgggtagtctgtctgctggtaatggatattcatctgttcatttgccaaaccagcagct

SEQ ID NO: 39219 - DNA, 201 bp, Homo sapiens
ggcaaacattctaaaataatttcagaaaattctcccacctctgagagaaagtgaatatataaatcgtgttttattttaagtaacaatagctaatatttatygagaataatattaggctattttaaaactttttttgttgccagcatggtggctatgcccatattcccaatactttgggaggccaaagtgggcagataacct

SEQ ID NO: 39220 - DNA, 201 bp, Homo sapiens
gaagtgttacagtgccctttacctttgctgtctgtagacagcttaacagctcagcagagggtcagtgtgacagccttttgtgcccacacttgaggcacackagtttttgtctggagtccaggaggaataaggtctcacaaacgaattgaaggtggtaaatgtgggggatttcattgccaatgaaagtggctctcagtgaga

SEQ ID NO: 39221 - DNA, 201 bp, Homo sapiens
atccagtgtttctgcatccttgtcagcatttgatgctatcactattttttagttttgccattttgataggagtatagtgatatctcattgtgttttgttgktgtttttgttttgttttttttttttgagataaggtctcgctctgtcacccagggtggagggcagtggcatgatcatggttccctgcagcctcaacctccc

SEQ ID NO: 39222 - DNA, 201 bp, Homo sapiens
atggccatatgaaaatatgtgaaaaatttaataattaattaccttgacattttggttactttttgttctataattaatcaaactaatcatattttaaattkgggagaaagaatgaaaggacatgtctgtttcctgatttgtctgattgttcagacaggcctgatattgaaagcttttgatactgagatcctattaatctca

SEQ ID NO: 39223 - DNA, 201 bp, Homo sapiens
cagtgtttctgcatccttgtcagcatttgatgctatcactattttttagttttgccattttgataggagtatagtgatatctcattgtgttttgttgttgkttttgttttgttttttttttttgagataaggtctcgctctgtcacccagggtggagggcagtggcatgatcatggttccctgcagcctcaacctccctgg

SEQ ID NO: 39224 - DNA, 201 bp, Homo sapiens
gaaccctgggagctgaatattgaggagcagagaggaacagggatcagaggcacaaaatttggcttgctcttgtagatagcaatagagatgggcacaaggcwgagtgaaatctcatcagagtagtgagtgcttagcacatataaggcactgtccttagtgccgtaagagataacaagagaaggtaagatagattaaaatgta

SEQ ID NO: 39225 - DNA, 201 bp, Homo sapiens
caggaggcgaaggttgcaatgagccaagatcgcgtcactgcactccagcctggatgacagagtatgactccgtctcaaaaaaaaaagaaaaaaccgaacawacaaaaaacatggccatcattgacttgggcttgatcctctgtctaatcagttgggggataggttgcagaacctacaccactcagagcaagacaacttttt

SEQ ID NO: 39226 - DNA, 201 bp, Homo sapiens
gcttcattcaatccactgaaacttctcttgtcaagaacacctgtgatgccaaaccccatgatctgttcctagtctccaggttccttgatctattagtactwgacacagttgatgaggttctcctgcttgtgcactttgtcacttgacttccaggattccacactctcttgattttcctcctatcatgctagtcatttcttc

SEQ ID NO: 39227 - DNA, 201 bp, Homo sapiens
aatattatatctggatctcacaattagtgggattggttgttggctagggtgtggttttagttctccaagttattctgttgtatagctggatttgagaattytgatctaaaaaaaaattttttttggaacaaatgagaaaaagcagcagattctaaaaatatgactgttttttattagaacatcatctgttaaaacattcca

SEQ ID NO: 39228 - DNA, 201 bp, Homo sapiens
tctcacaattagtgggattggttgttggctagggtgtggttttagttctccaagttattctgttgtatagctggatttgagaattctgatctaaaaaaaawttttttttggaacaaatgagaaaaagcagcagattctaaaaatatgactgttttttattagaacatcatctgttaaaacattccagattctgctagaagt

SEQ ID NO: 39229 - DNA, 201 bp, Homo sapiens
tcctgcaagatgctgacgccccgccactgcactggcaactgctccttcaagccaccgctgttgccctagggccggcctggccgcacccctgcgccctcaasccatgctgctccttgtaaatacccgctgctgcggtggccctgagcgaggaacaagccattcggacccgaccgatgtaaatacagccgcccgtccgcccgc

SEQ ID NO: 39230 - DNA, 201 bp, Homo sapiens
ggagcctcctgcctttgccagccgcctgccatctcgagctcagctatttctgggacttagctccctcccttgaaaaacaaaccgtggccctcactgtcatmcccaataaaccccccagtttgtgcagccttaatcatgttttccagaagagttctccaactgacggcctggatgcaatgtgttgggctcaggagagccagt

SEQ ID NO: 39231 - DNA, 201 bp, Homo sapiens
atctcaaagaggagaacttggctaatgaacagcctgaaatttatgtcctttcttagtttgttccataaacccagagcaaagtttgcttttactaaaaagcmccgtaattactagtcataacccttcacatctggttgtcacttagtgtagaagtcttttcacttctgttatctcatttgttctcccccatgagaaaggcat

SEQ ID NO: 39232 - DNA, 201 bp, Homo sapiens
cttcacatctggttgtcacttagtgtagaagtcttttcacttctgttatctcatttgttctcccccatgagaaaggcattattagtcccatttatttaccytttttgaaaaaaaaaaaaaaaaaaaaaaagatgagatctcactatgtttctcaggctggtcttgagctcctaagctcaagtgatcctcctgtcttggcct

SEQ ID NO: 39233 - DNA, 201 bp, Homo sapiens
aggagcaatacatttacacagttatatgttaataaatttcagaaacctctatgaagtttccagatatattaaacattccaaatgtttttttctacatgtawatgcagtgaaaataatgtataaaatgtgatatactgataacttgacaatattatcaaagaactactttttaaaaaaagaaaaactctgggtttgatacat

SEQ ID NO: 39234 - DNA, 201 bp, Homo sapiens
aggctcaggcatgaaccctgatgtcagaccagtgcttccccctgtgtccctccaggggaatcaggacaactccttaataagaatttcttattttttatcaraggtagtaacgcacgtaatttaaaaagccaactcatattcagagacaaaagacagcagcccagaacaaacacttttaactcctttggttagttctgtata

SEQ ID NO: 39235 - DNA, 201 bp, Homo sapiens; identical to SEQ ID NO: 8642

SEQ ID NO: 39236 - DNA, 201 bp, Homo sapiens
aagttgagaaacgatgtattcgacactatctatgacaatgtaacagccatgatttaatgatactgatggacagtagaatgtacatatgcagatatagtgtrgttagaactacatttaatattaagaaaaaaacactcgaaaagataaaatgtgttgaattgtttaacatttttctttattatattttccaaaaatttaaaa

SEQ ID NO: 39237 - DNA, 201 bp, Homo sapiens
aatgtaacagccatgatttaatgatactgatggacagtagaatgtacatatgcagatatagtgtagttagaactacatttaatattaagaaaaaaacactygaaaagataaaatgtgttgaattgtttaacatttttctttattatattttccaaaaatttaaaaacaggctgatgctaccttggtagagaaatccagtga

SEQ ID NO: 39238 - DNA, 201 bp, Homo sapiens
acatcagatttgggatgaaaattctaagttatatatttgtaggatttttgtgagtctgcaaaccaatattttcaaagtaatttatttcaaattagtgttakgaatattttatctttttaaattgatgttcccttggtttgaaaatgcgtgtgttactgtcagtgcctcctggcatttgtcgttgaaagcactggtgctttt

SEQ ID NO: 39239 - DNA, 201 bp, Homo sapiens
gcctgggagcagtaggccagaccacacagcctaggtgtgtagcaggctctactgtctaggtttgtgcaagcacactgtgatgtttgcacagccacaaaacygcctaatgatgcatttctcaaaacacatccgtgtcattaagcgacgcatgactgtatttaaaagtataatgtgtagccaagagaaagataaatttccttg

SEQ ID NO: 39240 - DNA, 201 bp, Homo sapiens
tatgtatggagaaggctttaggcagaacttaaaatatgaaaggaggcagctttaggtgaaacttaattgaacatattaaaagatcttcttttttccacatrgtattaaaacatacctatttagtctttgtccctaattcctgatacagagctactaaaacccaaggaatttcctgagtgataggaatatcttgttattcag

SEQ ID NO: 39241 - DNA, 201 bp, Homo sapiens
aattgtctcttgcacaagatccaagaaccctctcttggggtctggatcaggacccttttctggtaacagtggtatatgttatattaatgctacaccaaatrtaggtgctcagataggtttgatggttttgctataagatagccataaccaatgaccagagggtagcctgttgtatgataaagaatttgtctttgtcccagg

SEQ ID NO: 39242 - DNA, 201 bp, Homo sapiens
cctcccagacctcactctgtaagtctcttcgtttggctgatcgtgacttgtattctttatcataaaattgcagctatgactatagggctttcctgagttckgagttgttctagtgaattgtccaacatgagggggtcataggaacccccaactttgtagccagttaatcagaagtgcaggtggcccttgaagtgtggctgg

SEQ ID NO: 39243 - DNA, 201 bp, Homo sapiens
gtttggctgatcgtgacttgtattctttatcataaaattgcagctatgactatagggctttcctgagttctgagttgttctagtgaattgtccaacatgarggggtcataggaacccccaactttgtagccagttaatcagaagtgcaggtggcccttgaagtgtggctggcatctgaggtaaggaaggtcttgttgggga

SEQ ID NO: 39244 - DNA, 201 bp, Homo sapiens
atggatttgcctattctgggtattcatataaatggaatcatatagtgtatggccttttgtgtctggcttctttcacttagcatgttttcaaggtcattgattttttttttttttgtatgtgctgttttctttgtctaaatattctacagttactgttttgatttcttctttgactcaaagcatttaggagattgtttttac

SEQ ID NO: 39245 - DNA, 201 bp, Homo sapiens
aaaaaagatgagatctcactatgtttctcaggctggtcttgagctcctaagctcaagtgatcctcctgtcttggcctctcaaaatgctaggattacaggtrtggaccactgtacccagtcaatcccatttatttaattaatccatctatttgtctccttatttggtgttaataatacagtcatgtggcttgaaaattttaa

SEQ ID NO: 39246 - DNA, 201 bp, Homo sapiens
tcacacctgtaatcccagcaatttgggaggctgaggcagaatgattgcttaaagccagcagttcaagaccagcctgggcaacatagggagaccccatttcttttttttttttttttgggagaccccatttctacaaaacttttttaaaaaaattagccagatgtgggggtgcatgcctgtagtcctaggtactcaggaggc

SEQ ID NO: 39247 - DNA, 201 bp, Homo sapiens
agctcctaagctcaagtgatcctcctgtcttggcctctcaaaatgctaggattacaggtgtggaccactgtacccagtcaatcccatttatttaattaatccatctatttgtctccttatttggtgttaataatacagtcatgtggcttgaaaattttaaattccagtgaaaagatgtcttctcttctactcttccacaat

SEQ ID NO: 39248 - DNA, 201 bp, Homo sapiens
attaatccatctatttgtctccttatttggtgttaataatacagtcatgtggcttgaaaattttaaattccagtgaaaagatgtcttctcttctactcttycacaattcttctggtctctatctgcccacaggtaaccactactgttcatttttctgtgtatctctccagagatgctttatgtatatctaagcaacttggg

SEQ ID NO: 39249 - DNA, 201 bp, Homo sapiens
cagcctcccaaagtgctgtgattacaggcatgagccattgctccccacccacttttgttgtattctagttctcaaaagtcattaggtccaggtcccctacsccatacacctaaccatcacacagatgtgcacgcacacatacacacacacatggagaggtctacacagggcatgaatactaggaggtggaggtcaccaggt

SEQ ID NO: 39250 - DNA, 201 bp, Homo sapiens
ccctgaccccaaagggttggtaaggccggggaggggaaagggtggactgcgcggtgaggtgagcctggagaggcgcccagagtgaccctcgcgactgtctycccagaagcccacgacgccctgcaccatttctcctgcaagatgctgacgccccgccactgcactggcaactgctccttcaagccaccgctgttgccctag

SEQ ID NO: 39251 - DNA, 201 bp, Homo sapiens
gagggatgagggcctcagccaaccttggggggaattctggagttgggatggcttttcagagttgcctccaatgaaggtaacgtaatcacctgatgggttcttttttttttttttttttgagacggagtcttactctgttgcccaggctggagtgcagtggtgcaatctcgcctcactgcaagctccacctcccaggttcat

SEQ ID NO: 39252 - DNA, 201 bp, Homo sapiens
tgtctgtaatcccagcactttgggaggccgaggcgggcagatcacttgaggccagaagtttgagaccagcctgggaaacatggtgaaacctggtctctataaaaaaaaaacaaaaattagctgggtctggtggtgcaccctgtgatcccagctaattggaaggatgagatgggaggatcacttgagcctgggaggtggagg

SEQ ID NO: 39253 - DNA, 201 bp, Homo sapiens
ctggtcaaggaaatatatattatgtttaccagttactcagcaaatgtttctcaagaactgtcttaggcccagtgaagccagtcaaagaattatcaagcccwttgaggagggcttgatcattcagtcatctacttgcaggtggttggtgcaagctatgttatatttaagctgtatttggattaccaattttcaggaaattaa

SEQ ID NO: 39254 - DNA, 201 bp, Homo sapiens
cttctgccttctgctctgcctgagagctttttcaaggtttcatagttcagagataactctctgtttaaatgagaggaatggggaggagcaaatgagggagsgaggcaacctattaaaatctcagtatataaaatctagctgcataggcaagaggcaactgaggttcccaaattcgggaagcaaggggtacatagaagggga

SEQ ID NO: 39255 - DNA, 201 bp, Homo sapiens
ccaggtgcttttcagaagctgttgaccgtaattctctagcagtacataaaaagcatcctggtcttggccgggtgtggtggcacagcctgtaatcccagcastttgggaggccgaggcgggtggatcacgcggtcaggagatcaagaccatcctggctaacacggtgaaaccccgtctctactaaaaatacaaaaattagcc

SEQ ID NO: 39256 - DNA, 201 bp, Homo sapiens
taattctctagcagtacataaaaagcatcctggtcttggccgggtgtggtggcacagcctgtaatcccagcactttgggaggccgaggcgggtggatcacrcggtcaggagatcaagaccatcctggctaacacggtgaaaccccgtctctactaaaaatacaaaaattagccaggcctggtggcgggtgcctgtagtccc

SEQ ID NO: 39257 - DNA, 201 bp, Homo sapiens
aattctctagcagtacataaaaagcatcctggtcttggccgggtgtggtggcacagcctgtaatcccagcactttgggaggccgaggcgggtggatcacgmggtcaggagatcaagaccatcctggctaacacggtgaaaccccgtctctactaaaaatacaaaaattagccaggcctggtggcgggtgcctgtagtccca

SEQ ID NO: 39258 - DNA, 201 bp, Homo sapiens
tctctagcagtacataaaaagcatcctggtcttggccgggtgtggtggcacagcctgtaatcccagcactttgggaggccgaggcgggtggatcacgcggwcaggagatcaagaccatcctggctaacacggtgaaaccccgtctctactaaaaatacaaaaattagccaggcctggtggcgggtgcctgtagtcccagct

SEQ ID NO: 39259 - DNA, 201 bp, Homo sapiens
gcatcctggtcttggccgggtgtggtggcacagcctgtaatcccagcactttgggaggccgaggcgggtggatcacgcggtcaggagatcaagaccatccyggctaacacggtgaaaccccgtctctactaaaaatacaaaaattagccaggcctggtggcgggtgcctgtagtcccagctacttgggaggctgaggcagg

SEQ ID NO: 39260 - DNA, 201 bp, Homo sapiens
tgggaggctgaggcaggagaatggtgtgaacccgggaggcggagtttgcagtgagccgagattgcgccactgcactccagcctgggcgacagagcgacacwccacctcaaaaaaaaaaaagcatcctggtcttgtagcaaactcccatcatatggaggacccttgtcccttcaaccagggctctcctggtaggttcatgac

SEQ ID NO: 39261 - DNA, 201 bp, Homo sapiens
gtgaatgcattagactgtcatagctcagtgatatctgccatgaagaccattcgtttcttctcatggctctgattccagagtccccagaagccttgtgtttygcatttgacttctcataaagctctgtgctgattagcccacaaagggttctgattctcttgacagctataactcattgtaaattaataaattggcgtctgg

SEQ ID NO: 39262 - DNA, 201 bp, Homo sapiens
caggacttggccgggcgtagtggctcatgcctgtaatcccaggactttgggaagccgaggtgggcagatcacctgaggtcaggagttcgagaccagccggrccaacatggtggaaccccgtctctactaaaaatacaaaaattagctgagcgtggtggtgcatttgtgtaatcccagctacttggggggctgagacaggag

SEQ ID NO: 39263 - DNA, 201 bp, Homo sapiens
taactagctgcctctagctatttttgctgacaggctgattcttactgacataggattgcttggttcttctctcagatattttgttctattttgtctttggttttttttttttaagaaaatatttttatacatagataaagctatagattttttattagatatttaatattttaattataaagctaatatatttgtgacaag

SEQ ID NO: 39264 - DNA, 201 bp, Homo sapiens
tacccaccctgccactaccacaacagcttgcaattacctgtgcatgtcacctgcaggcctggggactagctcacacagcccatcacagctaccaccaacascagtgtacactgtttatttttgaataaaatacaaaatacatttgaaagcttcaacaatagggtagatcaaggagaagaaagaatctcagaacttgaagaa

SEQ ID NO: 39265 - DNA, 201 bp, Homo sapiens
ttctgccttctgctctgcctgagagctttttcaaggtttcatagttcagagataactctctgtttaaatgagaggaatggggaggagcaaatgagggaggraggcaacctattaaaatctcagtatataaaatctagctgcataggcaagaggcaactgaggttcccaaattcgggaagcaaggggtacatagaaggggat

SEQ ID NO: 39266 - DNA, 201 bp, Homo sapiens
ctgccttctgctctgcctgagagctttttcaaggtttcatagttcagagataactctctgtttaaatgagaggaatggggaggagcaaatgagggagggargcaacctattaaaatctcagtatataaaatctagctgcataggcaagaggcaactgaggttcccaaattcgggaagcaaggggtacatagaaggggatag

SEQ ID NO: 39267 - DNA, 201 bp, Homo sapiens
gcactgtcctggggccccgtggtaccaggtccgaggcacaagcaaggagcaggctgttgctgccggggctgaggcacaagtgaggtatgggctgctgccaycggggctgaggaacaagcaaggcatgcattctccatttgccagcctaggttgccaccactaaaagcaaccatgccctccccagtggcagggccaacgtgt

SEQ ID NO: 39268 - DNA, 201 bp, Homo sapiens
ctctgcctgagagctttttcaaggtttcatagttcagagataactctctgtttaaatgagaggaatggggaggagcaaatgagggagggaggcaacctatkaaaatctcagtatataaaatctagctgcataggcaagaggcaactgaggttcccaaattcgggaagcaaggggtacatagaaggggatagatccaaggga

SEQ ID NO: 39269 - DNA, 201 bp, Homo sapiens
caccatgtgcttaggagagaacaaatacacacataaggactactgtaatccacacttctagtcaccaaacatctttcccacactcaaaataccttcacccrccccttcctaagggagtcaaccccaaggtcccattctggttggacctttattctgagaacacctcagcctgttcagagattttgaccatgaatgtgatgg

SEQ ID NO: 39270 - DNA, 201 bp, Homo sapiens
aaaggaaatgatgagtgagcactggctcttaaagcttctgccccaaagtgacacacataatttcctttcacattttattgaccaaattcagccacatggtsaggattaatttcaaatggaataaggaagcacaatttcaccatgtgcttaggagagaacaaatacacacataaggactactgtaatccacacttctagtca

SEQ ID NO: 39271 - DNA, 201 bp, Homo sapiens
gccaattcatcctaattctggcagtccaaggcaacagaccactggttgctgctttccagattcctcaaactgccctcctgcctgtccttctggagcatggrgcttcagcttttccttcatctttctgttgcctcactcttccaataaagaactttcaaagtaagttacccagaatcgatttctgttgcttactacctaaga

SEQ ID NO: 39272 - DNA, 201 bp, Homo sapiens
gcctgtaatctcagcactttgggaggccaaggcaggtggctcacttgaggtcaggagttcaagaccagcctggccaacatagtgaaatcccatctctactraaaatataaaaattatccgattatggtggcacatgcctgtaatcccaggtactccagaggctgaggcaagagaagtgtttgaacccagggggcgggagtt

SEQ ID NO: 39273 - DNA, 201 bp, Homo sapiens
gtggctcatgcctgtaatctcagcactttgggaggccaaggcaggtggctcacttgaggtcaggagttcaagaccagcctggccaacatagtgaaatcccrtctctactgaaaatataaaaattatccgattatggtggcacatgcctgtaatcccaggtactccagaggctgaggcaagagaagtgtttgaacccagggg

SEQ ID NO: 39274 - DNA, 201 bp, Homo sapiens
gcaccctggctattgccttgagaagagtctggaggctgaaagcaggaaggccaggcagaagccgttgctgtaagccaagtgagagatgataatgattgctytgaccagaaagaccacaggattacattctgattgtatctccacccaacctttgaaataggtgtcgtaatgatccttcacaaacaggggaggaaattcagg

SEQ ID NO: 39275 - DNA, 201 bp, Homo sapiens
taaccatctgaaagtgtgggaatcattctgagctcatgggctgtagttatcctgtgagccatagtttgtggacttccattttaaaggatagtcatgatccsactaagtttcaaccagagcaccctggctattgccttgagaagagtctggaggctgaaagcaggaaggccaggcagaagccgttgctgtaagccaagtgag

SEQ ID NO: 39276 - DNA, 201 bp, Homo sapiens
ccactcactctctgctccaccccacgtgggagtgggagcacaggtgagcaggtgcaggagccagggtgtgtgcttttaggtgccggcaagagcgaactccrtactggcccatggcagcatctaagggagggtgccggaagtccctgaagccacagaggaagtgttacagtgccctttacctttgctgtctgtagacagctt

SEQ ID NO: 39277 - DNA, 201 bp, Homo sapiens
ggagatagagctatcgtaggagtgaggagaacctaggcaacattgaactcagggttaagagacttgaatttgagttctgactctggaacttgctaattacraggaagtcactggcccaaggttagtcagtcagcaaatgtttagtgagcatctgtggccaggaactgtgtttagcactggagagtccctctctggcctcat

SEQ ID NO: 39278 - DNA, 201 bp, Homo sapiens
tgaaaatatttttagggtcatatcttcgctcttttttcttgctgctgcttagatgaacttgaataacattaaatccagaataatttatcaagggctgtttyagatttaccttttacattattttaagttatagagataataagtgactacacttctcattgtaatgatctaacagtaaatagggtaaaaatggaaagacct

SEQ ID NO: 39279 - DNA, 201 bp, Homo sapiens
ttgatcgtactctaaatttgattcgttcgactttggtcttcacctaaatctgtatttatgtaacgttttatcattaggatttctttgaaataggcagtagmgacaattttaaagtacttagttgtctttaaccatcaatttcagaagtagtattaattgccactgcactttttgctagatgtttatgactatatttcccct

SEQ ID NO: 39280 - DNA, 201 bp, Homo sapiens
cataggcaatgaaagcatttttatttttagaaaaaacctttatgagttaaaccaattaataaatgcatatgtgaattaagaatgctatttgtgcaacatcygaaaagtagtgcatgtagaaggaacttgaaattgatcgtactctaaatttgattcgttcgactttggtcttcacctaaatctgtatttatgtaacgtttt

SEQ ID NO: 39281 - DNA, 201 bp, Homo sapiens
attttttcccccacatagatatcgaaatattccaacagcatttgttgaaaagactgtctttccttccatttcattaccttggcacctttatcaaaaaccarttgaccatagatgtataaatctatttccggacgttattcttttccattgacctgtatgtctatccttatgccaaacgagtcttaattaccgtagcttgat

SEQ ID NO: 39282 - DNA, 201 bp, Homo sapiens
cttctcaggtgcttatttgccattcttatagcttctttgatgaagtatctgccaaattttttgcccattttttaatgtcatgcttttgatatattatgaartctttgcctaaatgaaagtcacaaacactctcttctatttttcttctagaaattttattgtttgagctcttggatctaggtctgtgattcattttgagtt

SEQ ID NO: 39283 - DNA, 201 bp, Homo sapiens
ccaggcaggcccagaagcctcaagatattagatattgcaggcaaagtctgatgtctgccttggtttgacttcctaacatcaagaggtttttaaaagtccaratttgttgtcacaatttccagcaaaataaatttaaaagaagcctatgtggttattcttgccgcacttatgtaaataatcaggtcaagtttgaaactaaat

SEQ ID NO: 39284 - DNA, 201 bp, Homo sapiens
gtctgaagctctgatgaggagtaccacattttgaagtgaggactttgcctttctgcacaacctcgccaggcagcctcaccagaacatgtctttacttcacytttccagctgtagtgggaagctcacagtacatactccacctgccttttcgatgcttgttcctaggaaagttgagaacccaaggttgtaaggggactgtga

SEQ ID NO: 39285 - DNA, 201 bp, Homo sapiens
ttatcttttaaaaaataggaaaacaagctcctctatggatagagctctgtgttcctcccattgttctcatcctaatttttgtgagagtagtctacacttgmtctttttacctcctcactgcatctcattatggtctttaaccctctatcattccactgaaattgctctttcagatgtcacaaatgatgatctgattgctaa

SEQ ID NO: 39286 - DNA, 201 bp, Homo sapiens
tctgtcactctgtgctgtcaagactcttttatcttttaaaaaataggaaaacaagctcctctatggatagagctctgtgttcctcccattgttctcatcckaatttttgtgagagtagtctacacttgctctttttacctcctcactgcatctcattatggtctttaaccctctatcattccactgaaattgctctttcag

SEQ ID NO: 39287 - DNA, 201 bp, Homo sapiens
aggaagttatttagataaaaataagatttattcaatcattttaagaaattcacagctgagtgtggtggctcatgcctataatctcagcactttgggaggcygaggcaggaggattgcttgagtcagggagttcaagaccagcctggacaacatggtgagaccctgtttcaacaaaaaataaaaaatagctgggcatggtgg

SEQ ID NO: 39288 - DNA, 201 bp, Homo sapiens
aacagagcgaggctccatctcaaaaaaaaaaaaaaaaaaaaaaaaaaaatgcagttcaggaagaggaggttgcagacatacttacagaagaggtaccatgytttctgggactgggcatcaagcctgcttctgaaagtcctggcagccagggagggagaaagaaaaatgcgatttcttccataatgcttctcatcagaaaga

SEQ ID NO: 39289 - DNA, 201 bp, Homo sapiens
tcaaaacaatggcctcccatcattatgttttaccatcacccaaacaaggcaaaaatattaacaggaagcttaatttcattacctccactttttgtggaatrttcctatgcatactcagtatgctaacctcaaattttagttccaggttgttataacttttcaggaagttatttagataaaaataagatttattcaatcatt

SEQ ID NO: 39290 - DNA, 201 bp, Homo sapiens
gaattttaaatacttaatatggcaaaatttatgtattttcctttatagatttttgttttttgttcaaaaagatttgatctacgtttttcactaataatttwaagtatctatttacttatcttttttttaaacattaaaacattgactccatctggatttattttggtgtatgtatgtgataggaatctaattttgttgctt

SEQ ID NO: 39291 - DNA, 201 bp, Homo sapiens
ctgttactgacgaaccccatgaccttgggagatttattttaaagagtcaaagggatcatccccaggtttgtaagaggtccagaagagtaataggattaaayggtgcttcagagtgttttatattgtttctaaatgtcagggcctctttgggggaagggaagtaagcacactgctctttaaagactgaatttgacagtgggt

SEQ ID NO: 39292 - DNA, 201 bp, Homo sapiens
ttcatgtaagtgccttaaattcattagcttcaagtataggtaatattaaatccaagacagacctgggtttaaattctaggtttgttacttgaaaattgcaraattagggcaagttcttttacttctctgtacttcagtatcctcatccataaaaacaggtttatgatcatctcagcagctttttggtcaggattaaatgaa

SEQ ID NO: 39293 - DNA, 201 bp, Homo sapiens
tattaagtcttcaaatccacaaactcaggatgtttttccatttatttagatcttctttattttaacaatgttttcattgtattagtctcacatcttcttgrttaaatatattgttaagtattctattttttaaaattgtttaaagttttttttgagacagggtctcatttgcttgagacagggtctcattctgtcacccag

SEQ ID NO: 39294 - DNA, 201 bp, Homo sapiens
agcctcccaagtagctgggactacaggcgcgtcccaccatgcctggctaattcttgtatttttagtagagacgaggtttcaccatgttggccaagctggtstcgaactcctgaccttgtgatccacccaccttggcctcccaaagtgctgagattaccggcttgagcccctgcagcctggcctaattgccccttttctacc

SEQ ID NO: 39295 - DNA, 201 bp, Homo sapiens
agtgattccccattaccttttctcctcagttcctggaaaccactaatttactttctgtgtctgtaaaattgcctcttctggacatttcacataaacagaawcatataaaatgtggccttttatgacttgttcttttacttagtataatgtttttttttttcgagacagagtctcactctgttacccaggaggctgcagtat

SEQ ID NO: 39296 - DNA, 201 bp, Homo sapiens
cagcctcccaaaatgctgggattacagttgtaatttctttataaaatagcaaccacagaggtatgaggagtgtaagtgaaacttttaagttgtcaagtgtyatgcaaacatgagggcctctcagcatctggggcattggagggcactagacgtgttctgtctcagctgagaggcaaggtggggtcctctgaaggaggggcc

SEQ ID NO: 39297 - DNA, 201 bp, Homo sapiens
ctgcctgagagctttttcaaggtttcatagttcagagataactctctgtttaaatgagaggaatggggaggagcaaatgagggagggaggcaacctattaraatctcagtatataaaatctagctgcataggcaagaggcaactgaggttcccaaattcgggaagcaaggggtacatagaaggggatagatccaagggatg

SEQ ID NO: 39298 - DNA, 201 bp, Homo sapiens
gtcacaagccagcaccgattccttcctggggacgtgccacctctcaggaagcagaaccatgctccctgctgatcagagaccctcaggcctctctcttcttyttccccaccaagatgctctatttttgtccctaaacaccaccaatacctgcaaaccagcttcttcccttcattccttagcaaactccctaattttccctca

SEQ ID NO: 39299 - DNA, 201 bp, Homo sapiens
atgatccagtgtttctgcatccttgtcagcatttgatgctatcactattttttagttttgccattttgataggagtatagtgatatctcattgtgttttgktgttgtttttgttttgttttttttttttgagataaggtctcgctctgtcacccagggtggagggcagtggcatgatcatggttccctgcagcctcaacct

SEQ ID NO: 39300 - DNA, 201 bp, Homo sapiens
tggtaccactgagacaaccgtcggccctgcccacatggtccctttgggcccagtaatgctgttatcttcatgtcatgtttgggattcaggcactgtttgtragtctgcttgtagtcacaagccagcaccgattccttcctggggacgtgccacctctcaggaagcagaaccatgctccctgctgatcagagaccctcaggc

SEQ ID NO: 39301 - DNA, 201 bp, Homo sapiens
ctgggcatggaggcgagcgcctgtagtcccagccactcaagaggctgaggcagaagaatcccttgaacctgggaggcagaggttgcagtgagccgagatcrcgccactgcactccagcctgggtgacagagcaagataccatctcaaaaaagaaaaaaagaaagaaactattagagccatgaatgaatctgactttgatga

SEQ ID NO: 39302 - DNA, 201 bp, Homo sapiens
ctgcttgtcatggtagggtggggtacattttaagttagtactgtttactgcgaataaggctaaatttcccccatcattcattgcaaaatgtccatggcccrgaggtctcatcaatgtttagggcagttgctggcttagggcttggctgacttcttagttcattaacttctcattgaccagcttgaggttaaaaaggggagc

SEQ ID NO: 39303 - DNA, 201 bp, Homo sapiens
tctgactacattctggctttctttgcttcccagacaaggtggcagaaatcaccattcccagatcctgagtttatgagttctgtctattaaccagccacacygaaactgtaatctctcagtcttgattccagattcccagggaaggagctcattggctcaggttgttctagatacccagctctagacttatcaaagattttt

SEQ ID NO: 39304 - DNA, 201 bp, Homo sapiens
gggctagcaatgaggggttaggtgagattgctctatattaactctagtattaaccctgtatttgaatttgaccaacaaacattcatctcaatcagtggtasgctggagccagcatgtaccagtttgcaaaagcagaggatcaaatttacaggaattttgccagacagttatgaaacacagtcattattaaaattgaattac

SEQ ID NO: 39305 - DNA, 201 bp, Homo sapiens
atctagtctataacagtggtttgcaacttgacagtgcattagaattgcctgggaatcttttaaacctcccctccccacaaagcccaggccacacctcagaycaattaagtctgcatcactgcctgtggtacccagccacacatttcccttcccacatccccctactctgttgctcaggctggagtgcagcagagcaatcat

SEQ ID NO: 39306 - DNA, 201 bp, Homo sapiens
aactcttgccttctaggagctctttgggggttgatgctggtttctgcaactatgtgaccaactaacaataagactgtttaatcattgactgcaccacaccytacttctattattttgtaactccactggggtaaataatcaaggaatgtgttgataagatgatgggtggggcctcaaggaaagcctagaataagaggagtc

SEQ ID NO: 39307 - DNA, 201 bp, Homo sapiens
tctcaggaacgagggacaaagcccaaatacagttgatctttgcacaaccaggggattaggggagctgacccttcacacaatagaaaatttacgcataactwtcactccccaaaaacttaattattaatagcttactgttgacaagaagccttaccaataacataaacaattagtacatacattgtatattatatgtgttat

SEQ ID NO: 39308 - DNA, 201 bp, Homo sapiens
aaaatgtgtttcttacatttactagtttattatgaaggatgccactcaaataactgaatggaagagatgcacagggcaatgtaaagggggactatgcagarcttccgtgccctgttgctcttccccacagtactctcgtgtgtttgccagtgcagaacctcttctatctcttgttgaagaatttataactcaatcaccagc

SEQ ID NO: 39309 - DNA, 201 bp, Homo sapiens
agtcccacaaggataccctccttcagacaccagtcacaagttccttaggccacctgcactccgactgaccagctgtgaagtcaaggcttcctataattccytcctcatggtgaataattcactagaatgactcacagaactgaggaaaatgtgtttcttacatttactagtttattatgaaggatgccactcaaataactg

SEQ ID NO: 39310 - DNA, 201 bp, Homo sapiens
ataatatatatcagtagttggaattagtatttgaaggattagcaggaacaataaaatactgtctacctagaaaagaatctctgtcactattaagctttggyggggttttttttgctgctgaacctctttcatatgatgtaaaaatttcattttatattaccagtacaagtggcatttgttagtaccacattctttttgctg

SEQ ID NO: 39311 - DNA, 201 bp, Homo sapiens
tttttagtagagacagggtttcaccatgttagccaggatggtctcgatctcctgaccttgtgacccgcctgcctcggcctcccaaagtcctgggattacargtgtgagcccccatgcctggccaacagtgagtgagttcttacaagatctggttgtttaaaagtgtgtgccaccttcctccccaactctctcttgttcctg

SEQ ID NO: 39312 - DNA, 201 bp, Homo sapiens
aacactggaaaaggactgagtgtgggtgtgttttgttttgtttttgttttgttttgttttactttgaagaatgggcattggaggacaagatggagaaaatyatgaatttacttttgaaacttttgagtttgaaatgcctgtgagacatcctgaataggcagtggggcagataggcttaaaggatacatttgggctagaggg

SEQ ID NO: 39313 - DNA, 201 bp, Homo sapiens
cacaatccatgaaataaataattgatttgctggatttcattaaagtttagaactgctcagcaaaagacaatgtcaaaagaatgagaatacaaccatagacwgggagaaaatatatgcaaaagatataactgataaaggactgttacccaaaatatacaaagaactcttagaactcaacaaggaaacaaacaacttgattaa

SEQ ID NO: 39314 - DNA, 201 bp, Homo sapiens
cagttatttcctttatatagtcttttctcgtctccatcatgctttgcctatctgcccttcccaagctatggaattatttgtttattttcttctagacttcyaaggtttcatattttacctttaaatatttagttcatattaaatatatgtgtgatgtgaggtaaaaattgctttctttcactttttaaatagctggttcta

SEQ ID NO: 39315 - DNA, 201 bp, Homo sapiens
tctcaaacaaacaaacaaacaaacaaacaaaacgaaccaaacaaaagtaacaacttgcaattcattcagttaatttcaatacctatgagttaagatgagcrgattgaaatacacattcaagcctaatctctgaattatgcagagattttgagaatattccttcattagccacagccatgtgtgccacacaggagaaaccag

SEQ ID NO: 39316 - DNA, 201 bp, Homo sapiens
gttaggagtggtcctgtgagctttgacatctgtttgctaagtatatttctagaaaatctttgtagatcagtaaatcttaacttttttatggatccctgatmcctttgagaatttgatagaagctgtgaatggtttccctataaaactgaacatgtatatgtactcaaaataatttacatataaaattgttttatattgtgc

SEQ ID NO: 39317 - DNA, 201 bp, Homo sapiens
gagtgagactttgtctcaaacaaacaaacaaacaaacaaacaaaacgaaccaaacaaaagtaacaacttgcaattcattcagttaatttcaatacctatgrgttaagatgagcagattgaaatacacattcaagcctaatctctgaattatgcagagattttgagaatattccttcattagccacagccatgtgtgccaca

SEQ ID NO: 39318 - DNA, 201 bp, Homo sapiens
ttttagtttttttataaattagatttcaggttttatgtaaaatctcatctttataaaactttgttttgcagatagatacttttttctgtatccctgtggaytgtcttttgtacccatggaaatgtatacccccaacattggaggtcattgttttggatgattttgtaagactcatttcagtatgaagattctgtaattctt

SEQ ID NO: 39319 - DNA, 201 bp, Homo sapiens
gttggagaatcttccctcctccctgattccactccccagtgcaggctaccgtcccagctttgttaggggataggcaaattgctcaagatcattcagtctcrcctaccaagtcaggactgctttcctagagcagttagcccgcctcagctcagctcaggtggcctttggaaaatccctggctgttaccagatcacggccttc

SEQ ID NO: 39320 - DNA, 201 bp, Homo sapiens
gaagggaggggtcagggcagccagaaaacttgtggttctgaaatgaatctgcatgagtcatttgtttaaaaagggcggagtttctggagcccccagataawcctggggaatagagtagaccagaaaagacaaaatacaatgaaaggatcaagggacagctaaatgcctgagataggcccttggcttgtgcttaaatgatcc

SEQ ID NO: 39321 - DNA, 201 bp, Homo sapiens
catttttgctcagttttatcttttgaatttgatttaaacgtaaaaattaactagaaaactattaaaattcttcctatttcttatcccattctctgtctctyataggtaatcatttttaattaatttcagtttatccttctggttttcttttcttttctttttttttttccgaaaaaagccagtagctttatgtattattac

SEQ ID NO: 39322 - DNA, 201 bp, Homo sapiens
tataggggatctctgtcttccatgctgggggatgggagaaaggggttgagtctgcatagggctgaagctgccagcaagagctgggacccaggagagcaggygagaagggaggggtcagggcagccagaaaacttgtggttctgaaatgaatctgcatgagtcatttgtttaaaaagggcggagtttctggagcccccagat

SEQ ID NO: 39323 - DNA, 201 bp, Homo sapiens
atctccagctgtgaagtccccagagacaccttccacaaagctggcagcctttgcccagggctgtggcaattactccaaatgttgggagagtccaaacctcstcttctaactttgtgtataggggatctctgtcttccatgctgggggatgggagaaaggggttgagtctgcatagggctgaagctgccagcaagagctggg

SEQ ID NO: 39324 - DNA, 201 bp, Homo sapiens
agaggcaactgaggttcccaaattcgggaagcaaggggtacatagaaggggatagatccaagggatgggcagaagagagaatcattgacacttatagaccrgttcaatgtgggagtctcaccatgcatgcctgaattagcactctgacccaggtcaatcaaacaaagcaatcaggaattgtcattttaagttgaccttcag

SEQ ID NO: 39325 - DNA, 201 bp, Homo sapiens
aagcaaaactgaatggtagcccaggtatgtcagctgccctcattctcggcaacacttccaactccttttctgcctctttcacaggacaaatctccagctgygaagtccccagagacaccttccacaaagctggcagcctttgcccagggctgtggcaattactccaaatgttgggagagtccaaacctcgtcttctaactt

SEQ ID NO: 39326 - DNA, 201 bp, Homo sapiens
gaacccctcttacctgcccctgtatcccaggcgaagatgggcttaccttggatgtcacaggaactcatttggtggagaaagatatcgagaacctggccagaggtgaggataaatttgtgaaaaaggtgtacgctgtgcttgagagtgatgggtcattcctgtagaggggtgttatccctgtagggggtgagtgtggaaaag

SEQ ID NO: 39327 - DNA, 201 bp, Homo sapiens
taaaactaaaatgacagataagagtaagaaaatggctgcattgatatagttagtggagggtacatcacacaaccttttggaatagagtttggccatgtcarttaacattaccatgtgccctactcagtgatccagcagatctacttctagaaatctggcatacagaaaaactcatgcacatgcataaagatacatggatga

SEQ ID NO: 39328 - DNA, 201 bp, Homo sapiens
gatcagcataagcaaagtcacggaggctataagatggtgcatggttagggaattaactatattcattatgctcattatgttccctgcatacccatggagcrtagttagaagtggccaagagggatgctgaatgacactgaatagactagaggagcccctcccgaactcttgccttctaggagctctttgggggttgatgct

SEQ ID NO: 39329 - DNA, 201 bp, Homo sapiens
caagatgcagtcactgcactccagccagggtgaaagagcaagactccgtctcaaaaaaaataaaaataaaaatgcccaagacttgatatatacagccatgyatcactgagccaccaagatacattctgagaaaggtgtcagttagatgacttcgtccttgtgcaaacatcatagacaaacctagatggtatagcctactac

SEQ ID NO: 39330 - DNA, 201 bp, Homo sapiens
cagttggagaagtaggaaatgacattccagatggaaggaagcatggaggaagcagttcagtgtggctagagctcaggatagatgagaggagggatgaggcyggaaaggctctgttgggctaaggaggctggctttgatcttgtatgtggtgggaaaaagcaaatgattttttgatctggactatatcgtgatcagggacac

SEQ ID NO: 39331 - DNA, 201 bp, Homo sapiens
atccagttggagaagtaggaaatgacattccagatggaaggaagcatggaggaagcagttcagtgtggctagagctcaggatagatgagaggagggatgargctggaaaggctctgttgggctaaggaggctggctttgatcttgtatgtggtgggaaaaagcaaatgattttttgatctggactatatcgtgatcaggga

SEQ ID NO: 39332 - DNA, 201 bp, Homo sapiens
ataggccaggtgcgctggctcactcctgtaatcctagcactttgggaggctgaggtgggcagattacttaaggccagaagtttgagaccagcctggctaaygtggtgaaaccccgtctctactaaaaatgcaaaaattaggcaggtgtggtggtgcatgcctctagtcccagctactcaggagactgaggcaggagaattg

SEQ ID NO: 39333 - DNA, 201 bp, Homo sapiens
atcatctagcccaaggaaggatcttataacccttacagtctgagggaattgaagacaattctttccattcatgtatttaatcatttattccataacattcracaaacatttgtgtgccagatcctgggacacaaagaagatgaaggaaatgtccctggatcacaatctaacaagacagataaaccagctatgatagagtga

SEQ ID NO: 39334 - DNA, 201 bp, Homo sapiens
gcttaaatgatccacctgcctcggcctcccaaagtgctgggattacaggtgtgagccactgctcctggccaacctggaaaacctttaagaaatattatatstggatctcacaattagtgggattggttgttggctagggtgtggttttagttctccaagttattctgttgtatagctggatttgagaattctgatctaaaa

SEQ ID NO: 39335 - DNA, 201 bp, Homo sapiens
gtcctctaacgccttacatcgaaggcccagagccaaggaagaggcggagatgtcccgcagtcccctatgctcggctgttacctggaaaggatcatttcacytccactgaagagaaaaggaatgagtcctgaatggaatgctgcccggcagctcccagcgcccgctggtagagtacccgccgctgtccctgggtggctccgg

SEQ ID NO: 39336 - DNA, 201 bp, Homo sapiens
aagtaaaattgcaatccaggcttgataaagcctgccaaccaggtggggaaatctgtgggaagtagtgcctggcagagttgttccagatcaggttaaaatgrtcaggccctgatatagtttggatatgtgtcccctctaaatttcatgctaaattgtaatccccagtgttggaggtggggcttggtgggaagtgattggatg

SEQ ID NO: 39337 - DNA, 201 bp, Homo sapiens
tgtggtggtagttgctgctcccagcagtgctgtggctcagtactgagagaggggagggacctggggagccactgccagggagttcgggctttggaggcttsagttctccccactcggtacgcctcttaagtgaaatggaagtcatttgactagcttctcatctgaccttactaaataagcagtaggcaaacgcaaacctca

SEQ ID NO: 39338 - DNA, 201 bp, Homo sapiens
agaactaaataatatcattatataaagctgaccatctcatacgaaatgactctgaaatgttacccctggatatatattccagtctagagaaactcatgctcaaaactaattatggcagcatgatttgtaatagccaaaaagtaaaaacaacccgaatgcccaacaataggaaactggataaataaatggagtattgtcata

SEQ ID NO: 39339 - DNA, 201 bp, Homo sapiens
ccatgactatcacctttgatcaagctgtggtggccgcccagagtgatagactgagaatgcctgtgagagagcagcccaggatggtgggaaagagtgctgcratcgcttgatcatgtctgccaggctgtggaaatgaagagtttggtgtggagagtggctcacattgcaaaagttgggacccccatttaatctgacctgaat

SEQ ID NO: 39340 - DNA, 201 bp, Homo sapiens
agacacaggggtcttgctatgtcgcccaggttggtcttgaactcctaggctcaaacgatccacctgactcagcctcccaaagtgcagggagtatgggtgcragccaccaagcccagcctatgtctataattatgttattacatgattgttacataaaggcaataatgtactatgtattcttttgaaattattttttttaac

SEQ ID NO: 39341 - DNA, 201 bp, Homo sapiens
gcctgttctctatctcaataattatgttattattattattatttttagacacaggggtcttgctatgtcgcccaggttggtcttgaactcctaggctcaarcgatccacctgactcagcctcccaaagtgcagggagtatgggtgcaagccaccaagcccagcctatgtctataattatgttattacatgattgttacata

SEQ ID NO: 39342 - DNA, 201 bp, Homo sapiens
caagagaaatgtacagggaagtcacatgtacccttctctcagtctcctgcaatgttaacatcctatgcaactataatacaatatcacaaccaaaaaattgrcatcaatatcacccatcctttctacccttccctaatccccagagaatgactagcctgttctctatctcaataattatgttattattattattatttttag

SEQ ID NO: 39343 - DNA, 201 bp, Homo sapiens
gctataaaactagggttaagttcaatttgagtggcaaaatagagcttagaagaacaaaaaccgaaattatgtaataaccactttgaataacaaccaaagtragagtccacgcaaaatataaatattaaaaagttagaaatactcatttttgctcagttttatcttttgaatttgatttaaacgtaaaaattaactagaaaa

SEQ ID NO: 39344 - DNA, 201 bp, Homo sapiens
acttaaaaagcaagatcaaaccaaaaccaaaattagtagaaggaaagaaataataaacatcaaggcagaactaaatgaaattgacactaaaaaaacaatayaaaggattagccaggtgcagtggctcacacctgtaatcccagcactttgggaggtcaaggcaagcagatcacaaggtcagaagattgagaccatcctggc

SEQ ID NO: 39345 - DNA, 201 bp, Homo sapiens
tggccgggcatggtggctcacacctgtaatcccagcactttgggaggctgaggcgggcggatcacgaggtcaggagattgagatcatccttgctaacacgrtgatactccgtctctactaaaaatacaaaaaatcagggcgtggtggccctcacctgtagtctcagctactcgggaggctgaggcaggagaatcacttgaa

SEQ ID NO: 39346 - DNA, 201 bp, Homo sapiens
acaaagcaatcaggaattgtcattttaagttgaccttcagttacctgcaagtaaatgagttgatttaccatctgttgactcctctcagtcaactgaacacrgtagaaataaacacgtatgttttaggttgattgggctggatgaagggtataaggggcttcatatgattttgtgtgtaaatgtttaaatttttgcatatta

SEQ ID NO: 39347 - DNA, 201 bp, Homo sapiens
attcatttctatcttgtctatggctccttatacgttacaacagcaaagttgagtggttgtgacagacactttatggcccacgaagcctaaaatatttactstctggtcctttacagaaaaagtttcccaagtcctgatcaaggggattggtggggtagggagaataataatctcccaaagatgtccatgtcctaattcctg

SEQ ID NO: 39348 - DNA, 201 bp, Homo sapiens
gacccagttccagttttgaatttctttttttttgagcagttctatctgacttttgcaggatgaaggaagggcagttgtccagctaactagagaggatgaawggacctggggatctgataacttcataagcaggttttcaagaaattccccttgctttagctatattctgttagccccacttgtacaggtattttgcattat

SEQ ID NO: 39349 - DNA, 201 bp, Homo sapiens
cactctttgcagggaggagagtgtggatggagtgggagagagctcacggcacagggaatcattcagccttggctttcatttctcgccctcggctggctagygggggtcccgggttgagcccttcttttatctttcctgggtctccgtttcggcctctatgaaataacacgcaggcctccgtccatgcggctcgtagaaggc

SEQ ID NO: 39350 - DNA, 201 bp, Homo sapiens
gcccaagatcaacaaggtcttgatgactccaaagcaactatccctattactaatctaggctaattctcaatttaaaatgggattactgcccactaggtgcytctattctaggtagcaggattctttatacaatcagtgcctctgaggtgtcaataaagagcctagggcattcaggctgggcgtggtggctcatgcctgtaa

SEQ ID NO: 39351 - DNA, 201 bp, Homo sapiens
ttggattcccagcctggctgacttctccaagcgttgacatctgtcccaccccatggggccaacacaccttcccaggcacctgcctgagtttctcatcttckaagtgggcataatactatattgagagggttcatctatgtaaagtgcctgggacagtgttgacaccctgtatgtgctaattttaatagcagcagcagcagc

SEQ ID NO: 39352 - DNA, 201 bp, Homo sapiens
tattcccagactaaccctctaattttcaaacctgttttcttcctccttgtctttttgctttactttctgggagatatcctgaactttattgtccagcctgyctattgagcttttcctttgtgcatcgtatttttaccctccaagaactttgtgtatacatataaaatacagatgtttcttttttttaaacaataactagtt

SEQ ID NO: 39353 - DNA, 201 bp, Homo sapiens
acggggcgggacagcgcgggtgtgggagtttgccggcccctttccccaccgcggattgcacctttggaagctgcacttttcttctctgtaaaatgggcatmaccattaccacccaggcaggaagttccgtggctgcggctcgacagaggagccaggcaaatgctccttcccacccttccttcccaactccccccaaagtgg

SEQ ID NO: 39354 - DNA, 201 bp, Homo sapiens
agtttgcaatgagccaagatctcgccattgcactccagcctgggagacaagagcaagactccatctcaaaaagagagcagtaagaccagtgggagagggcrgttggccagccttgacagtgtttcctgagaggacacttctcaccctgaatgctactgcctcctgcccacagggtgttgctgcttctctttcatgctttcc

SEQ ID NO: 39355 - DNA, 201 bp, Homo sapiens
gacagggtctcactgtgttacccaggctggagtacagtggcatgattatcgctcactgcagcctcaaactcctgagcttaagccatcctcctgcctcagcrtcctgagtagccaagtctaaggcctgtgttatcatgcctggctaattttgttattttttgtagagacaggtttgctatgctgatctaagctgacctcaaa

SEQ ID NO: 39356 - DNA, 201 bp, Homo sapiens
agaaatggttgtttagaatatcccaacttgaattatctggcaaatgtacgtatcacagatatgaaaggaaccttgtttccctcctgagagcaaaacccagracctccaagcaaaacccaggacctccaaagtcgtctgtggaaggagtatagctggagtaagacagcagggagagccaggcgccatggctcacacctgtaa

SEQ ID NO: 39357 - DNA, 201 bp, Homo sapiens
tgggctgttctcctggagtgtttggtttggcctggtccccagcggtgcctacaggaggtctggctctggagtcccaggtctggggtaagggacaagagtgmacggaagccggggcccctcttgggatccgcagtgggaagatgatctctatccccacctgttctggcaaatccagagtgagagactgagcaaagttggagc

SEQ ID NO: 39358 - DNA, 201 bp, Homo sapiens
aatgatggtgggaggttatttttattttgaaatgaaaaaataacatgggtattccagagaatttgaatcagggtattactcttgcattcttcaactactgrtggctataactatgtaaagaagtaaaacatttcctgtaaagacagtcagaagttaggaagatctcatctttatcctgtggacatacagatattttttctt

SEQ ID NO: 39359 - DNA, 201 bp, Homo sapiens
atccagagtgagagactgagcaaagttggagccgccgttggagacagcatcaagtgggtttatttttcacccccacgggagaaagcagtaagtcccttccsatctccatttcctctgcaaatcagggtaacctgtgtgcaaaagcaccacttagaagaccccttaactcctggagcacaggtgactctgtgttctagtggc

SEQ ID NO: 39360 - DNA, 201 bp, Homo sapiens
ggtacaagcgtagctcactgcaacctcaaactcctaggctaaagtggtcctcctgcctcatcctcccaagtagctaggacctactggtgtgagccaccatrcctggcacatttttaaaactttttgtagagagtgtcttgtagtgttactcaggctggtctcaaactcctggcgtcaagcagtcctcctgccttggccacc

SEQ ID NO: 39361 - DNA, 201 bp, Homo sapiens
gccgccgttggagacagcatcaagtgggtttatttttcacccccacgggagaaagcagtaagtcccttcccatctccatttcctctgcaaatcagggtaamctgtgtgcaaaagcaccacttagaagaccccttaactcctggagcacaggtgactctgtgttctagtggcactcggttcatgaggctagcagggcactca

SEQ ID NO: 39362 - DNA, 201 bp, Homo sapiens
tgaaattgtaggcaaactgttgtatgtgtatttttctgggaaaggtgtccaaggctctgaccaaagcctccctgatttatattgaaagggcggcggtgcgsgggggggaggtcggggccggggcgggggcggggtctgtcacttgaagtgggaaatcaagtttccgtgggccagcctcttaggttagggagtgaggaacaa

SEQ ID NO: 39363 - DNA, 201 bp, Homo sapiens
aggatgcgatcacaggagtgtggaaaacgtccttgtgtgctgagtccacctctgggtgggggccgcaggaccggttgagtcatgagtcatgagttcaggtrgggtcagtcacttaccagaatgcaaaagtctgaaaaacatctcaaaagaccaatcttaggttctataacagtgatgttatctataggagcagttggggaa

SEQ ID NO: 39364 - DNA, 201 bp, Homo sapiens
ataggccctcttcctgcccgaccttggcgcgcgctcggcgcgcggtcacgctccgtcacgtggtgcgttttgcctgcgcgtctttccactggggccggggmggcgcggagggttcagacgcgggctcttactcaaacgctgatccccgaaactaccgagcagtgtctgcgcgacgcgaaagcatttttggagcgaggggcc

SEQ ID NO: 39365 - DNA, 201 bp, Homo sapiens
actattcatatttaaaaacttaatactttcaaattacatcctaaaaaggtgatatcattttaaacttctgccaaaaatgtgtaagaggttgggcatggcgscttgtgcccataatcccaacgctttgggaagtcaaggcgggaggatcccttgaggccaggaggagtttgagaccagcctgggcaacagagcaagaccctg

SEQ ID NO: 39366 - DNA, 201 bp, Homo sapiens
ttaaaccataaattaaattcctcctgtggttagcttagcctatgcccaggaatgagcaaggacagccagactgtgaggctagaagcaagatggagtcagcyatgctagatttctcttgttttcataatctttgcaaagtctgtgacaatgatagcaaggagccagggctttgtcctcccgctaggcattggatactatctg

SEQ ID NO: 39367 - DNA, 201 bp, Homo sapiens
ctctcccaggtaagcctggggtttttatgcacacaggatgcgggttagggcaggcgccatagtggttttggaaaaggcaacatttgagtgggaaaacaggsatgtaagttcttgctttggaccactgttccaggctcaagggtggggtcctcgctggggacctgccctcccagaatttttctgcctcctgtccctatcaca

SEQ ID NO: 39368 - DNA, 201 bp, Homo sapiens
tcatggagctcggttccagcaggggagccaggcagacatgaaagagccctctggatgccgagacgtgtgctgtgaaagtgtggcatagaaagtgcctgggrgatgatggccacttcagtggggcaagagagaaggtgacattggagctgtcattgatgataacggcggcagcgctgaggggacggggaccgagatccaggc

SEQ ID NO: 39369 - DNA, 201 bp, Homo sapiens
gtcggcaaggaaatctagaactctcatataccatttggttatgcaaatgaaaattggtacatttctggaagcaatttgacaatttttacgagagctttaarattgtgttcgtcttttgacttgcccattctgtttctaagagtatgtctcagggaaataacacacaaatgcatgatgcatccacccacatacaaccaggga

SEQ ID NO: 39370 - DNA, 201 bp, Homo sapiens
cactctcctcctactcatggtatagataagagggaaggagggggtagagtgggagggaaaccaccaaccccagcaagccacagactccaggaggccaccaytgggtcccgaaccatgctcctattgtctttacaaaggggaatggcagctgctccacctcccacaacatccaatcaggcatcctgcagacggtggcaaatc

SEQ ID NO: 39371 - DNA, 201 bp, Homo sapiens
atgtgtaataataactgtatgtcttctgaggctgtgttctaaaagacattgcagcttctgtctttgttctcttggattgtctcagggaagccagccaccaygccatgaggacactcaagcagccctgtggagagacctacctagttaaccaaccagcacgaatttgtcaggcatgtgagggagccacgttggaagctaatc

SEQ ID NO: 39372 - DNA, 201 bp, Homo sapiens
gagagtagagacatgaatgagtgctgatggcccacttgaggtttgtggtcataaatgtaaagagagattagtggacagagttgttttcttccagtcacatstagctgctcaggtgaagggaatttgctctggccatttttcaggacaatataatgaggaagagaggggccaggagtggttattgtgttagaatctaaaggg

SEQ ID NO: 39373 - DNA, 201 bp, Homo sapiens
tcattttatttgaagcaggaagggctggggactcccagcagccccaccggagggaaggagggaggaaggagcggggatgtggagagaggcccctgtgaccytgtttatgtgcaggcctgggaggaatggcattagtggtttcaggaggtgttgccctgggattgtagcacagggacaatgcgctgagttcacatgcctgac

SEQ ID NO: 39374 - DNA, 201 bp, Homo sapiens
atcagtggtgggtaaaactgccagcaccttggcacaaattaaggcattggtactaaattgtactagtagttgtgttcttcatcactgtgcacttggaattaaaaaaaaaaaatgccagttaaactttatgtccttgatgaagcaataaaacttactaattttattgtatctcaatccttgagtacatttaaaaatatattt

SEQ ID NO: 39375 - DNA, 201 bp, Homo sapiens
cacgccaccacgcctggctaattttttgtatttttagtagagatggggtttcaccatgttggccaggctggtctcaaactcctgacctcaggtgatctgcytgccttagcttcccaaaatgctgggattacaggtgtgagccaccactcccagcctttttaaaattttattttttgagacagagtcttgttctgttgccca

SEQ ID NO: 39376 - DNA, 201 bp, Homo sapiens
cccctaaactcttacatgcagggtaggtggagaaatccaaggctgataggcctggctgctcctgctacaggtccccagttaattcccttgtcaatttcccyggagtatcttttgttccaactttcttccatcacctctggacatgggacatcttagtgttgctcctccttttgaggtggttcactgcagctactgtatcct

SEQ ID NO: 39377 - DNA, 201 bp, Homo sapiens
tgatctcttgagtttcatttatttgatacttcttgagaagccaggggtttctttcctgaagaaggaactaataaaacaaatgtacgtttcaagctttaagrccagaagtgtccatttctatgtttatcaaaaaaaatctatgggactgttgggtcggtttcatcctgatttctcagaaggtccgataacaacttactttct

SEQ ID NO: 39378 - DNA, 201 bp, Homo sapiens
ccgccaaatagttttccaaagtggctgtactattttacaattccatcagcaatgtatgagggttccaatttttccacatccttgccaatactttttattgkctatcttttttattatagcaagcctggtgggtgtagtgaggtgcctcattgtggtttttatttgcatttccctaatgactaatgttgaattcttttcatg

SEQ ID NO: 39379 - DNA, 201 bp, Homo sapiens
gaaaagagcttgcgaagtctccttgcccagtggttttcaagcaggtttgtagctaaagattctcgtttcaaagaaaaccttaccaagaacctcagtttgcraaacagacctatagggagctaagtcaccccacttcaccttcccagattgtggaaaaactctggtctgggcccaaaccctccttgtagagatgggaaaact

SEQ ID NO: 39380 - DNA, 201 bp, Homo sapiens
tgcccattatcatgagcccagcgtggactcccacgcggacccaggcccccagccctggccacagggtcacagagataactccgtgggaaattataccccakggccctttgctcctgactccccacgtggagcagagaaccactcagatgcgtgcttccagcccccacctcggacgacccgctgtccccctctcacggctgt

SEQ ID NO: 39381 - DNA, 201 bp, Homo sapiens
ggacttgcccagggtcctgctgccttttatggctgagcttgggacaggcttagcactttttcccttcagagctccaactcactccttaaattgaaccccartttttcagtgtaatttgcaggtacaaatttcagccagttgcctctacaaagcccctgtccattccttccaaatccctgatctcttcctattcatttgccc

SEQ ID NO: 39382 - DNA, 201 bp, Homo sapiens
tgaaaaagcattaaaagcctgatgtctgtacagagatcacacaaattggcctgtagatgatttttgttgaaggggtggtgacagagcagtaataaaaaacytaagttgttcttatccactgagttgagtctttagaacccagcttaatattttcatggctcagatttattttgaatcttagcttttatttagtgctttaaa

SEQ ID NO: 39383 - DNA, 201 bp, Homo sapiens
gaggctgggcatggtggctcacacctgtaatcccagcactttgggaggccaaggcgggcagattgcttgagtccaagtgtttgagaccagcctgggtgatrtggcgaaactctgtctctacaaaaaatacaaaaaattagccagatgtggtggcacacacctgtagtcccagctacttaggaggctgaggcaggaggatca

SEQ ID NO: 39384 - DNA, 201 bp, Homo sapiens
ctttcatgctttccctagaacttcaacaacagcaacaaaagctttatagatatttaaggagaccaaaaaggagaaagcctgaggaagagccatccacttargctgctcctcatcctactggaatgaggaagtgtagcttggattcccagcctggctgacttctccaagcgttgacatctgtcccaccccatggggccaaca

SEQ ID NO: 39385 - DNA, 201 bp, Homo sapiens
tagttttagttgcttttaataatgatcctggattttttaaaagaaacaaacattctataaccagaaagatttctgagaatccaaatagatacaagattgascttagaaaaatctaaagaaatggttgtttagaatatcccaacttgaattatctggcaaatgtacgtatcacagatatgaaaggaaccttgtttccctcct

SEQ ID NO: 39386 - DNA, 201 bp, Homo sapiens
cacctgtaatcccagctacttgggaggctgaggcaggagaattgcttgaacccgggaggctgaggttgcagtgagccaagatcatgccactgcactccagyctgggcaacagagcaaaactccataaaaaaaaaaagtaaatgggcaaaagacctgaatagacattcctaatatatttctgttatttagtttaattgaatt

SEQ ID NO: 39387 - DNA, 201 bp, Homo sapiens
taacttttctttctgcactttttatgtattttgagttgtaattatattctgcttattgtgggcagttctcttctttcttggagatgaaactttgataattratacttacggggagatggtgttacaaatcttctctcataataggctcttaatattcacaagagagatcccccatgaccattgtaagtacccttaattatg

SEQ ID NO: 39388 - DNA, 201 bp, Homo sapiens
gatcttgcccaaattcttatctaaggggtctggggaatcatgccctacaaaccatacattcttatcagatgagttttatttaaccctgtatatcatgactkactttccaatctgactctcatataacaagaaagaaaatcaaaatatttaaccctaaatatgtttcctagccatttcttgaaattgccctgcaaagtctct

SEQ ID NO: 39389 - DNA, 201 bp, Homo sapiens
gcgaaattgtgaaagtggtcaggctacctctgggaaccttttgtggccataccccatcctgttctcctgaatggttctaattctgattgtgggttatcccrcagaggtgaggactaagctctgattttttgatcttgcccaaattcttatctaaggggtctggggaatcatgccctacaaaccatacattcttatcagatg

SEQ ID NO: 39390 - DNA, 201 bp, Homo sapiens
acatcatgttaatgagaccaaatgagcaagaaatgacaagtatattaaagactgtggcatgacacattcactccagaaggtgggaaataactcctacccaratttagggcccagacacatcactgaaatgcataaaggtctagtggtctgggcataaaggtaaaggagtgctggagctctgaggtaaagaatgtaaagaac

SEQ ID NO: 39391 - DNA, 201 bp, Homo sapiens
cactctccatacactttcttaggtgacttttgtatcttattctcttactacatacttccaacaactgttgttgagccgtaactctttggtgattactttgygttttatttcttcctcactgagaaaatggaaccaatcagaagataacttataaaggcttccaccaatatataccttatgcccatgtgcctacatctctgt

SEQ ID NO: 39392 - DNA, 201 bp, Homo sapiens
ggggtctaactcaacactgatatctggtgacccaaagtgcttttatatccctccctcccatcagaatgagggagtatgggttccaggtgacaacgaagccstgatcctgctctaattcacagtgagtccagttgggtgcgtccaccaacccactgtggtcctatccctgattcctgaacgcttcggaatggacatacatgg

SEQ ID NO: 39393 - DNA, 201 bp, Homo sapiens
aacaatttgtgtgtggattgggggtgcttaatcctacctggccatcatacagtattaccctagtccatacactctccatacactttcttaggtgacttttstatcttattctcttactacatacttccaacaactgttgttgagccgtaactctttggtgattactttgcgttttatttcttcctcactgagaaaatggaa

SEQ ID NO: 39394 - DNA, 201 bp, Homo sapiens
gtttgcatttccctaatagctaatgatgttgaacatccttttatttgtttatttgccatctgaatatcctcttcagtgaaatatctttttatgtcttttgkcttttctaattgcagtgtttttttttttttttaacttatgagttttcagagttctttctagattctagattctagtccttcgttgggtttgtggtttgca

SEQ ID NO: 39395 - DNA, 201 bp, Homo sapiens
cttgggccttggcatgagtgttttctttacctggaatactcatcccacaaacattcacgtggccatctccttcatcttcttctagtcaaggtattaatatktctgatgagacacctaccctgactaccctattctttccaattcccattacactgccctattatttccataacattgtcagcatctgacatactttactat

SEQ ID NO: 39396 - DNA, 201 bp, Homo sapiens
ttagaactgctgtggcagataggagttcaagtcttggagaagtagtccaggtatggtggctcatgtctgtaatctcagcactttgggaggctgaggtgggmggatcacttgaggacaggagttggagaccagcctggacaacatggcaaaacccgtctctactaaaaaatacaaaaaaaaattagccaggtggggtggcct

SEQ ID NO: 39397 - DNA, 201 bp, Homo sapiens
agtttatcactattagatcatctcccctttgtcccattagacttctgcaggactgttcattcttcatcaaagccaagcataaggatacacaggtttccctstttctttgagtcttcatttctgaaggctcctgtgtcatgtaaaactaatattaaatacatatgtatgcttttctcttgttaacctgtcttttgctacaga

SEQ ID NO: 39398 - DNA, 201 bp, Homo sapiens
atttcctctgagagacctagcttctttttttttttttttttttttgagatagagtctgtcacccaggctggaatgcagtggtgtgatcttggcccactgcracctccactttccgggctcaagccattctcctgcctcagcctcctgagaagctgggactacatgtgtatgccaccatgcctggctaatttttgtattttt

SEQ ID NO: 39399 - DNA, 201 bp, Homo sapiens
aatttgggaccctctgaagggccatgtggctcagagctccctgtaggattggctcttcctggttgcaaccacattgggggtcatcttctccctcttctcartcctgccctctcacttacgtacaggtgtatctcccaaaattactgcctaagaaaccttctgcagacagaaaccacctccatctcagagtctgcttccagg

SEQ ID NO: 39400 - DNA, 201 bp, Homo sapiens
ctgatcactccacacttgtttaacctgcctgtgaggttcactattttctcagctctgtgatcatcaatggtttcaaatcaccaatgtagccatgcttcatyatcacagttagaaactggatgatgactttggagaacggcctaataagaacctggcatttactcctcttctcagcattgttgatgctcttgagagcatcaa

SEQ ID NO: 39401 - DNA, 201 bp, Homo sapiens
tgtggcatttaaggggctagggcttaacattctcctcctctttttccttcccattagcagcaacccagatatggctgctaacccggcgtcaaccatgcagwtgagaactgggctcttggaatggcagaacaataacttggaaagagcctgggtcttgagggactatgggctgcagagctgccagccttcaaggactatact

SEQ ID NO: 39402 - DNA, 201 bp, Homo sapiens
catgtcactggggtcagtgggagtgctgctggaaagtgagggaacatatgatgattaatagtaataataataataaatcagtacttgtaatgtcccaggarttgtgtcaagcagtatctcatttaacccttacaacagccctttgaagtagatactggtagatggtatttccattggctaggtgcggtggctcacgcctat

SEQ ID NO: 39403 - DNA, 201 bp, Homo sapiens
gtgtcctttggtgggctccctaagctctgtctgcacaactttgtaaatagtccctgtattaaactcacctcaaattgtatagatcccctgcagggatcctraatgagaatggctagttttagttgcttttaataatgatcctggattttttaaaagaaacaaacattctataaccagaaagatttctgagaatccaaatag

SEQ ID NO: 39404 - DNA, 201 bp, Homo sapiens
gtggtgggaactgaggtttcctgctaaaacccagcactaacttgcagggtgagtgtcttcatgcattttgtgctgctctaacagaatacctgagaccgggyaatttataaagagcagtaatttatttcttcacagttctacacactaggaagtccaagattaagacagcggcatctggcaagggccttcttgctgtgtcat

SEQ ID NO: 39405 - DNA, 201 bp, Homo sapiens
aagcaattaagctcatttgcataaggttaattaaacacaggtttactgctcagaaagaagatccttcatcaataggattcgttttgggagcaggtatcagrtaagtgattgttaacctagaaaaggaaaactttgttcctgttccaactgtgtcctaaagggggtattccttcactccgtcatacttttccaggtcactgg

SEQ ID NO: 39406 - DNA, 201 bp, Homo sapiens
ggatcaccatttcctgtgcagcattttcccctgggccatctttgcacagatgcctgggaaactattcctcttctgccagctctttcttcaggcagtacacmgtgtgctcgggaggtttcaccttgtttggtgatggtcatgtttcagtgcagtttcaagtcctccccaaattcttcagttatataaccacaatgtcttcaa

SEQ ID NO: 39407 - DNA, 201 bp, Homo sapiens
agaacagccttggaaaagtaaaattactagtgtctcctcccttaagaaccataagaagtttgaagtgaaaagacttaaagattatctagtgtgggttccarttttactacaagtaaaattaagctgagaaaggaggattgacttgcctaagagggcacaagtattttatagagaaatagattaaaattcaaataattgtat

SEQ ID NO: 39408 - DNA, 201 bp, Homo sapiens
gtatgagggtactactaaggggcattttacattctcgaagtatgctgtaattgttgtttataatttaaatttaatctttttctttagtgtttttaattacwtaagaaatacatactcattgtaaaggattcaaaagatagaaaagtacatgaaataaaaagcatcactttatcgctttctactgctaaaggtagacactta

SEQ ID NO: 39409 - DNA, 201 bp, Homo sapiens
tattgtctcagtgtatttataaaaattttacattatttatttttattattgttatttttttgagatggagtttcgctcttgttgcccaggctggagtgcartggtgccatctcggctcaccacaacctctgcctcccgggttcaggcgattctcctgcctcagcctcctgagtagctgggattataggcatgcgccaccac

SEQ ID NO: 39410 - DNA, 201 bp, Homo sapiens
aagatgaagacgttcaaagctcagcttctctcttgttaccaagttagagaaaatcgatatctgtttttcagataattatttagaatttagtgatttttttwaaaaaaatcaggaatatgagaattatcacataatagttattttatgattctaaggcatttgtgtggcagctaataatgcatttgaaagcgagcttttgct

SEQ ID NO: 39411 - DNA, 201 bp, Homo sapiens
gaggaggagcacgtgttcttagagctcagtgtccctcccaccacattcccctgtgcgttgccccaggcacaggaactttgtaatcacatccagcctgggaytataaccaaacacagcattccaccaccctctgcaacctctttgtttgatcttccccctggagacacaggtcaagaggaagagaaggggaaggggggcaaa

SEQ ID NO: 39412 - DNA, 201 bp, Homo sapiens
cagcctgggcaacatagggagaccccatttcttttttttttttttttgggagaccccatttctacaaaacttttttaaaaaaattagccagatgtgggggygcatgcctgtagtcctaggtactcaggaggctgaggtgggaggatggattgagcccaggagatcgaggctgcagtgagttgtgattgtaccactactaca

SEQ ID NO: 39413 - DNA, 201 bp, Homo sapiens
tctcctgtaagtctactccagtcatgcttttgcttcattcaatccactgaaacttctcttgtcaagaacacctgtgatgccaaaccccatgatctgttccyagtctccaggttccttgatctattagtacttgacacagttgatgaggttctcctgcttgtgcactttgtcacttgacttccaggattccacactctcttg

SEQ ID NO: 39414 - DNA, 201 bp, Homo sapiens
aagaccagcctgggcaacatagggagaccccatttcttttttttttttttttgggagaccccatttctacaaaacttttttaaaaaaattagccagatgtrggggtgcatgcctgtagtcctaggtactcaggaggctgaggtgggaggatggattgagcccaggagatcgaggctgcagtgagttgtgattgtaccacta

SEQ ID NO: 39415 - DNA, 201 bp, Homo sapiens
ctgggctgcatgtcaaagtctgtcatgtgtctcctgggtgacgcttaacaaattgcttagcctctctgggcctctgatggctcatctagtgttaataagawaataagccaggcgtggtggctcacacctgtaatcccagcaatttgggaggctgaggcagaatgattgcttaaagccagcagttcaagaccagcctgggca

SEQ ID NO: 39416 - DNA, 201 bp, Homo sapiens
cgttgttacatttggtctttgttctgccatcttaatttgttgtctgtcatttttttctgacctctgtgatatgaattatactttgtttctcttttattttstaatggtttgggagttctgccttctatttctgtaggtagttactattgaaattttacccaacacatttaagcctaaattttactaccaacatcaacaact

SEQ ID NO: 39417 - DNA, 201 bp, Homo sapiens
attctcctgtaagtctactccagtcatgcttttgcttcattcaatccactgaaacttctcttgtcaagaacacctgtgatgccaaaccccatgatctgttcctagtctccaggttccttgatctattagtacttgacacagttgatgaggttctcctgcttgtgcactttgtcacttgacttccaggattccacactctct

SEQ ID NO: 39418 - DNA, 201 bp, Homo sapiens
aattcttttggttaaatacctagaactagaaatgctggctcatatggtaactttgtttaacctttgaagaactgccagactgttttctaaagcagctgtaycatttatattcccaccagtgatttatgaggattcgcatttctctccacatccttaccaacacttgttattatatgccttttttaatatagtcatcctagt

SEQ ID NO: 39419 - DNA, 201 bp, Homo sapiens
cctgacctcgtgatccgcctgcctcggcctcccaaagtgctgggattataggcatgagccaccgtgcccggcgagaggtgttttcttaagaggaggtcaargagagtatgaggaatgcttggagattgtcaaggctttgtgccggaggttccgctactacctacaacagtccatctcccttctttcctgggcttatagcca

SEQ ID NO: 39420 - DNA, 201 bp, Homo sapiens
ctttagtgccacctctcccatcccctgaaactactaatacggcatctgtctttatagattttcctgttttggacatctcatatgaatggaatcgtatggtrtatgaccttccgtgactggctgttttcatttagaatgatgttttcaagttcataaagttgtatgtgccgaaactttgttctttttaatggccaagtaata

SEQ ID NO: 39421 - DNA, 201 bp, Homo sapiens
tttccacatacttatttgccatctgtcgacatacttatactctttggtgaaatgtctgtgcatatttttctcattctttaattgaattacttgtttttatrttattgacttttgagagttcctttgcatattgtagatactagttttagtcagagatgtagtttgcaaatgttttcttccagtctgtagcttgtatttctt

SEQ ID NO: 39422 - DNA, 201 bp, Homo sapiens
cttcctcgcctgcctcccgttccgggccttccctcttcacccaccggatatcttttcctttcttgccttttcctgtccccagatcttgctcttggaccagygcctaattttcagaaggtatttccagataagaaaagctacagtgacaaagaaaacgcatcagtctaggatcactgtggtggcacagggagagtttgggct

SEQ ID NO: 39423 - DNA, 201 bp, Homo sapiens
tcctgttgagttttttaattataaaagcatgttgtaattaattaattaatttatttatttatttttgagacggagttttactcttgtcacccaggctggartgcaatggcatgatctcagttcactgcaacctctgcctcctcagttcaagtgattcttctgcctcagcctcccaagtagctgggactacaggcacgcacc

SEQ ID NO: 39424 - DNA, 201 bp, Homo sapiens
tgtttcttttttagtgcgttaatatggtgacttgatttttgaatggtgaaccagccttgtatttttgcaacaaatctcccttagttatgataaattattgyttttccatatggttggattttatttgctaaagttttattaagagtgtttgcatttatgttcatgacaggtaaatggttggtaattttttgtctaataagg

SEQ ID NO: 39425 - DNA, 201 bp, Homo sapiens
ggctttctcaaggaatttgaaaaaaatttttcttgtcagcctcttctgtaaaagaatatccagcaccaaagcatgtgctgtggttttgttaaaaattgttytgtaatttgaagagtctgggtcacagccccagagagcttctggatggcaactgcatcacagtcctgaaataaaagatgctgtcaatatgctgccatccag

SEQ ID NO: 39426 - DNA, 201 bp, Homo sapiens
agccaccgcacccagctgactatgagtgttatttctaatgttctaattcaatgttcttctacttgattactgaaggatagaatatctccttgctgtggtcygaatgtgtccctcacaaattcaaatgttgaaacctaattcccaatgcaatagtgttaagaggtggggcctttagcaggtgattaggtaatgagggcgtgg

SEQ ID NO: 39427 - DNA, 201 bp, Homo sapiens
agacattcctgaggggtccacccccatgaccaaagcagctcccactaggcccccctccaacattggggattacatttcaacttgagttttggaggggacaratatccaaactatatcatgggagaagtgggctttctcaaggaatttgaaaaaaatttttcttgtcagcctcttctgtaaaagaatatccagcaccaaagc

SEQ ID NO: 39428 - DNA, 201 bp, Homo sapiens
tgtcatatgggagaagaattaaatttgctctagataatgcagcaggaaataccaggaccagcagctaaatatttttaggaaaaaaagttaattcaggaggraggaaaatgtagaggccccagaagcagcctagaggtactgtagtgaagtggaagtgaatgagcccaaggtggggagacacaaatggtatacactggtgag

SEQ ID NO: 39429 - DNA, 201 bp, Homo sapiens
ttggtcaggctggtctcaaactcctgaccttgtgatctgcccacctcggcctccaaaagtgctgtttaaccatttttaactacacatttaattggcactamgtgcatttacattgttgtgcaaccaccactattatctatttccagaacttttttgatcatcccctactgaaactctgtactcaataaacaataacaatat

SEQ ID NO: 39430 - DNA, 201 bp, Homo sapiens
ctgtctgacttgaaagcccatgttctttaatacctatattgtacagataaggaggctgggaacagagagattaagtggcctcttgttgcatcttggacttyctgggaggtagattctgagacagattgtcatgcaggaagtgtattgggaagtgttcccaggatcaacaccctgagggggagtggagaaggcaggactggg

SEQ ID NO: 39431 - DNA, 201 bp, Homo sapiens; identical to SEQ ID NO: 8645

SEQ ID NO: 39432 - DNA, 201 bp, Homo sapiens
actctgttgcccaggctggagtccagtggcatgatcttggctcactgcagtctcgacctcctgggctcaagcgatcctcccatctcagcctcccaagtagstgagactccaggcatatgccatcatgccaggagcctttagcaggcatgtcctgctaaaattttggttgtattttgtagagacgtggtcccactatatttc

SEQ ID NO: 39433 - DNA, 201 bp, Homo sapiens
ccaaggcactgctggatgatcaaaataaaggtccttcctcttacgtgctgtgagtctttaagggggtgaagaagtcaagcactgagtgggaagtacacctrgaggcgcagtgtccactgggctgcatgtcaaagtctgtcatgtgtctcctgggtgacgcttaacaaattgcttagcctctctgggcctctgatggctcat

SEQ ID NO: 39434 - DNA, 201 bp, Homo sapiens
ttgagttcatggtcccgcctgctccaaggcactgctggatgatcaaaataaaggtccttcctcttacgtgctgtgagtctttaagggggtgaagaagtcargcactgagtgggaagtacacctagaggcgcagtgtccactgggctgcatgtcaaagtctgtcatgtgtctcctgggtgacgcttaacaaattgcttagcc

SEQ ID NO: 39435 - DNA, 201 bp, Homo sapiens
caggcctggaaagatacttagggatggtctagttcagtctgagtcagtgtgagcctggcctcatcccagacagacaaccatctccctacaaacagcaccakgatgccttgttgagttcatggtcccgcctgctccaaggcactgctggatgatcaaaataaaggtccttcctcttacgtgctgtgagtctttaagggggtg

SEQ ID NO: 39436 - DNA, 201 bp, Homo sapiens
tccacccccagccttcccgggacgtcctgtgcagcaggagttgataacgctgtgtacaggctgatgggggtagacacgctcttgttgccaggccctggacrctctgaaccccagcctgggctcctggccttaatggggcagggaggggaccatcggggcacagagccagggatcctgttactctctacatagaggtgccaa

SEQ ID NO: 39437 - DNA, 201 bp, Homo sapiens
agaagcaatggcaaaggggctgtggatgggcctgactgtctggacatggccaaatctgctgcccagccacttgctcttgtgacttcatcctgacctgaagygtctgcctacaggtgctcctgcctctcccctggcccagcaaggaccgcaggatgcccttccttaactcctgggtaggagcccacagtggtgactgatcca

SEQ ID NO: 39438 - DNA, 201 bp, Homo sapiens
acggtggcaaatcacagagaagcaatggcaaaggggctgtggatgggcctgactgtctggacatggccaaatctgctgcccagccacttgctcttgtgacytcatcctgacctgaagtgtctgcctacaggtgctcctgcctctcccctggcccagcaaggaccgcaggatgcccttccttaactcctgggtaggagccca

SEQ ID NO: 39439 - DNA, 201 bp, Homo sapiens
tctgagggtaaacagagctggatttgaagcccactctcctcctactcatggtatagataagagggaaggagggggtagagtgggagggaaaccaccaaccycagcaagccacagactccaggaggccaccattgggtcccgaaccatgctcctattgtctttacaaaggggaatggcagctgctccacctcccacaacatc

SEQ ID NO: 39440 - DNA, 201 bp, Homo sapiens
agacttctgttctccagaactgtgagaaataaatctctgttgttgataagccacgcagcttattgtgctttgtgatagcagcctgaattgactaacacaaygatcccagggcccagtgaggttgaataactcacccaaagtcacacaggtatttaggccacttattgtagacatcattcttgttccaggtccccttttgag

SEQ ID NO: 39441 - DNA, 201 bp, Homo sapiens; identical to SEQ ID NO: 8646

SEQ ID NO: 39442 - DNA, 201 bp, Homo sapiens
ccaacaatgctggtaccctgatttcagacttctgttctccagaactgtgagaaataaatctctgttgttgataagccacgcagcttattgtgctttgtgayagcagcctgaattgactaacacaacgatcccagggcccagtgaggttgaataactcacccaaagtcacacaggtatttaggccacttattgtagacatca

SEQ ID NO: 39443 - DNA, 201 bp, Homo sapiens
ggcagtctgcaaccctgaagagagccctcaccagaacccaacaatgctggtaccctgatttcagacttctgttctccagaactgtgagaaataaatctctrttgttgataagccacgcagcttattgtgctttgtgatagcagcctgaattgactaacacaacgatcccagggcccagtgaggttgaataactcacccaaa

SEQ ID NO: 39444 - DNA, 201 bp, Homo sapiens
aaagaggcgaagacttgcccaagttccctcagcaggttagtgcagaggaaaggaagtcagccaggtctctggattttctggggctaggaactgcctgtctytttcctaatttctgttctaatcttttcttttcttttaagtagcgacagggcttcaccttgttggccagactggtctcgaacccctgacctcggtatcctc

SEQ ID NO: 39445 - DNA, 201 bp, Homo sapiens
aagacagtagttctgataattcccattttattaggtaattctcattcattcttacgatcattttgttatttctttaaaacaatttaaaataattttaaggmctttattttggagccataattaaagtattcttttcattgtccataattaactgtaagaattgagaggtgaagtaaaaggtggttgtaaagtaagatgttt

SEQ ID NO: 39446 - DNA, 201 bp, Homo sapiens
gaggaaggagcggggatgtggagagaggcccctgtgaccttgtttatgtgcaggcctgggaggaatggcattagtggtttcaggaggtgttgccctgggaytgtagcacagggacaatgcgctgagttcacatgcctgaccctgaagctccaaaggcctcagacacagagcatggccagagcagggttggaggaggcctga

SEQ ID NO: 39447 - DNA, 201 bp, Homo sapiens
cctttttgagtttctgcagggtaagttgacttgcttcacatggtatcacccatgcacagtctattaagagtcagccgcttctagtctgataagacaccctsgatgtctatcgacttttcatcctcctagcgcatgttgacgactctttcccccattgtttccattcttgtcctctttgtccttgtgaacttagtttgttcc

SEQ ID NO: 39448 - DNA, 201 bp, Homo sapiens
agttgatcacaactatcactgagtccagaatgggacaggcacatttactttttcattttttcccttccattgtggccttaagcactagatttaaacagatyttaagatgttcaaatgtaaactgaatgtttttatgcatggttttgtatttctaactaaaatggaagacagtagttctgataattcccattttattaggta

SEQ ID NO: 39449 - DNA, 201 bp, Homo sapiens
attgttttatagttgtaccatggttataaatgatagcttttttcagagcctttggaaatttatctaattgttgcataatctctgcctgttcccagctaccttttttttttttggtcattttggtcaccattattccacattgaaggctttcctctgatacttggtcgtgctggcatgtctgttcattttttttgacttatt

SEQ ID NO: 39450 - DNA, 201 bp, Homo sapiens
ctgtatgggattgcaaggatgggaggaaaagtgtcacacctcctccaaatcctggctgccctggagtccagacatcgctccctgccaaggctacagtgacygcagcagtggtacaggggaagactgcaatggctttcagccaagaaggtccatatttatgtctcatcaactgtgactaggtgggtcaccagtctcttccag

SEQ ID NO: 39451 - DNA, 201 bp, Homo sapiens
tgataaaacaggttgtgtaaagaagtcggccaaaacccactgataccaagatggcaataaaaatgacctctttttttttaagcctcatattcattttctgyattaccttgtgcctctagttactgagcctttttgagtttctgcagggtaagttgacttgcttcacatggtatcacccatgcacagtctattaagagtcag

SEQ ID NO: 39452 - DNA, 201 bp, Homo sapiens
tggtgatgcaatcttttaggattctgctaatagctgtgtgatcttgggtaagtgatttcttctctttggattccattttccaccactttaaaatgggaggwttggtatagatggtcatttcctattagtaggtggggaaaaaggagaaagggggactaaataagtttgcgaacataggtaaacaaagttaaatagattact

SEQ ID NO: 39453 - DNA, 201 bp, Homo sapiens
gaaagagttttccaagccagagaagtaaaggaaggactcatatttctttgattaaccagctatattgcttataaagctctttatatacttttctcctcagwattttattttttgcttaatggttttgccacctgcaaagaacccttagagaattggctggggttatcattgtgagtggtggtgagttagggaaggcagcat

SEQ ID NO: 39454 - DNA, 201 bp, Homo sapiens
aagaaaagagaaatgcagaaaattaaaagagttcatggaaattaaaaatttaatgtaagcgttaggagataaaattgaggaaaatcccagaagatagagcyaaaagacaagagatgtaaaaatgcacaaggaaaaagaaaatagagtaaaggaaaaatgagattatcagtctaggaagacctgtgtctgaataataagtgt

SEQ ID NO: 39455 - DNA, 201 bp, Homo sapiens
ggatacatttgggctagagggaaaaaatgtgtgagtcatctgcatattggtggttattggaaccacactggcagggctgacattgattctcctgcattactttttttttttttttttttaaacattctttcttccagataaagtagaattactttatcatatttcttttcctcgctcctgtaccccatttgcacatctttc

SEQ ID NO: 39456 - DNA, 201 bp, Homo sapiens
aggacaaatgtgaaactacctcttgatcagtcacagactgtgggcctcttgggagtctgggaggtcacaggtcaaggcctagagaaatggctgtgtcctakgattagggacagtggaactgctttctctcctgaggcctctttggtgtggtcatggggtgctgctgatgtctgcagccctctgggcactctctcaaagctg

SEQ ID NO: 39457 - DNA, 201 bp, Homo sapiens
attgtcttgaatgtattgaacctcccattctgcactactctgcccttagaacactagaagccagccttataccaccaaagcaggagattgggttgttcctytctgtcaaaagtgatcagacaaaaggaagcaaagggaatccaaacaaaatagccaggttattgcccagtcattctagatgaagtaccctggtctgctcac

SEQ ID NO: 39458 - DNA, 201 bp, Homo sapiens
ctgttaaacatcctacaatgtactgcacagcccctcataacaaacgattatccagcccaaaatgtcatagcatccaggttaagaaaccttgagttacagtyattaaaatggatgaccctcataatgttgagcacagaaagcaagttgcagaagaatatatatacagtataatactattttttaaaattcaaaagtaagcaa

SEQ ID NO: 39459 - DNA, 201 bp, Homo sapiens
agcagagcagggacacaaggttggtcccccacttgaaatcaggtggtctttcaatcaatgtggctgggtctgaggcttttatgggcccagaatgggagagygcatgctgattggtttgtgagtacgcaagaaagcctaaaacgaaggtaccactcaaaggtgggcatgacggtgtaaaatcccaattgaggaagggtagat

SEQ ID NO: 39460 - DNA, 201 bp, Homo sapiens
cactccagtgtgggtgctgtgtctgctgtgactgtgctggcaggaggggatgtgtgagccagtgacagcagggtccagccagctgttctaagagccggcasaggagtgggatccatgcagggcttgtggctgaaccaggtgtgtcacaagcgactcctgtggtagactctggtgtccagacgaggggaatgtggtggcacc

SEQ ID NO: 39461 - DNA, 201 bp, Homo sapiens
ttgccagccagagacctccagccagcaatacccctggcccaggccttgctcgggcctgggttcaccacaggagaggccccatctaccgctgggctatgccyggcttgcactccagtgtgggtgctgtgtctgctgtgactgtgctggcaggaggggatgtgtgagccagtgacagcagggtccagccagctgttctaagag

SEQ ID NO: 39462 - DNA, 201 bp, Homo sapiens
ttttctcggtcactttgccagccagagacctccagccagcaatacccctggcccaggccttgctcgggcctgggttcaccacaggagaggccccatctacygctgggctatgcccggcttgcactccagtgtgggtgctgtgtctgctgtgactgtgctggcaggaggggatgtgtgagccagtgacagcagggtccagcc

SEQ ID NO: 39463 - DNA, 201 bp, Homo sapiens
atattcctctttaagagtggggaaagagactgctgtttcatgaattctttatatttctcttagagtggggcaaaggattcctgttttatgcagaattctgytttcatgagaacccggaatttttaatggtttgtagggataaatccgagactttattgttaatggttttaaggtacattgcaaggtctcttgtttcatgag

SEQ ID NO: 39464 - DNA, 201 bp, Homo sapiens; identical to SEQ ID NO: 8643

SEQ ID NO: 39465 - DNA, 201 bp, Homo sapiens
gttgttgttatttatgtatgtatttatttattgagacggagtctcgctctgtcacccaggctggagtgcagtggcgcgatcttgtgtcactgcaacctccrcctcccgggttcaagcaattctcttgcctcagcctcccgagtagctgggactacaggcgcccgccaccacgcctggctaacttttgtatttttagtcgag

SEQ ID NO: 39466 - DNA, 201 bp, Homo sapiens
agcctctgcgccggctcgcgcccgcagtgcctttaaaacgtgcgttggaagtagacgccacgcagcctgctttccagagtcccggcgtttcccctcttccrccgctgcactccaggggcctcccttacgcgtccgcacgcggcgagtccttccactatgcagggcgcgccgcaggactcttgagtgggcgggaaggctgga

SEQ ID NO: 39467 - DNA, 201 bp, Homo sapiens
ctccctaagggcccctggcttagaatatgtgtgagtggcaacccagtccctcaacccctgcgcggggagccggggcagagcgaactgctgtaactttcgcwcgccgccaccagagggcggcggctccgcggaggagggccccagcctctgcgccggctcgcgcccgcagtgcctttaaaacgtgcgttggaagtagacgcc

SEQ ID NO: 39468 - DNA, 201 bp, Homo sapiens
gagatgctcctcattaatgaacgttctccctattgcaatggcctgaatgaaatcttaactgtctggggcttttggcgttcacaatgaccataattgtgctrttgtaagcgtcaatcgggggcgcagccggagtcccaggtcccagtcctggcttccccatgtcaggcttccccttcgggccggtttcaggtctcaattggg

SEQ ID NO: 39469 - DNA, 201 bp, Homo sapiens
gttggcagtctgcaaccctgaagagagccctcaccagaacccaacaatgctggtaccctgatttcagacttctgttctccagaactgtgagaaataaatcyctgttgttgataagccacgcagcttattgtgctttgtgatagcagcctgaattgactaacacaacgatcccagggcccagtgaggttgaataactcaccc

SEQ ID NO: 39470 - DNA, 201 bp, Homo sapiens
ggtagctcacacctgtaatctcagcactttgggaggccgaggcaggtggatcacttgaggtcaggagttcaagaccagcctggccaatatggtgaaaaccyatctttactaaaaatacaaaaaccagcaaggtgtggaggcatgtgcctgtagtcccagctactcgggagactgaggcaggagaattgcttgaacccggga

SEQ ID NO: 39471 - DNA, 201 bp, Homo sapiens
ccaaggaaagacatcccctatctctgtgggtaaatgcaagaaacttaaaatcagggaagtggttctcatgatggaggagaaggaagtcagtaaagaaaacytgatctcgccaggcgcggtggctcacgcctgtaatcccagcactttgggaggccgaggcaggtggatcacgaggtcaggagatcgagaccatcctggcta

SEQ ID NO: 39472 - DNA, 201 bp, Homo sapiens
agagcttcctctatacaataaaacttggtttccgcaatcctttattttaacctgaacatttcctttctattgatcccagatcttcagataaactcaaccarttgtcaaccagaaaatgtttacatttacctatagcctggaagcccccaccttgacttgtccctcctttctgaaccaaaccaatgtatttcttaaatgtat

SEQ ID NO: 39473 - DNA, 201 bp, Homo sapiens
acagagaggggatgtcaaaacaggcaaagtccatgggagaaagggaggggatttggagcaggtttacagagattgtcttggatttaagaagggacaccttrtgtttggagactgatggaaagaggtatgattgggtgtagacagaatcattgtaaggaggtaggtggattcaagaggctagtccctagtggctaccttttc

SEQ ID NO: 39474 - DNA, 201 bp, Homo sapiens
gggactttctatggtaaagacctctaggcctagcacctgcttgtggcgaaattgtgaaagtggtcaggctacctctgggaaccttttgtggccataccccmtcctgttctcctgaatggttctaattctgattgtgggttatcccacagaggtgaggactaagctctgattttttgatcttgcccaaattcttatctaagg

SEQ ID NO: 39475 - DNA, 201 bp, Homo sapiens
agaagtagtccaggtatggtggctcatgtctgtaatctcagcactttgggaggctgaggtgggcggatcacttgaggacaggagttggagaccagcctggmcaacatggcaaaacccgtctctactaaaaaatacaaaaaaaaattagccaggtggggtggcctgtacctgtaaccccaactactcaggagtttgaggcaa

SEQ ID NO: 39476 - DNA, 201 bp, Homo sapiens
tcagagatggattttagaagcttaggaaaagcaatggttcacactaagtaaagtagaaatattagaactgctgtggcagataggagttcaagtcttggagwagtagtccaggtatggtggctcatgtctgtaatctcagcactttgggaggctgaggtgggcggatcacttgaggacaggagttggagaccagcctggaca

SEQ ID NO: 39477 - DNA, 201 bp, Homo sapiens
gagagaaggagctgggctggaccctgctgatggggaacaagctggggctgaacagctaggtggtcctatgagattatctgggtaccaacctgggctctgakaaaatccacattggtcactgtgttgagtatgtatttctttgtattttattcttcttccatggtgcccagatttaatcagctcctgctagacactgcatct

SEQ ID NO: 39478 - DNA, 201 bp, Homo sapiens
gaggtattgctgtattgcccaggctggtctcaaactcctgggctcaagtgttcctcctgcctcagcctcccacagtgctgggattacaggtgtgagccacyacacctggcctaaactttttaggaaaaatattgtactccaatgttataacattctgagttggatttgttatttatttttttgagacagagtttcgctgtt

SEQ ID NO: 39479 - DNA, 201 bp, Homo sapiens
agcatttattgaacatctgtgtgcagagcagcctttttcttaaataagagccatattttcccacctctgcataagaagtctggcaatgtgttagaaatttrcactctaaattttaaaattaaactaagccctttaaaattttttttccttttttctttttgagacagtgtctcactctgttgcctagactggagtccagtg

SEQ ID NO: 39480 - DNA, 201 bp, Homo sapiens
gtagcctcccaaaatgctgggattacaggaagtaaaataacttttatttttaaacttttaagaacattggctgcattgagtatttggagaagtactctggwatttgattagctatatgttcaaggaatggtattaagaatgagttttcagtaattgttctttttgactgattatgataaacctcatattttatttcacttt

SEQ ID NO: 39481 - DNA, 201 bp, Homo sapiens
ctgtacccagtcaatcccatttatttaattaatccatctatttgtctccttatttggtgttaataatacagtcatgtggcttgaaaattttaaattccagkgaaaagatgtcttctcttctactcttccacaattcttctggtctctatctgcccacaggtaaccactactgttcatttttctgtgtatctctccagagat

SEQ ID NO: 39482 - DNA, 201 bp, Homo sapiens
ctgtcttggcctctcaaaatgctaggattacaggtgtggaccactgtacccagtcaatcccatttatttaattaatccatctatttgtctccttatttggkgttaataatacagtcatgtggcttgaaaattttaaattccagtgaaaagatgtcttctcttctactcttccacaattcttctggtctctatctgcccaca

SEQ ID NO: 39483 - DNA, 201 bp, Homo sapiens
aaaagtaagcaaaaaagaaagaatacattgtttaggaattacacatatacagtaaaattatgctgtgatttcagaatccacattgcaactatcctttaagraagtatcacttaatgagttttagtgtgatatcaaagaggaatatccacaattatttgaaaaagctgttaaaatactcctccttgtccctctacagatctg

SEQ ID NO: 39484 - DNA, 201 bp, Homo sapiens
ctcctgtcttggcctctcaaaatgctaggattacaggtgtggaccactgtacccagtcaatcccatttatttaattaatccatctatttgtctccttattkggtgttaataatacagtcatgtggcttgaaaattttaaattccagtgaaaagatgtcttctcttctactcttccacaattcttctggtctctatctgccc

SEQ ID NO: 39485 - DNA, 201 bp, Homo sapiens
caataataactttgcacgtaaatgaattaaactttccacttaaaagatgtagactggctgaatggattttttaaaagacccaattatttactgcctataayaaacagatatcatgtggaaagacacatatagactgaaagtaaaaagatggaaaaagatattccaagcaaacaaatcaaaagtgagcaggagtagctacac

SEQ ID NO: 39486 - DNA, 201 bp, Homo sapiens
acaactggacatccacatgcagaaaatgaatctagaaacagactttacactcttccccaaaattaattcaaaatagatcatagactgaaatgtaaaatgtraaatgtaaaactacactactcctagaagataacataggagaaaacctaggtggcctgggctatggtcatgactttttagatacaacaccaaaggcacaat

SEQ ID NO: 39487 - DNA, 201 bp, Homo sapiens
attattagtcccatttatttaccttttttgaaaaaaaaaaaaaaaaaaaaaaagatgagatctcactatgtttctcaggctggtcttgagctcctaagctmaagtgatcctcctgtcttggcctctcaaaatgctaggattacaggtgtggaccactgtacccagtcaatcccatttatttaattaatccatctatttgtc

SEQ ID NO: 39488 - DNA, 201 bp, Homo sapiens
cttttactaaaaagcaccgtaattactagtcataacccttcacatctggttgtcacttagtgtagaagtcttttcacttctgttatctcatttgttctccmccatgagaaaggcattattagtcccatttatttaccttttttgaaaaaaaaaaaaaaaaaaaaaaagatgagatctcactatgtttctcaggctggtctt

SEQ ID NO: 39489 - DNA, 201 bp, Homo sapiens
ctatgtcagttctaaatttggattcatcatctgtctctaacatgtcctcaagtagagtgatatatttcctggtgaaataatgatgagaagctatgtcttaygtaatgtctttagaggaagaccttcaggtctcagtggtaacagctcctcccctgtggctgcaggctatgggattgtagcaccatcctcttggtttccctt

SEQ ID NO: 39490 - DNA, 201 bp, Homo sapiens
gttcaaggctgcagggaggtgtgatcgtagccagggcattacacctgggtgacagagtgagaccccatctctaaataaataactaaaattttaaacaggarattaaacatagaattatcatatgattcagcaattctactcaaaagaagtgaaagcagggacttatgtatttgcacacccatgttcatagcagcattattt

SEQ ID NO: 39491 - DNA, 201 bp, Homo sapiens
caggagttcaaggctgcagggaggtgtgatcgtagccagggcattacacctgggtgacagagtgagaccccatctctaaataaataactaaaattttaaamaggaaattaaacatagaattatcatatgattcagcaattctactcaaaagaagtgaaagcagggacttatgtatttgcacacccatgttcatagcagcat

SEQ ID NO: 39492 - DNA, 201 bp, Homo sapiens
acaaataaataaaaataatatgttcaatcagtatttctcaatttataatcttcaaaaaagaaacagtaccatttattccctcttaaaaaaaaaaaaaaaamggaaattggcgatttaaaaaaatcacccttgcagcagccactgtggaaaacggtgtggtgattcttcaagaaattaaacatagaccaggcacaacagtgc

SEQ ID NO: 39493 - DNA, 201 bp, Homo sapiens
tttacaaaaaattggttttaaatttgggatccaaattttagccatgtttatcattatttatttgatactctgtgtttaaatggtttccacatttcctgcakgctccacttactatggctgcaaaacaaattagccccaaacagtggccaggtgcaatggctcgtgcctgtaatcccagcactttaggagaggccgaggaag

SEQ ID NO: 39494 - DNA, 201 bp, Homo sapiens
aaccataagattttgaccaccacgtttcagcatcttatcagctgagagtgatgactagcaaaggcctctctcctggtctggctcaccaggactttctgcasctgttgcactgggatgggcttccaagctcacccccgaggttgctggcagaattcaggtcctggggagctgttggactgagcaggctcctctcaggtcctt

SEQ ID NO: 39495 - DNA, 201 bp, Homo sapiens
tcccctccaaatctcatgttgagatgtaatccccaatgttggaggtggggtctggtgggaggtgtttgagtcatgggggtaaatcccttgatgctttcccrgagatagtgagttctcatgagatctggttgttgtaaagtgtggcacctcccccacgctctctcttgctcgtgctctgccatgtgaaacagcagctctccc

SEQ ID NO: 39496 - DNA, 201 bp, Homo sapiens
taataataataataaaagatgtcacttctggggctacggaggtgggagtgcaccggcggagcggggcggcggaacaccgtgcaacaggtgggggtgggagscgccccgcgggttctggggctcccagggtcagaatcgggcctgctcaagtgggcagcagcgagcactcaacctctccactgtgccctccagacacactca

SEQ ID NO: 39497 - DNA, 201 bp, Homo sapiens
tgcagataaggaggtgcagagggagaaagtgacaatgtcaaggtttcattcatttcagggcagaagggtgagtggcagctaggctacctggttcaaaaccrtaagattttgaccaccacgtttcagcatcttatcagctgagagtgatgactagcaaaggcctctctcctggtctggctcaccaggactttctgcagctgt

SEQ ID NO: 39498 - DNA, 201 bp, Homo sapiens
ttaagatgaccacagatcaaacttccttgatgtgccatcttccaacttaaattcgaaagctacttgagacacagaaaaagacaaaaactgagaaccattcrgaaaacttagtggtcagttgttggccagagtccaagatggaaatttccctaataacctgccactggggctgggggaagtcacatggtaggtggcctgtgc

SEQ ID NO: 39499 - DNA, 201 bp, Homo sapiens
aataataataataaaagatgtcacttctggggctacggaggtgggagtgcaccggcggagcggggcggcggaacaccgtgcaacaggtgggggtgggagcsgccccgcgggttctggggctcccagggtcagaatcgggcctgctcaagtgggcagcagcgagcactcaacctctccactgtgccctccagacacactcag

SEQ ID NO: 39500 - DNA, 201 bp, Homo sapiens
atttaatagaatctgaggggtgaggggctgccgagagggctgggggtggggacttggatctcaatgagaggcacgctgttaaggggcttctggcagcgccwccaccatgccatagttggtttctgtctctggttcatttgttttgtgcaagatcaactcgaatcaggaatcccaggttagaaagtccaccatcctctcatt

SEQ ID NO: 39501 - DNA, 201 bp, Homo sapiens
gcagcgagcactcaacctctccactgtgccctccagacacactcagttttcccccacagggcactccctctccgcgtttaggaccctcccttgggcccggratggaggaggggcattacgtcacggtccttagcgcagcggtcccgggctctttcctcaagagctcgaaggcgccgagggttcatccatgcccatttccac

SEQ ID NO: 39502 - DNA, 201 bp, Homo sapiens
ctcagaggggccgagctgcccctgggtgacccaggctccaagtgcttacagcactttgggtgcatggactgttgcctccattgataatttactgttgtggkcttagagtgaggccctgaaaacccgccataaaggtttctctcactccttcaccctcattaattgctcccgcctccctgttcttcccactcagatgcctat

SEQ ID NO: 39503 - DNA, 201 bp, Homo sapiens
caccatgttggtcaggctggtctcaaactcctgacctcgtgatccgcctgcctcggcctcccaaagtgctgggattataggcatgagccaccgtgcccggygagaggtgttttcttaagaggaggtcaaggagagtatgaggaatgcttggagattgtcaaggctttgtgccggaggttccgctactacctacaacagtcc

SEQ ID NO: 39504 - DNA, 201 bp, Homo sapiens
tccgcctcccgggttcaagcaattctcctgcctcagcctcccgagtagctgggactagaggtgtgtgccaccatggccggctaatttttgtatgtttagtrgaggtggggtttcaccatgttggtcaggctggtctcaaactcctgacctcgtgatccgcctgcctcggcctcccaaagtgctgggattataggcatgagc

SEQ ID NO: 39505 - DNA, 201 bp, Homo sapiens
tgaaaatgtcctcaacatctttaatcatcaggggaatacaaaaccacctcacaattaacactgagaagtctgataatgctgttaactaaaaactcaatcawtatataaatttggaaaggagagctttgtttcttataaagggttatagccagcaaggtggccattctgacaggctgggaagtgttagccttggtcgaagcc

SEQ ID NO: 39506 - DNA, 201 bp, Homo sapiens
ctcttttagtcccattttccgtggcccaatggatggcagtgtgttaacagctctgtcagccccgttgacccgctccagcccgtggctcggccttgctgctkcttcctattgtttagggcagctgccttctgctggcagagggcagaaggccacagtgttacagccttctttgtacctgcattcagtgggtcctgagttctt

SEQ ID NO: 39507 - DNA, 201 bp, Homo sapiens
ttaacaaattttaaaaagacattagaaaagctagcaaaagacttgaacaggtgcatcgcaaattaggagctccaaatggtgaatgtgaaaatgtcctcaayatctttaatcatcaggggaatacaaaaccacctcacaattaacactgagaagtctgataatgctgttaactaaaaactcaatcaatatataaatttggaa

SEQ ID NO: 39508 - DNA, 201 bp, Homo sapiens
caataggggaacgtagtcctctctgatactgtgatacttaaggcaagattataagtatgaggagaagttaagctccaagatgggaacagagtatgccaggrgaaaaggccagtgcagctggaatagagagagccaagaagggctgggtgcagtggctcacccttgtaatcccagcacattggaaggccgaggcgggtagat

SEQ ID NO: 39509 - DNA, 201 bp, Homo sapiens
taaaagacccaattatttactgcctataagaaacagatatcatgtggaaagacacatatagactgaaagtaaaaagatggaaaaagatattccaagcaaayaaatcaaaagtgagcaggagtagctacacttagataacatgaacttgaagtaaaaaacaataaaaagagacaagatatattagtcagcattctctagagg

SEQ ID NO: 39510 - DNA, 201 bp, Homo sapiens
agtggtgcacatctgtagtcccagctacttgggaggctgaggtgggaggattgctcaagtctgagaggttgaggctgcagtgagccgtgattgcatcactrcattccagtctaggtgacagagcaagaccctatctccaaaaaagagtaaatctgatgttatatatattttgctaccataaaaacaaacaagcaaacacca

SEQ ID NO: 39511 - DNA, 201 bp, Homo sapiens
cacctgtaaccccagcactttgggaggccatagtaggaggattgcttgaatctaggagtttgagaccagcctgagcaacatagaaagacccaatctctacmaaaaatttaaaaattagctgggcatagtggtgcacatctgtagtcccagctacttgggaggctgaggtgggaggattgctcaagtctgagaggttgaggc

SEQ ID NO: 39512 - DNA, 201 bp, Homo sapiens
ttcagaatatagacttaaatactctttacctgtccggcaagctagttaactagctatcatctattatcaatcttattaaaaatatcattcaaaatctcaaytatgtttcctctatttgattcgccatcgtctgagaggtgagttaaagcaccttgttgcagttgatttctgtgcttagttgagtattgcatcctgtaaata

SEQ ID NO: 39513 - DNA, 201 bp, Homo sapiens
ttgaggctgcagtgagctatgattgcatcactgcactctagcctgtgtgacagagttagaccctgtctccagaaaacaaacaaataaataaaaataatatrttcaatcagtatttctcaatttataatcttcaaaaaagaaacagtaccatttattccctcttaaaaaaaaaaaaaaaaaggaaattggcgatttaaaaaa

SEQ ID NO: 39514 - DNA, 201 bp, Homo sapiens
tatacagagcacttttgaatttgaatgccctaatttcccaacaattctctctccctggcttttactcccaggctttaggaaagttattctatgtaccaacygtactcttcggccccaggcagttgcagtttgtttgtttgccttacaatgtttaaacaacgcctgctgcttttctacagtgggttacagtgtgaaaacaga

SEQ ID NO: 39515 - DNA, 201 bp, Homo sapiens
gttatagtgccattttaatttacaggaagaagagtgggagagaagaagtccatcagcattttagtggagtaaataatgaaattaaatgggaagagaaaccrtaattataaaagttactatgagtgtgtcagtgaattctattgttattttctgcctctttattttcaagaaatagctacttaattttgatccttacgctgt

SEQ ID NO: 39516 - DNA, 201 bp, Homo sapiens
aacctaataagaatccatttctacaaaaatttaaaaattatctggttgtgatggcatgtgcctgtggtgcccagctactcagaaggctaaagtaagagaaytgcttgagcctgggaggttgaggctgcagtgagctatgattgcatcactgcactctagcctgtgtgacagagttagaccctgtctccagaaaacaaacaa

SEQ ID NO: 39517 - DNA, 201 bp, Homo sapiens
gattatgcaggcatttgaagagtttccactgttgtcaggccctagttgtagatgctgagggtaatatggttgtgtaccatggagaaccctggtttgcttaragaatcacttgtgtaaacagaaaattacaataaagcaaaataaatgctaaaatacagatgcgaaaagtggcctttgtaaaaatagtgagagtaaagatca

SEQ ID NO: 39518 - DNA, 201 bp, Homo sapiens
cccattttacattcaaaagtgagtttatatcagttttattcaagcctataacagacaggtttagtctacttctgtcatatttttgtattctcagctttggyttctatgtgatctgtttttgtttgttgctttcaaatatggaacgtattcaagctgttttttagttctactggtagatatctttgtgattgtaaataatat

SEQ ID NO: 39519 - DNA, 201 bp, Homo sapiens
ctcttctagactcatctgatgcccgctggggaaaggtaacactaaatactgagattcattccctaggttttcttctgaattttggtcctataatttttcaytggcttgttagctcttgagtccttcaatcagatgttcttcatattctgcccagattttcaaattgtccttagtagaaagtttggtctgagttatccagtc

SEQ ID NO: 39520 - DNA, 201 bp, Homo sapiens
gatggctatgggacagattccctggggggaaggcccagcacatagctggcaagtgggagtgatgctggtagcactagaggctataaatgggtccttaaagwaatagatgtacacgctggactgggttttgcatacccagtggtagatgcaaatgctcagatactataaaagaactggaacagaagatactacaccaatttg

SEQ ID NO: 39521 - DNA, 201 bp, Homo sapiens
tatcaaaagaagtcccttcaggataagaaggtcattggtgtcagtgagtggatatcttgatatgttcacttgaggtgatcacctgggtcatgaaacaagtrgacattgtggggtgggggctgtagcaatgcaaagatgggctaaatttaggcatattccttttgcaccctctgaggtgcaaaatgccagtaagtacagttc

SEQ ID NO: 39522 - DNA, 201 bp, Homo sapiens
tactgactcatgagcagtggtcaatgtcctggccttatggtcaggcagaagagcaatggaaaagtggcctcttaaagagatgcccatatggggcccacctytatggaaaccactagggggaacttgagggatgcattaaagtagaacatgttgatgcccatcttagtgtttgggtcataatttataaaggtgactgagtaa

SEQ ID NO: 39523 - DNA, 201 bp, Homo sapiens
gttgaagttctgggggaatacaaatacttgctcagtgtattcatgagcaggtagactcttttgctctgggactggctttggaaccacttaaggagctgccrgaacctattgtaacatggacggtgccctatgaatgctctctattgatcaacaaagaacttcttagtttatggatggcagttcgaaagtgaacggacagca

SEQ ID NO: 39524 - DNA, 201 bp, Homo sapiens
tgctgttaattccacacactgagttcttatttgttggttgtggtgtttttttatatctagaatttccatttggttaatttttatggtttccagttatttgytgaagttctgggggaatacaaatacttgctcagtgtattcatgagcaggtagactcttttgctctgggactggctttggaaccacttaaggagctgccag

SEQ ID NO: 39525 - DNA, 201 bp, Homo sapiens
ctaacccatgcagagataaggcagcaagcaagcccttaggtagagcgaggctgtaggaggagtagccgtggaggcagagtggctttgttgcctgatggtgraacctcagagtcaggggccactgggcaatgctgccagcatggagctacagtaattccaaatgactcctaaccatgtcctgctgacttccatgactgttag

SEQ ID NO: 39526 - DNA, 201 bp, Homo sapiens
aagagattaacaaattttaaaaagacattagaaaagctagcaaaagacttgaacaggtgcatcgcaaattaggagctccaaatggtgaatgtgaaaatgtmctcaacatctttaatcatcaggggaatacaaaaccacctcacaattaacactgagaagtctgataatgctgttaactaaaaactcaatcaatatataaat

SEQ ID NO: 39527 - DNA, 201 bp, Homo sapiens
attcaagttaatacacattttcagtgtggatcaaatggtcctgacgaaggtgcagtggcaggaaagtgttaattatgctcttagaataaaattgccatgascatagaaagtgaagagattaacaaattttaaaaagacattagaaaagctagcaaaagacttgaacaggtgcatcgcaaattaggagctccaaatggtgaa

SEQ ID NO: 39528 - DNA, 201 bp, Homo sapiens
tcagcataccacctaacactcaggagcactcagtacatggtactcttggctgttgctcatcttccgttctgcacaacaacaagaaggaggaagggaagtcrtatttactaataccatacagggttctcaggaccatgctggacatttacacatgattgcattcaactttcataatccagtgagggtggtgtagcagcaggt

SEQ ID NO: 39529 - DNA, 201 bp, Homo sapiens
ttgtctaaatattctacagttactgttttgatttcttctttgactcaaagcatttaggagattgtttttacatgttctatttttattactttcagttttgktgcactgtagtcagaatatgactgcttctgtttcaattttttgtaaattttctttgtggcctgttgtactatcaaattttgaaatatctcatgggaactt

SEQ ID NO: 39530 - DNA, 201 bp, Homo sapiens
gtccatatttatgtctcatcaactgtgactaggtgggtcaccagtctcttccagttgctgaccctgttttctcgtctctaaaatggaagtgatgatttttytacttaccacacagggttgtgaggctccattgaaatgccactgtaaattgctatacaacaaaagacaggaatatcagtattgtcagacacccattggagc

SEQ ID NO: 39531 - DNA, 201 bp, Homo sapiens
attagcctcctcaacttagatgcaatttttaaaaatgtattttagttttgtatatactttaaacctcatgagatattgttgtggtggtggttgttttagcrgttaagagtcaatttgactatttgattcatccctatatttgcttatattgttgctctttaatctttcctgtatctctgtgctttcatctggtatctttcc

SEQ ID NO: 39532 - DNA, 201 bp, Homo sapiens
aagcatcgcctccggacaggccatctccgggcagggcccctctagggagcgggaacgtttcatatgcatgggacccaccagatccgctttccgctggacckgtggcgaaactgaggtccagagaggaagagactggagtctccaggccgcgccagggcccgcggaactgcgacggggcgggacagcgcgggtgtgggagtt

SEQ ID NO: 39533 - DNA, 201 bp, Homo sapiens
ctcatccaatgttgtggcggtcacacaggaactgactcagcgaaagcggacagcgtctaatttctataatttcatctctgacctgaccaatcagcactccygacttactgcccccaccacccgacccaccaaatgaaccttaaaaactctgatcccccagtgctcgaggagaccgatttgagtaataataggatttgagta

SEQ ID NO: 39534 - DNA, 201 bp, Homo sapiens
tcctaaagggggtattccttcactccgtcatacttttccaggtcactggcacacaggtccacccattcgtagctaccctgctctaaagccttgatccgttrcaaacatgtgactcctgccttgaattcagaacaccaacaaaagcagaactggatctgcatgctcttcccatgaattctaaacagcctcatctcctctctc

SEQ ID NO: 39535 - DNA, 201 bp, Homo sapiens
ggggaagaacagaaatccagccaacaaagattgtcctctaacgccttacatcgaaggcccagagccaaggaagaggcggagatgtcccgcagtcccctatkctcggctgttacctggaaaggatcatttcacttccactgaagagaaaaggaatgagtcctgaatggaatgctgcccggcagctcccagcgcccgctggta

SEQ ID NO: 39536 - DNA, 201 bp, Homo sapiens
taattcctaagcaagaaaccataaccatacttttaaacctttatgtcagaattcctaagggcctcagggagcaggttgtatcttgatcccaggtagcaaarctggggttaatagtggatgtagctacgttgcttaatggtagaaatagctgagttctgtaccttttataaccctatcctagatgagatgagatgaatgaca

SEQ ID NO: 39537 - DNA, 201 bp, Homo sapiens
tctcaacttctttttcctacctaatgcagtggtcccaggcacagggctgtaacaagtgctggaagcaaagataattcctaagcaagaaaccataaccatamttttaaacctttatgtcagaattcctaagggcctcagggagcaggttgtatcttgatcccaggtagcaaagctggggttaatagtggatgtagctacgtt

SEQ ID NO: 39538 - DNA, 201 bp, Homo sapiens
ttgctctggttccagtgcttctaacagtttggcattttactgtctttcaataagcagacattataaatcttaatagagtccaatttattattttcccttayatagttggcccatttttggggtcttgtttaagaaacttttgcatactacaaagttgtgaagatattttcttatgtttccttcaaaaagctctattgtttt

SEQ ID NO: 39539 - DNA, 201 bp, Homo sapiens
ttacatgtcattctaattattgctcctttgaaggaaatctgctttcctaagatattcattgtgtttgagtttatgatttgtctggaagtggttttcttttytttttttttcattctgttgggcatttgtaagaattattgcatatgtggcttgatgtctttaatcagttttggaaaattctcaggcattatctcttcaaat

SEQ ID NO: 39540 - DNA, 201 bp, Homo sapiens
caagcagcctgggcaccatggatggtggcaggaggcagatcggctcctgggtggaagaggacaggttactggtgaagccccaccttcaggccaggctgctrgtactgctgactggagtgggaacttgtggtgccttttccaggccctcccatggccgcccacagaccaattggcagcacttcctcccatctgaggcccata

SEQ ID NO: 39541 - DNA, 201 bp, Homo sapiens
ggagttgctctggttccagtgcttctaacagtttggcattttactgtctttcaataagcagacattataaatcttaatagagtccaatttattattttccyttacatagttggcccatttttggggtcttgtttaagaaacttttgcatactacaaagttgtgaagatattttcttatgtttccttcaaaaagctctattg

SEQ ID NO: 39542 - DNA, 201 bp, Homo sapiens
cgctttggttgccgggttaatttcaccaaaacactcctttcattctgtcactcctatctataaaaactttgaatggctttctatcgaaaactggataaagwcttagttctcagtctagtattcaagattttctattgtctggccccattccactttgtgtgtgtgttttgtctcttcagctgtatagcaaaagcccttaac

SEQ ID NO: 39543 - DNA, 201 bp, Homo sapiens
tcatcctcatttttatctaggcactattcaagatggagttgctctggttccagtgcttctaacagtttggcattttactgtctttcaataagcagacattrtaaatcttaatagagtccaatttattattttcccttacatagttggcccatttttggggtcttgtttaagaaacttttgcatactacaaagttgtgaaga

SEQ ID NO: 39544 - DNA, 201 bp, Homo sapiens
tatagccagtctgtctgaagcatgggtcacagcctggaatttgttcttggcatctgaattgggggcagtcttgtgggagtgaacctttcacctgtgggatstgacgctatctctaggtagattatgtcagaattgaattgaaatacaggacacgaagatggtgtctgctggaaaattccttggtgtgtgtggggaaaaccc

SEQ ID NO: 39545 - DNA, 201 bp, Homo sapiens
gcggacagcgtctaatttctataatttcatctctgacctgaccaatcagcactcccgacttactgcccccaccacccgacccaccaaatgaaccttaaaawctctgatcccccagtgctcgaggagaccgatttgagtaataataggatttgagtaacaacagccggctgtgcatgaattactttctctattgcaaatctc

SEQ ID NO: 39546 - DNA, 201 bp, Homo sapiens
tttttttcattctgttaatgtggtgtattatattgaatttcatacactgaaccatccttgcattccaggaataaaccccacttgatcattatgtaaaaccsttttcatatgctattgaatttgaagtgtagatattcttttcttgttccttaagaaaagcatcttgtctttcaccattaagtataatgttagctgtggatt

SEQ ID NO: 39547 - DNA, 201 bp, Homo sapiens
acctaggtgcaaaactggcccaggccaaattctaatagacacttgcctttggcagtctcccagttgtctctcttcatgtttcccccacctttgtctgcccsctccttagttgtgtgttgagctcctcactgtgccattttcctcaggtctgtagacatgcctcttcttataccccacaaaatcccctccagtttcctccta

SEQ ID NO: 39548 - DNA, 201 bp, Homo sapiens
tcttcatgtttcccccacctttgtctgccccctccttagttgtgtgttgagctcctcactgtgccattttcctcaggtctgtagacatgcctcttcttatrccccacaaaatcccctccagtttcctcctaatattatctataaagcagaagaaaatagcctgatctgtagagtgaagggggattaggctctaacgtcagt

SEQ ID NO: 39549 - DNA, 201 bp, Homo sapiens
cttggttaattgtccctttcctttttttttttttttccttgagaaggggtctcattctgtcacccaggctggagtgcagtggtgtgatcttggcttactgyaacctctgcctcccgggttcaagcaattcttttgcctcagcctcccaagtagctgggactacaggcgcgtcccaccatgcctggctaattcttgtatttt

SEQ ID NO: 39550 - DNA, 201 bp, Homo sapiens
ttagtagagacgaggtttcaccatgttggccaagctggtgtcgaactcctgaccttgtgatccacccaccttggcctcccaaagtgctgagattaccggcwtgagcccctgcagcctggcctaattgccccttttctaccagctcttcttacaacagagaaatcctgagcctcgcttgtaattatagtgaggaaatatttc

SEQ ID NO: 39551 - DNA, 201 bp, Homo sapiens
agtggctttaagatgatagaggtttatttctctttcacatgaaacaagttgtcttttaaggacttgtctggtagctccattgtggcagacagccaggctcktttatcctttagggccacaattcatggtccaagatgcttgctagagctccaagttccaagcaggaaaggcaagggggaggccattactgccccgagtaaa

SEQ ID NO: 39552 - DNA, 201 bp, Homo sapiens
ttctcctgtaagtctactccagtcatgcttttgcttcattcaatccactgaaacttctcttgtcaagaacacctgtgatgccaaaccccatgatctgttcytagtctccaggttccttgatctattagtacttgacacagttgatgaggttctcctgcttgtgcactttgtcacttgacttccaggattccacactctctt

SEQ ID NO: 39553 - DNA, 201 bp, Homo sapiens
gaaacctcatctctactaaaaattcaaaacttaaccaggtgtggtggcacatgtctgtagtcccagctgcttgggaagctgaggcagaatagcttgaaccygggggcaaaggctgcagtgagctgagatggtgccactgcactccaagctgggcgacagaaagagactctgtctcaaaaaaaaaaaaaaaaaaaaaaggag

SEQ ID NO: 39554 - DNA, 201 bp, Homo sapiens
taaagtaagcctgtgtgaatatgtcttttctcctttttgtttctatttttgctttatgtactttgaggctaaatattgagtataaataaagttagatgtaytttatctttctagaatcaaatttttttcattatggaatgttcctctttatttagtaatgcttttttgctttgaagacaattttgtcagttttaactttca

SEQ ID NO: 39555 - DNA, 201 bp, Homo sapiens
agtgcttgagatattttgcagaccttgcacttgatggatcagctggcaccacccagatcgataaactggctcatccaatgttgtggcggtcacacaggaastgactcagcgaaagcggacagcgtctaatttctataatttcatctctgacctgaccaatcagcactcccgacttactgcccccaccacccgacccaccaa

SEQ ID NO: 39556 - DNA, 201 bp, Homo sapiens
atatctagttgacctagtaccatgtactgaaaagactttcctttccctactgcagtacagtgccacctttgtggtatatcatatgacaacaagttcatgtrtctgattctgggctttcaatctgttctgtggtctatttgtttgttcttgttccaatactacactgttttaattaccatggcttcatgagtcttgttaatt

SEQ ID NO: 39557 - DNA, 201 bp, Homo sapiens
cgtgagccaccacacctggctaatttaacagactttaattgagcaaagaatgagaacctggcagcctcttaacaagaataactccagaaaggttccagtgyggccttgaggtggaagatttatggacagagaaaggaaagtgacatatagaaaaccgaagtagggtacagaaacagctggattggttacagctcagtaagt

SEQ ID NO: 39558 - DNA, 201 bp, Homo sapiens
cgcctggcctgttggatccttttatctttttcttattgctttataaatgatttatatattctggctacaagccctttgtcagttctatgtgttgtaaatascttctcccatttcatgacttgcattttcactatcttaatgctgtcttgaaaaacagaagctccaatttaccaatcttttcctttataattagggcttttg

SEQ ID NO: 39559 - DNA, 201 bp, Homo sapiens
gaggcctcaggaaacttacagtcatggtggaaggcaaaagagaagcaaggtatgtcttacatggtggcaggagagagaaaacgagcagggaactgccacayacttttaaaccatcagatccagatctcttgagaactcaatcactatcatgagaacagcatgggggaaaccaccctcatgatgcaatcacctcccaccagc

SEQ ID NO: 39560 - DNA, 201 bp, Homo sapiens
cttctaactggttgatatcagctgttttactagaacttcaggcaatccttaaacaaaagccttatgattctaatgtcagagatcctgtcataggaacagtrgagatgcaaataaattattaaacagttttatgaccctactgtcagaaatcctgtctataggaagaacggggatataaatggtcaggagctagtgctacgt

SEQ ID NO: 39561 - DNA, 201 bp, Homo sapiens
cagaaaagtataatgaagaaaccatttaaaatcctctaaaatccacttgcccagagagtactattaacttgatggagacaccctgctagacagctttctayccccaaacatagggaataaatgggctccttcagttgaaaaccacagagatccactgaagctgacttatgtaccagatactttgtttcgaggacttagggg

SEQ ID NO: 39562 - DNA, 201 bp, Homo sapiens
tcactatattgcccaggctgatcttgaactcctggcctcatgcaatcctcccaccttggcctcccaaagtgctgggattataggcttcagtcaccacgtcyggcctatttaataatttatatgattattgtgaagtgcttgttcaaatcttttgtccagtattccattgtttcgtcattctgttattgatttgtgggagtt

SEQ ID NO: 39563 - DNA, 201 bp, Homo sapiens
ggtcatatgtgtaatgttaccctcaaaacactttagtttggctcctgctgggggataatgcaaagcacagtagtactaactctttatgttgttttctctgygccaggcactgttctggaccctgggagtagcagggttggaatttgaacgcaggggtctggttctaaccaccctgcctctctgtacaagtaatcccagtgc

SEQ ID NO: 39564 - DNA, 201 bp, Homo sapiens
attcactatattgcccaggctgatcttgaactcctggcctcatgcaatcctcccaccttggcctcccaaagtgctgggattataggcttcagtcaccacgyccggcctatttaataatttatatgattattgtgaagtgcttgttcaaatcttttgtccagtattccattgtttcgtcattctgttattgatttgtgggag

SEQ ID NO: 39565 - DNA, 201 bp, Homo sapiens
ttatcaaatactaaatcctatgtatagtttttttaattaaaaaaatattaatttatagagacaaggtctcactatgttgcccagattggtcttgaactccygagctcaagcaatcctcttgccttggcctcctaaagtgctagggttacaagcgtgagccactgtgcctggtcatatgtgtaatgttaccctcaaaacact

SEQ ID NO: 39566 - DNA, 201 bp, Homo sapiens
ggattcactatattgcccaggctgatcttgaactcctggcctcatgcaatcctcccaccttggcctcccaaagtgctgggattataggcttcagtcaccaygtccggcctatttaataatttatatgattattgtgaagtgcttgttcaaatcttttgtccagtattccattgtttcgtcattctgttattgatttgtggg

SEQ ID NO: 39567 - DNA, 201 bp, Homo sapiens
acactagcagtgaggcagtttctgtagaggttgagtggcggctcttcaccgactaactgggtttgcgtcccccgcctttttgttttccttttttaaaatayattttttaaatatcatggagtgtcactatgttgcccaggttagtgtcgaactcctgagctcaagggatcctcccactttggcttcccaaagtgctgggtt

SEQ ID NO: 39568 - DNA, 201 bp, Homo sapiens
agacagaagtttccacttcggcctctgattgactggtccaagcctccactttagcctctgaatagtcacagggcaatcctttataggttgtaaccaattgraggcctctaaaagcacctaggggtgttgccaaagtcctttggcttcataaaaaccccggggagcattgcggtgaagaagcgcttgagctgcttgtttgag

SEQ ID NO: 39569 - DNA, 201 bp, Homo sapiens
agtctactggactaaaatcttgatagagatacatcctctaagaagcaaagaagttagttacttgcattgcctgacagagggaaatgttagctggttttctrcattctgggccttagttattggcattgccaggttgatgtttcacaattaagacaactttttctgttagtgactgctccttggtgatagattctttaagaa

SEQ ID NO: 39570 - DNA, 201 bp, Homo sapiens
aggagtcggcctgcctatcaaaggaggtgagagctaagttgttgctgcctttccgcttcaggatgaatggattccaccccattgaactggagtgacctggygcctggattctttcatctctaaaatgggaaaaataattgttgcacatatatggtgttgaaattatggccctcaattggtgataattatcattacttagta

SEQ ID NO: 39571 - DNA, 201 bp, Homo sapiens
atataacaattagccaggtgtggtggcacatgcctgtggtcccagctactcaggaggctgaggtgggaggattacatgagcctgaaggtcgaggttgcaaygagctgtgattgggccactgcactccagcctgggtgacagggcaagaccctgtctcaaaaaagaaaaaagaaaaaaagaaaatctccacaataacagcct

SEQ ID NO: 39572 - DNA, 201 bp, Homo sapiens
gagaaaaaccagcccctgctttaaagggccacaaaaaagcaacgtcctcaggcacaaccagattttagtgaaagcaggaaggggaaatgaatgtttggagragaggttgaggattgaggacattttcctgagggtggaccatgaatttcagggtcacagtggaagaatggaggaagtagggaagggtgggaaactggttag

SEQ ID NO: 39573 - DNA, 201 bp, Homo sapiens
gttggaaaatgtatttctcaaaccatcaaattcatgaaggaaacagtctcttttgattttccctattgaaatataacttcaccagaccaatctggttcaaytgtaacaaaggttaagtaacctgagcatacccagtgtgcatgaaccaagcgtgcaatcaccagaggaacctaagtgctcaaacccaaggagcggggagtg

SEQ ID NO: 39574 - DNA, 201 bp, Homo sapiens
tatttctttttctttttacctttccttttttcttccctgggatggatcctgagcaactagaacacttatatattgctgatggaaatgcaaaatgggacatyggtttggcaatttccgataaagttaaatatatactgatgtatatatctcattgttttaatatgcaattccttaatgacaaataatgttgagcattttgtt

SEQ ID NO: 39575 - DNA, 201 bp, Homo sapiens
aatcttcagggagtaagggagattatccaggaggcttcaatgagaacagtgagtggtatagcctaaggacacgaacttcaagggaacagaattttgtagaraaaaggaaggataattagtctagaaaaggcagtgtacagccaggagggtacctacccctcctccaggtctgtagtatatggggtgtaggagaaaaaccag

SEQ ID NO: 39576 - DNA, 201 bp, Homo sapiens
tgggattacaggcgtgagccactgttcccagcctattttgttaatttgtgatttgttacacaatagataagtaatacagaacctgaaaatctaggatgttrgatgggtttttgataccggagttggttgaaatcacaaaatggtgagtactgctgatggtgagagaggctaagagccagcatctaaaatcttcagggagta

SEQ ID NO: 39577 - DNA, 201 bp, Homo sapiens
gttctgaggcctagagttgtggctgcggggaaggagggagaagtcttgggaactgagccctcaacctgtgggatctgacactatctccaggtagatagtawcagatatgaattggaagacaccagccaggtgtctgctgcttggtggtgggggaaacccacacacatctggtcacaggaggttctgtgttgatgattgttg

SEQ ID NO: 39578 - DNA, 201 bp, Homo sapiens
catcatgttggccaggctggtctcgtactcctaacctcaagtgatcaacctgtcttggcctcccaaagtgctgggattacaggcgtgagccactgttcccagcctattttgttaatttgtgatttgttacacaatagataagtaatacagaacctgaaaatctaggatgttggatgggtttttgataccggagttggttga

SEQ ID NO: 39579 - DNA, 201 bp, Homo sapiens
aacatattagtggtgtaaaatcagccctttaaagaacttttaaaagctctgtcattttataagaaaaagtacacaaatataaccaatctaattttttaaarcataaagctttatttaaattaaaattttttaaacaagtttaacatttttccatgtctttctaatacaatagataacatcaggaaaggaacaagtatgcac

SEQ ID NO: 39580 - DNA, 201 bp, Homo sapiens
tttgttgttgtcattgttgaaacagagtcttgctgtcatccaggctggagtgcagtggtgcgaccttagcttactgcaacctccacttcctgggttcaagygattcccctgcctaagcctccctgcttcagctgggattacaggcatgcaccaccacacccagctaattttttttgttttgttttgtttgtttgtttgttt

SEQ ID NO: 39581 - DNA, 201 bp, Homo sapiens
gtttgttgttgtcattgttgaaacagagtcttgctgtcatccaggctggagtgcagtggtgcgaccttagcttactgcaacctccacttcctgggttcaartgattcccctgcctaagcctccctgcttcagctgggattacaggcatgcaccaccacacccagctaattttttttgttttgttttgtttgtttgtttgtt

SEQ ID NO: 39582 - DNA, 201 bp, Homo sapiens
gtcaggcatgtgagggagccacgttggaagctaatcctccagccccagtcaagccttcggatgattgtggcagccccaggagataggctacagcagcatcrgagactctcagccagagtcatctgtctctggctccccaaagcctgcccatagaaactgtatgagatcataagtgcttattgagttgttttgttaatttgg

SEQ ID NO: 39583 - DNA, 201 bp, Homo sapiens
ctactagcccatgtattttttatttcaataattatatattttattacaaaatttctgtttcttgtttacaaccagctattcctgtatcatgaataaaatactttcttatctctctgatgatttataatcacatttatttttaagtctagttctggttttccctattaactctctttcttcaggtgtgcatttgtccatctg

SEQ ID NO: 39584 - DNA, 201 bp, Homo sapiens
tactagcccatgtattttttatttcaataattatatattttattacaaaatttctgtttcttgtttacaaccagctattcctgtatcatgaataaaatactttcttatctctctgatgatttataatcacatttatttttaagtctagttctggttttccctattaactctctttcttcaggtgtgcatttgtccatctgc

SEQ ID NO: 39585 - DNA, 201 bp, Homo sapiens
gccaggagtggttattgtgttagaatctaaagggataattaagaaagtgagaagataagtgaagggataggtagtgaaaacattaggaactctggctgggrttgaagagttattgagtcaggatactagagtgagagagctggaaatattggaagggttggccaaagagtgaggtggggtgctaaaaatgatgattttaag

SEQ ID NO: 39586 - DNA, 201 bp, Homo sapiens
ggagaaaggtcactggtacagatgcaggtaggctgtttcctttggtggtgggaagatgaggtggctctcctggatgctgcttttatttcaaaggaatgggygaggttgtcaggtgtgaagctgagagtggattggggatgggatgggatgttttctaaaaaacaagaagatatgaaataatttgtgtttgagagtagagac

SEQ ID NO: 39587 - DNA, 201 bp, Homo sapiens
accatttaaaatcctctaaaatccacttgcccagagagtactattaacttgatggagacaccctgctagacagctttctatccccaaacatagggaataartgggctccttcagttgaaaaccacagagatccactgaagctgacttatgtaccagatactttgtttcgaggacttaggggtgtctcctggaactgcacac

SEQ ID NO: 39588 - DNA, 201 bp, Homo sapiens
gtcttggtattatatgttttaaataccatcggaagctaatatggaagggacacagggagcaaggagcaagtggctaaagatgaagttgcagagtagatacrggccagtttctaagaactttctaacctaaaagaacttcctgaaagtggctgaatagcctggaggtaaggacaagaacatccactccacgtgcagctgtga

SEQ ID NO: 39589 - DNA, 201 bp, Homo sapiens
tgggggataatgcaaagcacagtagtactaactctttatgttgttttctctgcgccaggcactgttctggaccctgggagtagcagggttggaatttgaaygcaggggtctggttctaaccaccctgcctctctgtacaagtaatcccagtgcaaaagacaaagcaagatgtgttctaataaaggggagatgaagaactat

SEQ ID NO: 39590 - DNA, 201 bp, Homo sapiens
tacaggtgtgagccacaatgcccggcctttttattttttattagagacaagtcctcactatattgcctaggctgatcttgaactcctgggctcaagggatyctcccaccttggcctcccaaagtgctggaattacaggcatgagccactgcacttagcgctcttatttattgtctattgagcatctactttgtgtcctgag

SEQ ID NO: 39591 - DNA, 201 bp, Homo sapiens
gagctcaggcaatctgctggcctcggcctcccaaagtgctaggattacaggtgtgagccacaatgcccggcctttttattttttattagagacaagtcctyactatattgcctaggctgatcttgaactcctgggctcaagggatcctcccaccttggcctcccaaagtgctggaattacaggcatgagccactgcactta

SEQ ID NO: 39592 - DNA, 201 bp, Homo sapiens
ctgcaacctcaacctcaagcaatcgtcctgcctcagcatcctgcatacaggtgcacaccaccacgcctgggggtttcgccgtgttccccaggctggtcttkaactcctgagcttaacaaaatgatccacccacctcagcctcccaaagtgctgggattataggcatgagcccctgtgcccagctaaatttttatttttatt

SEQ ID NO: 39593 - DNA, 201 bp, Homo sapiens
gtttagaacctagagcaatacaaactcataataaaatttagctctttttattatttatttatttttttagagacaggatctcactcttttgcccaggctgkagtgcagtggggcaatcatggttccctgcaacctcaacctcaagcaatcgtcctgcctcagcatcctgcatacaggtgcacaccaccacgcctgggggtt

SEQ ID NO: 39594 - DNA, 201 bp, Homo sapiens
ccccatccctggaacaaagtacacttctgccgcaggaacattccagcaaactgaaggcatcgcgggcgcggccgccgcccccgcctccccacagctgcacrgagcgtccacggccccaggccgagccccactgtgccccgcttccgaccccgcccgccctgccggctccccgtcgcccgccgcgtgtgcagacgcaatcgc

SEQ ID NO: 39595 - DNA, 201 bp, Homo sapiens
cgtcatctgtgaaaatgagaataaaagctaacattcattaggcttatatgtgcctgccactgtgataagtgtttttatatgtgttagttgaattaagctcrctacagtcctataaggaggcactgtaagtcccatttatccatgacaaactgaggcacagagaaattaaatatcttgcccaggtcctagttaattagaggg

SEQ ID NO: 39596 - DNA, 201 bp, Homo sapiens
acagacacacacacacacacacacacacacacacacacacacacagacacacacagctatatgattccaattgtatacaaattataaattatttagtaatycataaactcttgctgtatatttcaaagctatgttgttagatatgtaaactcgtgttataattttttggaaaagtattccttttatcagcatgaaaattat

SEQ ID NO: 39597 - DNA, 201 bp, Homo sapiens
actagcccatgtattttttatttcaataattatatattttattacaaaatttctgtttcttgtttacaaccagctattcctgtatcatgaataaaatactttcttatctctctgatgatttataatcacatttatttttaagtctagttctggttttccctattaactctctttcttcaggtgtgcatttgtccatctgct

SEQ ID NO: 39598 - DNA, 201 bp, Homo sapiens
ctagcccatgtattttttatttcaataattatatattttattacaaaatttctgtttcttgtttacaaccagctattcctgtatcatgaataaaatactttcttatctctctgatgatttataatcacatttatttttaagtctagttctggttttccctattaactctctttcttcaggtgtgcatttgtccatctgctg

SEQ ID NO: 39599 - DNA, 201 bp, Homo sapiens
tttagccaagatgttagccaagatgttctggatctcctgaccttgtgatccacccgcctcagcctcccaaagtgctaggattgcaggtgtgagtcactgtsctcagcctatttattttattttatttattgtttttggagacagagtttcactctgttgcccaggctatagtgcagtggtgcaatcttggctcactgcaac

SEQ ID NO: 39600 - DNA, 201 bp, Homo sapiens
acccgctgctgcggtggccctgagcgaggaacaagccattcggacccgaccgatgtaaatacagccgcccgtccgcccgccttcctcccgggctccccggmcttgcccgccccctcccgggcgtccctgtccagggccccggcttggtttccaagtgtaaataccgcctcgcgcctcaaatccccctaccccgtgtgaact

SEQ ID NO: 39601 - DNA, 201 bp, Homo sapiens
ttcctaattacccccatgacattttaatactaaaactgtattgcatatctaactatggacactctctctctctctctctctctctctctctctctctgtgtgtgtgtgtgtgtgtgtgtgtgtgtgtgtgtgtgcttagctagatattctttgtaatgttgacaattttaaataattttcagcagttgacataattactgg

SEQ ID NO: 39602 - DNA, 201 bp, Homo sapiens
ttctgaaactcctgttcctaatgacaaagtggctatgtgcaatggatataaatgtactgtgagtctctcggttcagtattaggttcactttaatttatttrtgctgtaagttatttttgcttccttctcctggacccacttccagtcccgttttgcattcccctttggattttgctttggctattttttgttgtaacctct

SEQ ID NO: 39603 - DNA, 201 bp, Homo sapiens
atgttgttagatatgtaaactcgtgttataattttttggaaaagtattccttttatcagcatgaaaattatttttgctgatatttgccaggttttaaccaytttatttattcatgttttggaagcaccagggtccactaagacattttatttataggtatgtattacacccctagaaaaagaatcccaggattttccctca

SEQ ID NO: 39604 - DNA, 201 bp, Homo sapiens
tcctaattacccccatgacattttaatactaaaactgtattgcatatctaactatggacactctctctctctctctctctctctctctctctctctgtgtgtgtgtgtgtgtgtgtgtgtgtgtgtgtgtgtgcttagctagatattctttgtaatgttgacaattttaaataattttcagcagttgacataattactggt

SEQ ID NO: 39605 - DNA, 201 bp, Homo sapiens
tcaggcaatctgctggcctcggcctcccaaagtgctaggattacaggtgtgagccacaatgcccggcctttttattttttattagagacaagtcctcactrtattgcctaggctgatcttgaactcctgggctcaagggatcctcccaccttggcctcccaaagtgctggaattacaggcatgagccactgcacttagcgc

SEQ ID NO: 39606 - DNA, 201 bp, Homo sapiens
taatttcagttaaggaactctgattgaaaattaattgcattgtacccaatctgggagttgtaagaactctcggagtttggacagctggggtgagaaggctsggagagcaagaatttggccatgtgtctccaacactatccaggggagaaggtaggctcactataaatccccttcaagccttcccccaaaggggagtgaatg

SEQ ID NO: 39607 - DNA, 201 bp, Homo sapiens
cagaaagacaaggtgagggtggccatgagaggtccccaggggtaccccctgtagtgctaaggttaagctctgtgattggggcagtcctctctctgtccccmtgacgtgaggtgatggcattgtcccctctggcactgggccctcttgcaggcaattgggttttatgggaactaaacctggggtcttaggccaggctctggc

SEQ ID NO: 39608 - DNA, 201 bp, Homo sapiens
caagggcaaacccagacagaaagacaaggtgagggtggccatgagaggtccccaggggtaccccctgtagtgctaaggttaagctctgtgattggggcagycctctctctgtccccctgacgtgaggtgatggcattgtcccctctggcactgggccctcttgcaggcaattgggttttatgggaactaaacctggggtct

SEQ ID NO: 39609 - DNA, 201 bp, Homo sapiens
attacccgggcctccacccagcttggcagactttagacttgaggctggaggaaagggaactgaacgcggttctgggagcagcaagcccacgggtagcagcygaggccccagaatggtgagtgtgagggtctgtgtcggcctggccagggctgggggcgtgaacctcaggtggagccctcccctgactgttttcctttctct

SEQ ID NO: 39610 - DNA, 201 bp, Homo sapiens
aggttacgtcatggcgtccgacctgcggtcaaaactcacgagtctgggggagaagctcacccacaaggaaggtaacagcctgggtcctgtctcccaacagytggagggggttagggagttggaaggagggcaccaaagcctagctgatgccaccagggtggtacagaccacctctgttgatgcgcgcgcaggagactgtga

SEQ ID NO: 39611 - DNA, 201 bp, Homo sapiens
caggaggcggaggttgcagtgaaccgagattgagccactacactccagcctgggcaacaagagcgagactctgtctcaaaaaaaaaaaaaaaaaaaaaaaagccggtcatggtggcacatgcctataatcccagcttcttgggaggctgaggcaggagaatcacttgaacctgggaggtggaggctgcagtgagctgaaat

SEQ ID NO: 39612 - DNA, 201 bp, Homo sapiens
aaagatcaaggtttacatccattaagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgatt

SEQ ID NO: 39613 - DNA, 201 bp, Homo sapiens
caaagatcaaggtttacatccattaagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgat

SEQ ID NO: 39614 - DNA, 201 bp, Homo sapiens
gcaaagatcaaggtttacatccattaagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtga

SEQ ID NO: 39615 - DNA, 201 bp, Homo sapiens
agcaaagatcaaggtttacatccattaagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtg

SEQ ID NO: 39616 - DNA, 201 bp, Homo sapiens
gcccagcctgcgactgaggcttgagaccccaggtgggggtgctgatccatcctggtaagatgtactgtggtggctgtcaaaggtggaatgcacacatggayctgtttccctccagttcagggcaggagggaagcgctagaagggagcagaggagcccagtcctccatctgtggttgggaacccactttcttgagctttggg

SEQ ID NO: 39617 - DNA, 201 bp, Homo sapiens
gtgtcaatccctacatctatctgtacaaaaagttaaaaagacagccctattgtgatcagtggagatggagatttgaaagaagtttcaatttaatgaatgtrtttggtaaaagggtgagaaatagtttaacagtagatcacatcaggtttaatgaccattcattcattggaaaaagaatcgcactcattggcgcgcagcttc

SEQ ID NO: 39618 - DNA, 201 bp, Homo sapiens
gggctggctcactacagctagcaagagccatagttttaggaattttgcaagcaggatgttaaagccagccattattaaataatgtaggatcaaacagtgtktcaatccctacatctatctgtacaaaaagttaaaaagacagccctattgtgatcagtggagatggagatttgaaagaagtttcaatttaatgaatgtatt

SEQ ID NO: 39619 - DNA, 201 bp, Homo sapiens
ttgaacctgggaggtggaggctgcagtgagctgaaattgtgccattgcactctagcctgggcaacaagagcaaaactctctcaaaaaaaaaaaaaaaaaargttggcaaaactcatttgtggtaatcaagtggctagatggaatttatttatttgagacagagtcttgctctgtgcaatggcatgatctccgctcatttca

SEQ ID NO: 39620 - DNA, 201 bp, Homo sapiens; identical to SEQ ID NO: 8658

SEQ ID NO: 39621 - DNA, 201 bp, Homo sapiens
gctccacccacaggcccgggtgcctcgtctgggctggacgagaatctccctgtcctgatggcagccccacctacccctaaatcagatgctcagtcagtgcrgttcagggacttttcctgaactcccagctggccttcctgggcctcccagggccgggagcccgtgggatggctgtgtcaggccgggagtctgtgggtttag

SEQ ID NO: 39622 - DNA, 201 bp, Homo sapiens
caagcccacgggtagcagccgaggccccagaatggtgagtgtgagggtctgtgtcggcctggccagggctgggggcgtgaacctcaggtggagccctcccctgactgttttcctttctctgctgcaggccaagtttctttcccaagaccaaattaatggtaggttgggtttgttctttgattagcaactcagcaaaatatg

SEQ ID NO: 39623 - DNA, 201 bp, Homo sapiens
ccaggaggcggaggttgcagtgaaccgagattgagccactacactccagcctgggcaacaagagcgagactctgtctcaaaaaaaaaaaaaaaaaaaaaaaagccggtcatggtggcacatgcctataatcccagcttcttgggaggctgaggcaggagaatcacttgaacctgggaggtggaggctgcagtgagctgaaa

SEQ ID NO: 39624 - DNA, 201 bp, Homo sapiens
aaaagaatcgcactcattggcgcgcagcttcatttgtcaaatcatggttgaatcgaaactataggttggcaatggatataagagttggcaaaacttgggcygagtgcagtggctcacgtctgtaatcccagcactttgggaggccgaggcatgtggatcacctgatgtcaggggtttgaaaccagcctggccaacatggtg

SEQ ID NO: 39625 - DNA, 201 bp, Homo sapiens; identical to SEQ ID NO: 8659

SEQ ID NO: 39626 - DNA, 201 bp, Homo sapiens
agcagcctggaggccagggcaggggcaataggctcagaaatgccccagctctgatgatgatgataatatcatcatatgaaggccactctctggcaggcctsctgggatttctggctctcacagtaatcctgaggccttattattcccattgtccagaaaagttgtgtttgcagaggtcccctgggggtctggacgccttgc

SEQ ID NO: 39627 - DNA, 201 bp, Homo sapiens
tcttctttctgccaagttcattcgatctggggtggggatgggagcagcagggcctgggaatcagtccaatgaaataatgtctggtatgatgccaaagatgratgccgtgtccgtgctgctcctgtttgtgacggtgtggctatggctttcccttaggctgttggaagaaaccaggctgctgttactgccactactgcttcc

SEQ ID NO: 39628 - DNA, 201 bp, Homo sapiens
acagcctaggggaaacccagctcggaacccacaaggcagggcagctggagcgtgcagtctggtctccccctgtgttcaagctctcactgtggggcttcatytagtgcatgacacccctgggagcacaaatgcctgctcctactgataaagaagcagggggagtgagcggctcccaagcagcggcgcaggagcgaaggcagg

SEQ ID NO: 39629 - DNA, 201 bp, Homo sapiens
aaacaagaagacccaaagaaagaaattcttctagccatgttgatggtggacaaggagaagaaaggttacgtcatggcgtccgacctgcggtcaaaactcamgagtctgggggagaagctcacccacaaggaaggtaacagcctgggtcctgtctcccaacagttggagggggttagggagttggaaggagggcaccaaagc

SEQ ID NO: 39630 - DNA, 201 bp, Homo sapiens
aggttcacgcccccagccctggccaggccgacacagaccctcacactcaccattctggggcctcggctgctacccgtgggcttgctgctcccagaaccgcyttcagttccctttcctccagcctcaagtctaaagtctgccaagctgggtggaggcccgggtaataaatgctcggctgccatggagactgggcccgacgcc

SEQ ID NO: 39631 - DNA, 201 bp, Homo sapiens; identical to SEQ ID NO: 8665

SEQ ID NO: 39632 - DNA, 201 bp, Homo sapiens
aacggggagaggggaggggcccagcaggtgggtgcagacagtagaggtgtgaaaagctcagcagtttgaggggcaggtggcagggaggcctcctggggatycagctgtggcagccccagaccaggagtgccgtacctcacttgggcttcctggaatcctcatagcaaccagtgataccccatctcacagacctcgggatct

SEQ ID NO: 39633 - DNA, 201 bp, Homo sapiens
gagtaggcaaaaggaaggggaaaagagggagaagagactaaggatggggagggcggcatgggcggagagtgaccagacgctgctgaccctccctctgggcygtgtgcagagtacaaggaatgcttctccctgtatgacaagcagcagagggggaagataaaagccaccgacctcatggtggccatgaggtgcctgggggcc

SEQ ID NO: 39634 - DNA, 201 bp, Homo sapiens
tcatgctgccaaccccactctgaaccccagctcatcgagcggtccccccgcaccctgccacgctccatcacgtacgtgagcatcatcatcttcatcatggrtgccagcatccacctggtgggtgactctgtcaaccaccgcctgctcttcagtggctaccagcaccacctgtctgtccgtgagaaccccatcatcaagaat

SEQ ID NO: 39635 - DNA, 201 bp, Homo sapiens
ttccaatatctctaaaacatattctcagggggtacagagcaaataagagaatatgtgatggagaacatgcaattgggatagttgataaagatgctcacacrtgagttcaagaccttcaaagcactttgaaagaagcaagcaactgattatattaactgaatgcacactcgggaggagagggaacagtgatgacagaaaaat

SEQ ID NO: 39636 - DNA, 201 bp, Homo sapiens
ctgaggcaggagaatcgcttgaacctgggaggcggaggttgcagtgagctgagattgtgccactgcactccagcctgggcaacaagagcgaaactgttttwaaaaaaaaaaaaaaaaagcacacggtggcatcagtgaccgaatccttaccagtacacctccctactccctgcccctgcagaaagcccgattagctcaaaa

SEQ ID NO: 39637 - DNA, 201 bp, Homo sapiens
gggcgcagggaggtctgccagggtgaagggacagcctaggggaaacccagctcggaacccacaaggcagggcagctggagcgtgcagtctggtctccccctgtgttcaagctctcactgtggggcttcatctagtgcatgacacccctgggagcacaaatgcctgctcctactgataaagaagcagggggagtgagcggct

SEQ ID NO: 39638 - DNA, 201 bp, Homo sapiens
cttgaacctgggaggcggaggttgcagtgagctgagattgtgccactgcactccagcctgggcaacaagagcgaaactgttttaaaaaaaaaaaaaaaaaagcacacggtggcatcagtgaccgaatccttaccagtacacctccctactccctgcccctgcagaaagcccgattagctcaaaatggaataagggtctcag

SEQ ID NO: 39639 - DNA, 201 bp, Homo sapiens; identical to SEQ ID NO: 8663

SEQ ID NO: 39640 - DNA, 201 bp, Homo sapiens
agggcgcagggaggtctgccagggtgaagggacagcctaggggaaacccagctcggaacccacaaggcagggcagctggagcgtgcagtctggtctccccctgtgttcaagctctcactgtggggcttcatctagtgcatgacacccctgggagcacaaatgcctgctcctactgataaagaagcagggggagtgagcggc

SEQ ID NO: 39641 - DNA, 201 bp, Homo sapiens
ctgaaagaaaacccatccaagatgttaccaagtggttctctctggtaatgggattatgggtgatttttgttccttttattgtttcctgtattttcaacaaygagaacacatacagcttttcataatcagaaacaagttttatgttttgttttgctttttctaagaaaaaaagtagtttcagagcctggggttgctgtttgc

SEQ ID NO: 39642 - DNA, 201 bp, Homo sapiens
gttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgatttttgttccttttattgtttcctgta

SEQ ID NO: 39643 - DNA, 201 bp, Homo sapiens
tgtctgtccgtgagaaccccatcatcaagaatctcaagccggagacgctggtgaggccacctcctgctccctgcctgtaagccctaggagcacagtctgtyctgggaggctgaagaaatggcccccacccctcgccgcacctgtcctttcaccaaaggcattctgctaggtgagggcactgtcgcctgccccaagctagga

SEQ ID NO: 39644 - DNA, 201 bp, Homo sapiens
cccccaggatggttttagccacctggctgattgtggaaacttctccacaaaatgagatgaattatactgtcctcaacattctcccaataaatactcagaaytactatcagcttaggccaaggcatggtgattatactttcgagaaggatagttaagcagagaatcacaggatattttctaactgacgaccggaggtgtgtg

SEQ ID NO: 39645 - DNA, 201 bp, Homo sapiens
aagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgatttttgttccttttattgtttcctg

SEQ ID NO: 39646 - DNA, 201 bp, Homo sapiens
tcagtggtctgatacctgagatcccccatgtccagctccaaaggggtggtggtttccttgatttctgtcccctccaaacaggaagttgtagtccagggaakttttgatttcctgcagttacatcccagccagggcccgtggaggaggggctgggatggagactgcagtgaggggaaggcaggtgagcagcccagcctgcga

SEQ ID NO: 39647 - DNA, 201 bp, Homo sapiens
taagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgatttttgttccttttattgtttcct

SEQ ID NO: 39648 - DNA, 201 bp, Homo sapiens
attaagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgatttttgttccttttattgtttc

SEQ ID NO: 39649 - DNA, 201 bp, Homo sapiens
cattaagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgatttttgttccttttattgttt

SEQ ID NO: 39650 - DNA, 201 bp, Homo sapiens
agatcaaggtttacatccattaagttcttgagccaatgatggcatcaggattagtacccaattcttctgatatcaaagactgacctaaaaactatgcaatagtttttagaaaaactattgctagaaaaaaaatgctgaaagaaaacccatccaagatgttaccaagtggttctctctggtaatgggattatgggtgatttt

SEQ ID NO: 39651 - DNA, 201 bp, Homo sapiens
ttgttactcaaacacacttgtttataaatacatatatacacacacacatatacatatcaacaccaacttttttttttcccaaaattcaagtcaacaatttrgtggcagagagatgctataaaaacattatttttagatgccacacaagtcatgagaaccattaattttatcatacaactgaagtacagccatcttgaattc

SEQ ID NO: 39652 - DNA, 201 bp, Homo sapiens
ggaggcaccgcccactcccctggcattccagctttgcaggtgaccctcctctacccaaagctctgtccccctgctcccactccagaagaactgcggcacgygcttcgggcagcctagccacaggctttgagcgcctgcattcctgggggctggagggtggggtgccaaaggccctgagcaaaagccagagctcctctcatc

SEQ ID NO: 39653 - DNA, 201 bp, Homo sapiens
gggagggagtagggagaaagggaaggggagccagataaaatacaggacacccagttaaattagaatttcagacaaacaacaaatacttttccaatagaagyatatgtcctatgcaaaatttggggcatacaataaaagtatattcagtgtttatctgaattcggtttaacttggcagtcctgtattttcatttgctgtatc

SEQ ID NO: 39654 - DNA, 201 bp, Homo sapiens; identical to SEQ ID NO: 8664

SEQ ID NO: 39655 - DNA, 201 bp, Homo sapiens
ttccacgccccgaggcccgcccctagctgggagcctctagggagcctcaggccccgcctctccgaggcaggcccctcccctgagacccaggccccgccccygagacccaggccccgcccccactcggttgccaactttcgcccgtctatgccaaagcctcggcggcgaccccgccccaagggcccgccccattggccgccg

SEQ ID NO: 39656 - DNA, 201 bp, Homo sapiens
gatccctgcctctgggaaagtgcatgtcaggctggtgtgtggctggcgcctggcctgcctttgccagtttgagcctgcacgtccaagtgtggggacccctyagctcccgggtgctgggatgggccaactgaatagggtggactcaaccctcaccacttggtccccacagtgctgggcagtgccccctggtccatccccagg

SEQ ID NO: 39657 - DNA, 201 bp, Homo sapiens
ggcaggcaggagagggcacccctttctgctctgcttgtggctcactcctgccaggctctttgcacacacccaccagccctctgctcacaggcaccccagtyggggccatccggtttctggcttctcccagggtgttttgtccctgaggtgtcctttctgactctccctttctctctccagcagggtctgcgaggtgcaggg

SEQ ID NO: 39658 - DNA, 201 bp, Homo sapiens; identical to SEQ ID NO: 8669

SEQ ID NO: 39659 - DNA, 201 bp, Homo sapiens
cgggctctgtcctccatatcgaataataatgacacatatcgaatcgcatggacttatccgacctcctcagaccccgcttccgccctgccccgggcccccacccccccccccgtaccccaggcattcgtgttggaggacggattcccggggccggcaggcaggcctgggcgctgccctctacacacctctgtcttcgctttg

SEQ ID NO: 39660 - DNA, 201 bp, Homo sapiens
gctgtggtcacttgggtgcccatgcaccacatacttgctgcttcccattggatcccaggagagtcctgcagatgtggtgtgggcgtggggaggccgaacartgcctggctggagcctgtgtgttgtgagctgggcctgaggggtgcagggcctccagggagggcagggtggagggggtcttgccctgggctggtgggagag

SEQ ID NO: 39661 - DNA, 201 bp, Homo sapiens; identical to SEQ ID NO: 8670

SEQ ID NO: 39662 - DNA, 201 bp, Homo sapiens; identical to SEQ ID NO: 8676

SEQ ID NO: 39663 - DNA, 201 bp, Homo sapiens
ccctgggggctgggatgggccatggtgtgctctgatccccctgtggtctcttggcccccaggaactccgagtctgtcacctacttctggcagaactggaasatccctgtgcacaagtggtgcatcaggtaggtggggtgtgtgtgtgtgtgatgtggaacatggctgtgaacctgaaccgctttccatgccccctcctctg

SEQ ID NO: 39664 - DNA, 201 bp, Homo sapiens
agcggccaatgtctttgctgtggctgcattccaggttgagaagcgcctggcggtggtaagcagtgcccctcacctccgtgtgtgctcaccctgctgtgtgygctcctgggaggagctgctccccaggcctggcagccctctcccaggcaatgggagccctggttgagtgctctgctccccactccagggtgccctgacgga

SEQ ID NO: 39665 - DNA, 201 bp, Homo sapiens
gcggccaatgtctttgctgtggctgcattccaggttgagaagcgcctggcggtggtaagcagtgcccctcacctccgtgtgtgctcaccctgctgtgtgcrctcctgggaggagctgctccccaggcctggcagccctctcccaggcaatgggagccctggttgagtgctctgctccccactccagggtgccctgacggag

SEQ ID NO: 39666 - DNA, 201 bp, Homo sapiens
cctcgggtggggatcaggctgacgtggccctaaacctgccccttggtgcttctgtccacagcggccaatgtctttgctgtggctgcattccaggttgagargcgcctggcggtggtaagcagtgcccctcacctccgtgtgtgctcaccctgctgtgtgcgctcctgggaggagctgctccccaggcctggcagccctctc

SEQ ID NO: 39667 - DNA, 201 bp, Homo sapiens
gtgtgtggctggcgcctggcctgcctttgccagtttgagcctgcacgtccaagtgtggggaccccttagctcccgggtgctgggatgggccaactgaatakggtggactcaaccctcaccacttggtccccacagtgctgggcagtgccccctggtccatccccaggttggaccctgcttgtggccccagtgctagtccac

SEQ ID NO: 39668 - DNA, 201 bp, Homo sapiens
gggtgcccatgcaccacatacttgctgcttcccattggatcccaggagagtcctgcagatgtggtgtgggcgtggggaggccgaacagtgcctggctggarcctgtgtgttgtgagctgggcctgaggggtgcagggcctccagggagggcagggtggagggggtcttgccctgggctggtgggagagtggactgcatgct

SEQ ID NO: 39669 - DNA, 201 bp, Homo sapiens
ggtgtcgggagcgggtctaggtccaggtggggctctgtcccaggctggcctttgcctgagaacaggctctgtcacccagggtgtccaggctggagcccctstgggctggggtgtgtggagcaggctgcacctccatgtggctgccagcactggactgttggggaggggagtggcagtggctgcccctgctgtggtcacttg

SEQ ID NO: 39670 - DNA, 201 bp, Homo sapiens
ccctgcctctgggaaagtgcatgtcaggctggtgtgtggctggcgcctggcctgcctttgccagtttgagcctgcacgtccaagtgtggggaccccttagytcccgggtgctgggatgggccaactgaatagggtggactcaaccctcaccacttggtccccacagtgctgggcagtgccccctggtccatccccaggttg

SEQ ID NO: 39671 - DNA, 201 bp, Homo sapiens
gcccggcggctgtaatggttccatgggcgggggtggggtggttgcccccaagacccctccttcaggcattaatcattcactgaccgttcattgagcacctmctatgtgccaggccaattgctgagtccgccaggagcgcagccacctgctgggaggtgtgtttgcaggacaggggtccaaccggcttgggtgggccaggga

SEQ ID NO: 39672 - DNA, 201 bp, Homo sapiens
gctgcccctgctgtggtcacttgggtgcccatgcaccacatacttgctgcttcccattggatcccaggagagtcctgcagatgtggtgtgggcgtggggasgccgaacagtgcctggctggagcctgtgtgttgtgagctgggcctgaggggtgcagggcctccagggagggcagggtggagggggtcttgccctgggctg

SEQ ID NO: 39673 - DNA, 201 bp, Homo sapiens
gttggggaggggagtggcagtggctgcccctgctgtggtcacttgggtgcccatgcaccacatacttgctgcttcccattggatcccaggagagtcctgcwgatgtggtgtgggcgtggggaggccgaacagtgcctggctggagcctgtgtgttgtgagctgggcctgaggggtgcagggcctccagggagggcagggtg

SEQ ID NO: 39674 - DNA, 201 bp, Homo sapiens
ggctcctgccatggctctcaggcccactctccctgcctaggggctctgaggggcagatgtgcgtgtgcgggagggaaagggaggctctggcctctcctctyacaaagttgaggacttgctcaatgctgtgtgtggtgtcccagtggcacggcagatggggggtgaggcgggcctgcagctagtgtatgtgagccagcactg

SEQ ID NO: 39675 - DNA, 201 bp, Homo sapiens; identical to SEQ ID NO: 8666

SEQ ID NO: 39676 - DNA, 201 bp, Homo sapiens
catggctagctgaagggcttgtttctgcaggacatggactactcacgcatcatcgagcgcctcctgaagctggcggtgagtgcggacaggtggcgcatgcrcaggacaggaggggacagtggcatgtgggggaaggttctagaacttggtgcccacccccacctccctgccaggtccccaatcacctcatctggctcatct

SEQ ID NO: 39677 - DNA, 201 bp, Homo sapiens
tggactgttggggaggggagtggcagtggctgcccctgctgtggtcacttgggtgcccatgcaccacatacttgctgcttcccattggatcccaggagagycctgcagatgtggtgtgggcgtggggaggccgaacagtgcctggctggagcctgtgtgttgtgagctgggcctgaggggtgcagggcctccagggagggc

SEQ ID NO: 39678 - DNA, 201 bp, Homo sapiens
tgctcaatgctgtgtgtggtgtcccagtggcacggcagatggggggtgaggcgggcctgcagctagtgtatgtgagccagcactgcttcctaggacgtgtrggggcctggccaagctcttgctgtccttgtcctagctatatggcagtccctctattgggctgggtgccctcttccacctgtgcagtatgctgaggaccag

SEQ ID NO: 39679 - DNA, 201 bp, Homo sapiens
tggcctctcctctcacaaagttgaggacttgctcaatgctgtgtgtggtgtcccagtggcacggcagatggggggtgaggcgggcctgcagctagtgtatrtgagccagcactgcttcctaggacgtgtaggggcctggccaagctcttgctgtccttgtcctagctatatggcagtccctctattgggctgggtgccctc

SEQ ID NO: 39680 - DNA, 201 bp, Homo sapiens; identical to SEQ ID NO: 8667

SEQ ID NO: 39681 - DNA, 201 bp, Homo sapiens
cttccacctgtgcagtatgctgaggaccaggcagggtctgcctgtgcccctccagcgctggttgggagatcatgggtgggtgcctgcctctgttggaagcytctcagccagcaggcacctagccccgggtgggttcctttcagccccctcagcctgggcacacatcacaaacaagtggaggctacaccggcacacgagggc

SEQ ID NO: 39682 - DNA, 201 bp, Homo sapiens
tcactccctagatcccactggcctggttcgtgggccgctttttccagggcaactatggcaacgcagctgtgtggctgtcgctcatcatcggacagccaatwgccgtcctcatgtacgtccacgactactacgtgctcaactatgaggccccagcggcagaggcctgagctgcacctgagggcctggcttctcactgccacc

SEQ ID NO: 39683 - DNA, 201 bp, Homo sapiens; identical to SEQ ID NO: 8672

SEQ ID NO: 39684 - DNA, 201 bp, Homo sapiens
ggttagcgctgaccccactggggagggaggagggctctgccagcgctcgggccctcccacacagccgtggaccagacccagcctggccgggcatgagcgtygggcctgggcggcagcagccgagacccctctgtggcgggggctcagtgtcgtcatggctcccctggccacgggcctgtggtcattgcctgtgacagggat

SEQ ID NO: 39685 - DNA, 201 bp, Homo sapiens
tggggcaacatagcttggccaacatggtgaaaccttgtctctactaaaaatacaaaaactagctgggcgtggtggcaggtgcctgtaatccccgctactcrggaggctgaggcgggagaatctctggaacccaggaggcagaggctgcagtgagccgaaactgcaccattgcactccagcctgggcgacacagcgagactc

SEQ ID NO: 39686 - DNA, 201 bp, Homo sapiens
cacggagttccagcacccatgcttcctgcgtggccaggagcagctccttgagaacatcaagaggaaagtgaccagtgtgagtgccggccctgcacccttgmccggtctcacctgccacagctctccccgcccgcccctccctgagggctcccaccccagcctgccccttcctgagggacctggctgcagtggacgagcctg

SEQ ID NO: 39687 - DNA, 201 bp, Homo sapiens
cgacaaagcgagactccgtctcaaaaaaaataaaaagcatccagaagagccgtgcacggtggtggtgcctgtggtgccagctactcagaggctcgggtggmaggattgctcccagatggggcaacatagcttggccaacatggtgaaaccttgtctctactaaaaatacaaaaactagctgggcgtggtggcaggtgcctg

SEQ ID NO: 39688 - DNA, 201 bp, Homo sapiens
gcccagtcctgggcctcacagtgaggatgcaggtcacgctgcacagatgaggcccgtgtggcaggtggtcccaggaacgaactcgcctcccgccagccccmtgggcctcccatggccccagccccatcaggtggaacgtgcactgcctgcgtttcagaaggggcggcctggggaaggggcggcttgggcacgctgcccctc

SEQ ID NO: 39689 - DNA, 201 bp, Homo sapiens; identical to SEQ ID NO: 8701

SEQ ID NO: 39690 - DNA, 201 bp, Homo sapiens
ctggtgtgagccactgcacccagcccttcttctttttcttattccccttaatcctcagaagttaaggggaataactcccccattgggggaggggcatccgmgattatctgggatattctaagcttaatcctactagcgtgatctgtcctgtcccgtaatctgcttgctgtttctgcttaaagattatgaggcatgtgggtt

SEQ ID NO: 39691 - DNA, 201 bp, Homo sapiens
gaacctggcgcctagagtggcctgcgggccattcagcccatgggagccaggatgagttgaattcgcttcacaaagcaatggggcagtttcaacaacccagmgcggccgcggccgagggggctgtgaggggctggctgtccatcccctccaccacccaatttgatgatccccacaaccaagacagggctgagctagcagaga

SEQ ID NO: 39692 - DNA, 201 bp, Homo sapiens; identical to SEQ ID NO: 8702

SEQ ID NO: 39693 - DNA, 201 bp, Homo sapiens
ggtctttctggctttttccctgtttgcatctgcagctcccttccctggcagggagaaacctgccccactgcccttcaccagtttcttcactgagtcagccrccccttcctatgcagacacccctcacccctctctggccctgcttcaggccccccttccccgccgtgtgggcttctcgctgtcccctaagccttcgatgtc

SEQ ID NO: 39694 - DNA, 201 bp, Homo sapiens
cagaggagggggcatggaaagcggttcaggttcacagccatgttccacatcacacacacacacaccccacctacctgatgcaccacttgtgcacagggatsttccagttctgccagaagtaggtgacagactcggagttcctgggggccaagagaccacagggggatcagagcacaccatggcccatcccagcccccaggg

SEQ ID NO: 39695 - DNA, 201 bp, Homo sapiens
acgccccttgtctcctgggtccactgccaccaaggcccccaggccctcatggcaaagggatgcccagcataggcccagccgcacccctgcagggcacagascctccactgccttccaggccgtcctcgaatgcgctgccccctccagcctgtgcaggcgtacacgggggtgcagcctggggggtacagtcaaggggagccc

SEQ ID NO: 39696 - DNA, 201 bp, Homo sapiens
gagagggctgccaggcctggggagcagctcctcccaggagcgcacacagcagggtgagcacacacggaggtgaggggcactgcttaccaccgccaggcgcytctcaacctggaatgcagccacagcaaagacattggccgctgtggacagaagcaccaaggggcaggtttagggccacgtcagcctgatccccacccgagg

SEQ ID NO: 39697 - DNA, 201 bp, Homo sapiens
ggaggctgaggcggttggatcacctgaggtcagcagttcaagaccagcctgaccaacatggtgaaaccccgtctctactaaaaatacaaaaaaaaaaaaaatagccaggcgtggtggtgcgtgcctgtaatcccagctactcgggaggctgaggcaggagaatcacttgaacctgggatacagaggttgcagtgagccgag

SEQ ID NO: 39698 - DNA, 201 bp, Homo sapiens
caccctgccctccctggaggccctgcacccctcaggcccagctcacaacacacaggctccagccaggcactgttcggcctccccacgcccacaccacatcwgcaggactctcctgggatccaatgggaagcagcaagtatgtggtgcatgggcacccaagtgaccacagcaggggcagccactgccactcccctccccaac

SEQ ID NO: 39699 - DNA, 201 bp, Homo sapiens
gcagaaagtgaagcctcagaactgggttcaccatcatcccagttttttacaagctatgattttgtcccatctttattaacaagataaggaagtatgaaaartaatctcgacatctgagatggtgagattacagccccaggagccacccagctggctgaggagcctgagaacaaggcacagccacatgacctgtgccagaca

SEQ ID NO: 39700 - DNA, 201 bp, Homo sapiens
ccatgagacccgggacccgcagcctccctgccccgtgccctggtgccggccctcagcccagcttcctcgtctgcatgcagcagctcctctgtccaccagcrgaggctcttctagggccttgctgggctgcagctgactcaggagggcaacagcctcttcagagaatttgacagcatggagaaccaaacaaaagcagaaagt

SEQ ID NO: 39701 - DNA, 201 bp, Homo sapiens
agatgagccagatgaggtgattggggacctggcagggaggtgggggtgggcaccaagttctagaaccttcccccacatgccactgtcccctcctgtcctgygcatgcgccacctgtccgcactcaccgccagcttcaggaggcgctcgatgatgcgtgagtagtccatgtcctgcagaaacaagcccttcagctagccatg

SEQ ID NO: 39702 - DNA, 201 bp, Homo sapiens
gccctccctggaggccctgcacccctcaggcccagctcacaacacacaggctccagccaggcactgttcggcctccccacgcccacaccacatctgcaggrctctcctgggatccaatgggaagcagcaagtatgtggtgcatgggcacccaagtgaccacagcaggggcagccactgccactcccctccccaacagtcca

SEQ ID NO: 39703 - DNA, 201 bp, Homo sapiens
ggccctcgtcatcaagggctccgtcctctccctcctcgtcgccttcgtcatcatcctcactgctgtcactgccggaatcttccaggcctgagaacacactytcctcgctgtcggagacgccagaatcgctgccggtgctgtggctgagaggagaggtgcagaggagggggggctgcaaggaaacactgggttggtgacaac

SEQ ID NO: 39704 - DNA, 201 bp, Homo sapiens; identical to SEQ ID NO: 8704

SEQ ID NO: 39705 - DNA, 201 bp, Homo sapiens
ggtggcagtgagaagccaggccctcaggtgcagctcaggcctctgccgctggggcctcatagttgagcacgtagtagtcgtggacgtacatgaggacggcwattggctgtccgatgatgagcgacagccacacagctgcgttgccatagttgccctggaaaaagcggcccacgaaccaggccagtgggatctagggagtga

SEQ ID NO: 39706 - DNA, 201 bp, Homo sapiens
ctgcggtgctgactgcacttcctgtcaggcagggtctccagggcacctctgggacccagcctggctgtccgtcccatagcccaggtgtgccctgtggcctrgggctttcttggtcacagccaccagaccgtgggtctcatccccacagcagcaccagggcagggactgagccacccacacactgagcagagccccacctgt

SEQ ID NO: 39707 - DNA, 201 bp, Homo sapiens
gcgtcgggcctgggcggcagcagccgagacccctctgtggcgggggctcagtgtcgtcatggctcccctggccacgggcctgtggtcattgcctgtgacarggatgacagggacaggcctccctgctctggcacggcctctggtgttggcaggatccagactgcggtgctgactgcacttcctgtcaggcagggtctccag

SEQ ID NO: 39708 - DNA, 201 bp, Homo sapiens
agtgggactgaagaagatgtgacaactggatggattttggatgatgtcctggagcagaggaaggattgggtaaaaagctaaggaatctgattagaatgtgsgtcctagttaacaatgtgtctaatgttcttgagacaactgtaccacacaaaggcaggatgttaatgatgggggacactggtgtagggcatgtattctaaa

SEQ ID NO: 39709 - DNA, 201 bp, Homo sapiens
accccacccacacaggcaagggccttgaggggacccagcaagtcgtggaggacagcacagccttggagaggaaatgtgtcagccacaaggttatgatcccrgggatccacataagagcatgggcgtgcacgtgggtggtcctccctcagccagcttctcaacagcttctcccaaaggtacacctggatccagtaccactga

SEQ ID NO: 39710 - DNA, 201 bp, Homo sapiens
ggcagccctccaggtgtttgccaggatggatgccaggatccgggtgcacctggctcgcatggatccatccccaacaccctacgtgacaccaggtgtccccrgcagggaggggcagtgggaccagcaagccctggccctggcccccagtccctccacacacaagttctcatcctggggtgggccaggccagacatggtcaca

SEQ ID NO: 39711 - DNA, 201 bp, Homo sapiens
ggggaggggctttccgactgagaggaaggcctcgcatctgcccaccgcccagtcctgggcctcacagtgaggatgcaggtcacgctgcacagatgaggccmgtgtggcaggtggtcccaggaacgaactcgcctcccgccagccccctgggcctcccatggccccagccccatcaggtggaacgtgcactgcctgcgtttc

SEQ ID NO: 39712 - DNA, 201 bp, Homo sapiens
tagggctccatttccttcgctgttcccaagggaaaggtcctgcttaaacaggtgctttgtgagtggaaacgtggccagagtgcggcgggtgctttgtgagkggaaatgtggccagagtgcggcggatgctttgtgagtggaaacgtggccttctctggaagccctggggaggggctttccgactgagaggaaggcctcgca

SEQ ID NO: 39713 - DNA, 201 bp, Homo sapiens
tcccctccctggcctgagatcaggactcccactgcagccactggaggcagaatgccgggtcactgcccaggagaccccattggtggggactgtggcagctrccccatccctgtgttgtttgatttcccacccccccctcccaagaccctcattcccatgagcaccccacccacacaggcaagggccttgaggggacccagc

SEQ ID NO: 39714 - DNA, 201 bp, Homo sapiens; identical to SEQ ID NO: 8703

SEQ ID NO: 39715 - DNA, 201 bp, Homo sapiens
ggtctaacgtatttgaggttccagaaaacagtggggaagagaatacagaaatatgaccaaaaggctggacacggtggctcctgcccgaaatcccagcactytgggaggctgacatgggtggatcgcttgagcccaggagttcaagaccagcctgggcaacatagcaagaccctgtctctataaataatacaaaaattagcc

SEQ ID NO: 39716 - DNA, 201 bp, Homo sapiens
tcttactaagattcagctgtttttcttgaataaatgctccccgtgctactgtaattctttggttaactttcagagttctggaaagttggcttggcgctttycgccgtctctctcctgctgccttggggtcctttccgtgaccgtttccctccctgacacgtgtacatccctgtgtatttcacatctctctatgctggaaag

SEQ ID NO: 39717 - DNA, 201 bp, Homo sapiens
gactccaacctggataacctgcagaccatgctgagcagccacggcttcagcgtggacaccagtgccctgctggacgtgagtggagccccgccgccccgcckccccgccccgcctccccgcgcctccccgcctccccgcctcgcctcgccgcctccccgcctccccgcgccgcctccccgcctccccgcgccgcctccccgc

SEQ ID NO: 39718 - DNA, 201 bp, Homo sapiens
agtatgaagtggcaatggttggtgcaggacgtagcactgggggcgagcatggcaatgagacagaaacactgacttaaaactggaaggaagcccttctccargccgcgcagggggctgcagagctttccggcgctggctgcctggcctggagaaaggaggtgatcatcccatcctgtgactttgagagcactcacacaagcc

SEQ ID NO: 39719 - DNA, 201 bp, Homo sapiens
gggatattctaagcttaatcctactagcgtgatctgtcctgtcccgtaatctgcttgctgtttctgcttaaagattatgaggcatgtgggttagggcccaktgtacccttttttgggaccgaggcatgttctgggcagggcttttgagcaaggaaggcaggtgtgatgaggcccgtggccagcctccactccactcacagg

SEQ ID NO: 39720 - DNA, 201 bp, Homo sapiens
taacctagacgacataaagaggataattaaagccagagagtaagttggattcttgggctatctattaatcattttatttagaccaattgtataaagaatgytgacaaatatgtggtaaagataaaaatcatgccactggaatgattaaaaaagagttataatgttattgacataaaataacaaaagcactactaactatga

SEQ ID NO: 39721 - DNA, 201 bp, Homo sapiens
ttggtgggtccagttgggtctggaaagtccagttttttcaattcagtcaagtctatttttcatggccatgtgactggccaagccgtagtggggtctgataycaccagcataaccgagcgggtaagttatttccctgaggattttattttatagattacaattattatattgcttatgtctttgcctttttctcttagggca

SEQ ID NO: 39722 - DNA, 201 bp, Homo sapiens
ttctaggactttcaagaatcacatcttatttgttgatgttggccagatactgtgctcttgagtggctttattttaatatattagtgtagtctcagaagccrtggcaaggtacggcagcacaaattaaattaattaggcattgattgaaatgtttctgtttgctaaatatttattcagacatagagacctaaatacaaataa

SEQ ID NO: 39723 - DNA, 201 bp, Homo sapiens
tcaggacaacttgtctccatacagttgggttgtaaccctcatgcttggcccaaataaactctctacttatatcagtttttcctacacttcttccttttagktcaacaataccaagaggggttactgtgctgggtaatgtgtaaacttgtgtcttgtttagaaagataaatttaaagactatcacattgctttttcataaaa

SEQ ID NO: 39724 - DNA, 201 bp, Homo sapiens
gtctgcttccagttcatacttcttccctgtacctcttttcttaaattttttttaaaattttatttcaacagcatttggagtataagtggtttttttttacrtggatgaattatatagtggtgaattctgagattttagtgcatccatcactcaagtagtgtacattgtatctaatatgtagttttttttaatccctagctc

SEQ ID NO: 39725 - DNA, 201 bp, Homo sapiens; identical to SEQ ID NO: 8710

SEQ ID NO: 39726 - DNA, 201 bp, Homo sapiens
tccgaagataacttattaagccattgcttttttggtttctttcttaaattgtatttaaaattggtcaaatttcaaatattaaatacaggacttacactttytaaatatactttccacaggtcatgaatgtccataaaatgctaggcattcctatttccaatattttgatggttggaaattatgcttcagatttggaactgg

SEQ ID NO: 39727 - DNA, 201 bp, Homo sapiens
cacctgccagatgtaaagccaggaaagctggtggtgtaattcagtctgaatccaaatgcctgagaactggtggagccagtggtggaactcccagtctgaawtcaaagtcctgggaactgtgggaactgagagagctggaggtgtaagtcccagaatccgaatgtttgagaaccaggagctcagatatctgagagcagaaga

SEQ ID NO: 39728 - DNA, 201 bp, Homo sapiens
tttcttaaattgtatttaaaattggtcaaatttcaaatattaaatacaggacttacactttttaaatatactttccacaggtcatgaatgtccataaaatkctaggcattcctatttccaatattttgatggttggaaattatgcttcagatttggaactggaccccatgaaggatattctcatcctctctgcactgaggc

SEQ ID NO: 39729 - DNA, 201 bp, Homo sapiens
cagatttggaactggaccccatgaaggatattctcatcctctctgcactgaggcagatgctgcgggctgcagatgattttttagaagatttgcctcttgargaaactggtaatctggcccttttctccccctgtcatagatcactggtgccttttgaaaaatcctaagttatacatcagttattagatgactggggcccac

SEQ ID NO: 39730 - DNA, 201 bp, Homo sapiens
ttctgttttcctattgatcttctgtttggatattttataatggataaagtattgaaagtgggctatcaaaatctccttctcttattgtgttgctgtttctrccttcaattctttcagtgtttgcttcatttatttaggtgctctgatgttggatgaacatatatttataacggttatatttttctggagaattgacccttt

SEQ ID NO: 39731 - DNA, 201 bp, Homo sapiens
tttcattgaaataattcttgtaatgaccaatagtctagtatgctgctgtaagacttctatagctgttaactcctttcatatttcaatttctttatgtgctkttttttgcaagaattcctaggctccattttctaattcatacgttggcaaatgatgaatgtgatatgacaatgatgacctctgttccagccatatactttt

SEQ ID NO: 39732 - DNA, 201 bp, Homo sapiens
tcgtttatcgaaaacggatattttcattatatgtcgagataataaaatttatctagataaaatgataacaagaaacttgaaactaaggttttatggccacygtcagtatttggaatgtgaagtttttcgagttgaaggtttgtaaaattagataatcctacatctcacattatgattctaatccttgtgttcggtaggtaa

SEQ ID NO: 39733 - DNA, 201 bp, Homo sapiens; identical to SEQ ID NO: 8717

SEQ ID NO: 39734 - DNA, 201 bp, Homo sapiens
catgttgccaactctgactcctaactgagcagctcagccctgggttatgcaagaaaactccatgtcttatttcaaaagtagacttggccacatttaaccaracaagttttaaaaatgtattatgctatgtttatttcctataggaattaaggataacctagacgacataaagaggataattaaagccagagagtaagttgg

SEQ ID NO: 39735 - DNA, 201 bp, Homo sapiens
tatttcaaatcatattatagaagatctcattatcaaaataataattaagtattgaaaaaatacccttctcagggaagagaaagaagctctaggtgacttgmgatgttctttatggtattctttattggctgttctgatgctgtatttaaccactatattttaacaggcacagaaataggcttctagcagacatcagagact

SEQ ID NO: 39736 - DNA, 201 bp, Homo sapiens
ttttttgtaagcatcatggttaagcacaaaacaaatactgatagtagatacacaaaatataaaaagcatggagtcaaaacataccattatatatatatatrtgtgtgtgtgtgtgtgtgtgtatgtgtatatatatatatatacacacacgttttacatgataaattacatagaaatttcttttttaattaaaaaggaata

SEQ ID NO: 39737 - DNA, 201 bp, Homo sapiens
agatgttctttatggtattctttattggctgttctgatgctgtatttaaccactatattttaacaggcacagaaataggcttctagcagacatcagagacyataggccctatgcagacttggtttcagaaattcgtattcttttggtgggtccagttgggtctggaaagtccagttttttcaattcagtcaagtctatttt

SEQ ID NO: 39738 - DNA, 201 bp, Homo sapiens
ctattttgtgtgggataaggacacacaccccttgcgggttatcttgcggttcttgcagttaccatttgcaaaggtacccttattatcacttgattttcatyctatgtgtgttcttaagtctaagtgagttcttggggacagcatgctgttgtattttgtcatgacatgctttgactcagtattatccttctttctttcctt

SEQ ID NO: 39739 - DNA, 201 bp, Homo sapiens
gatgaattatatagtggtgaattctgagattttagtgcatccatcactcaagtagtgtacattgtatctaatatgtagttttttttaatccctagctcctyttccatcctctcctttctgagtctctaaagtccatcatatcagtctgtatgcctttgtgtactcatagcttagctcccacttataagtgagagcatatgg

SEQ ID NO: 39740 - DNA, 201 bp, Homo sapiens
tttgaagctggaagaatgttcttttcatccagacaagatttattttgtttctgctatgcagctatggacactagcaattctcatttaccttaattcaatcmaggactgagaatactgaagtatgaaattaactctgtctgcttccagttcatacttcttccctgtacctcttttcttaaattttttttaaaattttatttc

SEQ ID NO: 39741 - DNA, 201 bp, Homo sapiens
ctagataaaatgataacaagaaacttgaaactaaggttttatggccaccgtcagtatttggaatgtgaagtttttcgagttgaaggtttgtaaaattagayaatcctacatctcacattatgattctaatccttgtgttcggtaggtaataattgatctacaagagcaaggaaagtgaaaggaacagttagattcatgcca

SEQ ID NO: 39742 - DNA, 201 bp, Homo sapiens
actgctgaatatgatgttaactatgaactttttatacatgtatttactatgttgaggtaatttccttctactcctggtttaagtgtttttgtgtttttttkttttttttttttttaaatcatggaaggacttgggttttatcaaatgtcttttctgtatctattgagatgaccaatttgtattagtcagcgttcttcagag

SEQ ID NO: 39743 - DNA, 201 bp, Homo sapiens
ctcaacacaattcaaacaaatagactcagactgtttcaggctccaggacaggaagtgcagtgtaggcaaaattgcaaaaattgagggcacaggggtggagrtgggggggttgaataacaagctgtgctaaataattacgtgtaaatatattttttcatttttaaaaattgatttcttttgcacattccatgacaatatatg

SEQ ID NO: 39744 - DNA, 201 bp, Homo sapiens
aatatgatgttaactatgaactttttatacatgtatttactatgttgaggtaatttccttctactcctggtttaagtgtttttgtgtttttttgttttttktttttttaaatcatggaaggacttgggttttatcaaatgtcttttctgtatctattgagatgaccaatttgtattagtcagcgttcttcagagaaactga

SEQ ID NO: 39745 - DNA, 201 bp, Homo sapiens
tcacctcaaccatttatcatttctttgtatttggaacattccaaattttctcttctagctatttcaaaatagacaataaattattgttaactatagttaamctgttgtgctatgaacacaagaacttattccttctatgtagctgtatttttgtaaccattaaccaacctcttttcatcatctccttcctctgactttccc

SEQ ID NO: 39746 - DNA, 201 bp, Homo sapiens
gtagttacagtattagaagcattaattgtgtctttaagggttaaacagaggctctctgatttctgaatgttaccttatgtttttataacagtttaattccygtaaaccaattacacctgagcattctacttttatcacctctccatctctgaaggacaggattcactgtgtggcttatgtcttagacatcaactctattga

SEQ ID NO: 39747 - DNA, 201 bp, Homo sapiens
agataatcctacatctcacattatgattctaatccttgtgttcggtaggtaataattgatctacaagagcaaggaaagtgaaaggaacagttagattcatrccatactctttgataaattctgaaatgaaacgtggggaacataaggattatgaggtttttatccagaacgtataggctgctttgagcaaagcaagttgag

SEQ ID NO: 39748 - DNA, 201 bp, Homo sapiens
aaataacaaaagcactactaactatgaaactttaaatatccacctgatgacattgaccaatttgacttcatttccactttagaccaaaattttccaggtarggtctggataaccattttaggtaatttctctgaatcctttccttgagaaacagcttttgagaatcctcagtaaatgtcaaaaacaaactttctttttaaa

SEQ ID NO: 39749 - DNA, 201 bp, Homo sapiens
aatttccactattttaaatatccatagatataacccacataaacaacagatctttgggattctcaataacttttaagagtctaaaggggtcctgagaccaractgtttgaggaccatggtgttcaaatattaaccaatctcttttcttcttattgtcatgtcttgaatgctgggtgatgaatgaacctttacacttaatgt

SEQ ID NO: 39750 - DNA, 201 bp, Homo sapiens
agacatcagagactataggccctatgcagacttggtttcagaaattcgtattcttttggtgggtccagttgggtctggaaagtccagttttttcaattcartcaagtctatttttcatggccatgtgactggccaagccgtagtggggtctgatatcaccagcataaccgagcgggtaagttatttccctgaggattttat

SEQ ID NO: 39751 - DNA, 201 bp, Homo sapiens
tagttacagtattagaagcattaattgtgtctttaagggttaaacagaggctctctgatttctgaatgttaccttatgtttttataacagtttaattcccrtaaaccaattacacctgagcattctacttttatcacctctccatctctgaaggacaggattcactgtgtggcttatgtcttagacatcaactctattgac

SEQ ID NO: 39752 - DNA, 201 bp, Homo sapiens
gagaaagagggagatcagtagttacagtattagaagcattaattgtgtctttaagggttaaacagaggctctctgatttctgaatgttaccttatgttttyataacagtttaattcccgtaaaccaattacacctgagcattctacttttatcacctctccatctctgaaggacaggattcactgtgtggcttatgtctta

SEQ ID NO: 39753 - DNA, 201 bp, Homo sapiens; identical to SEQ ID NO: 8711

SEQ ID NO: 39754 - DNA, 201 bp, Homo sapiens
aaaacataccattatatatatatatatgtgtgtgtgtgtgtgtgtgtatgtgtatatatatatatatacacacacgttttacatgataaattacatagaawtttcttttttaattaaaaaggaatatttacatttttttcagttgtaatttccactattttaaatatccatagatataacccacataaacaacagatcttt

SEQ ID NO: 39755 - DNA, 201 bp, Homo sapiens
ctagatgaaactagtcaacagcaaaaaaaattttcctttttgctggctctaatttgtattttccagttgtgagtgtctccaaaagccaatctgggacataygaagtaaaaagaaaacctagagagctcatctctgtattgtttcttgggtctcaaggtctctagccaaattgcattatctgcacttttcaatctttatgtt

SEQ ID NO: 39756 - DNA, 201 bp, Homo sapiens
taataaaatttatctagataaaatgataacaagaaacttgaaactaaggttttatggccaccgtcagtatttggaatgtgaagtttttcgagttgaaggtwtgtaaaattagataatcctacatctcacattatgattctaatccttgtgttcggtaggtaataattgatctacaagagcaaggaaagtgaaaggaacagt

SEQ ID NO: 39757 - DNA, 201 bp, Homo sapiens
gctaagttttaaaatgacttttcaaggatgtatggcaacacattgtccttggcgtgctggatggcaatgcttaatgcaacttagtgtgctgacttaggacstctaaaaggacattgtattaattttgaaacagaagaattacattgcaacagaggttgaaaaaaattataggtgtcaactgagaactgctctctaccagaa

SEQ ID NO: 39758 - DNA, 201 bp, Homo sapiens
aaagccgggtaaaaaatgctgatcataaccagatattattgtaatagtatcacaatcatacgtgtgtgtgtttgtgtgtgtctgtacgtgtatatgtgctyacagagtgtatttgcagggaaatgaagaatgggatcaattgcttgattaattcaaatttatatcacactttaaaactgcaatgatctgaattattgtatg

SEQ ID NO: 39759 - DNA, 201 bp, Homo sapiens
tccatagatataacccacataaacaacagatctttgggattctcaataacttttaagagtctaaaggggtcctgagaccaaactgtttgaggaccatggtrttcaaatattaaccaatctcttttcttcttattgtcatgtcttgaatgctgggtgatgaatgaacctttacacttaatgtatttttttaacagtatagga

SEQ ID NO: 39760 - DNA, 201 bp, Homo sapiens
aaagaaagttagtggcagttggcatgctgccagctgagtttttttgctgctttgagtctcagttttctttctttcctagagtctctgaagccacagatctsttaagaactttctgtctccaaaccgtggctgctcgataaatcagacagaacagttaatcctcaatttaagcctgatctaacccctagaaacaggtaagcg

SEQ ID NO: 39761 - DNA, 201 bp, Homo sapiens
ttcactttcttttttattttggcctacttgttctggctaggacattcagtattatgttgaatagaagtggtaaaagtggataatcttgtcttgtactttaycttagaggaaaagctgtcagtttttcactgctgaatatgatgttaactatgaactttttatacatgtatttactatgttgaggtaatttccttctactcc

SEQ ID NO: 39762 - DNA, 201 bp, Homo sapiens
atgaaatgaaacatacagagatgaaaactggaagtttttttttgtttgttttgttttttttttgttgttgtttttttttttttttgtttttttgctgagtsaattccttggagggggtcttcagactgactggtgtcagcagacccatgggattccaagatctggaaaactttttagatagaaacttgatgtttcttaacg

SEQ ID NO: 39763 - DNA, 201 bp, Homo sapiens
acttgggttttatcaaatgtcttttctgtatctattgagatgaccaatttgtattagtcagcgttcttcagagaaactgaaccaacataaaaaaaataaawttaaaaaaaaactaaggaaatttgttatgggaggtggctcatgtggtgttggagggcgagaagtctcactatctgccacctgccagatgtaaagccagga

SEQ ID NO: 39764 - DNA, 201 bp, Homo sapiens
atatggcctacaaaggctaaaatatttactatcttgttcattaagaaaaaatttgctgactcttattgagatttatttttcctttattcaactttctgaaktttgtcaattgatttaaaaattttaatgacttttcctttctaaattatatatttttatatctaacattattgtgccatttctatatttttgctatatttt

SEQ ID NO: 39765 - DNA, 201 bp, Homo sapiens
tgtttgtgtgtgtctgtacgtgtatatgtgcttacagagtgtatttgcagggaaatgaagaatgggatcaattgcttgattaattcaaatttatatcacaytttaaaactgcaatgatctgaattattgtatgttccgaagataacttattaagccattgcttttttggtttctttcttaaattgtatttaaaattggtca

SEQ ID NO: 39766 - DNA, 201 bp, Homo sapiens
aaaagatcaaagatcatttctcctctagaaaagcttcaggctccatattgagatgtattggggatatttcattcttcagctctcaaaatcaccctatagarttgccttcacacatatttaataacttgttgacacattgctatttatgatataaaataactgatttatctatttgatataggtatagcatatgtggccttg

SEQ ID NO: 39767 - DNA, 201 bp, Homo sapiens
atggaaaaaatggaaaatctctgccatttatgttgtgtgacactatggggctagatggggcagaaggagcaggactgtgcatggatgacattccccacatyttaaaaggttgtatgccagacagatatcaggtaagatttcttcaatatccaaaacatttcaaatcattttcttcagtatttttcattgaatttttaacca

SEQ ID NO: 39768 - DNA, 201 bp, Homo sapiens
aaaattttaatgacttttcctttctaaattatatatttttatatctaacattattgtgccatttctatatttttgctatattttttgccttaaccaaacartgtgttttaattgagtcagtgaataaagaactcactgaaagtagaagtggaaacctaagctataagctactatattatataagcttctcaacctataatt

SEQ ID NO: 39769 - DNA, 201 bp, Homo sapiens; identical to SEQ ID NO: 8719

SEQ ID NO: 39770 - DNA, 201 bp, Homo sapiens
acagtggggggactgcaccgttttcccccaacatcatccctgaggcaacgtcctgagccgcaggtgacagggactgtaggcctgcatctgggggtaacccyctctgtgatccgtaagcgatacaacttgacctcacaagacgtgggctctggcaccagcaataacagccaagcctgtgcccaggtgagccaagcaaagagc

SEQ ID NO: 39771 - DNA, 201 bp, Homo sapiens
aagcgatacaacttgacctcacaagacgtgggctctggcaccagcaataacagccaagcctgtgcccaggtgagccaagcaaagagccccagggtcctcayagcctccccacagtgtcctcaattccttaccaccctgggactcaccctcggacccacgatctctgctctgactccctccatagttcctggagcagtattt

SEQ ID NO: 39772 - DNA, 201 bp, Homo sapiens
gtgtgtgcttgtgaactgcagaggctggggacggggcagtgtgacactagtgtgcatggcaggaaacagtgactcaccatcgtgttaagcttaaaatcaamaagtatgcaaatttgagctaaactgaataactggtgccgaaagatttgaaaacatttaccggacataagcttaaaattaaaatggaaaatttatatgtat

SEQ ID NO: 39773 - DNA, 201 bp, Homo sapiens; identical to SEQ ID NO: 8720

SEQ ID NO: 39774 - DNA, 201 bp, Homo sapiens
tgtaaggtgggcattacagtctataagatctcctcaagcctgacttctccctacagtggggggactgcaccgttttcccccaacatcatccctgaggcaaygtcctgagccgcaggtgacagggactgtaggcctgcatctgggggtaaccccctctgtgatccgtaagcgatacaacttgacctcacaagacgtgggctc

SEQ ID NO: 39775 - DNA, 201 bp, Homo sapiens
tgacctctgttctctgacctccagacaagcagagctgctgctccctggggctgagtttcatcactatgtgggaggacctacggaaacccatgttgtaaggyccccacatccctaccagcttccacaggccttggccccccatgtggactttggtaacacctatggggtgaatgggggttggggcacacagatccaggggct

SEQ ID NO: 39776 - DNA, 201 bp, Homo sapiens
tccgttttgagctttctgacctctgttctctgacctccagacaagcagagctgctgctccctggggctgagtttcatcactatgtgggaggacctacggaracccatgttgtaaggtccccacatccctaccagcttccacaggccttggccccccatgtggactttggtaacacctatggggtgaatgggggttggggca

SEQ ID NO: 39777 - DNA, 201 bp, Homo sapiens; identical to SEQ ID NO: 8723

SEQ ID NO: 39778 - DNA, 201 bp, Homo sapiens
ctgaccctccacacggtgcaaaaatggctcttggcagccggagcccagaagtgccattctgtgatcacacaggactttctgacttgctggctgagcatccrgtgagaggaaatgattgctccatggagggcaccagtcatcccatcagtgagatggatgggagggagttgagagcttgctggggcttgtgggtgggagcta

SEQ ID NO: 39779 - DNA, 201 bp, Homo sapiens; identical to SEQ ID NO: 8721

SEQ ID NO: 39780 - DNA, 201 bp, Homo sapiens
agttttttctctctagaattcggctcatctccttagctgcccagaaattcatctcagatattgccaatgatgccctacagcactgcaaaatgaagggcacrgcctccggcagctcccggagcaagagcaaggtgtgaggggaggcttaatgaatcagtaattaccttccacaacagtggaggcttatcctgccaccccttt

SEQ ID NO: 39781 - DNA, 201 bp, Homo sapiens
gaaacccatgttgtaaggtccccacatccctaccagcttccacaggccttggccccccatgtggactttggtaacacctatggggtgaatgggggttgggrcacacagatccaggggctgaggaagtttagatgccattggggactgggggtggggtgagttgtaaggtgggcattacagtctataagatctcctcaagcc

SEQ ID NO: 39782 - DNA, 201 bp, Homo sapiens
actgaccctccacacggtgcaaaaatggctcttggcagccggagcccagaagtgccattctgtgatcacacaggactttctgacttgctggctgagcatcyggtgagaggaaatgattgctccatggagggcaccagtcatcccatcagtgagatggatgggagggagttgagagcttgctggggcttgtgggtgggagct

SEQ ID NO: 39783 - DNA, 201 bp, Homo sapiens
ccgttttcccccaacatcatccctgaggcaacgtcctgagccgcaggtgacagggactgtaggcctgcatctgggggtaaccccctctgtgatccgtaagygatacaacttgacctcacaagacgtgggctctggcaccagcaataacagccaagcctgtgcccaggtgagccaagcaaagagccccagggtcctcatagc

SEQ ID NO: 39784 - DNA, 201 bp, Homo sapiens
catgcgcctcttcggtggcaactttgcacatcaggcatcagtagcccgtgtggttggacaacagggccggggccgggccgggattgaggccagtctagatrtgcagtacctgatgagtgctggtgccaacatctccacctgggtctacagtagccctggtactaccaagaggactggacagtggggaagggggtgggagat

SEQ ID NO: 39785 - DNA, 201 bp, Homo sapiens
cgcctcttcggtggcaactttgcacatcaggcatcagtagcccgtgtggttggacaacagggccggggccgggccgggattgaggccagtctagatgtgcmgtacctgatgagtgctggtgccaacatctccacctgggtctacagtagccctggtactaccaagaggactggacagtggggaagggggtgggagatgggt

SEQ ID NO: 39786 - DNA, 201 bp, Homo sapiens
gtggcgcggcgcccccggagggggccatatctaacggggtttacgtactgccgagcgcggccaacggagacgtgaagcccgtggtgtccagcacgcctttkgtggacttcttgatgcagctggaagattacacgcctacggtgggcttccgcccgaacaaggccacctagcctgctgtcaaaactttcagccacatcgtgc

SEQ ID NO: 39787 - DNA, 201 bp, Homo sapiens
gcctccggcagctcccggagcaagagcaaggtgtgaggggaggcttaatgaatcagtaattaccttccacaacagtggaggcttatcctgccacccctttsgggaaactgaatcgtaggggaggtgtaagacttactcagggtcacccatctgggattgaagtccgggattcctgtgctcagttggtgctcttccctcttc

SEQ ID NO: 39788 - DNA, 201 bp, Homo sapiens
cccgtggtgtccagcacgcctttggtggacttcttgatgcagctggaagattacacgcctacggtgggcttccgcccgaacaaggccacctagcctgctgwcaaaactttcagccacatcgtgcttttcagcgttctcttccatttgctcccctagtcgctcttctgtgtttgccctctgctcacccaaactgtgagcttc

SEQ ID NO: 39789 - DNA, 201 bp, Homo sapiens
ctacggaaacccatgttgtaaggtccccacatccctaccagcttccacaggccttggccccccatgtggactttggtaacacctatggggtgaatgggggwtggggcacacagatccaggggctgaggaagtttagatgccattggggactgggggtggggtgagttgtaaggtgggcattacagtctataagatctcctc

SEQ ID NO: 39790 - DNA, 201 bp, Homo sapiens
actgcaccgttttcccccaacatcatccctgaggcaacgtcctgagccgcaggtgacagggactgtaggcctgcatctgggggtaaccccctctgtgatcygtaagcgatacaacttgacctcacaagacgtgggctctggcaccagcaataacagccaagcctgtgcccaggtgagccaagcaaagagccccagggtcct

SEQ ID NO: 39791 - DNA, 201 bp, Homo sapiens
gagggcaagtgcctcttctgaatccctgcaggaaaatacctgaccctagagaatgtggctgatctggtgaggccatccccactgaccctccacacggtgcraaaatggctcttggcagccggagcccagaagtgccattctgtgatcacacaggactttctgacttgctggctgagcatccggtgagaggaaatgattgct

SEQ ID NO: 39792 - DNA, 201 bp, Homo sapiens
attgtacagaaggtacgtacaaactccttcgtcatccacatcacatacatgccatgagggtcagtcacaggcactgtaacatacagtagaaagcatgtgtrctcttcccccttttcccatgccctgacaccagtatctcatttggaactgactgtactttctgcctcttctttttgtctggccatggggtccagctattgc

SEQ ID NO: 39793 - DNA, 201 bp, Homo sapiens
tctcatttggaactgactgtactttctgcctcttctttttgtctggccatggggtccagctattgcagtacaaggcagacatcaatgcagtgaatgaacaygggaatgtgcccctgcactatgcctgtttttggggccaagatcaagtggcagaggtgagtactcagcccttaattcctgagatgggtaggaagtaaagtc

SEQ ID NO: 39794 - DNA, 201 bp, Homo sapiens
accctgaacaaacactctggcattgacttcaaacagcttaacttcctgacgaagctcaacgagaatcactctggagaggtgacccctgcccttcttgcccytccctcactaaacccccataaattacttgctttgtacctgttttaagtttttcctccagttagtgggcaaggaagtggcagcaacatttcaagcctccta

SEQ ID NO: 39795 - DNA, 201 bp, Homo sapiens
cgggagggcaacgcagtcgccgttcgcctgtggctggacaacacggagaacgacctcaaccaggggtgagctgaaacggttggtggatgagaggaaggctrgagatctcctggctacgtggagtggagtgctcatgtctggtggtggcggctgcctttgctagccagtgtaatgagtgctaagcatagcctgtggggggca

SEQ ID NO: 39796 - DNA, 201 bp, Homo sapiens
acgaagttcctgagctctagcccccacctgccaccatccagttacttcaatgccagtggccgtgcctacccagatgtggctgcactttctgatggctactrggtggtcagcaacagagtgcccattccatgggtgtccggaacctcggtgagaatcagcccatctccaaactctcactcaggaactacccttaccccctaa

SEQ ID NO: 39797 - DNA, 201 bp, Homo sapiens
agggcaggggacaagccatctctcctgataggaaagggtcaggggttgagtagagtcttcagcaaagctgggaagttgggtgttccccagcctgttacagratcccagccaggaccagagcagaaaccctggccctctacctcttcatccagacaggactcatggcagccacgggttacctagggaggaggctggcatcag

SEQ ID NO: 39798 - DNA, 201 bp, Homo sapiens
tggggataatcccatctcaaggaaaagcttttggctatttctgtgttagcagatgcgagcaagttgtggaggaaaatgattaacttaaaggccacaccccmcaaccccttcagctgtacgggcatctggatggccagacccctgatcagctccaggccttgcctagagtcgcacacaggaagtgaccacaacactaaggca

SEQ ID NO: 39799 - DNA, 201 bp, Homo sapiens
acctcatcagtagtcaaaagcatttctccttttcaacataaacccttccaaaacatcatttaaattccattccatttttagatgttagtttcagtaccagmgccaaatagtaagtttgttccctcttctataagttgtggcctgccttctccaagacacccttctcccccactaacatgcactgaacagctgctgtcaatc

SEQ ID NO: 39800 - DNA, 201 bp, Homo sapiens
agttacagcatcttattgaggaatctaaggcaggagtagggagacctgagtatgatggagcatggtagggttgggagtcaagtcaagctcacagcatttcrgggttagggagataagctgtctgcagcagtcaatagttgagggttcagcagggcttccaacagggcagaataagggactgaactgccagcttcagggcag

SEQ ID NO: 39801 - DNA, 201 bp, Homo sapiens
atttgttccatttttcatataattctcaaagggtaccctgataaagacagtaagcactgttactgttttgttggtgaggaaatagaggcttaggcagttgsccagtgggcctagcatctaggaagactctagctgagtctaggaagactctaggaagatgctgccagaaggaaaaggggtggaattaatgaaactggaagg

SEQ ID NO: 39802 - DNA, 201 bp, Homo sapiens
catttgttccatttttcatataattctcaaagggtaccctgataaagacagtaagcactgttactgttttgttggtgaggaaatagaggcttaggcagttscccagtgggcctagcatctaggaagactctagctgagtctaggaagactctaggaagatgctgccagaaggaaaaggggtggaattaatgaaactggaag

SEQ ID NO: 39803 - DNA, 201 bp, Homo sapiens; identical to SEQ ID NO: 39786

SEQ ID NO: 39804 - DNA, 201 bp, Homo sapiens
cctcttctaggattttctcgcatccaaatgtgctcccagtgctaggtgcctgccagtctccacctgctcctcatcctactctcatcacacactggatgccrtatggatccctctacaatgtactacatgaaggcaccagtgagtagggatgttgaatttccttggggaggaaatggcagagagggagcctctctgaactat

SEQ ID NO: 39805 - DNA, 201 bp, Homo sapiens
ctttcctcctcctcctcctcagagtcacttatacataggctggggggatgctgggaaagagatgctgcctctagggcccgtaatgtggccaagagctggcrgcgcttggagccctggaggaaaacaggggatgacagtgggcctaaagagaatggatgaggcctggagaacaagaagggagagatgtggacctgattcaga

SEQ ID NO: 39806 - DNA, 201 bp, Homo sapiens
ggagcctctctgaactatttgacttttgcctcctctcagatttcgtcgtggaccagagccaggctgtgaagtttgctttggacatggcaaggggcatggcyttcctacacacactagagcccctcatcccacgacatgcactcaatagccgtagtgtaatggtgaggccacaagctcactcctggcccaggccccaaaagc

SEQ ID NO: 39807 - DNA, 201 bp, Homo sapiens
gaagagggaagagcaccaactgagcacaggaatcccggacttcaatcccagatgggtgaccctgagtaagtcttacacctcccctacgattcagtttcccsaaaggggtggcaggataagcctccactgttgtggaaggtaattactgattcattaagcctcccctcacaccttgctcttgctccgggagctgccggaggc

SEQ ID NO: 39808 - DNA, 201 bp, Homo sapiens; identical to SEQ ID NO: 39788

SEQ ID NO: 39809 - DNA, 201 bp, Homo sapiens
gtactaccccagccatggggtccatccccttcccccatccctaccactgtggccccaagaggggcgggctcagagctttgtcacttgccacatggtgtctyccaacatgggagggatcagccccgcctgtcacaataaagtttattatgaaaacaggctggtgtggggacatggggacagataagtacatttaggttgggt

SEQ ID NO: 39810 - DNA, 201 bp, Homo sapiens
aaaatgctagttacagcatcttattgaggaatctaaggcaggagtagggagacctgagtatgatggagcatggtagggttgggagtcaagtcaagctcacmgcatttcagggttagggagataagctgtctgcagcagtcaatagttgagggttcagcagggcttccaacagggcagaataagggactgaactgccagctt

SEQ ID NO: 39811 - DNA, 201 bp, Homo sapiens
ggagaacgtctcaggagagtggaaggcaagaggtcaggggacaggaagcctgcacgacagaaaaggagcaaccgcaagttgaaaaagaaataggaaaatgtgtgagtaaagcttacagaagagaatgttttaatgaaggggaggtagtcaacggcagtacaggctactgagagatcaaagaacattaatattttaaagtag

SEQ ID NO: 39812 - DNA, 201 bp, Homo sapiens
gatgtctgatactttaaagcatcactcccaaaaagtccaatcactcagaacccctgacctctacttgcaccttcactcttgtaggcctctactccagtgtktggggggatcctatccttgatcaatgagcacaggatccttagtggccgcccccctcttggctttctcaacccaaggctctaccagcagcatggggcagga

SEQ ID NO: 39813 - DNA, 201 bp, Homo sapiens
ctcccaggctgcagaggtgtaagcgttgtctaagtttagggtaggaggtcacctgaggcgaagagcagggtgagaccccgagcggcagccttcatgagctyagtgttgacccgctggatgtaggcgctgctgagggagtcctcatcatctccatagctcacagtatgcacatgtggcagggctgactcattactgagcagc

SEQ ID NO: 39814 - DNA, 201 bp, Homo sapiens
aagtgtcatgagacagatatccccatgttctcacaataaactctttattgtttagctagccccagtgactttatgcatcttataaccaagaagccttcagyagagcaagtctgagccagaggttttatcacactttgtcctcagggtccaccaggaaccaggtcttggctcacagccaggctggaaacagtcttcacagtt

SEQ ID NO: 39815 - DNA, 201 bp, Homo sapiens
agaaagacagaaagttctgtgtaagtgcacagactcatgcatgcacacatacatacatgcatctgtgtcctgggggctcttaccctggcttcagtactctrtttgcctcctctaggaagtccctgatgttggttcccatcagtgaaaggcaaaacacagccacatccacagactcatcctccagaggaacctgtggagagt

SEQ ID NO: 39816 - DNA, 201 bp, Homo sapiens
tcctgggaacaggagacacctctgtcttctctgtgggggcctcagctggggcctggtctggcacctgaggtggctgaaacttgttcttacatcttctcttrttcttttgccggttccgccactgcttgcggcttaatgtatgagggggtttaggggaagtggacccagggctttgctttggtggatcatttgtagtactac

SEQ ID NO: 39817 - DNA, 201 bp, Homo sapiens
atccccaagtcatcttccagagtaaaatgcaaatcccatcaggccacttggatgaaaacccttcaaggattactggatagaattcaggctttcccctccascccccaatcatagctcacaaaccttccttgctatttgttcttaagtaaaaaatcatttttcctcctccctccccaaaccccaaggaactctcactcttgc

SEQ ID NO: 39818 - DNA, 201 bp, Homo sapiens
tatctagaacttatccacttatatccccactgctactaccttagtttagggctatattctcttgaaaaaaagtgtccttacttcctgccaatccccaagtyatcttccagagtaaaatgcaaatcccatcaggccacttggatgaaaacccttcaaggattactggatagaattcaggctttcccctccagcccccaatca

SEQ ID NO: 39819 - DNA, 201 bp, Homo sapiens
ttggggggatcctatccttgatcaatgagcacaggatccttagtggccgcccccctcttggctttctcaacccaaggctctaccagcagcatggggcaggwctctttgatgtaagtatggaagggaagggtgtggacgttttcaaacaactatggggagtgctaagggggacttgggggcagttagggtggtgtggaatag

SEQ ID NO: 39820 - DNA, 201 bp, Homo sapiens
aggtgagcaaatagtgaaagtgaatgtacaccagttctacaaggttggctgagataggaaggcaagaagagcagtagtgatggtgactcagagtggcaaawtcaaattctttattttttaaaattggtggagtttagtttttaggtttgacaggtcaggatcacctgtcatcttagtctagacttcactggttcccattag

SEQ ID NO: 39821 - DNA, 201 bp, Homo sapiens
caggaaattgtctggagttccatatggctggaggatagatgatctctgtgggtcggagcattgggtacaagaggaaaagaacaggacataagactgtagargtctccaaggatcagccagatcatgcaagcatatttaggctataagaaggtctttattttaaaagcaaggttttaaagctgtatagtgacataatgagat

SEQ ID NO: 39822 - DNA, 201 bp, Homo sapiens
ccgcggcgattccgtccagaccggaaccagcgtgcgtctggctctcctccgccgctctgggacacctcattctgtctgacgctcaagacctggcttcgacrtttatggccctatgtccctcgactacgggttgcctgcctgtctgcatcgtttcaagttcccttattcagccttttaaggattcatagtggatttggaaag

SEQ ID NO: 39823 - DNA, 201 bp, Homo sapiens
ttgcctgctctcggacatccgttcagcagacactacctcttcgtcaccccctgcccaccctgacccgcctttacctcgcgtctagaggacacagccagggrtcatcccgcagccccgaactccttcacagacccccactagccggggacgcagctcaggccccctacccccaacacaaacacttctctcctgtagaggata

SEQ ID NO: 39824 - DNA, 201 bp, Homo sapiens
gtcggagcgctcagacctgccagaaccgacccggaaaccaaagcgtgacagccaggggttgctagagcggccggcgcggcgcagcgaaccatcgagtttarccaggcgcggctagaagggcagggaggcggtgggaggggagggacggaggcccgcgctgcccaagagcgccacgggcggggcggggccggcggcgggctg

SEQ ID NO: 39825 - DNA, 201 bp, Homo sapiens
ggcagggaggcggtgggaggggagggacggaggcccgcgctgcccaagagcgccacgggcggggcggggccggcggcgggctgcgggcgcggccggacggkagttccccggagaaggatcctgcagcccgagtcccggtgagtgcgagaggacccgcgccccctgtcacccctcacttctcctgagtcccaagtaaggaac

SEQ ID NO: 39826 - DNA, 201 bp, Homo sapiens
tctccaaactctcactcaggaactacccttaccccctaacaccttgaacaccttgcacctagaacccctgactccttagagatgtctgatactttaaagcrtcactcccaaaaagtccaatcactcagaacccctgacctctacttgcaccttcactcttgtaggcctctactccagtgtttggggggatcctatccttga

SEQ ID NO: 39827 - DNA, 201 bp, Homo sapiens
agatgatacttgaagacgtggttgtgaaggagaacgtctcaggagagtggaaggcaagaggtcaggggacaggaagcctgcacgacagaaaaggagcaacygcaagttgaaaaagaaataggaaaatgtgtgagtaaagcttacagaagagaatgttttaatgaaggggaggtagtcaacggcagtacaggctactgagag

SEQ ID NO: 39828 - DNA, 201 bp, Homo sapiens
cagggtcttcctggaagagacgctgtgcagcactgctgggccctgagtacaactgttcattgaggtagcgaaatcgggccccatccagccgctgtgccatrcgggctcgcaaagcccctgcccgagcctcatggctgtctgtcctgggaacaggagacacctctgtcttctctgtgggggcctcagctggggcctggtctg

SEQ ID NO: 39829 - DNA, 201 bp, Homo sapiens
tgagaatcagcccatctccaaactctcactcaggaactacccttaccccctaacaccttgaacaccttgcacctagaacccctgactccttagagatgtcygatactttaaagcatcactcccaaaaagtccaatcactcagaacccctgacctctacttgcaccttcactcttgtaggcctctactccagtgtttggggg

SEQ ID NO: 39830 - DNA, 201 bp, Homo sapiens
atgatacttgaagacgtggttgtgaaggagaacgtctcaggagagtggaaggcaagaggtcaggggacaggaagcctgcacgacagaaaaggagcaaccgsaagttgaaaaagaaataggaaaatgtgtgagtaaagcttacagaagagaatgttttaatgaaggggaggtagtcaacggcagtacaggctactgagagat

SEQ ID NO: 39831 - DNA, 201 bp, Homo sapiens
gtagagaagaaaagcctcagggtcttcctggaagagacgctgtgcagcactgctgggccctgagtacaactgttcattgaggtagcgaaatcgggccccawccagccgctgtgccatgcgggctcgcaaagcccctgcccgagcctcatggctgtctgtcctgggaacaggagacacctctgtcttctctgtgggggcctc

SEQ ID NO: 39832 - DNA, 201 bp, Homo sapiens
cacgacagaaaaggagcaaccgcaagttgaaaaagaaataggaaaatgtgtgagtaaagcttacagaagagaatgttttaatgaaggggaggtagtcaacrgcagtacaggctactgagagatcaaagaacattaatattttaaagtagccattgaatttacagttgggttttttttttttaagttaaggggtacatgtgc

SEQ ID NO: 39833 - DNA, 201 bp, Homo sapiens
cacatccttccaggaacctttcctcatcacaaatgaaattgttgactatatcagtggtggtggcttcagcaatgtgttcccacggccttcataccaggtasgtgtgtttgtgtggatggatgcagggtaagagtgaggatgggggatcctcagttcagctgactgctgggcaggccacatgccaatactcactcaaaaatg

SEQ ID NO: 39834 - DNA, 201 bp, Homo sapiens
aagaacattaatattttaaagtagccattgaatttacagttgggttttttttttttaagttaaggggtacatgtgcaggtttgttggatgggtaaactcakgtcatggaggtttgttgtgcagatcatttcatcacccaggtattaagccgtggcacccattagttatttttcctgatccctccctcttcctacccgcccc

SEQ ID NO: 39835 - DNA, 201 bp, Homo sapiens
aaactcaggtcatggaggtttgttgtgcagatcatttcatcacccaggtattaagccgtggcacccattagttatttttcctgatccctccctcttcctayccgccccactctggtaggccccagtgtctgttgctcccctcagtgtgcagttaggatgtatttgaccatctgtgagtgttgtttcagaataatgggtgaa

SEQ ID NO: 39836 - DNA, 201 bp, Homo sapiens
ttgttgtgcagatcatttcatcacccaggtattaagccgtggcacccattagttatttttcctgatccctccctcttcctacccgccccactctggtaggycccagtgtctgttgctcccctcagtgtgcagttaggatgtatttgaccatctgtgagtgttgtttcagaataatgggtgaagaaatcagactacattggg

SEQ ID NO: 39837 - DNA, 201 bp, Homo sapiens
acatccttccaggaacctttcctcatcacaaatgaaattgttgactatatcagtggtggtggcttcagcaatgtgttcccacggccttcataccaggtacrtgtgtttgtgtggatggatgcagggtaagagtgaggatgggggatcctcagttcagctgactgctgggcaggccacatgccaatactcactcaaaaatgc

SEQ ID NO: 39838 - DNA, 201 bp, Homo sapiens
tcactgtggagtcaaagctcccaggctgcagaggtgtaagcgttgtctaagtttagggtaggaggtcacctgaggcgaagagcagggtgagaccccgagcrgcagccttcatgagctcagtgttgacccgctggatgtaggcgctgctgagggagtcctcatcatctccatagctcacagtatgcacatgtggcagggctg

SEQ ID NO: 39839 - DNA, 201 bp, Homo sapiens
gtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcgatacagcagatttgtggcagattgaaaagtaggccgggcgcggtgg

SEQ ID NO: 39840 - DNA, 201 bp, Homo sapiens
tttcaggaggaagctgtaacgaagttcctgagctctagcccccacctgccaccatccagttacttcaatgccagtggccgtgcctacccagatgtggctgmactttctgatggctactgggtggtcagcaacagagtgcccattccatgggtgtccggaacctcggtgagaatcagcccatctccaaactctcactcagga

SEQ ID NO: 39841 - DNA, 201 bp, Homo sapiens
tgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcgatacagcagatttgtggcagattgaaaagtaggccgggcgcggtg

SEQ ID NO: 39842 - DNA, 201 bp, Homo sapiens
gtgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcgatacagcagatttgtggcagattgaaaagtaggccgggcgcggt

SEQ ID NO: 39843 - DNA, 201 bp, Homo sapiens
gttcagcagacactacctcttcgtcaccccctgcccaccctgacccgcctttacctcgcgtctagaggacacagccagggatcatcccgcagccccgaacwccttcacagacccccactagccggggacgcagctcaggccccctacccccaacacaaacacttctctcctgtagaggataaagcttggggttcatcctcc

SEQ ID NO: 39844 - DNA, 201 bp, Homo sapiens
gaacgtctcaggagagtggaaggcaagaggtcaggggacaggaagcctgcacgacagaaaaggagcaaccgcaagttgaaaaagaaataggaaaatgtgtgagtaaagcttacagaagagaatgttttaatgaaggggaggtagtcaacggcagtacaggctactgagagatcaaagaacattaatattttaaagtagcca

SEQ ID NO: 39845 - DNA, 201 bp, Homo sapiens
tcccaagtaaggaacggagccaaccctggggaggacccccggtcccctctcccagagtatacggagcctgaacctccccacttcccccaactctgttcgcsgatagggtctagttgcctgctctcggacatccgttcagcagacactacctcttcgtcaccccctgcccaccctgacccgcctttacctcgcgtctagagg

SEQ ID NO: 39846 - DNA, 201 bp, Homo sapiens
agaacgtctcaggagagtggaaggcaagaggtcaggggacaggaagcctgcacgacagaaaaggagcaaccgcaagttgaaaaagaaataggaaaatgtgtgagtaaagcttacagaagagaatgttttaatgaaggggaggtagtcaacggcagtacaggctactgagagatcaaagaacattaatattttaaagtagcc

SEQ ID NO: 39847 - DNA, 201 bp, Homo sapiens
gagaacgtctcaggagagtggaaggcaagaggtcaggggacaggaagcctgcacgacagaaaaggagcaaccgcaagttgaaaaagaaataggaaaatgtgtgagtaaagcttacagaagagaatgttttaatgaaggggaggtagtcaacggcagtacaggctactgagagatcaaagaacattaatattttaaagtagc

SEQ ID NO: 39848 - DNA, 201 bp, Homo sapiens
ctgagtcccaagtaaggaacggagccaaccctggggaggacccccggtcccctctcccagagtatacggagcctgaacctccccacttcccccaactctgwtcgcggatagggtctagttgcctgctctcggacatccgttcagcagacactacctcttcgtcaccccctgcccaccctgacccgcctttacctcgcgtct

SEQ ID NO: 39849 - DNA, 201 bp, Homo sapiens; identical to SEQ ID NO: 8729

SEQ ID NO: 39850 - DNA, 201 bp, Homo sapiens
aaaggggtggcaggataagcctccactgttgtggaaggtaattactgattcattaagcctcccctcacaccttgctcttgctccgggagctgccggaggcygtgcccttcattttgcagtgctgtagggcatcattggcaatatctgagatgaatttctgggcagctaaggagatgagccgaattctagagagaaaaaact

SEQ ID NO: 39851 - DNA, 201 bp, Homo sapiens
caatactcactcaaaaatgcctttcaggaggaagctgtaacgaagttcctgagctctagcccccacctgccaccatccagttacttcaatgccagtggccrtgcctacccagatgtggctgcactttctgatggctactgggtggtcagcaacagagtgcccattccatgggtgtccggaacctcggtgagaatcagccca

SEQ ID NO: 39852 - DNA, 201 bp, Homo sapiens
gtaacaaatttcccctctgacatccgaacccacatactaagccctaaccaattaatatgaatgctacacttggtctctctcaggtgacagtggggccgggygttggtctgtctctggaagacaccagttccgccctaccttccctgcctccaggtaagtactctagcctaccactcaggtataaccaccacctttcacttg

SEQ ID NO: 39853 - DNA, 201 bp, Homo sapiens
taacaaatttcccctctgacatccgaacccacatactaagccctaaccaattaatatgaatgctacacttggtctctctcaggtgacagtggggccgggtrttggtctgtctctggaagacaccagttccgccctaccttccctgcctccaggtaagtactctagcctaccactcaggtataaccaccacctttcacttgt

SEQ ID NO: 39854 - DNA, 201 bp, Homo sapiens
ccagcaagacctgggctatactcacccctccccacatatcttggaggtccccttgggtcccctactatccaaatgctgtcttctcccctcagcccctatgwcaccacagtgggaggcacatccttccaggaacctttcctcatcacaaatgaaattgttgactatatcagtggtggtggcttcagcaatgtgttcccacgg

SEQ ID NO: 39855 - DNA, 201 bp, Homo sapiens
atctcccacccccttccccactgtccagtcctcttggtagtaccagggctactgtagacccaggtggagatgttggcaccagcactcatcaggtactgcayatctagactggcctcaatcccggcccggccccggccctgttgtccaaccacacgggctactgatgcctgatgtgcaaagttgccaccgaagaggcgcatg

SEQ ID NO: 39856 - DNA, 201 bp, Homo sapiens
acccatctcccacccccttccccactgtccagtcctcttggtagtaccagggctactgtagacccaggtggagatgttggcaccagcactcatcaggtackgcacatctagactggcctcaatcccggcccggccccggccctgttgtccaaccacacgggctactgatgcctgatgtgcaaagttgccaccgaagaggcg

SEQ ID NO: 39857 - DNA, 201 bp, Homo sapiens
gggctatactcacccctccccacatatcttggaggtccccttgggtcccctactatccaaatgctgtcttctcccctcagcccctatgtcaccacagtggraggcacatccttccaggaacctttcctcatcacaaatgaaattgttgactatatcagtggtggtggcttcagcaatgtgttcccacggccttcataccag

SEQ ID NO: 39858 - DNA, 201 bp, Homo sapiens
gaggcacatccttccaggaacctttcctcatcacaaatgaaattgttgactatatcagtggtggtggcttcagcaatgtgttcccacggccttcataccasgtacgtgtgtttgtgtggatggatgcagggtaagagtgaggatgggggatcctcagttcagctgactgctgggcaggccacatgccaatactcactcaaa

SEQ ID NO: 39859 - DNA, 201 bp, Homo sapiens
aagaaatcagactacattgggttccttaatttaaggcactatgatgaacaccttctgtgctgggtgctagagtccagaatctgacataatctctgctctcratacagcagatttgtggcagattgaaaagtaggccgggcgcggtggctcacgcctgtaatcccagcactttgggaggccgaggctggtggatcacgaggt

SEQ ID NO: 39860 - DNA, 201 bp, Homo sapiens
gtaagagtgaggatgggggatcctcagttcagctgactgctgggcaggccacatgccaatactcactcaaaaatgcctttcaggaggaagctgtaacgaakttcctgagctctagcccccacctgccaccatccagttacttcaatgccagtggccgtgcctacccagatgtggctgcactttctgatggctactgggtgg

SEQ ID NO: 39861 - DNA, 201 bp, Homo sapiens
tatgatgaacaccttctgtgctgggtgctagagtccagaatctgacataatctctgctctcgatacagcagatttgtggcagattgaaaagtaggccgggygcggtggctcacgcctgtaatcccagcactttgggaggccgaggctggtggatcacgaggtcaggagttcgagaccagcctgaccaacatggtgaaaccc

SEQ ID NO: 39862 - DNA, 201 bp, Homo sapiens
cagttacttcaatgccagtggccgtgcctacccagatgtggctgcactttctgatggctactgggtggtcagcaacagagtgcccattccatgggtgtccrgaacctcggtgagaatcagcccatctccaaactctcactcaggaactacccttaccccctaacaccttgaacaccttgcacctagaacccctgactcctt

SEQ ID NO: 39863 - DNA, 201 bp, Homo sapiens
tggccagacccctgatcagctccaggccttgcctagagtcgcacacaggaagtgaccacaacactaaggcatccggaggctgctggcccagaccacggacygccccctgctccgccccttgaatctgcagccccgaactggagggaatttccttttatggccccaggctgtcaggcaggcccagctccaaaccaattgttt

SEQ ID NO: 39864 - DNA, 201 bp, Homo sapiens
ttcaatgccagtggccgtgcctacccagatgtggctgcactttctgatggctactgggtggtcagcaacagagtgcccattccatgggtgtccggaacctyggtgagaatcagcccatctccaaactctcactcaggaactacccttaccccctaacaccttgaacaccttgcacctagaacccctgactccttagagatg

SEQ ID NO: 39865 - DNA, 201 bp, Homo sapiens
gtaaagtatgggggccaaagttggctatatgctggatatgaagagggggttaattccttgcaggtcttcttgagatagaagtccaggccctgaggtggcasgcagcctgatagtgaacagaacccttgtgcccatacttttgccccccgagtttggcctgccctggcgccacaggcagtactggaagctgataagtcaggg

SEQ ID NO: 39866 - DNA, 201 bp, Homo sapiens
tcttcttgagatagaagtccaggccctgaggtggcacgcagcctgatagtgaacagaacccttgtgcccatacttttgccccccgagtttggcctgccctrgcgccacaggcagtactggaagctgataagtcagggcacaaattaaaggtctaggaggcaagaccaactgataaacagggggcgtaatgcttcctgggga

SEQ ID NO: 39867 - DNA, 201 bp, Homo sapiens
tgtatgtagaaccagctgaccccccgacacacacacaccaacacacacacatatacacatccaatggtacctgtttggtcaacattgtccaggtgctgggstgaatttataggggcatgtttctggcatttcctctttcttttctcatcttcagcagagtcactgccaacaagagcctgtttgtggcatttcttcttcctt

SEQ ID NO: 39868 - DNA, 201 bp, Homo sapiens
ggggggatgctgggaaagagatgctgcctctagggcccgtaatgtggccaagagctggcggcgcttggagccctggaggaaaacaggggatgacagtgggyctaaagagaatggatgaggcctggagaacaagaagggagagatgtggacctgattcagactggcagaagcatctgaattcttcccagtcaagcctgccag

SEQ ID NO: 39869 - DNA, 201 bp, Homo sapiens
tgtggtggaaaacagaaaggaccaatagatgttgcagaaggggtgcaagagaaaccaggggaagagcactaccacctaaggaaatgagatgtgggatatgrtgaagataacacatttttttatagaggttgttgagatatctaggtggttggtttggtttgaagctcaggggaaggtctgaaatggacagctttgggagtt

SEQ ID NO: 39870 - DNA, 201 bp, Homo sapiens
ggtggctcacacctgcaatcccagcactttgggaggccgaggtgggtggatcacctgaggtcaggagctcgagaccaacctagccaacatgatgaaacccygtctctacccaaaatacaaaaattagctgggtgtggtggtgcacgcctgtaatcaggctactcgggagtctgaggcaggagaatcgtttgaaccctggag

SEQ ID NO: 39871 - DNA, 201 bp, Homo sapiens
ctcctccacgctcgtgccgcccccccccgcgctcccagttgacgctctgggccgccacctccgcggaccctgagcgcaagagccaagccgccagcgctgckatgtgggccacgctgccgctgctctgcgccggggcctggctcctgggagtccccgtctgcggtgccgccgaactgtgcgtgaactccttaggtacgcaga

SEQ ID NO: 39872 - DNA, 201 bp, Homo sapiens
aagagccaagccgccagcgctgcgatgtgggccacgctgccgctgctctgcgccggggcctggctcctgggagtccccgtctgcggtgccgccgaactgtscgtgaactccttaggtacgcagagggcgcgccgcccgagagggtgctagcaggccctagagtggacgctgggagaacttggccaggggcgcactgggctc

SEQ ID NO: 39873 - DNA, 201 bp, Homo sapiens
atactttttcacattaatttggggtacaaaaccaggaagagtcggagtttctttttgcattctgcattatataacaccatttttggtgttttaaatttagyccagttttcgaaaatgcaaatcagttctaaagtgccctactttgctatagactcaacattactgtgatgcgcccagacctaattttttttttctttttac

SEQ ID NO: 39874 - DNA, 201 bp, Homo sapiens
tgggagtccccgtctgcggtgccgccgaactgtgcgtgaactccttaggtacgcagagggcgcgccgcccgagagggtgctagcaggccctagagtggackctgggagaacttggccaggggcgcactgggctccggaggaacggggcagagctttccccggtgagaggccaggaactctgcgtgctggcacggggagggg

SEQ ID NO: 39875 - DNA, 201 bp, Homo sapiens
tggtgttttaaatttagtccagttttcgaaaatgcaaatcagttctaaagtgccctactttgctatagactcaacattactgtgatgcgcccagacctaattttttttttctttttacagagaagtttcacttcaagtcatggatgtctaaggtcagtgcccaacttcttctttttgaagtttttcatttcacaaagtttc

SEQ ID NO: 39876 - DNA, 201 bp, Homo sapiens
ggctgccatttagttgaagcatgtgccaagctctcagcaataacatcttaacttgatggagtacttctaggtgctgtaccaaccctcaatacgcactatcycctctagacccgaactggccctaggagatgagtatccttattacctcatttgacaggtgaggaaacgggggctccaagtggttaagtaatgtgcccaagg

SEQ ID NO: 39877 - DNA, 201 bp, Homo sapiens; identical to SEQ ID NO: 8756

SEQ ID NO: 39878 - DNA, 201 bp, Homo sapiens
agtccagttttcgaaaatgcaaatcagttctaaagtgccctactttgctatagactcaacattactgtgatgcgcccagacctaattttttttttcttttyacagagaagtttcacttcaagtcatggatgtctaaggtcagtgcccaacttcttctttttgaagtttttcatttcacaaagtttcctgttatcaaaccaa

SEQ ID NO: 39879 - DNA, 201 bp, Homo sapiens; identical to SEQ ID NO: 8757

SEQ ID NO: 39880 - DNA, 201 bp, Homo sapiens
tactttgctatagactcaacattactgtgatgcgcccagacctaattttttttttctttttacagagaagtttcacttcaagtcatggatgtctaaggtcrgtgcccaacttcttctttttgaagtttttcatttcacaaagtttcctgttatcaaaccaaactgtcccagatttgagacaatgaaaaagggaatttccaa

SEQ ID NO: 39881 - DNA, 201 bp, Homo sapiens
agtgattaacttggctgacagccttccaagccctgggattcatttctgtattttgttttcaaagcacattgtggagaatgtaaattagtacaaccattgtaaaaaaacagtatggaggttccatcaaaaactcaaaacaaaactaccatatgacccagcaagcctactactgagtatatatccaaaagaaaggaaattagt

SEQ ID NO: 39882 - DNA, 201 bp, Homo sapiens
cagagtgagactccgtctcaaaagaaaaaaagaactgaaaggagttctctcacggagactaaatgtgattacatcaccaccttacatgcctccctggtccrctgtggggaacattgctctaaagcgctcaaagaggcgttgttggatgggactgtcattgcttttatccttcccatatgatcacctctttttgaattttgt

SEQ ID NO: 39883 - DNA, 201 bp, Homo sapiens
gttgggtatggagaaaaaaatgggatcccttactggatcgtgaaaaactcttggggtccccagtggggaatgaacgggtaagcagctcccaggtcccactkctgggagggggatgttgctcaggcctggaggccctgggggcatcacttccacctcagagttacggcttccacagacgagctggtcagccaagccctaggc

SEQ ID NO: 39884 - DNA, 201 bp, Homo sapiens
aggcaagggggaacctctttcctctcattcaatctgaacctgaacccatgggtataaaaacaatagggacagcaaacaaaaagacaaaacggtaataaatygttcatatctggcattctcaattcctcaaggaaactgaattgaagaggagaggacttcatggggatatcaactgatgaggtcttaaaaataatgttgagt

SEQ ID NO: 39885 - DNA, 201 bp, Homo sapiens
ggagaagtgggatatggatcattcatttggcagctaaggagagggaagaatgaattcttcacaaagtcaggtccgtgatttgccggtgatcaaataagccraatgctactgttttatgaataaatttagagggtctcacccctgaagtcagctcttggtgagcagcaaaacattctagaaaggcctgtggtggggagaccg

SEQ ID NO: 39886 - DNA, 201 bp, Homo sapiens
ggctgagatagaattgcttgaaccagggaggtggaggttgcagtgagctgatatcgtgccactgccctccagcctgggcaacagagccagactccttctcaaaaaaaaaaaaaaaaaagaaggaaagaaagggagggagggagggctgagtgatagagcaccatgggattggatgcacagaaaggagtgcgaagaattaag

SEQ ID NO: 39887 - DNA, 201 bp, Homo sapiens
aaaaaaaaaaaaagaaggaaagaaagggagggagggagggctgagtgatagagcaccatgggattggatgcacagaaaggagtgcgaagaattaagtggcrttgctcttaaaaactgcctccattcccagctgcttatttgagcagggtttcccagccctttgacctataagaaacaaaaataagaccagaattaatgctg

SEQ ID NO: 39888 - DNA, 201 bp, Homo sapiens
aagaattaagtggcattgctcttaaaaactgcctccattcccagctgcttatttgagcagggtttcccagccctttgacctataagaaacaaaaataagascagaattaatgctgaaccttttctcaaccaaacaatattcactcatgaaaatataaatccattgcgggggatgggcagtagagtactgtttatcacatta

SEQ ID NO: 39889 - DNA, 201 bp, Homo sapiens; identical to SEQ ID NO: 8745

SEQ ID NO: 39890 - DNA, 201 bp, Homo sapiens
gaatagggaagtgtggtcttaccctgcttctcccagagagaactggaacgtgaatgaacgccttcgtgactgcagtgtgcatgcatgcaagtgtgggaggrtgtgtgaggagtggaggaatatcgcttaggttgtgtgtgcgcccacgaatgtatgtacagttcacaaacgtgatgtctgtgtaatgacagcggctgccat

SEQ ID NO: 39891 - DNA, 201 bp, Homo sapiens
ctggactttctccaccactggggccctggagtctgcgatcgccatcgcaaccggaaagatgctgtccttggtaagaaatcagccacaggcgaccccctgcrgaggacaccccatcctgatgtgggccaggcctgggcctttggtttccctggagcattggctaagggtgctgtttcaggtggacccagatgccccagcctt

SEQ ID NO: 39892 - DNA, 201 bp, Homo sapiens
cggttggcctcacccgccaccaaggcctctgggagtgtggccaaaagaatttaatagagtgagcaacacaccattacacatcatcctccaaacccgagatscacacacagatacagggttggcctttagatgaactcactaaagtcccagcctcccaagctcattgcgccctgtgagggtgaggtggctgtgtgtaagggc

SEQ ID NO: 39893 - DNA, 201 bp, Homo sapiens
tttgctgagtcttatcccaaggctgggcctctcagagaccccctctgccactgggacatgcccaaccaagtccccagcctgccaggccagatatctcgccrcgccagtccccgagggccccgcctctatcaggacagccccaggtgggctcacctgtgtgtacttcttgcaggggtctccccagccaggctttcgagtata

SEQ ID NO: 39894 - DNA, 201 bp, Homo sapiens
cgccaaagccttgacggcttctcagctggcaggtcactgggttgtgtccttcttccaggcggaacagcagctggtggactgcgcccaggacttcaataatyacggctgccaagggtacgtctctgaccagaaggggcccaaaacttcctcatttcccactgaccgcttcgacaggatccagtgtgtgctgggtctgccaca

SEQ ID NO: 39895 - DNA, 201 bp, Homo sapiens
gaggagtaccaccacaggctgcagacgtttgccagcaactggaggaagataaacgcccacaacaatgggaaccacacatttaaaagtacgtggaacgcctyccttccttcctggaaggatgtcagttagtgacccagcccatgaaagggcccgctgggggctggtgggtggagggagcagaagcccaggctctgaagctgt

SEQ ID NO: 39896 - DNA, 201 bp, Homo sapiens
tccttccgggagaaaaggctggcatggggcggcctgggtgtatatgctgctgtgcctttgtcctgtcctcccagattccatgtccttgtctgaaaaggagmgctttcctgttccctcgggctcctggtgataaaatagctgtgtgagggcccggccagggctaagagggggccctcggtaaattttcgggagaagtgggat

SEQ ID NO: 39897 - DNA, 201 bp, Homo sapiens
gcaggccctagagtggacgctgggagaacttggccaggggcgcactgggctccggaggaacggggcagagctttccccggtgagaggccaggaactctgcrtgctggcacggggaggggtaaactgcattataggcgggggttctcggagggtgggcggcttgtaggaccagaggagcagatgggctgagtgtccagggtc

SEQ ID NO: 39898 - DNA, 201 bp, Homo sapiens; identical to SEQ ID NO: 8751

SEQ ID NO: 39899 - DNA, 201 bp, Homo sapiens
ccctgagcgcaagagccaagccgccagcgctgcgatgtgggccacgctgccgctgctctgcgccggggcctggctcctgggagtccccgtctgcggtgccrccgaactgtgcgtgaactccttaggtacgcagagggcgcgccgcccgagagggtgctagcaggccctagagtggacgctgggagaacttggccaggggcg

SEQ ID NO: 39900 - DNA, 201 bp, Homo sapiens
agtggatctgatgaagaaagacagtagaatggtgactagcagaagctaggaagggcagggaagcagggatgaagataaactgattcctgagtacaaaatatttttttttttttgagacagagtctcactttgtcacccaggctgaagtgcagtggcacactctcggctcactgcaacctccaccttctgggttcaagcgat

SEQ ID NO: 39901 - DNA, 201 bp, Homo sapiens
ctcccagttgacgctctgggccgccacctccgcggaccctgagcgcaagagccaagccgccagcgctgcgatgtgggccacgctgccgctgctctgcgccrgggcctggctcctgggagtccccgtctgcggtgccgccgaactgtgcgtgaactccttaggtacgcagagggcgcgccgcccgagagggtgctagcaggc

SEQ ID NO: 39902 - DNA, 201 bp, Homo sapiens
taagtggcattgctcttaaaaactgcctccattcccagctgcttatttgagcagggtttcccagccctttgacctataagaaacaaaaataagaccagaawtaatgctgaaccttttctcaaccaaacaatattcactcatgaaaatataaatccattgcgggggatgggcagtagagtactgtttatcacattaagagat

SEQ ID NO: 39903 - DNA, 201 bp, Homo sapiens
ttttttgttttgttttctttatttgagatggagtttcgctcttgtcacccaggctggggtgcagtggcacaatctcggctcacagcagcctccgcctctcrggttcaagcgatcctcctgcctcagcctcctgagtagctgggattacaggcgcctgccaccatgcccagctaatttttgtatttttagtggagctggggt

SEQ ID NO: 39904 - DNA, 201 bp, Homo sapiens
aggagcctgctcttccctactgcctccctcctttcctactgtccctggtcccagcctcagcccacaggctctgaacttaaagaccacctgcccccttcacmgagaaaagtagccaagaaacaacccaaggagccaagaacctagggagggggggtgccctgagctctggaggaacgggacagggctttcccccagctagag

SEQ ID NO: 39905 - DNA, 201 bp, Homo sapiens
cagggcaaggtaactccaacagcctccactctgtcttcttggcgtacagcatgcctagcttcactccctccccagccttggaagacatcccttctcccccsacctccctcccgccggaattctcacaattgtctgttctctccaaattcttccttcccctcctccacccacctgagcccactgctctcaccagtccagggg

SEQ ID NO: 39906 - DNA, 201 bp, Homo sapiens
ggctcctctccctcctgccacgagcgccatcctctcgcctctgtccatgcagttggcctcttgtgccaaggaccctttgggggcccacccccacccctacsctatcaaggctgctgggcctcccaccatcacctccgcccagcctggccacagccaagtgccttgtctttccccaagacctgttgctcctcctttatttcc

SEQ ID NO: 39907 - DNA, 201 bp, Homo sapiens; identical to SEQ ID NO: 8746

SEQ ID NO: 39908 - DNA, 201 bp, Homo sapiens
tttgcctttgaggtgactcaggacttcatgatgtatagaacgggcatctactccaggtgagtcagggtcccaggagccaggagggacagtggggaggggcytggtgggcctcctcacaccccactcgtgggacttgggctcgtggcccagactcctgtgtgtcagacccttcatgacacctgccaggtgctgggcgttttg

SEQ ID NO: 39909 - DNA, 201 bp, Homo sapiens
ctgagactgtccccactcccctgcctcacaggctctgactcggcctccacttctcagtgagtttcctcaggccgggtgaggcccctcctcaggctcccacsacacaccatgtgtgcccacctctgccaaagccagcacaggaccatctgctaccagaccctaagctccttgaggacaaggatgctttaattctctctgaaa

SEQ ID NO: 39910 - DNA, 201 bp, Homo sapiens
gtgccttagtgtccttcttaacagactcaaaccacatggaccacgaatattctttctgtccagaagggctactttccacatatagagctccagggactgtyttttctgtattcgctgttcaataaacattgagtgagcacctccccagatggagcatgctggtcctgggccatgactcaaaccaggtctgtcctcgccact

SEQ ID NO: 39911 - DNA, 201 bp, Homo sapiens
tcatgatgtatagaacgggcatctactccaggtgagtcagggtcccaggagccaggagggacagtggggaggggcttggtgggcctcctcacaccccactygtgggacttgggctcgtggcccagactcctgtgtgtcagacccttcatgacacctgccaggtgctgggcgttttgcacatccctcagttaatcctcacac

SEQ ID NO: 39912 - DNA, 201 bp, Homo sapiens
cattgtccttggaccccctaaccccccacacactgttccagcttccactgggagctgtctgccttctgaaacactcctcttgccaacgccaacctttgaayacaccagtgtccctgctttcccagggtcctaccctgagggggaccctcatgatctggtcctccctctttttccacactcatctgccatcaaacccgtccc

SEQ ID NO: 39913 - DNA, 201 bp, Homo sapiens
tgctgtgcctttgtcctgtcctcccagattccatgtccttgtctgaaaaggagagctttcctgttccctcgggctcctggtgataaaatagctgtgtgagsgcccggccagggctaagagggggccctcggtaaattttcgggagaagtgggatatggatcattcatttggcagctaaggagagggaagaatgaattcttc

SEQ ID NO: 39914 - DNA, 201 bp, Homo sapiens; identical to SEQ ID NO: 8752

SEQ ID NO: 39915 - DNA, 201 bp, Homo sapiens
ggagaaaaaaatgggatcccttactggatcgtgaaaaactcttggggtccccagtggggaatgaacgggtaagcagctcccaggtcccacttctgggaggsggatgttgctcaggcctggaggccctgggggcatcacttccacctcagagttacggcttccacagacgagctggtcagccaagccctaggccaggccagg

SEQ ID NO: 39916 - DNA, 201 bp, Homo sapiens
ctgaaggaactatcctagcccctgcctctgtggagaaaggagggacagtgcacagccggcctggtgatgccatgaggaccctgggttgtggacaggtgggrgtagggtctctggctgggcctgtttcccccatcctatacaccgctgtgggaccccacactctgcatcgtatgggcacacctacggggcaggggtttggac

SEQ ID NO: 39917 - DNA, 201 bp, Homo sapiens
gcctctgtttcctctcggcatctctccagccctcttcctttgaggggccagggaggtcagcacttctctaggctgctctggaggatgcaaaagttcctctktattgggctaaagtttactcccttccttccccacgccccagattttcccattggtcccaggtctctcctacagagccatccaaaacgttatgttccctgt

SEQ ID NO: 39918 - DNA, 201 bp, Homo sapiens
gtccctccctcccccagctgagagagatatgtgaagggaagagattgggtgaggccagtgtcaacctagggtgatgacctgggaggcaggtaggggacttaagagacatttcagaagtagaagctggaagactgaaccagcaaggtgaggaaacagagatgaacctgagagaaatccttacagcagccaccagcattgtgc

SEQ ID NO: 39919 - DNA, 201 bp, Homo sapiens
accagaaggggcccaaaacttcctcatttcccactgaccgcttcgacaggatccagtgtgtgctgggtctgccacagatataacccaccactgccctgggygatggcaaaatggtctctgttgtacaggggtggtcacctcacatggccaggtctcatagccaggacagggcagagctggaatctgagtccaggcctctgt

SEQ ID NO: 39920 - DNA, 201 bp, Homo sapiens
agcctgggcaacagagccagactccttctcaaaaaaaaaaaaaaaaaagaaggaaagaaagggagggagggagggctgagtgatagagcaccatgggattrgatgcacagaaaggagtgcgaagaattaagtggcattgctcttaaaaactgcctccattcccagctgcttatttgagcagggtttcccagccctttgacc

SEQ ID NO: 39921 - DNA, 201 bp, Homo sapiens
ggagctgcttctggccatccatgctgctctgggcctctagcccctagcttgaggcaaaaggctgtactgtgaaaggagtggggaggtgacaggccatgtgwttctgtctcggtcctgtttccacagtatgacgaggaagcgatggtggaggctgtggccctctacaaccctgtgagctttgcctttgaggtgactcaggac

SEQ ID NO: 39922 - DNA, 201 bp, Homo sapiens
gagagaggccgcaggggagctgcttctggccatccatgctgctctgggcctctagcccctagcttgaggcaaaaggctgtactgtgaaaggagtggggagrtgacaggccatgtgtttctgtctcggtcctgtttccacagtatgacgaggaagcgatggtggaggctgtggccctctacaaccctgtgagctttgccttt

SEQ ID NO: 39923 - DNA, 201 bp, Homo sapiens
ggaccagaggagcagatgggctgagtgtccagggtcccacctagccaggtggctctccagcctagaataccaaaggagcccgcagctccttccgccttccycaactggggacacagagtgtcacacagaggactctgatctgtccctgccagaggtgagcaaggacgtcccagccttctctagcagcttcccccgggactt

SEQ ID NO: 39924 - DNA, 201 bp, Homo sapiens
catgctcagtgtccccttacttttggtctgtttccactccacagcttagaaacccaacccataacaagagtctgacatttgggcactctggggtcccaccrtttttatttttttttatttatttatttatttatttatttattttttctttttttgagatggagtctcgctctgttgcccaggctggagtgcagtggcgcg

SEQ ID NO: 39925 - DNA, 201 bp, Homo sapiens
gtaggggttgctcatgggctcagagcagcccctgggagcatctgccttcactccggattaatttcactagaaactcacataggccgggcgcggtggctcaygcctgtaattccagcactttgggaggccgagatgggtggatcacctgaggtcgggagttcaagaccagcctaaccaacatggagaaaccccatctctact

SEQ ID NO: 39926 - DNA, 201 bp, Homo sapiens
ccggattaatttcactagaaactcacataggccgggcgcggtggctcacgcctgtaattccagcactttgggaggccgagatgggtggatcacctgaggtygggagttcaagaccagcctaaccaacatggagaaaccccatctctactaaaaatacaaaattagccgggcttggtggcgcatgtctgtaatcccagctat

SEQ ID NO: 39927 - DNA, 201 bp, Homo sapiens
tctaccgcctcggcctcccaaagtgctgtgattacaggcgtgagccaccgtgcccggccaactctcccttcttaacctcacgcccaggcccagccacatgytggttcctaaatgccaggtcctaccctccctctagttctgtcccttgtcctgctgccttctctcctgccttgaaagggctgcgcttccctccttgtgacc

SEQ ID NO: 39928 - DNA, 201 bp, Homo sapiens; identical to SEQ ID NO: 8761

SEQ ID NO: 39929 - DNA, 201 bp, Homo sapiens
gcctgtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattg

SEQ ID NO: 39930 - DNA, 201 bp, Homo sapiens
accttttctcaaccaaacaatattcactcatgaaaatataaatccattgcgggggatgggcagtagagtactgtttatcacattaagagatgcatttctgrtacaattttacttttgatgtttaacaattacttttcataatgtataatacatttgaaatgttttaatcagttgggacactaataataattatgattactc

SEQ ID NO: 39931 - DNA, 201 bp, Homo sapiens
agagctgctggcccaggagaggacctcagggaatggatgtgaatgactgaatgagtaggtccacgctgtaccccgtggtccctatctcagagggtgcaggrtttcctaggagcagagttggggagaggaacgagagatggccagacagacccagccagagacaggaagggagagaggccgcaggggagctgcttctggcca

SEQ ID NO: 39932 - DNA, 201 bp, Homo sapiens
cctgtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattgg

SEQ ID NO: 39933 - DNA, 201 bp, Homo sapiens
agtttgttcatgttactgatggtggatatcaaatcatcatggtatttagattccactggctagctttaaaagaatgatataacaatcttatttttagagatttttttttttttttgagacaaggtctcactcctgtcacccaggcaggaatgcagtggcgctatcatagctcattgcagcctcaacctcccaggctcaagt

SEQ ID NO: 39934 - DNA, 201 bp, Homo sapiens
aactggaacgtgaatgaacgccttcgtgactgcagtgtgcatgcatgcaagtgtgggagggtgtgtgaggagtggaggaatatcgcttaggttgtgtgtgygcccacgaatgtatgtacagttcacaaacgtgatgtctgtgtaatgacagcggctgccatttagttgaagcatgtgccaagctctcagcaataacatctt

SEQ ID NO: 39935 - DNA, 201 bp, Homo sapiens
ctcaagtgattctcccgtctaattttttttatttttttgtagagacgaggtctcactttgttgcccagactggtcccaaactcctaggctcaagggattcrcctgtgtcagcctcccaaagtactgagattataggcttgggccacactgccaggtgttatttttaaatctcaatatttataagttggaatatgtctttgg

SEQ ID NO: 39936 - DNA, 201 bp, Homo sapiens
ctgcttctcccagagagaactggaacgtgaatgaacgccttcgtgactgcagtgtgcatgcatgcaagtgtgggagggtgtgtgaggagtggaggaatatmgcttaggttgtgtgtgcgcccacgaatgtatgtacagttcacaaacgtgatgtctgtgtaatgacagcggctgccatttagttgaagcatgtgccaagct

SEQ ID NO: 39937 - DNA, 201 bp, Homo sapiens
aatatttataagttggaatatgtctttggaggtattcaaatttaaaatgaaatgtttagataagaacatacatggggaaatacggcaggaatccaaaaacaaatggctggcctgcttttgtaaaatattttgtcttgtttgttttattatgtttttgataatatctgtacatatttgggggtacatgtgaggtttcgtttt

SEQ ID NO: 39938 - DNA, 201 bp, Homo sapiens
ggggaatgaacgggtaagcagctcccaggtcccacttctgggagggggatgttgctcaggcctggaggccctgggggcatcacttccacctcagagttackgcttccacagacgagctggtcagccaagccctaggccaggccagggggaaagggagcatgagaatgtagcctccacatttccaagcccccatttgcagcc

SEQ ID NO: 39939 - DNA, 201 bp, Homo sapiens
acgggtaagcagctcccaggtcccacttctgggagggggatgttgctcaggcctggaggccctgggggcatcacttccacctcagagttacggcttccacrgacgagctggtcagccaagccctaggccaggccagggggaaagggagcatgagaatgtagcctccacatttccaagcccccatttgcagccctcacaggg

SEQ ID NO: 39940 - DNA, 201 bp, Homo sapiens
agccctaggccaggccagggggaaagggagcatgagaatgtagcctccacatttccaagcccccatttgcagccctcacagggccccaggtctttaggacrctgcagggagagcaggaggccagctggctcagaaggactgctaggaaaacagctcagaacttggaactctgctggcacgaaatcagtgtctgggagggtc

SEQ ID NO: 39941 - DNA, 201 bp, Homo sapiens
gtaatgtgcccaaggccacagagctaggaaatagatgctggatttgaactaagaatgtgtcattccagaaccagggctcattgccttgacaacatacagcrcaaatcctgtactcaggatgtcaccctcttcagaatgttgctgctgtcactcaagctggctgctctgggccatgatatcccaaggacaggtgaatttggg

SEQ ID NO: 39942 - DNA, 201 bp, Homo sapiens
tgcgcccaggacttcaataatcacggctgccaagggtacgtctctgaccagaaggggcccaaaacttcctcatttcccactgaccgcttcgacaggatccmgtgtgtgctgggtctgccacagatataacccaccactgccctgggtgatggcaaaatggtctctgttgtacaggggtggtcacctcacatggccaggtct

SEQ ID NO: 39943 - DNA, 201 bp, Homo sapiens
tgtctgtaatcccagctatttgggaggctgaggcaggagaatcacttgatcccgggaggtggaggttgcggtgagccgagatagtgccattgcactccagsctgggcaacaagagtgaaactccatctcaaaaaaaaaaagaaactcacacgcacgtccagcgtattttctgaggactctgagaaatattggtagttgact

SEQ ID NO: 39944 - DNA, 201 bp, Homo sapiens
ctgcgcccaggacttcaataatcacggctgccaagggtacgtctctgaccagaaggggcccaaaacttcctcatttcccactgaccgcttcgacaggatcyagtgtgtgctgggtctgccacagatataacccaccactgccctgggtgatggcaaaatggtctctgttgtacaggggtggtcacctcacatggccaggtc

SEQ ID NO: 39945 - DNA, 201 bp, Homo sapiens
gggcctcagatgtggctcagccagggaggcttagcgcctcacgccaaagccttgacggcttctcagctggcaggtcactgggttgtgtccttcttccaggsggaacagcagctggtggactgcgcccaggacttcaataatcacggctgccaagggtacgtctctgaccagaaggggcccaaaacttcctcatttcccact

SEQ ID NO: 39946 - DNA, 201 bp, Homo sapiens
cggcgtccccatcactgatgtcctctgctctcccctggcctttccagggtgcctgcggcagttgctggactttctccaccactggggccctggagtctgcratcgccatcgcaaccggaaagatgctgtccttggtaagaaatcagccacaggcgaccccctgcggaggacaccccatcctgatgtgggccaggcctgggc

SEQ ID NO: 39947 - DNA, 201 bp, Homo sapiens
atgacagcggctgccatttagttgaagcatgtgccaagctctcagcaataacatcttaacttgatggagtacttctaggtgctgtaccaaccctcaatacrcactatcccctctagacccgaactggccctaggagatgagtatccttattacctcatttgacaggtgaggaaacgggggctccaagtggttaagtaatgt

SEQ ID NO: 39948 - DNA, 201 bp, Homo sapiens
ttccacagtatgacgaggaagcgatggtggaggctgtggccctctacaaccctgtgagctttgcctttgaggtgactcaggacttcatgatgtatagaacsggcatctactccaggtgagtcagggtcccaggagccaggagggacagtggggaggggcttggtgggcctcctcacaccccactcgtgggacttgggctcg

SEQ ID NO: 39949 - DNA, 201 bp, Homo sapiens
atggtccccaggagagcctcattggtgacacctgcagggccctgacgaccaggccagaactagcattcagccctcttgggcaggcccatggggtggaaatrgtgccacctgcagaagtcatcgcccctgtgctgggctggcctctgtgccctccatgtctcagatatgccctgacctgttgggctcacaaggccttgtcca

SEQ ID NO: 39950 - DNA, 201 bp, Homo sapiens
ggtgcagggtttcctaggagcagagttggggagaggaacgagagatggccagacagacccagccagagacaggaagggagagaggccgcaggggagctgcytctggccatccatgctgctctgggcctctagcccctagcttgaggcaaaaggctgtactgtgaaaggagtggggaggtgacaggccatgtgtttctgtct

SEQ ID NO: 39951 - DNA, 201 bp, Homo sapiens
ctgtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattgga

SEQ ID NO: 39952 - DNA, 201 bp, Homo sapiens; identical to SEQ ID NO: 8760

SEQ ID NO: 39953 - DNA, 201 bp, Homo sapiens
gtaatcccaggtactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattggaat

SEQ ID NO: 39954 - DNA, 201 bp, Homo sapiens
attatggcacttttaaagtcctgactagattggaatggatctattttagggtaaggcacggttcaccagcagattattctggccccagaataatctctccrgaggcaaactggtagtcaattgtcctaaactcaaaccctgcctccaactcttgtcctgagttgaggtctgtcttcctctaaagccctcagctgcagcagg

SEQ ID NO: 39955 - DNA, 201 bp, Homo sapiens
aataaatcgttcatatctggcattctcaattcctcaaggaaactgaattgaagaggagaggacttcatggggatatcaactgatgaggtcttaaaaataaygttgagtgaggccaggcgtgggggctcacgcctgtgatcccagcactttggtaggccaaggtgggtggatcacctgaggtcagaagtttcagaccagatt

SEQ ID NO: 39956 - DNA, 201 bp, Homo sapiens
gtccccttacttttggtctgtttccactccacagcttagaaacccaacccataacaagagtctgacatttgggcactctggggtcccaccgtttttatttttttttatttatttatttatttatttatttattttttctttttttgagatggagtctcgctctgttgcccaggctggagtgcagtggcgcgatctcagctc

SEQ ID NO: 39957 - DNA, 201 bp, Homo sapiens
tccccttacttttggtctgtttccactccacagcttagaaacccaacccataacaagagtctgacatttgggcactctggggtcccaccgtttttatttttttttatttatttatttatttatttatttattttttctttttttgagatggagtctcgctctgttgcccaggctggagtgcagtggcgcgatctcagctca

SEQ ID NO: 39958 - DNA, 201 bp, Homo sapiens
ccccttacttttggtctgtttccactccacagcttagaaacccaacccataacaagagtctgacatttgggcactctggggtcccaccgtttttatttttttttatttatttatttatttatttatttattttttctttttttgagatggagtctcgctctgttgcccaggctggagtgcagtggcgcgatctcagctcac

SEQ ID NO: 39959 - DNA, 201 bp, Homo sapiens; identical to SEQ ID NO: 8762

SEQ ID NO: 39960 - DNA, 201 bp, Homo sapiens
attctcccacctcagcctcttgagtagatgggattacaggcatgcaccaccacgcctgactaattttttttttttttttttttttttgagacggagtctckctctgtcgcccaggctggagtgcagtggcgcgatctcggctcactgcaagctctgcctcccgggttcacgccattctcctgcctcagcctcccgagtagc

SEQ ID NO: 39961 - DNA, 201 bp, Homo sapiens
tacccggcctgctttcctgggccttgaaaccctctccaggccctctcctgggccttgaaaccctctccaggcgctcagcccctttctcaggaggctgggcrgggcgtcctgtgtgcagtctcgcctgtgccagggcaggcagccccctctggcatacggtttatcttacccaaaggacccgctgtcccccatctgtagtaa

SEQ ID NO: 39962 - DNA, 201 bp, Homo sapiens
atactgactttgtaaatatgcagtcttactcaatgcacttattagttctggttatttatttgtagaataaacaaaatcatatcatttgtaaaaaaacaacrggggggttgggttttgtttgtttgagacagggtctcactctgtcatgcagactggagtggagtggcacagtcatggctcactgcagccttgacctcttgg

SEQ ID NO: 39963 - DNA, 201 bp, Homo sapiens
gctgcaggcaggaggccgcagctgagcgctgtgtttctccccagggaagcagctgccacgccttgctagccggctgtgcttcttacaggaggagaggaccwttgtaaaacgaaaaccccgaggtagcctttgccttcccttccaaaacagccccaggcaggtgggcgctggcctcccaaggtggggggactccgtggaggg

SEQ ID NO: 39964 - DNA, 201 bp, Homo sapiens
aaaggacccgctgtcccccatctgtagtaacctggagaggccacgagtgtccccagggagccgcagtgccttcgcctcagcagacactccacacctgcccygggtacttggctcaatttgaaggtgtttattttgtgtgtgccgtggggcacatggagccgtctgtggatacctgcaggacagaatgaattcaggacgcag

SEQ ID NO: 39965 - DNA, 201 bp, Homo sapiens
aatactgactttgtaaatatgcagtcttactcaatgcacttattagttctggttatttatttgtagaataaacaaaatcatatcatttgtaaaaaaacaasaggggggttgggttttgtttgtttgagacagggtctcactctgtcatgcagactggagtggagtggcacagtcatggctcactgcagccttgacctcttg

SEQ ID NO: 39966 - DNA, 201 bp, Homo sapiens
ccacagggtccaggctcgcagtaatgccagctgccctgcggcctcactcacaccccaaccccagcacaggccacacgttccaggctgcaggaagactgtgtgtgtgtgtgtgtgtgtgtgtgtgtgtgtgtgtgtgtgtgtattatatggatatgagtatgtgtatatatgtgcatgcatattatacatttatatgcatat

SEQ ID NO: 39967 - DNA, 201 bp, Homo sapiens
aaatactgactttgtaaatatgcagtcttactcaatgcacttattagttctggttatttatttgtagaataaacaaaatcatatcatttgtaaaaaaacarcaggggggttgggttttgtttgtttgagacagggtctcactctgtcatgcagactggagtggagtggcacagtcatggctcactgcagccttgacctctt

SEQ ID NO: 39968 - DNA, 201 bp, Homo sapiens
cacagggtccaggctcgcagtaatgccagctgccctgcggcctcactcacaccccaaccccagcacaggccacacgttccaggctgcaggaagactgtgtgtgtgtgtgtgtgtgtgtgtgtgtgtgtgtgtgtgtgtgtattatatggatatgagtatgtgtatatatgtgcatgcatattatacatttatatgcatatg

SEQ ID NO: 39969 - DNA, 201 bp, Homo sapiens
tgctcttccaggctcagcctactcagactgtgggctctccgtactggggctggctgcaggaggggcaggagcggccaggcacagtggctgccgtggggccrggcacagtgcagccaggggcatgtgggcagccctcctctgcccctgcccaggccggaacttcgacaagaatggcaacatgatggattggtggagtaactt

SEQ ID NO: 39970 - DNA, 201 bp, Homo sapiens; identical to SEQ ID NO: 8767

SEQ ID NO: 39971 - DNA, 201 bp, Homo sapiens
caactactcctgggacctggcagacgaacagaacgtgagcgctgccaccagcacccaggctgcgggggtaccggagccccagccctggccctgagggagarggaagtcagggccggggctgccccaatcctgtctcctgtgcgcaggtgaacggattcaacacccttggggaaaacattgctgacaacggaggggtgcggc

SEQ ID NO: 39972 - DNA, 201 bp, Homo sapiens
taaacctgagaggggcttctggccgatttcggtcagggacattctcttacagactaagggcatttaagggtttaggaagggggagcctaccgcaggctgcraatgtttctgtgtgaaggagagttttattgcagagttggaatatctctggctggaggggaggttattctcaggattggcatgtttctggtcagatggggg

SEQ ID NO: 39973 - DNA, 201 bp, Homo sapiens
cctggctgggggctcttgcagcacagcagaaggatgggccaggccgacagggagctccggggtctcctgggacctgggctcctggctcctgtccacgtccrtgggcccgggaacgagctgctgctgctggagtttctgttgggcctcctggccaagctgggggccacagtagaacccggttctggtcagaggggcgggggc

SEQ ID NO: 39974 - DNA, 201 bp, Homo sapiens
ctcgcactcaccacctcctttccgttgctggcctgggggattcctttgctctgaagctcagccttgcccttcagcactttacctcggtgtatgcagcatgyggcactttctccctgtttccaccgggcggggggctccttgagggctgggccctgtcaggctcacatctgaactgcagcatctggcctggctcacagtcat

SEQ ID NO: 39975 - DNA, 201 bp, Homo sapiens
cccactctggggcacctccagggaccagagcccagcatggaaggccccttgggggaaaagcatgaggggcagggggcgggagctggacaggatttcaatgstgatgggaggaggggagcacctgctgactcccctcaccccaccctagaaggggcagcctggggatagtggagaccctcccccacccctcctggccacccc

SEQ ID NO: 39976 - DNA, 201 bp, Homo sapiens
caggggagggggcgtcagcatggcaggggagggggggcatcagcgctgcaggggaggggggcaccagtgcctcaggggagggggcgtcaggggctcattcrggacaggtggtgtgcagtgggctgtctggccagggatccccccccgagggcccagctcaggggtccctgagtgactgaggtggtgagcgctcatccgtgg

SEQ ID NO: 39977 - DNA, 201 bp, Homo sapiens
cctaaggcgcacaggtgagctccccaccctatggccccctagttcctggctccggaggccagattcaccgacaaggggccgggctggggccccagggcccrccagtctccagtgcggggcactgtctccccaggactcgagtgggagctggagcggcagctggcgctgatgaactcacagttcaacaggcgcgtcctcatc

SEQ ID NO: 39978 - DNA, 201 bp, Homo sapiens; identical to SEQ ID NO: 8770

SEQ ID NO: 39979 - DNA, 201 bp, Homo sapiens
agggggtgccagcacagcaggggagggggcgtcagcatggcaggggagggggggcatcagcgctgcaggggaggggggcaccagtgcctcaggggaggggrcgtcaggggctcattcgggacaggtggtgtgcagtgggctgtctggccagggatccccccccgagggcccagctcaggggtccctgagtgactgaggtgg

SEQ ID NO: 39980 - DNA, 201 bp, Homo sapiens
gacagctgctgccccttggagcccgcgatgctcttccaggctcagcctactcagactgtgggctctccgtactggggctggctgcaggaggggcaggagcrgccaggcacagtggctgccgtggggccaggcacagtgcagccaggggcatgtgggcagccctcctctgcccctgcccaggccggaacttcgacaagaatg

SEQ ID NO: 39981 - DNA, 201 bp, Homo sapiens
cagccccctgcccatcccttcctcctgggggcaccccagcctgttcttggaacattctcctatgtcaccccttgctgcccccgtggggaacactcactccygtgcccatgagcggcttcgggagggacttggcaggcggcccagagcctttcctgcaggcagaacaggatggtgggaggaggccggactgaggtcctgggt

SEQ ID NO: 39982 - DNA, 201 bp, Homo sapiens
ggaggctggctgcggcgccacgtgatccctgagaccaactcaagatacagcatctttgacgtcctccgcgacgagctggaggtcatcctcaaaggtggcaragcacggccgggggtgcagtggggtgacgccgaacaggacagcaccgggccaggagttggtcctggctgtgtctcgcccctgtttgtgcttcctccttgg

SEQ ID NO: 39983 - DNA, 201 bp, Homo sapiens
acatgggccctgattgcctgggggctcctctgtgccaagctctgtgccctcctcccaggcgctaacacagctgtcctcaccgtgccctagggtggtggctycagcactaccctcagtgtacagatggggaaactgaggcctggagggacgagggacttgctcagagtcatgtaaatgcccacagccagggctgccccgttc

SEQ ID NO: 39984 - DNA, 201 bp, Homo sapiens
ctaccaaatggccaccttcttgctgtgtcctcatgtggtggaaagagacagtgagctctgtcatttcttccccctcttatgagggcaccagacttaccagrttatgccccccaccagccctgcccattgagctgattttaaacctcctcacaggccctatccccaaatagtcacattaggggttagggcttcaaaccacaa

SEQ ID NO: 39985 - DNA, 201 bp, Homo sapiens
ggggacaaggaaccgcagggaggccctagggggattctggctgttctggggagagtgagttgagtagggggcggggtcagcatggaggccgatgtggtcamccaggtgaggtgacaggcttggccatggtgctggcagacacacagacgcaggggaggtgttgaccgcagcagctgagggattgggtataggggctaaggg

SEQ ID NO: 39986 - DNA, 201 bp, Homo sapiens
ctccccgtctgaaagccgcaggggtgctaagagcagagacgcggtcagatatgctgctcctgtagtcactgtggctgctccagggctggggtgagggtggrgacaaggaaccgcagggaggccctagggggattctggctgttctggggagagtgagttgagtagggggcggggtcagcatggaggccgatgtggtcaacc

SEQ ID NO: 39987 - DNA, 201 bp, Homo sapiens
aatgagcaccggggctagagagagatggagtaggaagtaaagcgggggatgccgtgtccgacctcgggggccacttgaaagtctcagactctgcccgagargagtgggggtatgacaggacgtgacctggttcacaagtaagagtgagtgaaggggacggggcaggtggcagagaagccaatcagaggctgccacgtagcc

SEQ ID NO: 39988 - DNA, 201 bp, Homo sapiens
aggctgaggataggtgggtctgctcaccccgtaagcccagggccccacgccaggcctgggaaggctgacgtgggggcccgtgggatgatcgggtggccccvccaggcgctgtttggcacaatggtggaggaggtgcgctggcgtgaatgtgtgggctacgtcaacagcaacatggagaacgccgtgggctccctctacgtc

SEQ ID NO: 39989 - DNA, 201 bp, Homo sapiens
ctcctactcaaagtgtggcccacagaccagtggtgtcagccattgcctgggagcctgttagaaattcagaaactcaaggtccaaccaaggccgcaggaccrgtgttggtatttcagcaagacccccaggtgattcatctgcacattcatgttagggaagcactggtttaaaacagtgttgaccaaatttgcttgataattg

SEQ ID NO: 39990 - DNA, 201 bp, Homo sapiens
gcatccggcccttccagcctcgggccgggctcggggagctccacgcccctctcccctctcccctgccctgggcctgcaggttcctccgcggtgctctcccstccagagccctgctgatggggaagtccgaaggcccagtggggatggtggagagcgccggccgtgcagggcagaagcgcccggggttcctggagggggggc

SEQ ID NO: 39991 - DNA, 201 bp, Homo sapiens
gcctcccggtctgtgggatcaagtgtcagaacccctggcagcgccatccctgagcctggcacacaggagatgtgtccactcacagcttattctttgtcccrcccttggggacagtattccctgccgggatcctccagccccccttcttcagcaaggagcagccacaggccttgaactttggaggcattgggatggtgatcg

SEQ ID NO: 39992 - DNA, 201 bp, Homo sapiens
ttgttttgcccagggggtctcgtggagcctccgcctgactgtggaactcgctgggaccctggctttagggggcgtctccgtgagacccctgcttgggtgcrctgggcttgtctcctccccatggaaacagaaggctgggcccccattctgggcaatactcccagctggagatgacttcctgtgtcctcgcctttacttaat

SEQ ID NO: 39993 - DNA, 201 bp, Homo sapiens
tgactgtggaactcgctgggaccctggctttagggggcgtctccgtgagacccctgcttgggtgcgctgggcttgtctcctccccatggaaacagaaggcygggcccccattctgggcaatactcccagctggagatgacttcctgtgtcctcgcctttacttaatttttggcctgagaggctgaatatacaaacggcagg

SEQ ID NO: 39994 - DNA, 201 bp, Homo sapiens
gggatcagtgggtgagacagacccctcagggggaggtgattggtggggcctggaacaggcagcgagtggcaggaatgagaaagggtccgactgagatgggmttggaggctgaggactggcgcggggtgtggacgcaggcaagggaggcagatggctccaaagtccagcttcagccagtggcgggataggggtgtctagggg

SEQ ID NO: 39995 - DNA, 201 bp, Homo sapiens
tattccctgccgggatcctccagccccccttcttcagcaaggagcagccacaggccttgaactttggaggcattgggatggtgatcgggcacgagatcacrcacggctttgacgacaatggtgagcggccgcccctccaatcacacacgccctcccctctccgcggagaagcagccaggaaggggcctgggggcgctccat

SEQ ID NO: 39996 - DNA, 201 bp, Homo sapiens
tctggactctcttttgccccactggtctctttatctatccaagtgataacccctaccaccatcactccttcagctttataatgtcttgatagtcaatagartatatatttcaactttgttcttcaagagtgtcttgataattctcagtcctttgcattttcacataaaacttaaaatctgccttccatttgcatacacgca

SEQ ID NO: 39997 - DNA, 201 bp, Homo sapiens
ttgacgacaatggtgagcggccgcccctccaatcacacacgccctcccctctccgcggagaagcagccaggaaggggcctgggggcgctccattcaacccyttcacggtttcagtggggacaccgaggccaggtcctcagggagctgtgggggcagagcaggctttgaatgccaggctggggccctgtctgggggcactga

SEQ ID NO: 39998 - DNA, 201 bp, Homo sapiens
aaatatgcagtcttactcaatgcacttattagttctggttatttatttgtagaataaacaaaatcatatcatttgtaaaaaaacaacaggggggttgggtkttgtttgtttgagacagggtctcactctgtcatgcagactggagtggagtggcacagtcatggctcactgcagccttgacctcttgggctcaagcctcct

SEQ ID NO: 39999 - DNA, 201 bp, Homo sapiens
gagtggcacagtcatggctcactgcagccttgacctcttgggctcaagcctcctgagtagctgcgaccacaggaatacaccatgaccaagccttgcctgatttttttttccccagaaacagggtttctctatgttggccaggctggtcttgaactcctgtgctcaagcagtcctcccgccctggcctcccaaagtgctggg

SEQ ID NO: 40000 - DNA, 201 bp, Homo sapiens
agtcatggctcactgcagccttgacctcttgggctcaagcctcctgagtagctgcgaccacaggaatacaccatgaccaagccttgcctgatttttttttycccagaaacagggtttctctatgttggccaggctggtcttgaactcctgtgctcaagcagtcctcccgccctggcctcccaaagtgctgggattacaggc

SEQ ID NO: 40001 - DNA, 201 bp, Homo sapiens
attgcgctgctgcacttgaacctgggcaacaaagcgagactctgtctcaaaaataaatttaaaaaaaagttatgtttgctatggagttgtttttgttgctkctgctgcttcatacatttcctttatcaggttatagaattttccttctatttttctttttatctttttttttttttttttgagacaaagtcttgctctgtt

SEQ ID NO: 40002 - DNA, 201 bp, Homo sapiens
tacttaggctttcgcatatatctgcatgatcgcttgggtttttacagctgtaggctctgtaataatgtcacccaccctttcctgattctgattacctgcaccttctctcttattccttgaacattcttcaacaggggctgggtttcttagattcccaggaactgtttctccctctctctctctccctctttctccccactt

SEQ ID NO: 40003 - DNA, 201 bp, Homo sapiens
ggcctgggtgtcccgcctggaggggcatgtccacagctgctctgggtcctgacgctccaggagctcacgctgtctgcagatccaccacttccctgggcagyccccggcctgcgtcttcctcagtgctcagctggaggtggagagaaatcaggctgggacggagggtggcccttgctttgcacgattcctgcctcgacgtta

SEQ ID NO: 40004 - DNA, 201 bp, Homo sapiens
cttaaaatacaaaattagccaggcgtgatggcggatgcctgtaatcccagctactcgggaggctgaggcaggagaatcacttgaacctgagaggcggaggytgcagtgagccgagatcgtgccattgcatgatgatggatgaaactgcatctccaaaacaaaaaaaaaaaaatgtgcattggttcagtccagaaaggtggg

SEQ ID NO: 40005 - DNA, 201 bp, Homo sapiens
ggggccggacccgtggtcagcagcggacaggaaggagaagatggcagggagggaggcgaggtgaccacgggccacagcagccggtttggattgtactcccygtctgaaagccgcaggggtgctaagagcagagacgcggtcagatatgctgctcctgtagtcactgtggctgctccagggctggggtgagggtggggacaa

SEQ ID NO: 40006 - DNA, 201 bp, Homo sapiens
aaaaccgcagagtatgatgtggcagggaggcagggagggacgaggacagggagcactgctccggggaggcgacatttgagaccttaaaggcctgaagaggyggcggggtgatttcccgggagcagaaacagccagtgccagtgcagaggccagaggcaggagcaggcaggggccggacccgtggtcagcagcggacaggaa

SEQ ID NO: 40007 - DNA, 201 bp, Homo sapiens
gagaagtcagcccggggaccagacggttctctcctcttgcctgctccagccttggccttcagcagtctggatgcctatgacacagagggcatcctccccawgccctggtccttctgtgagtggtgagttgctgttgctggtcagtactaggctcgggctggaggtgggggctctctggtgtcgtggcccagtctcaggctt

SEQ ID NO: 40008 - DNA, 201 bp, Homo sapiens
aaaagaaaattctgctagaaatttgatagggatcactttgaatctctctatcaatttggggaagactttgcaatgctgagtcttccaatccatgaacatgrtatatgcttccatttatgcttcaatttttcttaataacttttaaagctttcagtgtcaagttcttatacatattttattagataaattacaggtgtttgg

SEQ ID NO: 40009 - DNA, 201 bp, Homo sapiens
agctccacgcccctctcccctctcccctgccctgggcctgcaggttcctccgcggtgctctcccgtccagagccctgctgatggggaagtccgaaggcccmgtggggatggtggagagcgccggccgtgcagggcagaagcgcccggggttcctggagggggggctgctgctgctgctgctgctggtgaccgctgccctgg

SEQ ID NO: 40010 - DNA, 201 bp, Homo sapiens
ggatcttggaggtggttgtcctggaggttttctccagcacccataactctctggggtggaacgtgctggccaagggccctaagccatatctcctcccttgsaaagacctctcacctgttctcccctcaccctctaccttctgcccccaggaccatacagaactacctggtctggcgcctggtgctggaccgcattggtagc

SEQ ID NO: 40011 - DNA, 201 bp, Homo sapiens
aagcctacctgcagttcatggtgtcagtggccacgttgctgcgggaggatgcaaacctgcccagggacagctgcctggtgcaggaggacatggtgcaggtkctggagctggagacacagctggccaaggtaagggggccggggcgggtggggagcgggcagcgagtgggctgggagccccaggcggtgtggctggccaagg

SEQ ID NO: 40012 - DNA, 201 bp, Homo sapiens
cacattaggggttagggcttcaaaccacaaagtcagtccataacaagccccaaacagtgaaacccgggaatcttgtagggtaagacctctgaatcccacaygcatttgagaccttgcttgtgatcagacaagtttggggagccctgcttgaaaataatctatcagcattaaactcttatctcttgtctatgtgaaaattac

SEQ ID NO: 40013 - DNA, 201 bp, Homo sapiens
ctcccctgccctgggcctgcaggttcctccgcggtgctctcccgtccagagccctgctgatggggaagtccgaaggcccagtggggatggtggagagcgcyggccgtgcagggcagaagcgcccggggttcctggagggggggctgctgctgctgctgctgctggtgaccgctgccctggtggccttgggtgtcctctacg

SEQ ID NO: 40014 - DNA, 201 bp, Homo sapiens
ccagaccgcagcccctggccctctagggtctcccctgggacagaggggtcctgcgacctccatgggcggtgggcagtgggggagggaaaggctcactcacmctgaggaacccagagcccaagggaagctctgttcagagcctgctgggctcaaaacacctgctttccaggctttcataaaacaaggctgaccccacacaca

SEQ ID NO: 40015 - DNA, 201 bp, Homo sapiens
gatctcaaaagaatgaaagatttggaaagatcaagaaaatgatttcttaaaatcatgtactgaagtgtgtatgctaaaatcttgcactaaagaatcacccrttcttgtagttacatcaaatcttacctaatttacctatttaaggcgatattactatgtgaacgcaaatttaggtatgaattataaaattagtttcataaa

SEQ ID NO: 40016 - DNA, 201 bp, Homo sapiens
gcattttctcatctctggaaagttttaataagattggcagttttccttaaatgtcagatagaatccactggtgaagccaaatgggtctggaaatttctttrttggaaagtttcaaattaaatattccatttatttaacctagaagactattcatattttctatttctttttttgtcatttttgctaagttgtgtttttcta

SEQ ID NO: 40017 - DNA, 201 bp, Homo sapiens
ggggtttgtctatcttttaattggaggattttgttggtttataattaccaggacaactaaaatgtatgtgtttcctattgtgttgttttgtgtgtctcatkcgtttttttctcttttcttgccttgttttggatcaacctatcattatttcctctattttccctcaactaacttggaagttttgtatttctatcttttcga

SEQ ID NO: 40018 - DNA, 201 bp, Homo sapiens
accatccagccaaaccattggctacagcccatgaatcggtacataatcgcatcgcacatctggcctcttctccttccaagcaaagtgcacaacaaggtacrctgcttgaagttctgcccactgggaagatttcccttcaccgctgtccttcatggatgtcctggaaaggggctatagtgctgcagctgtccacttgtgggt

SEQ ID NO: 40019 - DNA, 201 bp, Homo sapiens
agtttcaggtagttctttctagcagtgtgataatggacgatacaagtagagactgagatcaatagcatttgcactgggcctggaacacactgttaagaacrtaagagctattgctgtcattagtaatattctgtattattggcaacatcatcacaatacactgctgtgggagggtctgagatacttctttgcagactccaa

SEQ ID NO: 40020 - DNA, 201 bp, Homo sapiens
ggaaatgagtctcggagggtttggggttcaagatcaagtggttaataagtgaaaacccagccgactcatgcctgaattcccagcaactctggaggccgagrtggaccacttgagcccaggagttccagaccagcctgggcaacacagcgagaccctgttctaaaataaattttttaaaaaggcattcgggagaggagacac

SEQ ID NO: 40021 - DNA, 201 bp, Homo sapiens
agggaccaggctgtgtcttggaccgggagacaggcttctgggctgtccacaactctctctgtctcccctctccctgctccacgccatggggacgagcagcygccaggatcctccagaacatggacccgaccacggaaccgtgtgacgacttctaccagtttgcatgcggaggctggctgcggcgccacgtgatccctgaga

SEQ ID NO: 40022 - DNA, 201 bp, Homo sapiens
gccatgggggggtaggtcagagacatctgtgagtcaagcgtcaggggggcactgagtctaggagctttggggaggaagaaagggctgcctccctttcctaragggcaggaagtcctgcagcccagaaggtgtggcaggacgctgggcagagtgctccctgggctttgcctgagtctggggcccagagtctcgtgctcctgt

SEQ ID NO: 40023 - DNA, 201 bp, Homo sapiens
ttcttcaagagtgtcttgataattctcagtcctttgcattttcacataaaacttaaaatctgccttccatttgcatacacgcacacacacaaaaagaaaaytctgctagaaatttgatagggatcactttgaatctctctatcaatttggggaagactttgcaatgctgagtcttccaatccatgaacatggtatatgctt

SEQ ID NO: 40024 - DNA, 201 bp, Homo sapiens
acatcccaagcacccggggcagatgggctggatcttggaggtggttgtcctggaggttttctccagcacccataactctctggggtggaacgtgctggccragggccctaagccatatctcctcccttgcaaagacctctcacctgttctcccctcaccctctaccttctgcccccaggaccatacagaactacctggtct

SEQ ID NO: 40025 - DNA, 201 bp, Homo sapiens
ccgattcccaggtcagagaactcattgacaaggtgcggacagtgtttgtggagacgctggacgagctgggctggatggacgaggagtccaagaagaaggcrcaggagaaggtatgtggctcgcagaggtcagggcagccccgactggatctgggcacgggcagcaccgccccgacaaagcctcctgacggtccccacgggg

SEQ ID NO: 40026 - DNA, 201 bp, Homo sapiens
taatcatgcacacgcacacacgagaggacacacgtgcacactcaggcacacacgtgcatatccacataatgcacatgcacacatgagagcacacgcacacrtgcacaatcacacagtcacacacgtgcacacacgagtgtacacgcacacacgtgcatatccgcacacataatcatgcacacgcacacacgcgagcacagg

SEQ ID NO: 40027 - DNA, 201 bp, Homo sapiens
tccgggagcagtcagagtgcatgatctaccagtacggcaactactcctgggacctggcagacgaacagaacgtgagcgctgccaccagcacccaggctgcrggggtaccggagccccagccctggccctgagggagagggaagtcagggccggggctgccccaatcctgtctcctgtgcgcaggtgaacggattcaacacc

SEQ ID NO: 40028 - DNA, 201 bp, Homo sapiens
atcagcgctgcaggggaggggggcaccagtgcctcaggggagggggcgtcaggggctcattcgggacaggtggtgtgcagtgggctgtctggccagggatccccccccgagggcccagctcaggggtccctgagtgactgaggtggtgagcgctcatccgtggggtgtgtgaagggcccttgcagcagcaggacccccaca

SEQ ID NO: 40029 - DNA, 201 bp, Homo sapiens
gcttgcagccccctgcccatcccttcctcctgggggcaccccagcctgttcttggaacattctcctatgtcaccccttgctgcccccgtggggaacactcrctcccgtgcccatgagcggcttcgggagggacttggcaggcggcccagagcctttcctgcaggcagaacaggatggtgggaggaggccggactgaggtcc

SEQ ID NO: 40030 - DNA, 201 bp, Homo sapiens
gtgtacacgcacacacgtgcatatccgcacacataatcatgcacacgcacacacgcgagcacaggcacacacgtgcagtcacacacatgcacacacgaggmcacacgtgcacactcactcacagtcacacacatgcacacatgagcgtagacagtgcatatccacgcaatcatgcacacgcacacacgagagcacacgcac

SEQ ID NO: 40031 - DNA, 201 bp, Homo sapiens
aggtgggctgggagcccagaagcccaagtggcctccccgacagcgtccctgacctagcgctcaggcccacagctccaagacacccagcatgagcagcccaggggggctccactacaggagtcccttgacagcacaggagctgagcctcctgggtccagcttgcgaccccaagctgggagcatcccagtcctagaacctcca

SEQ ID NO: 40032 - DNA, 201 bp, Homo sapiens
ggacccagtcacccagggttgtgagcttggagagggagacgggaagagtgttccaaaggcacccagcgcccgctcccagccagcatccggcccttccagcctcgggccgggctcggggagctccacgcccctctcccctctcccctgccctgggcctgcaggttcctccgcggtgctctcccgtccagagccctgctgatg

SEQ ID NO: 40033 - DNA, 201 bp, Homo sapiens
tctgggcttcaacaggaaaggtgggctgggagcccagaagcccaagtggcctccccgacagcgtccctgacctagcgctcaggcccacagctccaagacamccagcatgagcagcccaggggggctccactacaggagtcccttgacagcacaggagctgagcctcctgggtccagcttgcgaccccaagctgggagcatc

SEQ ID NO: 40034 - DNA, 201 bp, Homo sapiens
caatcaatacatgtaagatatggctgggcacagtggctcacacctgtaatcccagcacttcgggaggccaaggtaggtggatcacctgaagtcgggagctsgagatcagcctgaccaatgtgagaaaccccatctctacttaaaatacaaaattagccaggcgtgatggcggatgcctgtaatcccagctactcgggaggc

SEQ ID NO: 40035 - DNA, 201 bp, Homo sapiens
aggttctatttgctaatattttgcttagaacttttgtatctatgacataaacgagactggcttattatttactctgcttataatatccttattttggtatyaaggttattcttggcctcataaatcaagttgaaaagcattttctcatctctggaaagttttaataagattggcagttttccttaaatgtcagatagaatc

SEQ ID NO: 40036 - DNA, 201 bp, Homo sapiens
gggcgtcctgtgtgcagtctcgcctgtgccagggcaggcagccccctctggcatacggtttatcttacccaaaggacccgctgtcccccatctgtagtaasctggagaggccacgagtgtccccagggagccgcagtgccttcgcctcagcagacactccacacctgccccgggtacttggctcaatttgaaggtgtttat

SEQ ID NO: 40037 - DNA, 201 bp, Homo sapiens
ggtacctactgttctggtgtcgcccatcactggcttctgggcttcaacaggaaaggtgggctgggagcccagaagcccaagtggcctccccgacagcgtcyctgacctagcgctcaggcccacagctccaagacacccagcatgagcagcccaggggggctccactacaggagtcccttgacagcacaggagctgagcctc

SEQ ID NO: 40038 - DNA, 201 bp, Homo sapiens
tggacgaggcagggcgaggcgcccaccccagtggggagtggaccatgacagtcaacaaggcagaacgtagctctgccaaaaccgcagagtatgatgtggcrgggaggcagggagggacgaggacagggagcactgctccggggaggcgacatttgagaccttaaaggcctgaagaggtggcggggtgatttcccgggagca

SEQ ID NO: 40039 - DNA, 201 bp, Homo sapiens
ctttacttaatttttggcctgagaggctgaatatacaaacggcaggggccagaccatgtggaaaactggaacgcaactcaggaccggcagcccagccgggracccagccctttatccccagtgggcagcccaggaggtcagacggcactccccacggcatccggcccctaacagccggggcctgcctcatcacaggcagcc

SEQ ID NO: 40040 - DNA, 201 bp, Homo sapiens
gagaccttaaaggcctgaagaggtggcggggtgatttcccgggagcagaaacagccagtgccagtgcagaggccagaggcaggagcaggcaggggccggayccgtggtcagcagcggacaggaaggagaagatggcagggagggaggcgaggtgaccacgggccacagcagccggtttggattgtactccccgtctgaaag

SEQ ID NO: 40041 - DNA, 201 bp, Homo sapiens
ccttcctccagcataggaccctagccaagcccagaggaggccggcctctagtgagcccgccacagcctccccaggccagcagcccccactcagcccactcrggcctcccctcttccactaggaagccctgctgctccctgcaggcctttgacctgacggggcacctgccatgctgtgccagcactgaagccttcactttgc

SEQ ID NO: 40042 - DNA, 201 bp, Homo sapiens
catctgcacattcatgttagggaagcactggtttaaaacagtgttgaccaaatttgcttgataattggaatcacctggggaaattgttacaaatccagacrttgggccctccctcagtttgcctgggctacagtcacaaaatgctcaggtggcttaaaaacagaaacatattttctcctcctagttctggaggctgtgaag

SEQ ID NO: 40043 - DNA, 201 bp, Homo sapiens
tgccagcactgaagccttcactttgccctgtgggtggtcttcacttattcccacagtgactatctccgcgtccccacctttacctaatcttcgactgcaaragccctgcttgtcggggccccaccgtgctgagccgagacacaggacacacacaggccccagggctcccctgcctaccccgcgccccctcccagcccaccc

SEQ ID NO: 40044 - DNA, 201 bp, Homo sapiens
tccatccgcagtggggcacccactgaccagtccctcctccccactcaggccatgagcatccgggagcagatcgggcaccctgactacatcctggaggagaygaacaggcgcctggacgaggagtactccaatgtgcgcccccaaccccagccctaaactgccccccacaccgtggacatgggccctgattgcctgggggct

SEQ ID NO: 40045 - DNA, 201 bp, Homo sapiens
tgtaaatatgcagtcttactcaatgcacttattagttctggttatttatttgtagaataaacaaaatcatatcatttgtaaaaaaacaacaggggggttgkgttttgtttgtttgagacagggtctcactctgtcatgcagactggagtggagtggcacagtcatggctcactgcagccttgacctcttgggctcaagcct

SEQ ID NO: 40046 - DNA, 201 bp, Homo sapiens
agctggccaaggtaagggggccggggcgggtggggagcgggcagcgagtgggctgggagccccaggcggtgtggctggccaaggtgagggggtgctgggtkggccggtagcaggcagggactgggccaggagccccagggggcatcctggccacccgcccgtgtgactgctatccccggcacaggccacggtaccccagga

SEQ ID NO: 40047 - DNA, 201 bp, Homo sapiens
tgactcccagcatggaggaggggacccagggactccagcccatgaccctgactccacctggcactgggcacttccctcccacggcctgtgacatggggacracaacactgcccaatacagcagcgaagcccagatcccagcctgggagactctccagacggccagcatcctccaccggggggtgtgctacccccgccatgg

SEQ ID NO: 40048 - DNA, 201 bp, Homo sapiens
agggggctgctgatgtgtgggggtgtacagggtcccacccagggctctcagaccccaagtcccgctcagaaccttagcagggtgcttcctcccagtcctgyctgccctgagggtagcagttccccctggccacaccctcaggcgctcccctgcccagtgcccaggccaggcaccgccctgtgctttgaggtgggggctgga

SEQ ID NO: 40049 - DNA, 201 bp, Homo sapiens
acccagggactccagcccatgaccctgactccacctggcactgggcacttccctcccacggcctgtgacatggggacgacaacactgcccaatacagcagygaagcccagatcccagcctgggagactctccagacggccagcatcctccaccggggggtgtgctacccccgccatggccatgctgacctccgcccctcgg

SEQ ID NO: 40050 - DNA, 201 bp, Homo sapiens
acacgagggccatgcccgattcccaggtcagagaactcattgacaaggtgcggacagtgtttgtggagacgctggacgagctgggctggatggacgaggartccaagaagaaggcgcaggagaaggtatgtggctcgcagaggtcagggcagccccgactggatctgggcacgggcagcaccgccccgacaaagcctcctg

SEQ ID NO: 40051 - DNA, 201 bp, Homo sapiens
tcctggctcctgtccacgtccgtgggcccgggaacgagctgctgctgctggagtttctgttgggcctcctggccaagctgggggccacagtagaacccggytctggtcagaggggcgggggctcctgaacagcggggctggaaccggggcaggaggcctgacctcagggatccactgctggccacgggctggaggccaaag

SEQ ID NO: 40052 - DNA, 201 bp, Homo sapiens
tggtacaagttgcccctggcccacgaggacccacagcccagcagggaggaccctgaagttgggttgtcatctcatccccccaccggccccacacctcaccygagaggcccacagctgggcagccctgggccttgccccggcggggctcagaccagacctccccaaagcccttgaggctggtcattcgccctccagatgagt

SEQ ID NO: 40053 - DNA, 201 bp, Homo sapiens
ctgggaaaggcacaggtggtacaagttgcccctggcccacgaggacccacagcccagcagggaggaccctgaagttgggttgtcatctcatccccccaccrgccccacacctcacccgagaggcccacagctgggcagccctgggccttgccccggcggggctcagaccagacctccccaaagcccttgaggctggtcatt

SEQ ID NO: 40054 - DNA, 201 bp, Homo sapiens
ccaagcctggctgggggctcttgcagcacagcagaaggatgggccaggccgacagggagctccggggtctcctgggacctgggctcctggctcctgtccaygtccgtgggcccgggaacgagctgctgctgctggagtttctgttgggcctcctggccaagctgggggccacagtagaacccggttctggtcagaggggcg

SEQ ID NO: 40055 - DNA, 201 bp, Homo sapiens
gagagaaaccacctgacttcaggtcgggaaccacccgtgcatcccctctctgctgagagctgttccgtctctcaataaaattcttctctgcccttctcacrcttcgattggcagcatctcctcattcttcttggacacgggacaagaacttgggaactgccatacatgggtacaagctataacacaagcaggctggaacat

SEQ ID NO: 40056 - DNA, 201 bp, Homo sapiens
gagagcctgctggtcaaggtgggtggacacgcattaggggcttccccatgtcctacgcccaccccacccccacagaaaactccctgggggccatggtggcygaggccacccagctctgcccggcgtcctttggcccaggtgcgggaagcctacctgcagttcatggtgtcagtggccacgttgctgcgggaggatgcaaac

SEQ ID NO: 40057 - DNA, 201 bp, Homo sapiens
agcacccacctgtgcaaacccttataggcagccacacagtttaagccctgagcagccctgcagactaggtaccccgtccagtggctcgggcacaggtcacrcgtctgagacgctcccactcggcactctgtgtgcccgagagcctgctggtcaaggtgggtggacacgcattaggggcttccccatgtcctacgcccaccc

SEQ ID NO: 40058 - DNA, 201 bp, Homo sapiens
aggctgaggcaggagaatcacttgaacctgagaggcggaggctgcagtgagccgagatcgtgccattgcatgatgatggatgaaactgcatctccaaaacaaaaaaaaaaaaatgtgcattggttcagtccagaaaggtgggacaactccaagtaggggcttccacatcacaggtagattcaaaggttttctgatagcagt

SEQ ID NO: 40059 - DNA, 201 bp, Homo sapiens
ctttctcaggctcatcattcctgcccaccaatctggtcttcccactggtttcgtgtcccttctgagtgaagaccttttagcatttgttgtggggcacatcyggtagagacacatgttctcagctttggtctaaaatgtctttatttcactttcacttttgaaatatgtttttgctgggtatagaattataagctgataatg

SEQ ID NO: 40060 - DNA, 201 bp, Homo sapiens
ttcaaattgattttttattgttccttgttcttgcttttgatttttttttttttttttttgatagagtctcactctgtcgcccaggctggaatgcagtggcrcgatcttggatccatgcaacctctgcctcctggattcaagtgattctcatgcctcagcctcctgagaagctgggattacaggtgtccgccaccatgcctg

SEQ ID NO: 40061 - DNA, 201 bp, Homo sapiens
ggtgctgtgatggccccggtcttctgagcaggaaacggaggcctcagggggctgctgatgtgtgggggtgtacagggtcccacccagggctctcagacccyaagtcccgctcagaaccttagcagggtgcttcctcccagtcctgcctgccctgagggtagcagttccccctggccacaccctcaggcgctcccctgccca

SEQ ID NO: 40062 - DNA, 201 bp, Homo sapiens
tcagctcactgcaacctccacccacggtgttcaagtaattctcccacctcagcctcttgagtagatgggattacaggcatgcaccaccacgcctgactaattttttttttttttttttttttttgagacggagtctctctctgtcgcccaggctggagtgcagtggcgcgatctcggctcactgcaagctctgcctcccgg

SEQ ID NO: 40063 - DNA, 201 bp, Homo sapiens
ctccacctggcactgggcacttccctcccacggcctgtgacatggggacgacaacactgcccaatacagcagcgaagcccagatcccagcctgggagactmtccagacggccagcatcctccaccggggggtgtgctacccccgccatggccatgctgacctccgcccctcggtggggactgccctgcctgggacaggggc

SEQ ID NO: 40064 - DNA, 201 bp, Homo sapiens; identical to SEQ ID NO: 8811

SEQ ID NO: 40065 - DNA, 201 bp, Homo sapiens; identical to SEQ ID NO: 8813

SEQ ID NO: 40066 - DNA, 201 bp, Homo sapiens
gctgggctgagtggggctgtggcagaacagctcactcatctgggtagccgggtgggggatatggctggccagggctgccctaccctccctcctcctggtaygtggctgtgaggtgcaggcggcctccggggtgccgtgactgcctgcccgctgctacaggtggtgataaagtgctcctgcatttcgtccagaagtccccag

SEQ ID NO: 40067 - DNA, 201 bp, Homo sapiens
agcccccaggcaatcagggcccatgtccacggtgtggggggcagtttagggctggggttgggggcgcacattggagtactcctcgtccaggcgcctgttcrtctcctccaggatgtagtcagggtgcccgatctgctcccggatgctcatggcctgagtggggaggagggactggtcagtgggtgccccactgcggatgga

SEQ ID NO: 40068 - DNA, 201 bp, Homo sapiens
gcaggctgagaggggccgaagggcagcatggctggatggacaggcaccttgggactgtcctcagaggtgggggcgacacatggggtggcgggcagagaggygtgtcctctcagccttgggagggctggggattgtccaagggggccctccaggcatttgtctgatccagtgtccagcggccccatgggaccctgctgtccc

SEQ ID NO: 40069 - DNA, 201 bp, Homo sapiens; identical to SEQ ID NO: 8812

SEQ ID NO: 40070 - DNA, 201 bp, Homo sapiens
caggaggctttgtcggggcggtgctgcccgtgcccagatccagtcggggctgccctgacctctgcgagccacataccttctcctgcgccttcttcttggaytcctcgtccatccagcccagctcgtccagcgtctccacaaacactgtccgcaccttgtcaatgagttctctgacctgggaatcgggcatggccctcgtgt

SEQ ID NO: 40071 - DNA, 201 bp, Homo sapiens
ccacggatgagcgctcaccacctcagtcactcagggacccctgagctgggccctcggggggggatccctggccagacagcccactgcacaccacctgtccygaatgagcccctgacgccccctcccctgaggcactggtgcccccctcccctgcagcgctgatgccccccctcccctgccatgctgacgccccctcccctg

SEQ ID NO: 40072 - DNA, 201 bp, Homo sapiens
ccacctcagtcactcagggacccctgagctgggccctcggggggggatccctggccagacagcccactgcacaccacctgtcccgaatgagcccctgacgycccctcccctgaggcactggtgcccccctcccctgcagcgctgatgccccccctcccctgccatgctgacgccccctcccctgctgtgctggcaccccct

SEQ ID NO: 40073 - DNA, 201 bp, Homo sapiens; identical to SEQ ID NO: 8814

SEQ ID NO: 40074 - DNA, 201 bp, Homo sapiens
ccccgtggggaccgtcaggaggctttgtcggggcggtgctgcccgtgcccagatccagtcggggctgccctgacctctgcgagccacataccttctcctgygccttcttcttggactcctcgtccatccagcccagctcgtccagcgtctccacaaacactgtccgcaccttgtcaatgagttctctgacctgggaatcgg

SEQ ID NO: 40075 - DNA, 201 bp, Homo sapiens
atggagcgcccccaggccccttcctggctgcttctccgcggagaggggagggcgtgtgtgattggaggggcggccgctcaccattgtcgtcaaagccgtgygtgatctcgtgcccgatcaccatcccaatgcctccaaagttcaaggcctgtggctgctccttgctgaagaaggggggctggaggatcccggcagggaata

SEQ ID NO: 40076 - DNA, 201 bp, Homo sapiens
gaacggggcagccctggctgtgggcatttacatgactctgagcaagtccctcgtccctccaggcctcagtttccccatctgtacactgagggtagtgctgragccaccaccctagggcacggtgaggacagctgtgttagcgcctgggaggagggcacagagcttggcacagaggagcccccaggcaatcagggcccatgt

SEQ ID NO: 40077 - DNA, 201 bp, Homo sapiens
cctggtgaggcgggtgggtggggtggggcctgacctaggaactggtctcatggacactggagcaggctctggacccaggcttctccggagtttggccaagygacctggtgtcttcgcaggtacaacagcctgagcatcctcccagcagctctggggaagcccgtgcgtgatgtggctgccaaggtgtgtgcgggtcaaggg

SEQ ID NO: 40078 - DNA, 201 bp, Homo sapiens
tcagtgcccccagacagggccccagcctggcattcaaagcctgctctgcccccacagctccctgaggacctggcctcggtgtccccactgaaaccgtgaargggttgaatggagcgcccccaggccccttcctggctgcttctccgcggagaggggagggcgtgtgtgattggaggggcggccgctcaccattgtcgtcaa

SEQ ID NO: 40079 - DNA, 201 bp, Homo sapiens
tgtgggggtcctgctgctgcaagggcccttcacacaccccacggatgagcgctcaccacctcagtcactcagggacccctgagctgggccctcggggggggatccctggccagacagcccactgcacaccacctgtcccgaatgagcccctgacgccccctcccctgaggcactggtgcccccctcccctgcagcgctgat

SEQ ID NO: 40080 - DNA, 201 bp, Homo sapiens
tcctgcaggtcctgggcatctctgcggaggtctgtgccagcgacccgcctcaggtgagctgggccttgggggcgctgcctgccagcccacgccctgccccyaggtcccctgggaggagcactcggcttggctgggagctgagccacagcgctgtgggcatcatgccaattgtgccctgggatatggatgccactgtgaccc

SEQ ID NO: 40081 - DNA, 201 bp, Homo sapiens
caggcgactacgtccccaaggagcacatcctgcaggtcctgggcatctctgcggaggtctgtgccagcgacccgcctcaggtgagctgggccttgggggcrctgcctgccagcccacgccctgcccctaggtcccctgggaggagcactcggcttggctgggagctgagccacagcgctgtgggcatcatgccaattgtgc

SEQ ID NO: 40082 - DNA, 201 bp, Homo sapiens
cgtgatgtggctgccaaggtgtgtgcgggtcaagggtgtacaggccggggggtggtgggagctcccaggagcctttcttctaggattgactcaggctgtamccactcctgacaggccaaggctgttggcatccaggggaacttgtctggggacctgctgcagagcggagggctgctggtggtcagcaaaggtgggtcgagg

SEQ ID NO: 40083 - DNA, 201 bp, Homo sapiens
gacgtagagggagcccacggcgttctccatgttgctgttgacgtagcccacacattcacgccagcgcacctcctccaccattgtgccaaacagcgcctggbggggccacccgatcatcccacgggcccccacgtcagccttcccaggcctggcgtggggccctgggcttacggggtgagcagacccacctatcctcagcct

SEQ ID NO: 40084 - DNA, 201 bp, Homo sapiens
ctccaccaggtttgctgccagagccgactgtggctgcacctaccaactcaaagtgcagctggcctcggctgactacttcgtgttggcctccttcgagcccmcacctgtgaccatccaacagtggaacaatgccacatggacagaggtgaggcctcacccacttgctctctctacccactcctcccagggccaggatggcag

SEQ ID NO: 40085 - DNA, 201 bp, Homo sapiens
aatgtccgacgtcatggtttttagtggtatcagccgggggtcatgcatgtggacatcctgctcatccgccaggatccaggggaaatcctagggaggagacmaaggtcaggggggtgacggggctgggccctggcctgccctcactttgctgtccctcccactccagaccaggggcctccaacctgagcctcagaatcacta

SEQ ID NO: 40086 - DNA, 201 bp, Homo sapiens
atgtccgacgtcatggtttttagtggtatcagccgggggtcatgcatgtggacatcctgctcatccgccaggatccaggggaaatcctagggaggagacamaggtcaggggggtgacggggctgggccctggcctgccctcactttgctgtccctcccactccagaccaggggcctccaacctgagcctcagaatcactag

SEQ ID NO: 40087 - DNA, 201 bp, Homo sapiens; identical to SEQ ID NO: 8816

SEQ ID NO: 40088 - DNA, 201 bp, Homo sapiens
tgaaggtacagcctggagaggcaagaggttggtggaggctcccccaccgccctggtgccagccactgggcccagcctcttcccacttcccttgctggctcrgcagcacccccagagcagatggcaaagcaagtgctaagaaaagccccagtcaatagggagatggaagccaggtagaatcaatcagggaagcttcccagag

SEQ ID NO: 40089 - DNA, 201 bp, Homo sapiens
agaaggcgagcacgagacgccgggccgggcagttggggaccccgatcggtgtgagagggcttcctagggctggcatggacttccccaccacaaaatgcccmgggccgggggggggaaggggcgcaagaaaatgcggactgggccagagaccagacttcggtcaccacggtgggaagctattggtgcctagatgcctctagc

SEQ ID NO: 40090 - DNA, 201 bp, Homo sapiens
tcccaagtacctgggactccaggcatgtgccaccacacctggctaatgcagggttggagaggagtccctggcctggttccctggggacctgagggcccacytccctggtcaggctcataactgctgttgcccccacaggccatggatgctccccactccaaagcagccctggacagcattaacgagctgcccgagaacatc

SEQ ID NO: 40091 - DNA, 201 bp, Homo sapiens
tgggaggtgcagcatgttcccctgggcccctcagaaagtcgagcttggaggccagcctggatctgtctctcccttcccctcctgggaccattctacctgtrttctttgaccctcggagcagggacaggcaagacaactggcaagcttgcagctgccctgatggtgcaggtgcagggaggtgaccatgtaactctgaccaat

SEQ ID NO: 40092 - DNA, 201 bp, Homo sapiens
cctgttttctgagatgggagccttcagaagaccatgaactgctgctttggccaagcctctatggaaaatcagaagaggccacagcaaaaggctgggtacastggctcacacctgtaatcccagacttcaggaggctgaggcgggtggatcacctgaggtcaggagttcaaaaccagcctggccaacatggtgaaaccctgt

SEQ ID NO: 40093 - DNA, 201 bp, Homo sapiens
acctcatcgacctcatgaccctctggaaacgcaagtgcctgcgagagggcttcatcaccaaggactgggaccagcccgtggccgactggaaaatcttctayttcctacggagcctgcataggaacctcctgcgcaacccgtgtgctgaaggtggcatgggggcagggtggaggctgccaccaggctcgttccttctcatcc

SEQ ID NO: 40094 - DNA, 201 bp, Homo sapiens
tggtatcagccgggggtcatgcatgtggacatcctgctcatccgccaggatccaggggaaatcctagggaggagacaaaggtcaggggggtgacggggctrggccctggcctgccctcactttgctgtccctcccactccagaccaggggcctccaacctgagcctcagaatcactaggaagctgttggtgatgcagaccc

SEQ ID NO: 40095 - DNA, 201 bp, Homo sapiens
tttttagtggtatcagccgggggtcatgcatgtggacatcctgctcatccgccaggatccaggggaaatcctagggaggagacaaaggtcaggggggtgayggggctgggccctggcctgccctcactttgctgtccctcccactccagaccaggggcctccaacctgagcctcagaatcactaggaagctgttggtgatg

SEQ ID NO: 40096 - DNA, 201 bp, Homo sapiens; identical to SEQ ID NO: 8815

SEQ ID NO: 40097 - DNA, 201 bp, Homo sapiens
ggcctccctgtgttgccaaggttgcaaagccttttttcttttctttttttttttttttgagacggtgccttgtactgtcacccaggctggagtgcagtggygcaatctcggctcaccacaacctccgcctcccaggttcacacgattctcctgcctcagcctcctgagtagctgagattacaggtgcacaccaccacgcct

SEQ ID NO: 40098 - DNA, 201 bp, Homo sapiens
tccgctacatctggtttcagcacggcggcgtggacactcattactgggccggctggtacggcccgagggtcaccaacagcagcatcaccatcgggcccccrctgccctgacaccccctgagcccccatctgctgaaccctgactggtaaacaactgctgtcagaaaagggctgggcttgggaaggggaggtggaggccagg

SEQ ID NO: 40099 - DNA, 201 bp, Homo sapiens
agggtcgggacagttaccccctccttttcacagcttcccaactggtcactgcagaccaggattcaaacccaggcagtcttctcagccaccctccatctgattttttttttccggccatctccaagtggattctggcctgacaccaaagacagctcagccgggtgccgtgggggattcccatggggttgttttatcacatgt

SEQ ID NO: 40100 - DNA, 201 bp, Homo sapiens
tgaacccaggaggcggaggttgcagtgagccgagattgcaccactgcactccagcctgggtgacagagcaagactctgtctcaaaaaaaaaaaaaaaaaagattttatattctaacagtgaatccagagcattaaaataacaatcaccaaaaccctcacagaactttgcagacaagtgtggcctccacaaaatcttacagt

SEQ ID NO: 40101 - DNA, 201 bp, Homo sapiens
ttgtattgcactcttctgaatgtgtgtcccatgactactctttccactgaggggctactgtttactggaaggaccctcagcctcagaaatgctcttttgtgggtttttttttttttttagccagagtcttgcttggttgcccgggcaggggtgcagtggcgcgatcataggtcactgtagccttgaattcccaggctcaag

SEQ ID NO: 40102 - DNA, 201 bp, Homo sapiens
acctgggaacacagaccaacccgagataaccatggaaatgccaagggaagagagggtggggagtggacacacctggggggttgtggtccaggacggcatcrcacacgctgatcttcaggatgaaggcccggagcagctgctccacatgagacaacagcgagtctgagctgggagtgagaggaggtcttcccatcacactgg

SEQ ID NO: 40103 - DNA, 201 bp, Homo sapiens
actaacgcatgtgccagaggtcaacttcgagttgactggacacttgcctggggagtcagaaaactgcttctgtgtcctgggctctgcccccacccaggtgrccctgggtagctcatgtcatctctctggacccatctcagctgctcacaggctgtccccttgtcatgctggtgcttcttgccctttctcctcccaggcctt

SEQ ID NO: 40104 - DNA, 201 bp, Homo sapiens
gtattgcactcttctgaatgtgtgtcccatgactactctttccactgaggggctactgtttactggaaggaccctcagcctcagaaatgctcttttgtggktttttttttttttttagccagagtcttgcttggttgcccgggcaggggtgcagtggcgcgatcataggtcactgtagccttgaattcccaggctcaaggg

SEQ ID NO: 40105 - DNA, 201 bp, Homo sapiens
cctggacatctgggatgccatctgggtcaagtaagcagtctgtgttgggatgaacacgttagccttttttaaaaaattattttacttattaaaaaaaaaaggggggggggtgtcgctatgttccccaggctggtcttgaactcctgggttcaagcaatccacctgccttggcctcccaaagtgctgggattacaggcgcaa

SEQ ID NO: 40106 - DNA, 201 bp, Homo sapiens
gaactcctgatcttgtgatccgcccgcctcggcctaccgaagtgctgggaatacaggcctgagtctgtgcgcccgacctaatttctttttttctagagacrgtctcactatgttgcctagactacaagcatttttaattgacaacttttacattttttttcaaatgcttacagttgcttctcagaacttagaagacttggc

SEQ ID NO: 40107 - DNA, 201 bp, Homo sapiens
acccccttgactctcccactgaatccacagcctggtccattgtaagtacaggtgacatggcttggacagaccaggcctctctggaggggtcttttgatttytgaggtcatatctttagtaggatgcccaaaagggtccctcttctcagatggggtaacagaggccagcatggacagacagcttatccccgggccacagtgg

SEQ ID NO: 40108 - DNA, 201 bp, Homo sapiens
caggaccccagttctaggcaggccccagggctgccactctgaggataaagcggtgaggatggaggggtatgcagagctgcaggggggagaggtggctgggytgagcagagggtgagctttgtgccagccccattacacaggccacccccttgactctcccactgaatccacagcctggtccattgtaagtacaggtgacat

SEQ ID NO: 40109 - DNA, 201 bp, Homo sapiens; identical to SEQ ID NO: 8817

SEQ ID NO: 40110 - DNA, 201 bp, Homo sapiens
gtaagctaggaacttgagtttacaaaagtgccctggaacaatgggcctttggactgggatcaaatgccgcccaggcacaagtgggtcaaactccctcctgyactggaggaaaagccagagtcagccccagccagtgcctgtcccgcagcggccaaggggtaccctaggtccccaaaccacctccctgggctcacaggggct

SEQ ID NO: 40111 - DNA, 201 bp, Homo sapiens
tccaaggtgcagttggggtacacttgggctggtggggtaccttggccacacaatgcccttgagaaggaacaagctggttaaccctttggtgtccacagccscagagacctgagcatgagcaagtcctgcctcccaagaaggtcactaacgccaaccaccctccctcccgccctcctgggactaagtggggagggctggact

SEQ ID NO: 40112 - DNA, 201 bp, Homo sapiens; identical to SEQ ID NO: 8821

SEQ ID NO: 40113 - DNA, 201 bp, Homo sapiens; identical to SEQ ID NO: 8820

SEQ ID NO: 40114 - DNA, 201 bp, Homo sapiens
agtcaaagatcagaagagagatctgagctagaaatgtaagtgtggaattgaatgattttacctagaaagctgtgagctagaagagaaaaatggtgtaaaaycctttaaagagaagaattttaaaaagtgaattgttagcttgaaagtagggtaacaacaacaacaagaaaatgattgaaaagttgtatccacagggatggg

SEQ ID NO: 40115 - DNA, 201 bp, Homo sapiens
accgtccctcaccgaggaggacctcactgaagtgaagaaggacgtgagtaacgcagctgtgcccagggcgggcgggggcgggctgcagcccagcgggagasgaaagcggaagcctggagtccgaggacaaggaggatcctccaggtcggaggagcggaaagtcctagcacaggaggactgtggcgagccctgcatccgagg

SEQ ID NO: 40116 - DNA, 201 bp, Homo sapiens
tattagctaatattttttgtaccagaatactaaagaatatttattgtgaaagctatttcttattttataaaaaattttaggtggttaagtttatatgtacrctgtaccttaaatgagaattacagcatgtcgtttaacttccacgagactattttgttatatagaaaatgcaaataatagtatacttcatggttgttgaga

SEQ ID NO: 40117 - DNA, 201 bp, Homo sapiens
ccgaagcccccagccagggcggggcggcgcagcccgagctcccggacccggaagaagcgccatctcccgcctccaccatggagcccaccgcaccgtccctsaccgaggaggacctcactgaagtgaagaaggacgtgagtaacgcagctgtgcccagggcgggcgggggcgggctgcagcccagcgggagaggaaagcgga

SEQ ID NO: 40118 - DNA, 201 bp, Homo sapiens
acgtaaggaaatgtagagagacagatagttttaggtagagcataaattttcaggacaaaggtagtgatagattaagctggagaggtaggtaggagccataktatcaatgaaccttgtcttccataattagttattattgagtacttactgtgtacagagactatgcgtggccttcatatatagtattcccatttagtcctc

SEQ ID NO: 40119 - DNA, 201 bp, Homo sapiens
tggggagagaccaggcaacaggagcaggtacttctgagcctgcaggggcagggaggcttccctggcccccaagagatgcccgggtccacagccatggctgratggctgcagctgtgcctgagagggcagggctcctgcctgattctggcccccaagagcacagggatgtccaggtctggagctgtgcctgggcagctgcag

SEQ ID NO: 40120 - DNA, 201 bp, Homo sapiens; identical to SEQ ID NO: 8823

SEQ ID NO: 40121 - DNA, 201 bp, Homo sapiens; identical to SEQ ID NO: 8824

SEQ ID NO: 40122 - DNA, 201 bp, Homo sapiens
gccacttaccgacgacctgcgcaggcgtggcttgaggaaacgcccgctgtgggcggagccacccgaaaggctccggtcgggggcgggaacaggatcggccygcgggctggcgtcgataggctgccgcagagacagggcgggctctgctaagggacgcgcctcgccgtggggcggtgcctgcgcctgagcctctacgagagg

SEQ ID NO: 40123 - DNA, 201 bp, Homo sapiens; identical to SEQ ID NO: 8826

SEQ ID NO: 40124 - DNA, 201 bp, Homo sapiens; identical to SEQ ID NO: 8827

SEQ ID NO: 40125 - DNA, 201 bp, Homo sapiens; identical to SEQ ID NO: 8828

SEQ ID NO: 40126 - DNA, 201 bp, Homo sapiens
ttgctgactgtactcataatgctctctccttatatccacacggttcactccctcacttcctttaagcataaatcaaatcccttatcttggtattgacaagmcaaggacagactcctccaaagtgagcagggaggtcatgaccaccctagcttaaattttaccaatccatacagcctcatcctacttccctgttttattttt

SEQ ID NO: 40127 - DNA, 201 bp, Homo sapiens; identical to SEQ ID NO: 8829

SEQ ID NO: 40128 - DNA, 201 bp, Homo sapiens; identical to SEQ ID NO: 8830

SEQ ID NO: 40129 - DNA, 201 bp, Homo sapiens; identical to SEQ ID NO: 8831

SEQ ID NO: 40130 - DNA, 201 bp, Homo sapiens
gacccggaagaagcgccatctcccgcctccaccatggagcccaccgcaccgtccctcaccgaggaggacctcactgaagtgaagaaggacgtgagtaacgsagctgtgcccagggcgggcgggggcgggctgcagcccagcgggagaggaaagcggaagcctggagtccgaggacaaggaggatcctccaggtcggaggag

SEQ ID NO: 40131 - DNA, 201 bp, Homo sapiens; identical to SEQ ID NO: 8832

SEQ ID NO: 40132 - DNA, 201 bp, Homo sapiens
ccctgcatccgagggaccttggtggcagtgatcctccagtgatctgtcaatccaggttttacatcgctaaacgcagagcttgggctttgttgccaagtggwgttttgattcttgcccactcctcacccatctcctcatgctttccccccaactgggttcttggagatgcttcgttagggactggcggctcagattcatcct

SEQ ID NO: 40133 - DNA, 201 bp, Homo sapiens
aagtgcaggatatacagtgttggctaaaacatacctcgtagctgcctgcttcaaacagagacgttagtttaaaacaaataaataaattttgttttcattaytgcaattactatgaaggaatcaaacagtgccaagacaataataggggaaatcgacttgagataggatggtcaggagaggttatatttaaactgattcctg

SEQ ID NO: 40134 - DNA, 201 bp, Homo sapiens; identical to SEQ ID NO: 8833

SEQ ID NO: 40135 - DNA, 201 bp, Homo sapiens
agagactatgcgtggccttcatatatagtattcccatttagtcctccttgatgtcctgtgagttaagtttttaatccttattttatcaataacatacctgragcttggagtggtgaagtaacttggcccagctctcacaagggtgagtactagattcaagatttgcactgaggttgatccaactttagagccatgccctta

SEQ ID NO: 40136 - DNA, 201 bp, Homo sapiens
aaattttgttttcattattgcaattactatgaaggaatcaaacagtgccaagacaataataggggaaatcgacttgagataggatggtcaggagaggttayatttaaactgattcctgaaagatttgacagaactgagggaagagcattctgggcagaatagaatttgtcaaggacctaaaataggcaagaccctggtgac

SEQ ID NO: 40137 - DNA, 201 bp, Homo sapiens
tgtatcagctcagcttctggaggaactggagactgaggtcactcgtgggcaattaactgtgcctatatggccaagccccaataaaaactctggacaacaargctcaggtgagtttctctggatggcagtattccatgcatactgtcacgtgtctctgccacgagaagttcatactgttcacaattccactaggagaggaca

SEQ ID NO: 40138 - DNA, 201 bp, Homo sapiens
tgaaggaatcaaacagtgccaagacaataataggggaaatcgacttgagataggatggtcaggagaggttatatttaaactgattcctgaaagatttgacrgaactgagggaagagcattctgggcagaatagaatttgtcaaggacctaaaataggcaagaccctggtgacttggggaaatcggaggaaggcagagggta

SEQ ID NO: 40139 - DNA, 201 bp, Homo sapiens
acagggcagaacattgtttttaattttttttctaaattaacaaaatttcaatattagaatttgctgggcacagtggcccacacctataatcccaacaactyaggaggataaggtgggaggatcacttaaggccaggagttcaagaccagcctaggtaatgtagcaaagatcccttctctacaaaaaaaaaaaaaaaaaatt

SEQ ID NO: 40140 - DNA, 201 bp, Homo sapiens
ccttgccaactgatagctaaaatgtacagtagtgtttgccctcatctttactcccgaagatggccctcaacagacctccctgtttccaaggacccaggccytctagattcagctggtccctcttcacaacagcctggtcttggtttttaggtttgaaggtgagatcaaagcagtgaggaatgtctaggacctacttgtgtc

SEQ ID NO: 40141 - DNA, 201 bp, Homo sapiens
attgtcaactcagggtttctgtgcctgtaggttgaatatttgctaagcctaacagaagggtaaattgtgtttgtgtttattctttcaatcctctggataayggttaactataccctttggatatcataaaattctttgatggtatctaagttgttttctgctgtagcaatacctgagactgggtaacttttaaagaaaaga

SEQ ID NO: 40142 - DNA, 201 bp, Homo sapiens
tccaggttttacatcgctaaacgcagagcttgggctttgttgccaagtggtgttttgattcttgcccactcctcacccatctcctcatgctttccccccarctgggttcttggagatgcttcgttagggactggcggctcagattcatccttaagtcaggctgcctaggctgctcactcagcctagagcgaaggctgtacc

SEQ ID NO: 40143 - DNA, 201 bp, Homo sapiens
tacattctagttgagataagaatggaacataaataactactgtagaataaatgttgtcttattcatggtgagtgccagtaaaaccttgaacttccaagagytaggcctcctatgttccagatgctgtgtcacacagtttacaatgttcccacttaaccttcgcaacaacctctaaagaagataattgccattcccatttta

SEQ ID NO: 40144 - DNA, 201 bp, Homo sapiens; identical to SEQ ID NO: 8834

SEQ ID NO: 40145 - DNA, 201 bp, Homo sapiens; identical to SEQ ID NO: 8835

SEQ ID NO: 40146 - DNA, 201 bp, Homo sapiens
gaggactcatagtataagttgcctagaacatattagtaaggactcaataaatgtttgagtaggatgagctgggtggctcatgcctgtagtccctgcacttygggaagccgaggcgggtggatggcttgagcccaggagtttgagaccagcctgggcaacatggcgaaactccatctctataaaaaatacaaaaaaactagc

SEQ ID NO: 40147 - DNA, 201 bp, Homo sapiens
gaggctgatactgtggttggttctaacagttcaaaaattaaaaatgaaaacacaatcctaacttgaaaagagctcaatttcttgagggggattgttttaartcacaaaataagtgcagtgagttttgcattcaactgaaacattaactacttggtgccctagtaagtgcaggatatacagtgttggctaaaacatacctcg

SEQ ID NO: 40148 - DNA, 201 bp, Homo sapiens; identical to SEQ ID NO: 8836

SEQ ID NO: 40149 - DNA, 201 bp, Homo sapiens
aaagcaaaactatctctcaatatacctcagaaacaaagatgtctccatcaagtttatactcacagcaagtgctatgttcttcaatacctttatcgaaaaaygtgcacagttttttcagtgccttctgcacagaagataatattgaacagagtatctcatatcttgatcaggtaacatgtttttgtaaaaaacagtagcata

SEQ ID NO: 40150 - DNA, 201 bp, Homo sapiens
ggaaatccagttaggaggcactattggagtggaaacgaaagacaatggtaattggactagggtcataatatgaaggaagaaatgcttggatttgggatctrttttgaagttagaccagtagatgagttgaatatgggaagtgaaagtttatttattttacaatcaaaagataatgtgtaagcttatagtattttcttacat

SEQ ID NO: 40151 - DNA, 201 bp, Homo sapiens
tgagctttgtgggctggagtagttggagaaggttatgtgatggggatggcggttgtgcactgttttgtaaaagcattagttttgaaatacgtgcaagaagraagcacaggtggaggcacagaggctgaagtgagtgtgccacaagtgggactcggttcatattgtaaacatttactgagcacctgctatgtttcaggtact

SEQ ID NO: 40152 - DNA, 201 bp, Homo sapiens
caatcaaaagataatgtgtaagcttatagtattttcttacatagaatgttattcaaacttctaaatttgaccagtcagaactatctgtatagatatagacrcaaattctagccaccattcacaaataatgcattttatatctaagagatagcataacatagttgtctcaattgtttttatatattttaaatatttagcttt

SEQ ID NO: 40153 - DNA, 201 bp, Homo sapiens
ttactgagcacctgctatgtttcaggtactgttggctgcaaagatgcagacattccctgccctctagaagttcataaactagtcgggaagacatctaaccrtaatactatagaatgattaattgtaatactggatgatatcattgttaaaaacctgatcagtggcatttgtagtgtatggcatcatttttagttatgtttc

SEQ ID NO: 40154 - DNA, 201 bp, Homo sapiens
gaggatagtcactaagatctgcctttcttttcccaacagttcaatcaatgtactgaatataactgctgaagaaattaaaccaaatcaggttggaggagaaygtacaaatcaaaaatggagtgtggcatcaagacctggatcacaggaaggttgctatagtggatgctccttgagctacacaaattctcatgtagaaaaaga

SEQ ID NO: 40155 - DNA, 201 bp, Homo sapiens
gacaaaaattatatatatttgtcatgttcaacatgatgtttcataatacacattgtgaaatggctcagtgtgcatacctcccatacttatatcattttttktggtgagaatttacttgctcagcaatttcaggaatatagtacgtagttattagctgaggtcaccgtgttgtacaatagatctattaaacttattcttcct

SEQ ID NO: 40156 - DNA, 201 bp, Homo sapiens; identical to SEQ ID NO: 8840

SEQ ID NO: 40157 - DNA, 201 bp, Homo sapiens
tttaaaacaacaaactactgatctctggtaaagtgctatttcccttacataattgactatcttaaaaaactgtaggacatttgtataattttctaaccagtttttgcccaacaagactgcttgctgttttattttatgcattttttatcactcatgccattctaccattggttttggtggttcagaatggtgctgtttatc

SEQ ID NO: 40158 - DNA, 201 bp, Homo sapiens
cttcagattgctaataagaataattaaaatatgtggtaggcattctcaatggggacactattggtattttgaataggacactcaactgctatgctactttyaattactgtgacaactgaaaagactgttcctatgtgttttcagacatttcctgaaaaatgctggagatgattttccggggaattaatacatgtcaagcac

SEQ ID NO: 40159 - DNA, 201 bp, Homo sapiens
ttttattttagaggatataatatagaaatattacttagtacaatgctataccttagatgtatgttgagtcaaatcgtgtaccatgtatcttgtatataaastaatatgaatacctcagtagaacttgggaagcctttaaccttgatccttacatattatttatatttctatgtatatacacacaccatgttctatatctgt

SEQ ID NO: 40160 - DNA, 201 bp, Homo sapiens
aaaggctgtgccttagattccaggcaaggagacttgtgcgtaagttacctaaaaaacttagtttgatcatttgtacagggattctgatgaccgaattactrtaagtattggtaaataaatttatagtaatttggtcatcagaatcccttgtacaaatgattaaactaggcatgcactactactcccagctaattttttgta

SEQ ID NO: 40161 - DNA, 201 bp, Homo sapiens
aaacaagaaaggaagcttttaaaagaaggaggagaacacactataagttgtagttgacttttaagaggtggggggattaggactccaagtaaatgttagargggatgaaaaagagctaggtaagagcactctagccaagtgtaggaaccctgagggtgggacacacctcatacatttgcaatggtgaccaagacctagagg

SEQ ID NO: 40162 - DNA, 201 bp, Homo sapiens
ttctttaaaggtcatctagtttgacttcataattgaaacccaaagaaattatgaccggttcaaggtttctcagtacataacagaagtgttgctgagaaccrtggcctctgatgctactcagtccagcgctctctcagtaccctgtgcagcttccctgaagtgacagcgccctggaaaactaacagtttaattggcagccaa

SEQ ID NO: 40163 - DNA, 201 bp, Homo sapiens
atcagagagacctatggaaggtcttattaagtactgggctgatgcagagttgtaacccttggccacatgtcttataagtagctagtaaatcattatgataygttggtgatctgaggctattgagcctttacttcaaggagtggtcccatttattaggactacccagagcagagactgtttcttcaggatgtcttctaatat

SEQ ID NO: 40164 - DNA, 201 bp, Homo sapiens
tagatctagcatatgattaatccaacttgttgaacaaaatttattgagtatatgctaggcactgagtttcaaagatgagtgaaaccccagtcctaggtcaygaggagattgcagtccagggaagggagacatattgaaacataactgtttgcttcattaattgttcttggggtaggacgcaagggaaggcttcatggagag

SEQ ID NO: 40165 - DNA, 201 bp, Homo sapiens
aacttgttgaacaaaatttattgagtatatgctaggcactgagtttcaaagatgagtgaaaccccagtcctaggtcatgaggagattgcagtccagggaarggagacatattgaaacataactgtttgcttcattaattgttcttggggtaggacgcaagggaaggcttcatggagaggtaacacctgatctgagattgga

SEQ ID NO: 40166 - DNA, 201 bp, Homo sapiens
taacagattggtagtattctaataggctttaaaatgttcagaagagaagttgtgcttccttggaagagttactggcaagtagcttttgagtattggcaggrgctagaatcaccatgagccggatcctgggccattcccctgtctgctccgcctcagagaccctgacctctgctagcccattgctgacctcaactactgata

SEQ ID NO: 40167 - DNA, 201 bp, Homo sapiens
tcgtctagtcaaccagtttcttcattaaatgggcacagaagcagttcacattaaaaatctaatttctgacacaaaagatacaattctgatttctgctttaktggttacttagcagaattctaatttctactttagtggttacttggacctatagcactaatgcatttcaaaatatattttttaatttgtgtagaaagaaac

SEQ ID NO: 40168 - DNA, 201 bp, Homo sapiens
ataggctcagagctaaagtactatacttcagtttggtggtttgaaagcaagattttgcatacatttattttttcattttattttattttattttacttttygagacagaaccttgctcggtcacccaggctagagtgtagtggtgccatctcggctcactgtaacctccgcctcccaggttcaagttatttctcctgcctc

SEQ ID NO: 40169 - DNA, 201 bp, Homo sapiens
agaaccttgctcggtcacccaggctagagtgtagtggtgccatctcggctcactgtaacctccgcctcccaggttcaagttatttctcctgcctcagcctsctgagcagctaggactataggcgcacatcatagccagctaattttttggtgtgtttttagtagagatggggttttgctgtgttggccaggcttatcttga

SEQ ID NO: 40170 - DNA, 201 bp, Homo sapiens
gtgcatgagctgtaaacattctgaattctggaatagtcaaaaatatattcatacttgattggtttggctgtgtatagaatttagattccagttttttttcyttcaaaactttgaattattccatttctcctagtgtttagttttactgatgagaagcctgattgtaatatacctgtgttactttgtagataactgtgtttt

SEQ ID NO: 40171 - DNA, 201 bp, Homo sapiens
gattacagacgtgagccaccgcctctggccagcctgtatttttctgccctgccattttgttcactcttggcagtttgtgtgccgtgtcccaactgtagctrcagtcacagtgaccagaaatacttcattttgtccaaaaggttcagtcaccttttgcagacattttatcatgaaaaataaagtagtagaattaacaggaat

SEQ ID NO: 40172 - DNA, 201 bp, Homo sapiens
gtttctttctcaggaatgaagatgaaatgtataaaattctcttgaatgattatgaatatcgtcagaaacaaatcctaatggaaaatgcagaacttaagaargttcttcaacaaatgaaaaaggaaatgatttctcttctttctccccaaaagaagaaacctagagaaagagtagatgatagtacaggaactgtaagtggct

SEQ ID NO: 40173 - DNA, 201 bp, Homo sapiens; identical to SEQ ID NO: 8839

SEQ ID NO: 40174 - DNA, 201 bp, Homo sapiens
gaagtagaatgggtaggattttatgaaaaattgaatttggagactaggggtcatggattcaagaccccattcaggtttctgccttgagttactgaggatgrcgatgtgattcactaagaaaggaaggaggggtgtgtgcagatgttcaggggtggtgctgagttcaggtaaagtgttgataatcatgctgagtgaatttct

SEQ ID NO: 40175 - DNA, 201 bp, Homo sapiens
cttgccgaatctgtaaaaagttagattaggaaatatttatgctctgggaaaataaaataacaattctgtcaccccatccaatcttggttaagaaagtataygcttcatttaaaagtcttattgtaagaggctgcacaggttaattccaagaaaaatattattgaggcatctgtgatgccaaatgagctaaggctcaataat

SEQ ID NO: 40176 - DNA, 201 bp, Homo sapiens
ggccgctgcagtggaagagaaccccgatagtggtctagtaaaaagtctaggggaagaatttacatcatccaagaggcaggcatgtgtgaaaatactttggwttataattttatcatgaaaatactttggtttagaattttatagtcaacgacagtaaactgaattgtgagctccctgcacattttttgagcctatgctgat

SEQ ID NO: 40177 - DNA, 201 bp, Homo sapiens
cttttcccaacagttcaatcaatgtactgaatataactgctgaagaaattaaaccaaatcaggttggaggagaatgtacaaatcaaaaatggagtgtggcrtcaagacctggatcacaggaaggttgctatagtggatgctccttgagctacacaaattctcatgtagaaaaagatgacttaccttagacatgtggactgg

SEQ ID NO: 40178 - DNA, 201 bp, Homo sapiens
catagccagctaattttttggtgtgtttttagtagagatggggttttgctgtgttggccaggcttatcttgaactcctggcctcaagtgattcacctgccktggcctccccagagtgtctggattacacgtgtgagccactgtgcacagccgacattttacatacatttagatgtgaggtttgaacctcactgagaaaaat

SEQ ID NO: 40179 - DNA, 201 bp, Homo sapiens; identical to SEQ ID NO: 8849

SEQ ID NO: 40180 - DNA, 201 bp, Homo sapiens
tatttttctttagtgtgcttttttcacttaactattatccttatacatagctctacattgatgaatatattcttaatattttctgcttggtaaagtttgartgcttttaaactaggaaaatgaagatttctgctcagtaaatgaagcctatttaaagaaaaatttaaattgtcaaaatatgaactcagtgccattgtgtta

SEQ ID NO: 40181 - DNA, 201 bp, Homo sapiens
ttgacatatatgctacatatcacctggcctagtgcctgtaagttatgtcatgccaactgatctaccctagtagtaagttttacacattcaaaaaaaaaggktgccaaaaactgacaaccttagagttatccaggttatactcctacattttctgtaccttcttgagatctgttcttacagaaattgtgcaagttattattt

SEQ ID NO: 40182 - DNA, 201 bp, Homo sapiens
agatctgacgaacacttaagaagtagaatgggtaggattttatgaaaaattgaatttggagactaggggtcatggattcaagaccccattcaggtttctgycttgagttactgaggatggcgatgtgattcactaagaaaggaaggaggggtgtgtgcagatgttcaggggtggtgctgagttcaggtaaagtgttgataa

SEQ ID NO: 40183 - DNA, 201 bp, Homo sapiens
gaccataagagccactttacttgaaaaaagaaagaaccatttattcatctttccccaaattgatatggtggacctttgtgtaatagtatttaactggaagstcaggaaccctctccactacagaccccgcccccagtggatccatttggcttagatattagttcatagctggtaacagccagtgtcctggactgcccttcc

SEQ ID NO: 40184 - DNA, 201 bp, Homo sapiens
aagaaacacgaaagtagagctttacaatacagttttgctggcctggtataaatacgaggcacaagaagtgtgtgtatttatttattgaagagtggtttccwagtgactataggtagtcctctaacatacattataccgtgacacccctaaactgtcttaccttagatttgaaaaacaggcgatgagcgtacgtttcaggct

SEQ ID NO: 40185 - DNA, 201 bp, Homo sapiens; identical to SEQ ID NO: 8854

SEQ ID NO: 40186 - DNA, 201 bp, Homo sapiens
gctaatactatgcttagaaataattgtaaaaggattgaacacagtaactcacgaaatgttattttcatgctttatacaattgattttcagtggtgtttgtktatataaaaaatgtagacaactggttagtggaaagtaagtcattctgccttgctttatttaattgcatgtattttttaacatgaccagtgtagaattaat

SEQ ID NO: 40187 - DNA, 201 bp, Homo sapiens
tctatagaatatttaaaaaccccctagcaggaaatgtgctgtaatgatgtggcatagagttggcctacatgggaacactagaaacacttggggattggttkagagacatctttgctctttacgagcacctgtgcctaccatcctgtcattgataatgctgtcttatgttgtcttcttggttcatacacaatgataaaagtg

SEQ ID NO: 40188 - DNA, 201 bp, Homo sapiens
agtgtgctttgtaataattcctttaaataaacatttcatgtgccactaacatttgattttgactaataaacactaggatgtataacttcttgttactgatmttttaaggattcagttattctaaatcctttattaattttaagcaaaattgcttataaatgttttaggaacaactggaaacctccaggagggaaatgattg

SEQ ID NO: 40189 - DNA, 201 bp, Homo sapiens
tgattttattaactctaagattataataatttactctttttcctttttacgccaaatgtttccatgtccacctgcagcagaagatattactactatcaggrgctttgactcctttgatgaaaatgatgatgttaatgttaacaggacatggcaaactttttctgtatagatccatatagtaaacattttcagctttatggg

SEQ ID NO: 40190 - DNA, 201 bp, Homo sapiens
agtaattctttcaataaacattcattaaacgcttagtaagctgctacttgcctgacctgaggataaaaagatgagtgttgccttgaggaatttgtattttrgaaattatcagcatagtgaggcaggaagcaaaaaaacctcacaaaaaacaaatataggaaggctttcaaaaagaaggagaatttcagctgtgtctggtag

SEQ ID NO: 40191 - DNA, 201 bp, Homo sapiens; identical to SEQ ID NO: 8844

SEQ ID NO: 40192 - DNA, 201 bp, Homo sapiens
ttttgagatggagccttgctttgttgcccaggcaggagtgcaggggtgcgatctcagctcactgcaacccctgcctcctgggttcatgtgattctcctgcytcagcctcctgagtagctgggactacaggcgcacgccaccatgcccggctaaattttgtatttttagtagagatggggtttcaccatgttggccagactg

SEQ ID NO: 40193 - DNA, 201 bp, Homo sapiens
tagaatgggatcatttccccttaccagatttgagaattgaacttaagaaaaaaaaacgctataagcatttattactgctttcagattggctttctcctgcyaagtgttttacacaagaaatctcttttgggtatccatcattcatccacggtcagtaggtgtggtgtcagaagacagtgcaaccaagactatatttgctgt

SEQ ID NO: 40194 - DNA, 201 bp, Homo sapiens
aaaaaaattaaaaagcaggatgaaatgctgaaagtataaagtgtaacacagagaagtttattaaggatttagttctggaaacagagctcttccattatagyggtctggctgtttcctggtccaatcggaagtgacagtttcataatgattttattaactctaagattataataatttactctttttcctttttacgccaaa

SEQ ID NO: 40195 - DNA, 201 bp, Homo sapiens
ttgcttacaagtggtggaactagaaactcgaaaattaggctgtttaagcccaaatcctaacctatataccaggttcactttcaccacttacgtgtatagartgcattagagttttagacgcttaagcatgtatggtaagaattaattttatgtgttcatgtttgtagctatggacattttgaattatgtcgggagagctga

SEQ ID NO: 40196 - DNA, 201 bp, Homo sapiens
aaaatgctagttaacagcaagataccagaacttgttttttaaacctgtatttgaggattatttattttgtggtatcacaaatcagtccagctgataagccyatcccagcacttacctttttttctccttaacatttaaaaaaaaaaattacctaaatttttttttttttttttttttaagagacggagtcttgctctgttg

SEQ ID NO: 40197 - DNA, 201 bp, Homo sapiens
aatttttcaatgaaaatataaaataattactgcagatgttgaagatgtgactaaagagagacaaatcgttgtaaaatacttattttcatgtctactgagamcaccactgtatttgtatctttttggaaaaaaaagtatatcattttcataaagaggctttgccctaatttgaaaataccttaaaatatgtatgtatatatt

SEQ ID NO: 40198 - DNA, 201 bp, Homo sapiens
ctagcattttaaaattgggagacttcacataaaaattcagagttccagtatctcataaaaacatcaaagatcaacacaaccgctttccccttgaccacaayttattgtagccgagaagcagctgtccacagtattgacatgtgttccccaggctgcctgcagtcttcacccttcctcctcttccccctgaccttgaaatca

SEQ ID NO: 40199 - DNA, 201 bp, Homo sapiens
ccctgtgcctaggaaaacgtagtagcacatagtaggagctcaattagtatttattggatgaatataaatttcttttttctttttgagatggggtctctgtygcccaggctggagtgcagtggcacgatctcagctcagtgtaaccttgcctcccgggttcaagggattcttctgcctcagcctcttgagtagctgggatta

SEQ ID NO: 40200 - DNA, 201 bp, Homo sapiens
actctactgtgttgggtgctttaatagttatttctttgtcttctcaacaactctttggtagatacttttgttattcccagtgtccaagaagaaacaggctwagcagttaaataatgtgccgagatctcattgcttacaagtggtggaactagaaactcgaaaattaggctgtttaagcccaaatcctaacctatataccag

SEQ ID NO: 40201 - DNA, 201 bp, Homo sapiens
aaaggtgaatttttcaatgaaaatataaaataattactgcagatgttgaagatgtgactaaagagagacaaatcgttgtaaaatacttattttcatgtctrctgagaacaccactgtatttgtatctttttggaaaaaaaagtatatcattttcataaagaggctttgccctaatttgaaaataccttaaaatatgtatgt

SEQ ID NO: 40202 - DNA, 201 bp, Homo sapiens
actagaaactcgaaaattaggctgtttaagcccaaatcctaacctatataccaggttcactttcaccacttacgtgtatagagtgcattagagttttagaygcttaagcatgtatggtaagaattaattttatgtgttcatgtttgtagctatggacattttgaattatgtcgggagagctgatggaaaaagaggctcctg

SEQ ID NO: 40203 - DNA, 201 bp, Homo sapiens
ttcccgaatatcttttacattctccattttgaggcctgcttgacctcttatatgtagttaacctcttatctcaaactctgtcacttctagtcagttcttarcattcactaatacttcttcaaggttagcatagtgtccattactactgcagcatcttcagtttttggtccaaccttaacgtctcatcatcagatttcagtt

SEQ ID NO: 40204 - DNA, 201 bp, Homo sapiens
tgctgggattacatacaggcatgagccaccgcgcccggccaataatttttctaacagattggtagtattctaataggctttaaaatgttcagaagagaagytgtgcttccttggaagagttactggcaagtagcttttgagtattggcaggggctagaatcaccatgagccggatcctgggccattcccctgtctgctccg

SEQ ID NO: 40205 - DNA, 201 bp, Homo sapiens
ttacttagtacaatgctataccttagatgtatgttgagtcaaatcgtgtaccatgtatcttgtatataaagtaatatgaatacctcagtagaacttgggargcctttaaccttgatccttacatattatttatatttctatgtatatacacacaccatgttctatatctgtgcatgggaataggtattgcaaaatccttct

SEQ ID NO: 40206 - DNA, 201 bp, Homo sapiens
aagagtgctttaaatgcagatcttttattctctgctgtacctgtacgtgatagctgaggtgccccttcttgcatgcactgtcttaaatattgacattgttygtctagtcaaccagtttcttcattaaatgggcacagaagcagttcacattaaaaatctaatttctgacacaaaagatacaattctgatttctgctttagt

SEQ ID NO: 40207 - DNA, 201 bp, Homo sapiens
ttcagtaggagaaataacacagttataatgcagtacagaatctgggtgtcagacataaaaatgtcagactctagcaatgtaggattctgagatgagagaaraaatagtctttcaaattagcaaaaataagtttttaaatagaaatgaaactacaagcagttaaacattcagaacaatcttaactccagttgttctcatctt

SEQ ID NO: 40208 - DNA, 201 bp, Homo sapiens
tttaggatttttctctttcaaatttgtgaatcgttactgggcttataatagcaaatgcctttttcaggtgcaaaaattacaaaatatcattgcaagtcgarctactcagtataatcatgatatgaagagaaaagagcgtgaatataataaactgaaggaacgtctacatcaacttgttatgaacaagaaagataagaaaat

SEQ ID NO: 40209 - DNA, 201 bp, Homo sapiens
aaatttcagaattaaaaaaactttatgtgattcatataatatttaaaaaagtggtttctactggttacaaataaggaagaatcatcctaggattttaaaayctatatggggagatgaattttaggatttttctctttcaaatttgtgaatcgttactgggcttataatagcaaatgcctttttcaggtgcaaaaattacaa

SEQ ID NO: 40210 - DNA, 201 bp, Homo sapiens
tgttgaagatgtgactaaagagagacaaatcgttgtaaaatacttattttcatgtctactgagaacaccactgtatttgtatctttttggaaaaaaaagtrtatcattttcataaagaggctttgccctaatttgaaaataccttaaaatatgtatgtatatattatatctatgtttatatgtatatatgtaattcaaagt

SEQ ID NO: 40211 - DNA, 201 bp, Homo sapiens
cagatctcttatcctaaaactatcaacctacaggcttaggaagcttaggttattcattcacactaaacaagtaaggaaagctaatagctaatttaacactytgttctgcctgctgttaatgaaggtttctcaaacaaaacggttctttgagaagagggttaggaactgataattaaaacgaaggctcttttagtgactggc

SEQ ID NO: 40212 - DNA, 201 bp, Homo sapiens
gtccaattgtatacttgggatctcctagtacttgacagtctgctttttggccaaagcaggccgtgacaccggttttataaagtaggcgtttgagtgccttytatgtagtatacccctagagaaattaggtgcatgaaaagacaccgcccccaaattgtgtgattttaattcatttaacatgcttaaattggatcgatttca

SEQ ID NO: 40213 - DNA, 201 bp, Homo sapiens
gaccgctctcgctggcgttcgcggagctgcgcctgcggagcgctctgacccggggagccccaaaccctctctgggatggagcaaggttggcgcccggcgtkgggggacgagcagcgcggggacgtgggggaggaggggatggccgatttggggctgcagagtctcagcagcggccgtggggcatgcggggtttggcgattt

SEQ ID NO: 40214 - DNA, 201 bp, Homo sapiens
agattcccacagacattccctcaggtatgaagactgcattacccttgctcatgggtatgcgtacatatgtggaacaggtgctagaagtgtacctgattggkgggatttgtctaagtcgagatttccactcaaggacagggctgctactttttgggattgagctaagagtactttcacacattatctcatttaattgtgctt

SEQ ID NO: 40215 - DNA, 201 bp, Homo sapiens
gtttattagatggctatatacgtgttacctaccgctaatgaacaaaactatgtctcttatttatggattactttatacttttgctttgatgtatttcaagwttgttccctgacaatcttaaatgaatgaaatgccttttacaagatattttaattatttaatgttcaaggtttgctcataaaattcactcatgaatttgat

SEQ ID NO: 40216 - DNA, 201 bp, Homo sapiens
aagtttattagatggctatatacgtgttacctaccgctaatgaacaaaactatgtctcttatttatggattactttatacttttgctttgatgtatttcargattgttccctgacaatcttaaatgaatgaaatgccttttacaagatattttaattatttaatgttcaaggtttgctcataaaattcactcatgaatttg

SEQ ID NO: 40217 - DNA, 201 bp, Homo sapiens
ccctattttttaagttggtttttccttgcaattttttctgtccttataccaacttttgtgtttatagagcagaatttatgcctgtacatatctactgatayttgtttttttttcctgaggactaaataagctcatattagatatggttttgtaacttttttacattacttaacaaaatatcatggaagtctttccaagagt

SEQ ID NO: 40218 - DNA, 201 bp, Homo sapiens
tttgtatactgttggaattgccctttaaaacaacaaactactgatctctggtaaagtgctatttcccttacataattgactatcttaaaaaactgtaggasatttgtataattttctaaccagtttttgcccaacaagactgcttgctgttttattttatgcattttttatcactcatgccattctaccattggttttggt

SEQ ID NO: 40219 - DNA, 201 bp, Homo sapiens
gaaggttgaaagatgaagagcatttgtttttgaagagggtgttaataaagtcaatttccctctttcctcctaccaaggttggattgttcattaagccaggrggagagtccacttttgccaggtctgccagtactccatggctttgcccttgatgatagttggggaaaagtctggcctctgtatttctgttccctgtcttcc

SEQ ID NO: 40220 - DNA, 201 bp, Homo sapiens
tagaaattcagcagtgtaaagaaatgattaaaactcagcaacagcttttacaggtgaatatgaattaccttttaaagctgttctccatgaaaagccagaaytgtgctgaaccttaccagatttgtattcctttatttcataaggccctggtatttgacagatttctagtctgtgttccctgctaacagatacattgtgtac

SEQ ID NO: 40221 - DNA, 201 bp, Homo sapiens
atggccaaagtgttgacttgtctatcatactaaaacagcagcaaaccttacactaatacatccttgaacttggacattcattcagcaatcttgactgggcwccaaccttggagtgagtgatgatgcctgttaccgaagtggggtacaaagaatatgctgacaagcctgccaaatgagaactcagttgtggtgggagagaaa

SEQ ID NO: 40222 - DNA, 201 bp, Homo sapiens
aaaagcaagccaacatcatagaaataatctgtaagtacaacccatcattagccatgttgttttataatgaggcgataggctcagagaattgatatcatttkctcagcatatttgttgaatgtcaggaggaaaccaggcctgtgaggctttggaatcataaatagctagtttttagtctttccaggttaaatagctggattt

SEQ ID NO: 40223 - DNA, 201 bp, Homo sapiens
accatgttggccagactggtctcaaactcctgaccttgtgatccgcccaccttgtcctcccaaagtgctgggattacaggcatgagccactgcgcccggcttttttttttttttttttttttttggagatacggtcttgccgtgtcacctaggctagagtgcagtggtgctatctcggctcacttcagcgtcaacttccca

SEQ ID NO: 40224 - DNA, 201 bp, Homo sapiens
tcccaaagtgctgggattaggcatgagccactgcgcctggcctaaaaatcaactttaatattttatttactgtagtgaaagtgaggatgagagggggactrtgcatgcccaaagtaacttttgttgtgagtttgtaataatgcgaagtttttgaaaatttacattgagaatttcttttttcaagatgtagtcttgctctgt

SEQ ID NO: 40225 - DNA, 201 bp, Homo sapiens
caatagagattttggagaggaatttagtagatgatttattcattctacaaatattgagtgtccagtatatatagacactgtgctagatgctggaaatacamtagtgaacaggtagatctgttgtcttcttggaggtaaatcatatgatgtgtgtctttttatttcacatttaagatacaatttagaatgtagtcttaatta

SEQ ID NO: 40226 - DNA, 201 bp, Homo sapiens
gaggatcacctgagtttaggaaggtcaaggctgcagagagctgtgattgtgccactgcactccagcctcagcaacaacaacaaaaaaaaaaaaaaaaaaaragagagagagagagagaaaaagaaatatctagggtgcagaggctataccagcaaagcaccagtagggtttgggggatgcagcatcacctctgcccaggga

SEQ ID NO: 40227 - DNA, 201 bp, Homo sapiens
gcaagctgaccatctgcccacaggccgagaaccgcaacgaccgctggatccaggtaaccacagccactgggcagggcccagcaaggacgccatcctggagrgagaggccttcatttgggggccaccgagaaacatccaggaggacctgggtgctccccagggaacttgctgccgtttctaatgtgagacctagaggcttct

SEQ ID NO: 40228 - DNA, 201 bp, Homo sapiens
ggataattatggtgcccacgcccaggcatgtcatgaggatgaatggagttaatgtttataaagagtttagggcaggacctggatgtgaagttcattcacaytgggccatcttttcctccagaaccagaggggtcaggactgacctgggcacatttatggatccaactcaggccactgtgagggcttctctgtgtccacctg

SEQ ID NO: 40229 - DNA, 201 bp, Homo sapiens
ggaggcaggatggtgcacctgttcagagcacaagctttagggtcagaccaaccctgttccgttacttacatgctgtgtgatgttgcgtgagttactaccgytctctgagcctcagtttcctcatcagtaaaaatgacattttggccctggcctcacaggggtttgtgaagcatctcatcatcacagtacctgcatggaggg

SEQ ID NO: 40230 - DNA, 201 bp, Homo sapiens
ggctgagggttgggggtggtgatgatggtggagcaggggccattgcactccttgaagagagccagaagcaaggaatgatgaaattatactcccggatgtgstggggttggtgggtgttcaccagacacagtccacacttacctcggggactctgaaaccagagagagcagagacctaagagatcattcagtccaacacttt

SEQ ID NO: 40231 - DNA, 201 bp, Homo sapiens
gcctgcctgccatggggtgactgggctgcgtgccatggggtgactcacctgcccctgctgcctcgtgcccgttgggcagatgtgtctccggtttgacctgycccaggaagcctgggcctggctcctcccccgcagagcttccttagaggatagaggatggattggggcaataagagataaaggccatagcttcctggagtc

SEQ ID NO: 40232 - DNA, 201 bp, Homo sapiens
cctgggagaaaatgcatttaggtcaaagcttgttcatactaccatgtaaatgactaatataagatcttttcctgagagcaagagaagtgaggtacaagacwtgctaagtgaaatgacaataacatacagagagagtaacaaatgatgtgttgttcagtagtgacacaggggtgctgatggaaaaggaatcctatcatattg

SEQ ID NO: 40233 - DNA, 201 bp, Homo sapiens
taagtgaaatgacaataacatacagagagagtaacaaatgatgtgttgttcagtagtgacacaggggtgctgatggaaaaggaatcctatcatattggttrcttgctgtggactagaccaagacattgagctaaccaaatgcaacaaagctgttagaacagacttgggatcaaataatgaatgaatccagagtcaagcttt

SEQ ID NO: 40234 - DNA, 201 bp, Homo sapiens
acctgcacgacgcccacatggccttaccctccttgcttctctggagcacctgttgtgtgtcagacaccagctggctatgccacacttcatgtttctctggscaattgaggaaacatgagtccaggagagcatagatgtcttcatggtttgttcttgatggcttccagggttttcacaaagctagggctgggagacccaggt

SEQ ID NO: 40235 - DNA, 201 bp, Homo sapiens
agctttggaagggactactgccctcaaatacataatcccattgaaagaggaagctggaccatgcccttagatacattttcctaaaaattgaacatgggggwgaaatctgtctcttggagaataagaacctggtgtgagggtggttctgaagattttcctggatggtgggacctggtaggtcattgccctggtgtgactgac

SEQ ID NO: 40236 - DNA, 201 bp, Homo sapiens
ctcccttttttttttttcctttttgagacggagtttcactcttgttgcccaggctggagtgcaatggcgtgatctccactcaccgcaacctccgcctcccragttcaagcgattctcctgcctcagcctcctgagtagctgggattacaggcatgcgccaccacgcccggctaattttgtgtttttagtagagacgggggt

SEQ ID NO: 40237 - DNA, 201 bp, Homo sapiens
tgagtcttggggcagtgggtggtccctctggcccccaggccccggctccatcctgagcccctcttccctgggcttgtccgtagtgtgaggaacaacacgtrttttgtggatgcggtggcagagctggccaggaaggccggctgcaagctgaccatctgcccacaggccgagaaccgcaacgaccgctggatccaggtaacc

SEQ ID NO: 40238 - DNA, 201 bp, Homo sapiens
cgtgatctccactcaccgcaacctccgcctcccaagttcaagcgattctcctgcctcagcctcctgagtagctgggattacaggcatgcgccaccacgccyggctaattttgtgtttttagtagagacgggggtttctccatgttggtcaggctggtctcgaactcctgacctcaggtgatcagcccgcctcggcctctca

SEQ ID NO: 40239 - DNA, 201 bp, Homo sapiens
tcagctcactgcagcctccacctttcaggctcaagcaatccttccaccttagcctcacgagtagctgggactacaggcatgtaccaccacaccctgctaatttttttttttttgtaaagacagggtttcaccatgctgcccaggctggtcgtgaactcctgggctcaagcaatccacccgctttggcctctcaaagtacta

SEQ ID NO: 40240 - DNA, 201 bp, Homo sapiens
taaaacctgactgatggtgggtgggtgggcagcaactgacccagctccccgctaagccaaagcaagaggattcctcatccagtgccctcgggcagttgtamatttccagtgaaaggcgttaccacttccagtgaactcaaataaaggtctcagttcattccactgtggcaaccagaccctcccactccttataccccaaga

SEQ ID NO: 40241 - DNA, 201 bp, Homo sapiens
gatggtgggtgggtgggcagcaactgacccagctccccgctaagccaaagcaagaggattcctcatccagtgccctcgggcagttgtacatttccagtgamaggcgttaccacttccagtgaactcaaataaaggtctcagttcattccactgtggcaaccagaccctcccactccttataccccaagatgtgcacagtgg

SEQ ID NO: 40242 - DNA, 201 bp, Homo sapiens
gttgcagtgagccatgatcaccccactgcactccacagcctgggcaacaaagtaagaccctgtctccaaaaaataataataataaagggcagtggggaggrctccattcctggtaagtctaccaggcaccactggtgtgaaagaccccagacttcttgaccacccctctggttcatttccatcttgcagagaagcaagggg

SEQ ID NO: 40243 - DNA, 201 bp, Homo sapiens; identical to SEQ ID NO: 8869

SEQ ID NO: 40244 - DNA, 201 bp, Homo sapiens; identical to SEQ ID NO: 8871

SEQ ID NO: 40245 - DNA, 201 bp, Homo sapiens
accgagacataaggtttattgaggggactcatatacggggcagtgcagtggtggtgggctggacaggggaaccacctctgctcgtaaaaagcatgcagttrgccaggtgcagtggctcacgcctgtaatgccagcactttgggaggccaaggcgggtggatcacaaggtcaggaattcgacaccagcctggccaagatggt

SEQ ID NO: 40246 - DNA, 201 bp, Homo sapiens
gttcaggcgccgcacaagaccctcccggtggtctttgactccccaaggaatggggaactgcaggatttcccttacaaaagaatcctggtgagtggtcccgrccgcagcccacccctgagagctgagaggccttaccccaggggccacaccggggtgtggggtacagagggcagcagtgggaaccgtgctctttagggatga

SEQ ID NO: 40247 - DNA, 201 bp, Homo sapiens
atagatgtcttcatggtttgttcttgatggcttccagggttttcacaaagctagggctgggagacccaggtcttgatacccactgacctggggagggagcygggcagcagaggaaggggccaggggccaggactcccttgagtcactaccactctgtctggcttcacagacctggaagacatgtctgtcatggtcctgcgg

SEQ ID NO: 40248 - DNA, 201 bp, Homo sapiens
gctagtatttcttgggcacttcctatgggctcagtcttttacatgtattgtttccaagctgcattacaagcctctgaggtagagacctatagaggtagagrccttttcccattttgcagaggagaaaactgaggtggctcaggtaggtgagaggccttggccaaggtcatagagtacccagaggtgccgggctcaagcccg

SEQ ID NO: 40249 - DNA, 201 bp, Homo sapiens
aatgaatgaatccagagtcaagctttggaagggactactgccctcaaatacataatcccattgaaagaggaagctggaccatgcccttagatacattttcstaaaaattgaacatgggggtgaaatctgtctcttggagaataagaacctggtgtgagggtggttctgaagattttcctggatggtgggacctggtaggtc

SEQ ID NO: 40250 - DNA, 201 bp, Homo sapiens
aagaaagagtcaaatggaaatgctagacataaaaaccatagtaataagagattttaaaaatgcttttgaaggtttcaccagtagacttgacacagctgagkaaagaatcagtgaacttgaagataagtgaataaaagttacccaaactgaaacccaaagagaaaaaagaataaaacaaacaaatgaaaaaacataacagat

SEQ ID NO: 40251 - DNA, 201 bp, Homo sapiens
ttaactgtcaccattatcatcatcatcagtttaaggctttgtcctgggcctgtggacagcctcaagcatccccaaacctgccatatgcaggatgtctgggraacagtctctggaccgtattgggagaaggagttgagaaaagagaaatttacatctgactcatggctgagtcagggcagtcttcctggaggaggggcacca

SEQ ID NO: 40252 - DNA, 201 bp, Homo sapiens
gtgggcaacagagagccattgccattgacatgtcttgagaaggaggtgcttcgagaacgtggacctagcctcacagggttgggtggttacaggccaggctsgggttcctgggtagggaggcacaggtctcatctgagccctcatcactggctatgttttgtcattggcagcggcagtgggtctgggggcccagtgggtatg

SEQ ID NO: 40253 - DNA, 201 bp, Homo sapiens
gtggctgaggggcccgcgaagctggtcacctttgggattcatcacaggtgggcttggagagcagtccccaggctggttcagtgagacatctctggggtctyacacgccacttcattttttagttggggaaactgaggcctggagtgtgaaatgacttgctcagggttacatagtgagttagggacagagctaaaactagaa

SEQ ID NO: 40254 - DNA, 201 bp, Homo sapiens
agtccaggggagagcgccagcctccagacacacctcgatgctcctcaaaacccatctcaggctggcagctgcccctccctagtgtctctagggccagtgarcactcacatgccagggcagaagctctggaaatgagccacctcgccattctcttcctccaggggagcagaggatgctagcattatttgagcacctactgtg

SEQ ID NO: 40255 - DNA, 201 bp, Homo sapiens
ttctgctcttttaaatacgggggatttggaaaaagggtatacggggctgccactttccagtggtggggtggggcagggccacccagattacagtgggaccrtgatttcctgaacctgattctattgatgaggctggcagcgtcggcggatctgggatcctcgctgactggggaggggcagctggaactgccacccagaaac

SEQ ID NO: 40256 - DNA, 201 bp, Homo sapiens
cctgttgccaggttgcctaccagggaacctcctgttcctgccttgggccatgggcaggtcctgcttacactccgggagatgccctggtgggtggcgggtcrcagtaagaacagtcagaagtgggggctttggaactgatgaactggtgcccccagcacaacacctggcctgaggtcattttatttgatgaatgaccttttc

SEQ ID NO: 40257 - DNA, 201 bp, Homo sapiens
ccacccagattacagtgggaccatgatttcctgaacctgattctattgatgaggctggcagcgtcggcggatctgggatcctcgctgactggggaggggcrgctggaactgccacccagaaacccagctgcctgggtcttggtctcctctgcccccacatcccagctcggtggagacctcgttggtcatcttgtcaacctt

SEQ ID NO: 40258 - DNA, 201 bp, Homo sapiens
tgacttttgctcatcctgagtgctttacccacactggttcctttcatcttctcctcatccccaccagatagatgtcgatgctgcggctgagggaggcagtsactcgctcaaagtcacacacctaatgagtggtgggactgggatttgaacccagttgtctggccccagggaccacaggctcaagtaccttgccacggctcc

SEQ ID NO: 40259 - DNA, 201 bp, Homo sapiens
catagcatcccccagcccttcctcaagcatctgctgtgtagaacactcctaatctccgcgctttaatagatgacaaagaccctttgagacccagaggtgaratgagggaggtagggacaggacagctgtcttggctactctcagatcataccctgcttgtctcagctgtgtaggactggcccaggtggaggctcctgcctg

SEQ ID NO: 40260 - DNA, 201 bp, Homo sapiens
ctttcaccaggagaaaaatcatcgccaggaattatcaggcatggaggtacccagccctgagctaggccttggtttgtgggatcaagaccttctggactcayaaactaggtcaggagtgggcaaactttttccgtgaaaagtcacatagcaagtattttaggctttgtgggacatatggtctcaattctgccactatagtgt

SEQ ID NO: 40261 - DNA, 201 bp, Homo sapiens
gtcacagctgtgcgtctctcgcctctcctcacttgcaggatgagatggagctgggctacgttcaggcgccgcacaagaccctcccggtggtctttgactcyccaaggaatggggaactgcaggatttcccttacaaaagaatcctggtgagtggtcccggccgcagcccacccctgagagctgagaggccttaccccaggg

SEQ ID NO: 40262 - DNA, 201 bp, Homo sapiens
gcaggtcctgcttacactccgggagatgccctggtgggtggcgggtcgcagtaagaacagtcagaagtgggggctttggaactgatgaactggtgcccccrgcacaacacctggcctgaggtcattttatttgatgaatgaccttttcaaatacattttaagcatgtgtagaaattcttatcaaaaatttcaaacatacac

SEQ ID NO: 40263 - DNA, 201 bp, Homo sapiens
gggtggggccaggggcttttaaacctcatcctaaggggcctcaggggcagtgttggggttggcggccacagctaagtccaacaccagcatgtcgctgcagmgaatcgtgcgtgtgtccctggagcatcccaccagcgcggtgtgtgtggctggcgtggagaccctcgtggacatttatgggtaagagtcagaggcctagtg

SEQ ID NO: 40264 - DNA, 201 bp, Homo sapiens
gggtttcattgtcttagccaggatggtctcaatctcctgaccttgtgatctgcccgcctcggcctcccaaagtgctgggattataggcgtgagccaccgtrcctggccgcttattttttaaataatcagacaatatggaagtatagaaaatgaaacctgagagttctctacccgtctctaaatctgacttttttttttttt

SEQ ID NO: 40265 - DNA, 201 bp, Homo sapiens
gtgagccaccgtgcctggccgcttattttttaaataatcagacaatatggaagtatagaaaatgaaacctgagagttctctacccgtctctaaatctgactttttttttttttttttgagtcaaggtcttgctctgttgcccgggctggagtgcagtggcatgatctcagctcactgcagcctccacctttcaggctcaag

SEQ ID NO: 40266 - DNA, 201 bp, Homo sapiens
gtaccaccacaccctgctaatttttttttttttgtaaagacagggtttcaccatgctgcccaggctggtcgtgaactcctgggctcaagcaatccacccgmtttggcctctcaaagtactaggattataggcgtgagacgccgcacctggcctgaatctgattgtcactgttaacgagttgggatgtgtgcttcccaactt

SEQ ID NO: 40267 - DNA, 201 bp, Homo sapiens
gggctttcatgactggagccaatgaattggcaccctgggctggaggggtggggccaggggcttttaaacctcatcctaaggggcctcaggggcagtgttgrggttggcggccacagctaagtccaacaccagcatgtcgctgcagagaatcgtgcgtgtgtccctggagcatcccaccagcgcggtgtgtgtggctggcgt

SEQ ID NO: 40268 - DNA, 201 bp, Homo sapiens
tgggaaagagtaccccctggggaggatcctcattgggggcaacctgcctgggtgagagagagacagggaatggagttcctggggtggaggctgagggttgrgggtggtgatgatggtggagcaggggccattgcactccttgaagagagccagaagcaaggaatgatgaaattatactcccggatgtggtggggttggtgg

SEQ ID NO: 40269 - DNA, 201 bp, Homo sapiens
ctgttccagggggttgttggtgggtaacagtgccgtgtccctccttgcggcttgcctgccccttacccaaattaagacacatcatggcttgagagggggarggcaagttttaaagcaggggtgtgtccccaaattcagggcttctcactcctgcccctgcacaccttgcttcaccagacaccactgcccacagctggggcc

SEQ ID NO: 40270 - DNA, 201 bp, Homo sapiens
gctcagctgaatctgttctctgcacgcagggcttccggatgctcctggccagccctggggcctgcttcaagctcttccaggaaaagcagaagtgtggccaygggagggccctcctgttccagggggttgttggtgggtaacagtgccgtgtccctccttgcggcttgcctgccccttacccaaattaagacacatcatggc

SEQ ID NO: 40271 - DNA, 201 bp, Homo sapiens
tcttgaatttaacccttacaacaaccctgtgagctaggcttattattagcatcatctcatcagacaaatgagaaaaccgaggcagagagggcaagccattygctcaagtcacacagttactaagtggcaaagccagggtttaaacccgcttgtggtcttactcaggagtcttatggttttagctgctctgatacttggaaa

SEQ ID NO: 40272 - DNA, 201 bp, Homo sapiens
tgggcagacccagcataaagccctggaaacagattgcctctcaaagttgctccctgtgctctaggttggtgtgggtggggcaactgagcagtgaaaaaccyaaccccaaggcggacgagaagcaaaacacagttgaacacggcatccacctgtccacacagcaaaggacagggtcagtgcattactttttgaaggctacta

SEQ ID NO: 40273 - DNA, 201 bp, Homo sapiens
ttatgctcctactgtgtgccaggtcatgcctttgaggcccatggtagagggaggtaaggccttatcttctctctcttaggaagaaaagagggttagggtakggttttaagagctgggctctggggaccaccagggagctggcttcttaggcttttggggagaatccagggtcctggcttggaggtaatcaggatactggga

SEQ ID NO: 40274 - DNA, 201 bp, Homo sapiens
tatggttttagctgctctgatacttggaaaataaagatttccaacctggtttcctctagacactcaatgcccatgcattatgctcctactgtgtgccaggycatgcctttgaggcccatggtagagggaggtaaggccttatcttctctctcttaggaagaaaagagggttagggtagggttttaagagctgggctctggg

SEQ ID NO: 40275 - DNA, 201 bp, Homo sapiens
tcccataacatgtggagatgcttcctggagtctgttgggttgtggctgctcatgtggctgaggggcccgcgaagctggtcacctttgggattcatcacagrtgggcttggagagcagtccccaggctggttcagtgagacatctctggggtcttacacgccacttcattttttagttggggaaactgaggcctggagtgtg

SEQ ID NO: 40276 - DNA, 201 bp, Homo sapiens
tatcttctctctcttaggaagaaaagagggttagggtagggttttaagagctgggctctggggaccaccagggagctggcttcttaggcttttggggagamtccagggtcctggcttggaggtaatcaggatactgggaggggagggtgcagaactgtgggacagctctcacctctcaagtctcccagccctctcctcagg

SEQ ID NO: 40277 - DNA, 201 bp, Homo sapiens
cagggagctggcttcttaggcttttggggagaatccagggtcctggcttggaggtaatcaggatactgggaggggagggtgcagaactgtgggacagctcycacctctcaagtctcccagccctctcctcaggccaggtttctcaacctcagcactgctgtcacgatacctctttgtcatgggggccaccctgtgcactgt

SEQ ID NO: 40278 - DNA, 201 bp, Homo sapiens
ggttctcaaccctggaagtgtgtttcaatcacctggggatccataaaaaaattgatgcccaggccccaccttgggaaacctgattcaactcatctgtgaarggccccagcaccctaggttttcaggatccgctggggatgaatgtgcagctggggctaagaaccgctgccctcactgggaagacaaacaactcatgtcacc

SEQ ID NO: 40279 - DNA, 201 bp, Homo sapiens
tccgtagtgtgaggaacaacacgtgttttgtggatgcggtggcagagctggccaggaaggccggctgcaagctgaccatctgcccacaggccgagaaccgyaacgaccgctggatccaggtaaccacagccactgggcagggcccagcaaggacgccatcctggagagagaggccttcatttgggggccaccgagaaacat

SEQ ID NO: 40280 - DNA, 201 bp, Homo sapiens
ccgagaaccgcaacgaccgctggatccaggtaaccacagccactgggcagggcccagcaaggacgccatcctggagagagaggccttcatttgggggccaycgagaaacatccaggaggacctgggtgctccccagggaacttgctgccgtttctaatgtgagacctagaggcttctctccagaaccttctggagacccac

SEQ ID NO: 40281 - DNA, 201 bp, Homo sapiens
tcctgtatttttatttactgaatctggcagccctaaataggggaggcaggatggtgcacctgttcagagcacaagctttagggtcagaccaaccctgttcygttacttacatgctgtgtgatgttgcgtgagttactaccgctctctgagcctcagtttcctcatcagtaaaaatgacattttggccctggcctcacaggg

SEQ ID NO: 40282 - DNA, 201 bp, Homo sapiens
atgttgcgtgagttactaccgctctctgagcctcagtttcctcatcagtaaaaatgacattttggccctggcctcacaggggtttgtgaagcatctcatcmtcacagtacctgcatggagggagtgtgtgtgcgcgcaccactattagctagtatcattattttaagaaaaaggataacagggaaggtgatgattgctaac

SEQ ID NO: 40283 - DNA, 201 bp, Homo sapiens
tcagtttcctcatcagtaaaaatgacattttggccctggcctcacaggggtttgtgaagcatctcatcatcacagtacctgcatggagggagtgtgtgtgygcgcaccactattagctagtatcattattttaagaaaaaggataacagggaaggtgatgattgctaacgaggacctcttgagaaaacaagagtgacttgc

SEQ ID NO: 40284 - DNA, 201 bp, Homo sapiens
cagaggcccacatcagcagcctcttggttcccacaattggccacttgagctgctacttgcccttgggctgaacttgcaggaaggctgtgtaggtaaggggrtggagtggccatggcctcaggctccatgtccgatggggagtgcaggagcaaccggagcgccccctgctgtcttgccgtgataaggcagcagggccagaga

SEQ ID NO: 40285 - DNA, 201 bp, Homo sapiens
ccccacccaccgccaatgactctgtatttccacctgaagaatggatggcctttcccaccctgtcttgaaggagctcaaagcccagcaagttggttcaggcycttcctggtaccctccacccccgcctgacttggtttccctctccagggtccagattttggttacgtgactcgggaaccacgcgacaggtctgtgagtggc

SEQ ID NO: 40286 - DNA, 201 bp, Homo sapiens
gcagaactcaccctaagtggaattttaaaatatacgtatctggctgggtgcagtggctcatccctgtaatcccagcactttgtgaggctgaggcgggcagwtcacttgaggtcaggagttcgagaccagcctggccaacatggtgaaaccccatctctagtaaaaatacagaaaaattagcctggcctggtggtgcacgcc

SEQ ID NO: 40287 - DNA, 201 bp, Homo sapiens
aacttcgtgcatgacgtgtctttccctggcatctggggcaagaactgagctccagggcgccatgccaaggcaggaggctcagctgaatctgttctctgcaygcagggcttccggatgctcctggccagccctggggcctgcttcaagctcttccaggaaaagcagaagtgtggccacgggagggccctcctgttccagggg

SEQ ID NO: 40288 - DNA, 201 bp, Homo sapiens
gtgggtaacagtgccgtgtccctccttgcggcttgcctgccccttacccaaattaagacacatcatggcttgagagggggagggcaagttttaaagcaggkgtgtgtccccaaattcagggcttctcactcctgcccctgcacaccttgcttcaccagacaccactgcccacagctggggccgagctgaggtgggaagcgg

SEQ ID NO: 40289 - DNA, 201 bp, Homo sapiens
cagcaagttggttcaggcccttcctggtaccctccacccccgcctgacttggtttccctctccagggtccagattttggttacgtgactcgggaaccacgygacaggtctgtgagtggcctggactcctttgggaacctggaggtcagccctccagtggtggccaatgggaaagagtaccccctggggaggatcctcattg

SEQ ID NO: 40290 - DNA, 201 bp, Homo sapiens
tgggcaacagagcaagactccgtctcaaaaaaaaaaaaaaaaaaaaagcatgcagtttatatagcattttgacttagcactctcaccctaataacctcctyctggcaatcttcatttcacccataacaaagggcctcaatcccctgtacagcctgcattctacgagataagtggtgggtcccaatgttcctcatagataag

SEQ ID NO: 40291 - DNA, 201 bp, Homo sapiens
gcggggctggaggcaaggatgggatacagacatctgaggctaactgttcatgaaagctcaggttagaacaggcccagacagaggggtcccaacaccctctyttgacccagaagaagtgaggggagcgacaggatgccttggtgcccccaaaacacactggcaaggtgtccccaactctggccctcccctgcccccagagct

SEQ ID NO: 40292 - DNA, 201 bp, Homo sapiens
cagacatctgaggctaactgttcatgaaagctcaggttagaacaggcccagacagaggggtcccaacaccctcttttgacccagaagaagtgaggggagcracaggatgccttggtgcccccaaaacacactggcaaggtgtccccaactctggccctcccctgcccccagagctgcatcgactggaaccgtgaggtgctg

SEQ ID NO: 40293 - DNA, 201 bp, Homo sapiens
cgactggaaccgtgaggtgctgaagcgggagctgggcctggcagagtgtgacatcattgacatcccacagctcttcaagaccgagaggaaaaaagcaacgrccttcttccctgacttggtgagggcactacccatgactcctttgccaaatcaggctgcaaacctctaagctcgagagaggaaaaatgtctggtcacagtc

SEQ ID NO: 40294 - DNA, 201 bp, Homo sapiens
gctcagcccttgcccatggacactggaggcccaaggaacagctttggggttgagggagttccataaaaagtgtacaggcttcagccaggcgcggtggctcrcgcctgtaatcccagctgggaggctgaggcaggcggatcacttgaggtcaggagttcaagaccagtctggccaatatggtgaaaccctgtttctactgaa

SEQ ID NO: 40295 - DNA, 201 bp, Homo sapiens
ctcctccccacctcatcccctaaaagaactcaatttgcccattgtcagagccttgtggggaacctgtccacaccaccattgcttcatgccccgctttttcsttcctcttttcaggcaacattttgccctccgcttgcaaagcctcttttcactccccttccttcctgttcgaggctatcttgtaattatatatgtgcccca

SEQ ID NO: 40296 - DNA, 201 bp, Homo sapiens
aaaaaaaatagcgaggtatagtggtgtacacctatagtcccagttacttgggaggctgaggtgggaggatcacctgaaccccagggaggttgaggttgcartgagccatgatcaccccactgcactccacagcctgggcaacaaagtaagaccctgtctccaaaaaataataataataaagggcagtggggagggctccat

SEQ ID NO: 40297 - DNA, 201 bp, Homo sapiens
cagcttaaagtttttctgctaagcctccacaaatggatacataaactccgtgcaagatggctcagatgttggagctatcagacagggcatgcaaagtaatmgtgattaatatgttaagggttctagtggaaaaggtagacaatatgtatgaacagatggggaatttcaacagagaagaaaatcaataagaaagagtcaaat

SEQ ID NO: 40298 - DNA, 201 bp, Homo sapiens
tgccctcacctcttggatggtgtctccttagaaatgacttgcctttgctcagccccagacaagccctgagatcaaggcctgccctgggctcctgggaaccytgtagtgacttaccctctgcctcctcttgcagacatctctctggattgcgacctgaactgtgagggaaggcaggacaggaactttgtagacaaggtaagc

SEQ ID NO: 40299 - DNA, 201 bp, Homo sapiens
tgggcgtcttttgccctatgctatgtttgtgagatttatccacttgttgcatggtggttgagtatcttttcacatgtttaaaaatcatttcaggccacgcrtggtggctcatgcttgtaatcccagcactttgggaggctggggtgggtggatcacttgagcccagtagttcaagaccagcctaggcaacatggtgaaatc

SEQ ID NO: 40300 - DNA, 201 bp, Homo sapiens
aactaagaagactgcttttttttcagagcagaaagattgattctgacctcctgaatgctccatttgcattatgaaatctcacccagtgtctagggctaaaygttaagaaggtgggatgggggtgggatttggggactgcgagtagctcagaaaggacacacagccaggaggcggcagaacctgggtttgtgttcacatctg

SEQ ID NO: 40301 - DNA, 201 bp, Homo sapiens
cagatgtgtctccggtttgacctgtcccaggaagcctgggcctggctcctcccccgcagagcttccttagaggatagaggatggattggggcaataagagrtaaaggccatagcttcctggagtcacctgagccacactggaggtttgcagagaaggccatcggtgggacagccacagggtgggggatggaagctctgata

SEQ ID NO: 40302 - DNA, 201 bp, Homo sapiens
agcagtgcctgtaagcgctttccatatgttaactaattctcacaaaattctcaagtgggcactgtcatcatcgtcattttatagataagaaaacaaaggcmcagagaggttaaacaacttgtccaaggtcacatggccagtgagtggcagagccaggatgtaacccagtttggccttacttcaaagggcagttaggggcat

SEQ ID NO: 40303 - DNA, 201 bp, Homo sapiens
tgagccatgcactgggcgtctggtggctgattaactcctccctgcaactggaggcaggctcagcgggatggtggtctgacaagtgctatcccacagggctrtagggcttgaacccagatcccatcaagttccacagcccaggtggtttgcttggttccacacagctctttctcaaggctcaggcatcagcacaaaccttag

SEQ ID NO: 40304 - DNA, 201 bp, Homo sapiens
aatgtgaaatagcaaataaaaaccaccctgacaagtcaggagagagactcggggacaaagaaacaactttatactgtagcacttttaatggtactcttttstctgctctttaaacaaggagctggcattttcttttcttcttttttgagacagggtctatcagccaggctggagtgcagtgacatgatctcagctcactgc

SEQ ID NO: 40305 - DNA, 201 bp, Homo sapiens
gaaacaactttatactgtagcacttttaatggtactcttttgtctgctctttaaacaaggagctggcattttcttttcttcttttttgagacagggtctaycagccaggctggagtgcagtgacatgatctcagctcactgcagcctcgacctcccagacttaagcgagtctcccaccgcagccttgcgagtagctaggac

SEQ ID NO: 40306 - DNA, 201 bp, Homo sapiens
gcgagtctcccaccgcagccttgcgagtagctaggaccacaggcatgcaccaccacgcctggctaattttttgtattttttgtagagatggagtctcaccrtgttgcccaggctggtcttgaactcctgagctcaagtgatctgtctgtcttggcctcccaaagtatgggattacaggtgtgaactactgtgtctggccag

SEQ ID NO: 40307 - DNA, 201 bp, Homo sapiens
ttgaccctgttgctcccaaacgcaccctaactagactccggtgaacctagagtaagtcttagaaatccttaaatccaaattatgtaccaggcagggagaartgccaccttcatctttcctgggagaacttatggtgagcaagacccaggaatgggttgagcagagttattccaacctgcccagctgggagggagcgtggga

SEQ ID NO: 40308 - DNA, 201 bp, Homo sapiens
catcactaaggtatcccgggcaggtgtctcctaagagaccacacctggcaatgagccatgaagctcctcttttctccagctcagaggttctcaaccctggmagtgtgtttcaatcacctggggatccataaaaaaattgatgcccaggccccaccttgggaaacctgattcaactcatctgtgaagggccccagcacccta

SEQ ID NO: 40309 - DNA, 201 bp, Homo sapiens
agccaccccaccctcgagggctgacactcaggcagtgactgtggcgattaattacatagacacagaggccagacacagaggccagagcactgattagacamctcagtgcgccaggcctcacgctgtgtgcatcacacgtgttatctcatttgatctcacgagagatcaaatgggatgactctcacccacctttattcccaa

SEQ ID NO: 40310 - DNA, 201 bp, Homo sapiens
ggctgacactcaggcagtgactgtggcgattaattacatagacacagaggccagacacagaggccagagcactgattagacacctcagtgcgccaggcctmacgctgtgtgcatcacacgtgttatctcatttgatctcacgagagatcaaatgggatgactctcacccacctttattcccaagaatgtgaggctcagaga

SEQ ID NO: 40311 - DNA, 201 bp, Homo sapiens
ggcggggctggaggcaaggatgggatacagacatctgaggctaactgttcatgaaagctcaggttagaacaggcccagacagaggggtcccaacaccctcytttgacccagaagaagtgaggggagcgacaggatgccttggtgcccccaaaacacactggcaaggtgtccccaactctggccctcccctgcccccagagc

SEQ ID NO: 40312 - DNA, 201 bp, Homo sapiens
gggtggcagggagaatcaggggtcctatggtgctcctcagaagggcttctagctggctgaccaccatggtccctgtggaatgcttgctggccaagccctgscccaaggggcatcagggaaggggtccacttgacatttgtggagtgaatgaatgattgcatgaggtcacgtgtgcaaagcacatggcatcagctgggaacc

SEQ ID NO: 40313 - DNA, 201 bp, Homo sapiens
ttgcatgaggtcacgtgtgcaaagcacatggcatcagctgggaacccagatgctcattctgctctcttcctcccagcttgtggctcttcatccatcccacrtgtatttagggtgtcctgtggcagatgcagagatgattaagaatgccccctgctctcaagggactttcagtctaatcggttgagagggaaactcttccct

SEQ ID NO: 40314 - DNA, 201 bp, Homo sapiens
gtttcctcacctgttgcctggggatgataataatatcagcaatggcactgaatgccactccccagcagtgcctgtaagcgctttccatatgttaactaatyctcacaaaattctcaagtgggcactgtcatcatcgtcattttatagataagaaaacaaaggcacagagaggttaaacaacttgtccaaggtcacatggcc

SEQ ID NO: 40315 - DNA, 201 bp, Homo sapiens
gcaaagcctcttttcactccccttccttcctgttcgaggctatcttgtaattatatatgtgccccaagaagtttgtgcaatgattcaggttcttgtgttcrcaagagacagagtcctactgaagccagcttcagccagagggagtcttaatataaggacaccagaaacctgagggcaggatagctgcagcagagcctggaa

SEQ ID NO: 40316 - DNA, 201 bp, Homo sapiens
gacagcctcaagcatccccaaacctgccatatgcaggatgtctggggaacagtctctggaccgtattgggagaaggagttgagaaaagagaaatttacatytgactcatggctgagtcagggcagtcttcctggaggaggggcaccaatcagacccttgaaggatgaggacaagcaagtctgttgggcctctctatctgtg

SEQ ID NO: 40317 - DNA, 201 bp, Homo sapiens
cctgggtcttggtctcctctgcccccacatcccagctcggtggagacctcgttggtcatcttgtcaacctttcggtgttcagccatggggaactttcccawcagtttctcagctcctaaaatgtctgattttgttctcccagaagtccaggccctgagtccatgaagggagaagatgggtttgggtttgcaggcgagtggg

SEQ ID NO: 40318 - DNA, 201 bp, Homo sapiens
ttctgtcaacatcggattttgtttgatgcgagagctctgacctgcctgtgcagagagctgggcccttggggggattggtgcatttctgctcttttaaataygggggatttggaaaaagggtatacggggctgccactttccagtggtggggtggggcagggccacccagattacagtgggaccatgatttcctgaacctga

SEQ ID NO: 40319 - DNA, 201 bp, Homo sapiens
ctctgcctgggcccaggaagcaggagtgcagttggagcttgctctaggttgggttaagaaggatgaggccattacagatatccccctgcctcccagctgaygccgagaccaagggccaaaaacagaaaccaggcatggctggggatcttctttcaccaggagaaaaatcatcgccaggaattatcaggcatggaggtaccc

SEQ ID NO: 40320 - DNA, 201 bp, Homo sapiens
ctgggcccaggaagcaggagtgcagttggagcttgctctaggttgggttaagaaggatgaggccattacagatatccccctgcctcccagctgatgccgaraccaagggccaaaaacagaaaccaggcatggctggggatcttctttcaccaggagaaaaatcatcgccaggaattatcaggcatggaggtacccagccct

SEQ ID NO: 40321 - DNA, 201 bp, Homo sapiens; identical to SEQ ID NO: 8856

SEQ ID NO: 40322 - DNA, 201 bp, Homo sapiens; identical to SEQ ID NO: 8858

SEQ ID NO: 40323 - DNA, 201 bp, Homo sapiens
ttagccagttaccttctcattgcacaggaaagggtgagtagctattgacaaggctgtctaaaacacaaacctaggtcctgcaggtagagtagaggtgtggkgtgggagcccagtgatgaagtgctgcttcccctttggactgcaggtgaacatgctggtgctggggaagcacctgggcatccccaagccctttgggcccat

SEQ ID NO: 40324 - DNA, 201 bp, Homo sapiens
ggactgcaggtgaacatgctggtgctggggaagcacctgggcatccccaagccctttgggcccatcatcaatggctgctgctgcctggaggagaaggtgcrgtccctgctggagccgctgggcctccactgcaccttcattgatgacttcactccataccacatgctgcatggggaggtgcactgtggcaccaatgtgtgc

SEQ ID NO: 40325 - DNA, 201 bp, Homo sapiens
agaacagactggacccattcccactgggctttcccataacatgtggagatgcttcctggagtctgttgggttgtggctgctcatgtggctgaggggcccgygaagctggtcacctttgggattcatcacaggtgggcttggagagcagtccccaggctggttcagtgagacatctctggggtcttacacgccacttcattt

SEQ ID NO: 40326 - DNA, 201 bp, Homo sapiens
attgcaccactgcactccagcctgggcgacagagcaagactctgtctcaaaaaaaaaaaaaaaaaaaaaaaaaaaaggcttccttgggagatggaaggcgrgtgcctcaggagcgtggctgagggtgttcccgagggtatgagaggctgctcttcctacctgggtttgtcttcctgtgtctctttccgactccctgtctct

SEQ ID NO: 40327 - DNA, 201 bp, Homo sapiens
tctgcaagttacagacacataccatgtgtccttggaaagccttatcatccccttggggcctctgtctgccatctgtaaaatgggataatcataacccctgyctcctatcattgctgtggagtgccataggagccagtgttgctccttctcttgcttcccaagaccccctggagaaggagttgtcccagttctgctgagttg

SEQ ID NO: 40328 - DNA, 201 bp, Homo sapiens
gcatgcaaagtaatcgtgattaatatgttaagggttctagtggaaaaggtagacaatatgtatgaacagatggggaatttcaacagagaagaaaatcaataagaaagagtcaaatggaaatgctagacataaaaaccatagtaataagagattttaaaaatgcttttgaaggtttcaccagtagacttgacacagctgagt

SEQ ID NO: 40329 - DNA, 201 bp, Homo sapiens
catgcaaagtaatcgtgattaatatgttaagggttctagtggaaaaggtagacaatatgtatgaacagatggggaatttcaacagagaagaaaatcaataagaaagagtcaaatggaaatgctagacataaaaaccatagtaataagagattttaaaaatgcttttgaaggtttcaccagtagacttgacacagctgagta

SEQ ID NO: 40330 - DNA, 201 bp, Homo sapiens
atgcaaagtaatcgtgattaatatgttaagggttctagtggaaaaggtagacaatatgtatgaacagatggggaatttcaacagagaagaaaatcaataagaaagagtcaaatggaaatgctagacataaaaaccatagtaataagagattttaaaaatgcttttgaaggtttcaccagtagacttgacacagctgagtaa

SEQ ID NO: 40331 - DNA, 201 bp, Homo sapiens
tgcaaagtaatcgtgattaatatgttaagggttctagtggaaaaggtagacaatatgtatgaacagatggggaatttcaacagagaagaaaatcaataagaaagagtcaaatggaaatgctagacataaaaaccatagtaataagagattttaaaaatgcttttgaaggtttcaccagtagacttgacacagctgagtaaa

SEQ ID NO: 40332 - DNA, 201 bp, Homo sapiens
gtatgaacagatggggaatttcaacagagaagaaaatcaataagaaagagtcaaatggaaatgctagacataaaaaccatagtaataagagattttaaaartgcttttgaaggtttcaccagtagacttgacacagctgagtaaagaatcagtgaacttgaagataagtgaataaaagttacccaaactgaaacccaaaga

SEQ ID NO: 40333 - DNA, 201 bp, Homo sapiens
catgctggcagctcgaggtggcctggagaggaaggactttgtccaggtgaggctccaggtacttcccctgttctctaggaaatgggaagctagatcctccygtacctgatgcaggttctcctcccagcagctgcccctctcattctcctaacacacagctttcatgacaggcatgagcactggactggaagtcagcagccc

SEQ ID NO: 40334 - DNA, 201 bp, Homo sapiens
tgtatttttagtagagacagggtttcaccatgttggccaggctcgacctcaagtgatccgcccgcctcggcttcccaaagtgcctgacctcaagtgatccmtccgcctcggcttcccaaagtgctgggattaaaggagtgagtcaccacgcccggccgactgtgtatatgtttgtgtggggtccaggcttgactcgcagga

SEQ ID NO: 40335 - DNA, 201 bp, Homo sapiens
ggtgcagtccctgctggagcctctgggcctgcactgcatcttcattgatgactacttgtcctaccacgagctgcagggggagatccactgtggcaccaacrtgcgcaggaagccctttcccttcaaatggtggaacatggtgccctgagcctgcccccacccgccatcctctctgccctcttgctagggaaccctgccagg

SEQ ID NO: 40336 - DNA, 201 bp, Homo sapiens
ggcgcctctgtgctggcagacttggctctaagggccccagagctccaggtgttctcagatgcacggctgtgtaagccctgcagtcagaaggtcctggaagrgtcaggtcccatctgcatggctgcagaggggcccagcgcacacagcagcctagagggcagctgagtctgttctctaagacacctcgaagagggggcaacc

SEQ ID NO: 40337 - DNA, 201 bp, Homo sapiens
gagactcgcctggattggaggtcctggtggggcttgtggcgcctctgtgctggcagacttggctctaagggccccagagctccaggtgttctcagatgcayggctgtgtaagccctgcagtcagaaggtcctggaagggtcaggtcccatctgcatggctgcagaggggcccagcgcacacagcagcctagagggcagctg

SEQ ID NO: 40338 - DNA, 201 bp, Homo sapiens
tgccatgttgcccgggctggtcttgaactcctgggctcaagtgatctgcctgcctgagcctcccaaagtgttgggattacaggtgagagccaccgtgtctsgcccagtttcattcttaatgggcaaaatcaaaatcccaggatgacctctggtggggagggccatcctcagggcctctgtcattggcccagtggtaagaac

SEQ ID NO: 40339 - DNA, 201 bp, Homo sapiens
tgggcccagagagactaagtgatttagtcaagctcagctggccgatgtgtgacccagcctggtctaaaacctaattcttgactctggtcccagcaccaccygagccctcggcttgcagcccctcccttccccaacctcagatgtagcttgttcacctgtgctaagcccttgttcagaccgtggtcctggggaccctcctgg

SEQ ID NO: 40340 - DNA, 201 bp, Homo sapiens
aagtgatttagtcaagctcagctggccgatgtgtgacccagcctggtctaaaacctaattcttgactctggtcccagcaccacctgagccctcggcttgcrgcccctcccttccccaacctcagatgtagcttgttcacctgtgctaagcccttgttcagaccgtggtcctggggaccctcctgggcaggggtgcttcagt

SEQ ID NO: 40341 - DNA, 201 bp, Homo sapiens
tctccttcggcaccgaccatggctctctgccctgcccaggtcagtgcctgagggcacagaaatgtttgaggtctatgggacgcctggcgtggacatctacrtctctcccaacatggagaggggccgggagcgtgcagacaccaggcggtggcgctttgacgcgactttggagatcatcgtggtcatgaactcccccagcaa

SEQ ID NO: 40342 - DNA, 201 bp, Homo sapiens
gtgtggggtccaggcttgactcgcaggagcttactgtgaggatctgaggggactgggtggccaaggaaagcttcctggaggaagcagggcttgagccaaarctcaaacatctgagcaaaatatatctccttcggcaccgaccatggctctctgccctgcccaggtcagtgcctgagggcacagaaatgtttgaggtctatg

SEQ ID NO: 40343 - DNA, 201 bp, Homo sapiens
agaaagagcaaggttccttgggccccctcccctccttaccagatccccgagagctatcttttggggcgggagctcttggcttctgctggtattactctgcrcccaactctccacaggttcagatttcctaccactccagccatgagcctctgcccctggcctatgcggtgctctacctcacctgtgttggtaagttggggg

SEQ ID NO: 40344 - DNA, 201 bp, Homo sapiens
gcagtgggtctgggggcccagtgggtatggcggcatcttgctggtgaactgtgaccgtgatgatccgagctgtgatgtccaggacaattgtgaccagcacrtgcactgcctgcaaggtgaggccggggcagcctgagtccctgggtgtccagggtcactgctcagttaccccatgggagttccaacccacaggcgagactc

SEQ ID NO: 40345 - DNA, 201 bp, Homo sapiens
gccacgggagggccctcctgttccagggggttgttggtgggtaacagtgccgtgtccctccttgcggcttgcctgccccttacccaaattaagacacatcrtggcttgagagggggagggcaagttttaaagcaggggtgtgtccccaaattcagggcttctcactcctgcccctgcacaccttgcttcaccagacaccac

SEQ ID NO: 40346 - DNA, 201 bp, Homo sapiens
caaacaaatgaaaaaacataacagatctaagagctctgtgacagtatcaaacagtctaaattcaatgaaattcctatagaaattccaacgtggcttttttktttgtttgtttgtttgttttaaggagttttgctcttgttgcccaggctggagtgcaatggcacaatctcagctcaccgcaacctccgcctcctgggttca

SEQ ID NO: 40347 - DNA, 201 bp, Homo sapiens
tgggagtttgctttggctcacacacttgagaagcaattagcaaagaagttgaaaatgctttatctgtaggaggcattttttagaagcagaacttctaggtyatagagaatctatattttttaacttgatagatattgccaaactgctctccaaaaacactgtatcagtatacatgtctgccaactgcatatatgctttgcc

SEQ ID NO: 40348 - DNA, 201 bp, Homo sapiens
ctgcagcccaaatacatacacacatgatcattggaaaataacatagacagaaaagtacataaagctttattttacatacatatgtgcataaagcatatgtacacacacacacacacacacacacacacacacgaataattacaaagcaaatcaaagaatagctcagaaaataaacccaagagtagcccaagaaatgaaaca

SEQ ID NO: 40349 - DNA, 201 bp, Homo sapiens
tgcagcccaaatacatacacacatgatcattggaaaataacatagacagaaaagtacataaagctttattttacatacatatgtgcataaagcatatgtacacacacacacacacacacacacacacacacgaataattacaaagcaaatcaaagaatagctcagaaaataaacccaagagtagcccaagaaatgaaacac

SEQ ID NO: 40350 - DNA, 201 bp, Homo sapiens
cctccttctcctacaggtaaccactatcttgtgataagtattttcttgcttctcctcatggttttatctcttgaacgcaatacccaaataacatggtctcrttttatcatctgattttctgtggatgcagtcatatcatgtatgttcttttgcgttgggcgtcttttgccctatgctatgtttgtgagatttatccacttg

SEQ ID NO: 40351 - DNA, 201 bp, Homo sapiens
aggtctgtgagtggcctggactcctttgggaacctggaggtcagccctccagtggtggccaatgggaaagagtaccccctggggaggatcctcattggggrcaacctgcctgggtgagagagagacagggaatggagttcctggggtggaggctgagggttgggggtggtgatgatggtggagcaggggccattgcactcc

SEQ ID NO: 40352 - DNA, 201 bp, Homo sapiens
atgtgtgcttcccaactttattctacatgttctccagcgtgtgtccatatgctgctttccaaccggcttctttcattaagtaataatcccacacacctttyctggtatttattgagctctacttcattcttttccactgctgtataatattcctaagcatagaggtgctgtgacttacacagttctctgaacatcatagtg

SEQ ID NO: 40353 - DNA, 201 bp, Homo sapiens
gatcctcattgggggcaacctgcctgggtgagagagagacagggaatggagttcctggggtggaggctgagggttgggggtggtgatgatggtggagcagrggccattgcactccttgaagagagccagaagcaaggaatgatgaaattatactcccggatgtggtggggttggtgggtgttcaccagacacagtccacac

SEQ ID NO: 40354 - DNA, 201 bp, Homo sapiens
gctgtgacttacacagttctctgaacatcatagtggtttgcagtgttttgattttataacaatgcaggttgcttgaggtcaggggctttgttcaagtccakaaccgtgccccatgggtgcactgtagttgcacagtaaatatttgatgaattaatgaatatcgagcactcttgtacagaaatattatgtgactttgtacct

SEQ ID NO: 40355 - DNA, 201 bp, Homo sapiens
actcatgctccctgggcccacagggagtcacagccaccccgtccctccccttccaggtcctgaggatgtgtgtgaggcctataggcatgtgctgggccaarataaggtgtcctatgaggtaccccgcttgcatggggatgaggagcgcttcttcgtggaaggcctgtccttccctgatgccggcttcacaggactcatctc

SEQ ID NO: 40356 - DNA, 201 bp, Homo sapiens
ggagtgccatggcatgatcacagctcactggcagcctggaactcctgggttcaagtgatccttctgcctcagtctcccgagtagctgagaccacaggtgcrgccaccaggctcagctaattttttgtagagatggggtcttgccatgttgcccagggttgtctcaaactcctggcctcaagcaatcctcccgcctcaccct

SEQ ID NO: 40357 - DNA, 201 bp, Homo sapiens
gatgtgaagttcattcacactgggccatcttttcctccagaaccagaggggtcaggactgacctgggcacatttatggatccaactcaggccactgtgagkgcttctctgtgtccacctgccttggcccagtactcacagggacacccccaaggtcatgtccatgttctcgttcacctccggcctctgtcttgctgtgtga

SEQ ID NO: 40358 - DNA, 201 bp, Homo sapiens
ctcttgcttcccaagaccccctggagaaggagttgtcccagttctgctgagttgggtctcagtttccccacatgtaggctgagggttgactaggggatctytgccactttgaatgaaagagagaaagcagggacaggggagggacaccggtgcctgggaagacccccttcctaggtgacagcatttccccaaggcgctttg

SEQ ID NO: 40359 - DNA, 201 bp, Homo sapiens
cccagcctggtctaaaacctaattcttgactctggtcccagcaccacctgagccctcggcttgcagcccctcccttccccaacctcagatgtagcttgttyacctgtgctaagcccttgttcagaccgtggtcctggggaccctcctgggcaggggtgcttcagtcttcactggggatcccccagcatctcacacagagcc

SEQ ID NO: 40360 - DNA, 201 bp, Homo sapiens
tcttcactggggatcccccagcatctcacacagagcctggcacatggagaggcaggggcgctgggctgaaacaccctacacccaggggctggagcctgggractgagtggggttttcataccagaaggaccatcaagggcgctcagcccttgcccatggacactggaggcccaaggaacagctttggggttgagggagttc

SEQ ID NO: 40361 - DNA, 201 bp, Homo sapiens
ggaaacagaaaaagaacgacaagactggtgacatgtatgggagtggattctaagggttttagatccaggaaggcagaatgtaacactagcctgggctggaygcattgatacgggcacactcattagaggttctgaatttggctgttagcttctgcagctggaggtggctctaacagcttggttggttgactgaaacttgga

SEQ ID NO: 40362 - DNA, 201 bp, Homo sapiens
ggagaaagcatcctacttctcactattacctatgtgagttgtaggtgtttggatattctctttattaggataaggaaagtcttctctgttcctagttaaaratttttatgataaatgcatgttgaattctatccattgattttttttgcatctgttgagatggtcatatggtttttctttttcagtctgttactcgtttga

SEQ ID NO: 40363 - DNA, 201 bp, Homo sapiens
ctgggtgtagtcttccgtgttcacctagtgtttctaggggaaaagtcctgaatcaacacatgagaagtttgcataatgctcagattattccctaatgtatygattgcattggaacaaatacgcattttaaaaattagtgttatggcagcatgaactgcactttggatcgggagttatgagcggtgggagggtcttttctag

SEQ ID NO: 40364 - DNA, 201 bp, Homo sapiens
taagcacatttaatgttttgttagatttataccaaagtatctctctcataatttttgatgttattgtcaatgatacttttttaaagaaacacttttcagckatttattgatagtatataaaatataattggtttttaaaatatttaacttgtatcttgtgacttagtcaaattcacttattagttctaggatcttttttgt

SEQ ID NO: 40365 - DNA, 201 bp, Homo sapiens
agttaattatgttttttgtaaacaagtgaggaatgagtcgaggttattatttttacacggagaagtccagtttttccagcaccatttgttgaaaagactakcttttcatcacggaattgtccttgtacctttgtcaaaatcaattgattagatttgtgtgagtctattcttggacactctgttcttttctactgatccatg

SEQ ID NO: 40366 - DNA, 201 bp, Homo sapiens
ttctgttttatatctatattttacatgatccattttgagttaattatgttttttgtaaacaagtgaggaatgagtcgaggttattatttttacacggagargtccagtttttccagcaccatttgttgaaaagactatcttttcatcacggaattgtccttgtacctttgtcaaaatcaattgattagatttgtgtgagtc

SEQ ID NO: 40367 - DNA, 201 bp, Homo sapiens
cttgtttgtatggtaagtatatgtttaactttaaaagaaactcctaaactgttttccagagtgtacacttttatattcccactagcagtgtatgagagttscaatttctccacatccttgttagctcttggtattgtccttaaaattttatggttttaatttgtttttctctagtgactaatgacatttagcatctttcag

SEQ ID NO: 40368 - DNA, 201 bp, Homo sapiens
tggggccccaattctctgcacaatctactgttgtctttctttgcttcctttcagagcagagctcttcaaagttgtcttgctgtctcccatatctctccccrcatcctttcttttcctaaaagcttttcatttagagaaggtccaagaatagttcaatacgttctccaatatccatcatatatattcactagttactatctt

SEQ ID NO: 40369 - DNA, 201 bp, Homo sapiens
agccactccccattgctcacattactgcctgagctccacctcctgtcagatcaatggtggcattagattctcataggaacatgaaccctgttgtgaactgygcatgtgagggatctaggttgcgtgctccttatgagaatctaatgcccgatgatctgtcggtgtctcccatcactcccagatgggaccatctagttgcag

SEQ ID NO: 40370 - DNA, 201 bp, Homo sapiens
tcaatgcaatattgggttggagttgagtggtcaggaaaggctccagatctcactcaagctaaataagagtgatgagagctggtttttggaagggctagccrggggttccacacagagggtaaggcaaacataggggctgaggaaggaagaagcaggctgtggtccagggacagagagaaaggaaaggccgtggcctgttgg

SEQ ID NO: 40371 - DNA, 201 bp, Homo sapiens
catatggagctatcatgccgccagcaaaccaatgtatttttaaaaatttattcattcaacacaaactgatttaacaaaaatatgccagttacgtggtagaratggggaagtaaaatacaaatatgaacttgtcttcctggagcctacgttctggtggtgcttgggagaggtagacaacagccagcaaacacacagcataat

SEQ ID NO: 40372 - DNA, 201 bp, Homo sapiens
tcaggaatgctacgaggttctgacaggcagcttccagtcctgggtacccttggaggtggggttggtgatgctgtgacttcagcagcctaagcttctgggcmcccccccacagcatctctcatcctgatgcctattgggttcagcctcgtcctccttgtgtcgcccccacgctgttgatgatcctccagccccacttggcat

SEQ ID NO: 40373 - DNA, 201 bp, Homo sapiens
ggcatggtcaggaatgctacgaggttctgacaggcagcttccagtcctgggtacccttggaggtggggttggtgatgctgtgacttcagcagcctaagctyctgggcacccccccacagcatctctcatcctgatgcctattgggttcagcctcgtcctccttgtgtcgcccccacgctgttgatgatcctccagccccac

SEQ ID NO: 40374 - DNA, 201 bp, Homo sapiens
tccaatcacccttcttgcctgcctggtgaaaatggatctgggccctttaaattttctccctgtccaggcagcaagctgggctttgccagtagagggcgccraggagcctctgcagcagggaccttctgcttcctggttgccacgtgctcacagggcctgctcctgcagcacgtgccgctcagtgctggctgctgccgtgct

SEQ ID NO: 40375 - DNA, 201 bp, Homo sapiens
gtgttagaagctttatggggtgaaggtttggtgtggatcttgaaggactgagaggtgtgatggaagtgaattttaggcagagaggagatgtagaaaggacrgaattctccagcagcaaacattccagcgtggctttagcttcaggtgcatggagaagatggggaaagttggccagagactggtgggctttgtgtgtcaagc

SEQ ID NO: 40376 - DNA, 201 bp, Homo sapiens
tctaagcctcattccttcatctataaactggcaatgatactatgccctcatcattgggtttttatgcggagcaaataagagagatactgtgtgagaagtaycatacccagtgcctggttcttagtaagcgtgctcagcaaggattctggattcatagtggtccgtggaggaatgaattcctgtttgcaagttgtctggtgt

SEQ ID NO: 40377 - DNA, 201 bp, Homo sapiens
aatcttgactacactcaaaggtgggtggcgtggggacaactctgtcacttctctaagcctcattccttcatctataaactggcaatgatactatgccctcrtcattgggtttttatgcggagcaaataagagagatactgtgtgagaagtatcatacccagtgcctggttcttagtaagcgtgctcagcaaggattctgga

SEQ ID NO: 40378 - DNA, 201 bp, Homo sapiens
taagagctcaacagaccaatgtgagtgaacacactaaggcctctaccctttttccttcaaatgttattgttagtcctttcatctgtgaaagatagttattytcatctgaagactacggtgtagagaggtgcttaacttcaggccacataattaatcatggcagtgattaagagcttgggctgtgaacccacaggtacggat

SEQ ID NO: 40379 - DNA, 201 bp, Homo sapiens
agacaaagcccaggtgggcctcaggaggacatccacacagggagcaagggagggttttgggatggggttttgcctttagattcttctgcagagccctgcgrcctgctgcgctttgagcaggagagaagtgggagctgcttttgcatctgcatgaatctgctgttattactgtagcaaattaccaaatgcagtggcccaaca

SEQ ID NO: 40380 - DNA, 201 bp, Homo sapiens
cacaccttgtagccagacaaagcccaggtgggcctcaggaggacatccacacagggagcaagggagggttttgggatggggttttgcctttagattcttcygcagagccctgcgacctgctgcgctttgagcaggagagaagtgggagctgcttttgcatctgcatgaatctgctgttattactgtagcaaattaccaaat

SEQ ID NO: 40381 - DNA, 201 bp, Homo sapiens
gttcctgatttgcagggaagctgagccacatcctcaggatacaatgtccggtcacaccttgtagccagacaaagcccaggtgggcctcaggaggacatccrcacagggagcaagggagggttttgggatggggttttgcctttagattcttctgcagagccctgcgacctgctgcgctttgagcaggagagaagtgggagc

SEQ ID NO: 40382 - DNA, 201 bp, Homo sapiens
agaggttcctgatttgcagggaagctgagccacatcctcaggatacaatgtccggtcacaccttgtagccagacaaagcccaggtgggcctcaggaggacrtccacacagggagcaagggagggttttgggatggggttttgcctttagattcttctgcagagccctgcgacctgctgcgctttgagcaggagagaagtgg

SEQ ID NO: 40383 - DNA, 201 bp, Homo sapiens
ggactttggagcagaagaggcctgtagcagaggttcctgatttgcagggaagctgagccacatcctcaggatacaatgtccggtcacaccttgtagccagmcaaagcccaggtgggcctcaggaggacatccacacagggagcaagggagggttttgggatggggttttgcctttagattcttctgcagagccctgcgacc

SEQ ID NO: 40384 - DNA, 201 bp, Homo sapiens
agtaattctcacatttaagtgattaattctccagagttcagaacgactggttagttttacattaatgggggtttctgaatgccaagagacaatcaatcaakccttcctgccagggagagtaatgttaagatacctcaaggtacaatgaggttaagaagaggcataattaaaaccctgtcctcccctcatgcaaatttgatg

SEQ ID NO: 40385 - DNA, 201 bp, Homo sapiens
cttgttggtttctaagttcgttccatgtcatttttagatgttgctagtatcatctcccattttgatatgtttgtcttaaaggtgtctgtgttttcactgarcagaaatctatttctttgttgcttcctctcttttttttctctggccttagaaattgtgtgtgtgccttctgtcttgtttttagaagtccttccctttacc

SEQ ID NO: 40386 - DNA, 201 bp, Homo sapiens
aaccacctttatggtgctgaattcagctcttcacacacaggaggttctatttctgagctctctctgctgttccgttggtctgtctgtttttatacgaatgycttagccgtttctattgctgtacctctgggacatctcttaatgcctcggaggccagaagttttgctcttctttttcatgattaagcaactggcagaccct

SEQ ID NO: 40387 - DNA, 201 bp, Homo sapiens
acaccacatgccagggccgagaagcatttatcagtcacctgctctcagcagggcagagcccgcttcccggaatgtcatgcagccggccagttctctgtcaytctggatgattgagtgtgaggaatctatcactcagcctgccaggaggcgaggcaggaggcccggtcaccacagctccatctccacgctccttcttggctc

SEQ ID NO: 40388 - DNA, 201 bp, Homo sapiens; identical to SEQ ID NO: 8876

SEQ ID NO: 40389 - DNA, 201 bp, Homo sapiens; identical to SEQ ID NO: 8877

SEQ ID NO: 40390 - DNA, 201 bp, Homo sapiens
tttggtaggccagggtgggcggatcacttgagcccctgagtttacgaccagactgggcaacataccaagaccctgttctctacaaaataaataaatactacccccccccccaaataagaatgggtaagtgggcctaaatttaaaatagaatgaagcagccacttgctgactatggttacacaactaccctgacttccccag

SEQ ID NO: 40391 - DNA, 201 bp, Homo sapiens
gcgagacgggtgagcatcatgaagaaggggttccaggcagagagcagcgtctgcaaaggccctgcggtgggactgtggaggcctgctctggaaacagtgaggagggcatcaggaggtgaggtcagaacggtaagagtgaggagatgctggggttgcatcggatgataggatccgacttcgctgctggagacagagccgggg

SEQ ID NO: 40392 - DNA, 201 bp, Homo sapiens
gctataccatacaacctaggtaagtagtaggctataccatatctttgctttcaatggccatacatattttgggaggagaaaaatatactttataatttttwaaatatttaccgtttctgtttctctttcttcattcctgagtgctagattcagcattattttccttcagcctgaagagctttaattagcatttctttttaa

SEQ ID NO: 40393 - DNA, 201 bp, Homo sapiens
tcacaggctcacagctcagtgtttgatttctcccctgggcatttgtacccatggaccctctccctcctggacccctctgcctcctggacccctctccctcycacaaccccttctcacctccttcaacattcagctggggcaagccaccacagaagccttctctgaccttcgccttgtaccttgcatctggcttgagtcaga

SEQ ID NO: 40394 - DNA, 201 bp, Homo sapiens
ggattgctttgagcctaggaggtcgaagctgcagtgagctgtgattgcgccactgcactccagcctgggcgacagagttgagaccctgtcttgaaaaaaarccccaaaaacaaaaaaccctctggtttagtgaccggcttgtagcaaagaagtggcattagcctgggaagaccttaggatgctcttgtctaaagaccaggt

SEQ ID NO: 40395 - DNA, 201 bp, Homo sapiens
aaggtcatacaactagtaagtagcccaacaatcattcagactggctcttctgggtacctgatatggtttggctgtgtccccacccaaatctcatcttgaawttccacatgttgtgggagggacccagtgggaggtaattgaatcatgggggcaaatctttcccatgctgttcccgtgatagtgaataattctcatgagatc

SEQ ID NO: 40396 - DNA, 201 bp, Homo sapiens
tgaatcatgggggcaaatctttcccatgctgttcccgtgatagtgaataattctcatgagatctgatggttttaaaaagaggagtttttttttttgttttkttttttttttttaaaaaaactccagggcctgtgaccctaactagtcccatgtgtcggatgatgcctggaggctgtctgtgtgaaggtggtggtccgtatt

SEQ ID NO: 40397 - DNA, 201 bp, Homo sapiens
ttccggtccttgggagtggctgattaaaggcatcatcttcctgcttcctccttttcctcctctttctaggctgccaggatcttattagccctgtttacacrgccgggatgtcgagcgattaatttttaatggcttggtttattgcatgtttgaatggtttattgagtaattctcacatttaagtgattaattctccagagt

SEQ ID NO: 40398 - DNA, 201 bp, Homo sapiens
ctccctgaaccttcactttgtcaaaaggttgggctgtacccctgagctgagagaggggtgaatacatttcatctaggccacaggctgacatggggaaaggkcaggtccaaagcaagacctgggtgctgtggactggggaggcaacgaggacacagggacccagcaaatggctgcccctgaccattgcagccaccacccagc

SEQ ID NO: 40399 - DNA, 201 bp, Homo sapiens
cctccctgaaccttcactttgtcaaaaggttgggctgtacccctgagctgagagaggggtgaatacatttcatctaggccacaggctgacatggggaaagsgcaggtccaaagcaagacctgggtgctgtggactggggaggcaacgaggacacagggacccagcaaatggctgcccctgaccattgcagccaccacccag

SEQ ID NO: 40400 - DNA, 201 bp, Homo sapiens
tagttagtgtctcctcctctgattggcttgagttgggtcacatggtcctccctgaaccttcactttgtcaaaaggttgggctgtacccctgagctgagagwggggtgaatacatttcatctaggccacaggctgacatggggaaagggcaggtccaaagcaagacctgggtgctgtggactggggaggcaacgaggacaca

SEQ ID NO: 40401 - DNA, 201 bp, Homo sapiens
aacatctcatccctttactgtgtgtgttgctgatcaatgtatgtttgaacatcatctccttatatgcttgctgtttggattgctggtgtctgaatggatgygtttatacactttgtcaatttcctcatctttttgtctttttttttttcttgttggtttctaagttcgttccatgtcatttttagatgttgctagtatcat

SEQ ID NO: 40402 - DNA, 201 bp, Homo sapiens
ggatgaaggtggttgttgacaggctcagctcttgaaggacatcaggggtcacatcaaggacagacttgtaagcagaattatgacatcactggagaacgcasggctctctgggtatagctcggagaatataggggctcagagagggatcagacaaagagtgataacatacaccataaaatagatatttcactagactctagg

SEQ ID NO: 40403 - DNA, 201 bp, Homo sapiens
acatctgtgccagcacctgttggcgatcgtctagttttgctaatctgatatgtgtaaaacatctcatccctttactgtgtgtgttgctgatcaatgtatgkttgaacatcatctccttatatgcttgctgtttggattgctggtgtctgaatggatgcgtttatacactttgtcaatttcctcatctttttgtcttttttt

SEQ ID NO: 40404 - DNA, 201 bp, Homo sapiens
gctagttccaggagttgcggggtgaggctcactcgcttcggctcctctgcagtctcccaggagcttggacggctgcttccttgcagaccccctctctgtgragctgagtctgcttccgttccactctgccgtcgtcccttcttcctgccatatgttcctaatggcctcatttttcctcccaggcagagtcagtggccatct

SEQ ID NO: 40405 - DNA, 201 bp, Homo sapiens
gcggggtgaggctcactcgcttcggctcctctgcagtctcccaggagcttggacggctgcttccttgcagaccccctctctgtgaagctgagtctgcttcygttccactctgccgtcgtcccttcttcctgccatatgttcctaatggcctcatttttcctcccaggcagagtcagtggccatctgcaaacttggcagtgt

SEQ ID NO: 40406 - DNA, 201 bp, Homo sapiens
aatctttcccatgctgttcccgtgatagtgaataattctcatgagatctgatggttttaaaaagaggagtttttttttttgttttgttttttttttttaawaaaactccagggcctgtgaccctaactagtcccatgtgtcggatgatgcctggaggctgtctgtgtgaaggtggtggtccgtatttaaagcattcatcac

SEQ ID NO: 40407 - DNA, 201 bp, Homo sapiens
agagagaaagcaggggcgggacagttggtcccctcccatccaccctgcccaagcctgtcctgagtggtgtcttctgactttcttgcactgtcgaggggacrataaccacacaaatgacaacagatgccggcctgggaatggaacagcatttcctaagcaagggctggacttccctctcttttgtgccagatctagtgtctc

SEQ ID NO: 40408 - DNA, 201 bp, Homo sapiens
gtgtgccaaggtttgggaaatgccgagtcagcaggacacgcacatcaaattcaccgtgttcccagatgcctttccagccagtcccattgggctcactcccrccagcggggttgggagcttccttttcccacatctgtgccagcacctgttggcgatcgtctagttttgctaatctgatatgtgtaaaacatctcatccctt

SEQ ID NO: 40409 - DNA, 201 bp, Homo sapiens
ccacacgctgtttgaaagctctgtctgcactgctgtgaagtccactcacgagcgagctctccacggatgcattcctggctcagcctctccctaagcgatgyccactttggtcccctctctggttttccactttactaatgatgctgtagagaatgcccttgtagagtcccatcacaagcttggaggacgtggtttctctgg

SEQ ID NO: 40410 - DNA, 201 bp, Homo sapiens; identical to SEQ ID NO: 8874

SEQ ID NO: 40411 - DNA, 201 bp, Homo sapiens
acctcctgtaatctttcttctgctctctgcagtctatcctttctattggccgaagtgatcctttcacaagtgaagtcagatcatgccattcctctggccargcccccagtggcctcccacatctgcaagcatgatacagaggcttgcaaggcccttctcagatctccagtatcctccctccactcaccgtgtccttgctac

SEQ ID NO: 40412 - DNA, 201 bp, Homo sapiens
catcctaatttctaccaggatgattgagatgcatgagattgacttgcatttgttccaaacatgcttttcaaaagcaaaactgctttttaaaaaaatctatytttgttcccccaggtaaaacaagttcatgtcattctaccatttgtctggccaaggaccctctctggttttcacttttttaaagtctttccttctccattc

SEQ ID NO: 40413 - DNA, 201 bp, Homo sapiens
tgctttggagctaaggaccccacctctttgaagtgcctggagcttacttcatgccatatcggcgcttcccaggctgtgttctgcagacaagaatgttcccraaaggagtgttctgtaaccaccgtgcatcggaggcattgcgctcagtagccttctcaggatctttaatatggcagaaagcattgtgactctgcaggcgga

SEQ ID NO: 40414 - DNA, 201 bp, Homo sapiens
gagtttcagtttctgcacctctccaggcaggacagcagctgccacctgctagggctactgtggcagttcgcggtgatgccgatgttgtgcccaagccctgycatgagggcacttgatgcatggtagctattagtcataatttaggacctctctgtccctcctatgagaccacgtatgctttggagctaaggaccccacctc

SEQ ID NO: 40415 - DNA, 201 bp, Homo sapiens
cttggtcttgtaatctgacatagtcacagtttccatggattagggcatcagaatctttgtgctttggagaccgcagcattgacaggatgagaaacaagacrgctgacaggttggaggcacagaccctggagcctgataccctggttcagtccttgctcagctcctcaatagctgtggggacatgagtaagtttcccaactg

SEQ ID NO: 40416 - DNA, 201 bp, Homo sapiens
aagaagctcttgtttaagcagaaagagctcagacttccaaacccaccagggttgggatccaaatccctcccgcctctctgtggtccctgctgcctgagagyttcagtttctgcacctctccaggcaggacagcagctgccacctgctagggctactgtggcagttcgcggtgatgccgatgttgtgcccaagccctgtcat

SEQ ID NO: 40417 - DNA, 201 bp, Homo sapiens
attccggtccttgggagtggctgattaaaggcatcatcttcctgcttcctccttttcctcctctttctaggctgccaggatcttattagccctgtttacayagccgggatgtcgagcgattaatttttaatggcttggtttattgcatgtttgaatggtttattgagtaattctcacatttaagtgattaattctccagag

SEQ ID NO: 40418 - DNA, 201 bp, Homo sapiens
cagtagctgagatctggggcacctgctactaagaagctcttgtttaagcagaaagagctcagacttccaaacccaccagggttgggatccaaatccctccygcctctctgtggtccctgctgcctgagagtttcagtttctgcacctctccaggcaggacagcagctgccacctgctagggctactgtggcagttcgcggt

SEQ ID NO: 40419 - DNA, 201 bp, Homo sapiens
ggccaaaatagatgtattttctaacagacatacagacatgcatacacaccctccactccaatgtcagcttccttagggcagccactgttgtcttgttcatrgctatatctgcagagccctgtgcagtgtatggtacatagaaggtgctcagtaagtatttgttgagagctgtaactctaaccccactgcctcttcctaaca

SEQ ID NO: 40420 - DNA, 201 bp, Homo sapiens
gtatggctcgtacagggccttccctaggggtggtatccacactcctagcatggtgcttcctgggtttcaggccagtagctgagatctggggcacctgctastaagaagctcttgtttaagcagaaagagctcagacttccaaacccaccagggttgggatccaaatccctcccgcctctctgtggtccctgctgcctgaga

SEQ ID NO: 40421 - DNA, 201 bp, Homo sapiens
tcaggtgatccatgtgcctcggcctctgaaagtgctaggatgataggcgtgagccactgtgcctgggccttggatatgtccttatttagcagcatgaggayggactaatacacctgccaagggtataagtggggagtgagagtgtatgctgcattggtcatttctgacttaaatcattaaattcagcagaaggtctctatg

SEQ ID NO: 40422 - DNA, 201 bp, Homo sapiens
ctagaatgatagagtttgcacagcaccggcactgccgtggcaagtgggccagccctgagggcctcggaaggcagcagaagtctgctctctgctctggcacwttctagggacacgctgctcaagtatggctcgtacagggccttccctaggggtggtatccacactcctagcatggtgcttcctgggtttcaggccagtagc

SEQ ID NO: 40423 - DNA, 201 bp, Homo sapiens
caatggtggtctctctgtctcttcttccagttattttacgtgatgtttctcctttgccctactgcccttgccgggacttcgtttgatgttgagttgttgckcagtggcaaacttccttgccttggtgtcaatctttttttttttttttttttttttttttgagacagagtctcgcactattgttgccagggctggagtgca

SEQ ID NO: 40424 - DNA, 201 bp, Homo sapiens
gcccactttggtcccctctctggttttccactttactaatgatgctgtagagaatgcccttgtagagtcccatcacaagcttggaggacgtggtttctctrgggggtgtgccaaggtttgggaaatgccgagtcagcaggacacgcacatcaaattcaccgtgttcccagatgcctttccagccagtcccattgggctcac

SEQ ID NO: 40425 - DNA, 201 bp, Homo sapiens
tcttgatctagtcttccgacctcttcaagcttcttcagcagctgagaggatgctctagacttagattgcaacgagtagggaggtttaggtggctacttgtyggagtgttaacttctaagctgggaatttctagaatgatagagtttgcacagcaccggcactgccgtggcaagtgggccagccctgagggcctcggaaggc

SEQ ID NO: 40426 - DNA, 201 bp, Homo sapiens
ctttgcttccgcaggtcccacccacctctgcctccgccatggctgcaagaaccgttatcattgaccacgggtctggctttttgaaggctggcacggccggmtggaatgagcctcagatggtcttcccgaacatcgtgaactacctaccgtgcaaggagaaccctggccccagctatgcccgtaggcgtgtgagcctgggca

SEQ ID NO: 40427 - DNA, 201 bp, Homo sapiens
tttttttttttttttgagatggagttttgctcttgtcacccaggctggagtacaatggtgcgatcttggctcaccgcaacctccacctcctgggttcaagsgaatctcctccctcagcccccccagtagctgggattacaggtatgtgtcaccacgcccagctaattttttttgtttttgtatttttagtagagacagggt

SEQ ID NO: 40428 - DNA, 201 bp, Homo sapiens
tctatttttagttttcccttccctctgttacttgggtctaagagagaagctttagctacacgaagaaagatttaggagcaataaaaaaagaaaactctttragaggaaacgttgcagcacacaccaggaagctgggataacagattccctttggctccaatcagggaggcagtaaaactgaaattaaacagaagggtgggg

SEQ ID NO: 40429 - DNA, 201 bp, Homo sapiens
tcgtgtgaggattaaataagaatgtagtaaaatataacaggtgttctgcaaatgtaaatttgcttctatttttagttttcccttccctctgttacttgggwctaagagagaagctttagctacacgaagaaagatttaggagcaataaaaaaagaaaactctttaagaggaaacgttgcagcacacaccaggaagctggga

SEQ ID NO: 40430 - DNA, 201 bp, Homo sapiens
ccttgcagggttcgtgtgaggattaaataagaatgtagtaaaatataacaggtgttctgcaaatgtaaatttgcttctatttttagttttcccttccctcygttacttgggtctaagagagaagctttagctacacgaagaaagatttaggagcaataaaaaaagaaaactctttaagaggaaacgttgcagcacacacca

SEQ ID NO: 40431 - DNA, 201 bp, Homo sapiens
tttaatggaattccttcaagttctcctttttttgagccttaaggtcctcaggcagatttcattattttccggccatttccagttaaaatataatctgattyattttagaacctgggacctcacatctcatctaaagcactctaaacccttcccctacagcttttccaggctgctccaggagtggggagaaggaaggaatct

SEQ ID NO: 40432 - DNA, 201 bp, Homo sapiens
tataaagtaccatgtgaacattgtgtaaccctgtggttttgccttcaaatatctggaagggtcttcagaccatatccaatacaggcaagcgtccatctttytgataatcaaacatcaccatgcatatagaccagagattcgtgtacaacattcatgttctgctgtcttcgggcctcagataaggagcttgaagccccttct

SEQ ID NO: 40433 - DNA, 201 bp, Homo sapiens
ccacatgcctaccttcctttcacatccacagctctggactggggccgggagtcaaggtgggctgctgcctcagctcagagcttcccagccaggatacaagygtgcccagctctgatgccctcagccctcggagcagccaggcagggcctggggtagccaaagcctgaggaagatcactgcctgccatggacggcctcatcc

SEQ ID NO: 40434 - DNA, 201 bp, Homo sapiens
ttatttttctttatagctagtgctttataaaatagatatattttctttttctttttcttttttttttttttttttttttttttgagattaagtctccctcygtcacccaggctggagtgcagtggcgcggtcttgggtcactgcaacctctgctgggttcaagcgattcttctgcctcagcctcccaagtagctggcctac

SEQ ID NO: 40435 - DNA, 201 bp, Homo sapiens
ccttccttgttctgctcactgtagcctggcctcctgctgtgggatgcaggcagggatgggggcgtcatctctggggctcttgtgaaattattttaagaccrtggaaaacaaattagaatttcaaaccatccagccctcttgaaagcagactgggggtgtgttcgaagtaatgtaatttttgctttgttttattaataggat

SEQ ID NO: 40436 - DNA, 201 bp, Homo sapiens
aggagttgcatcgtgctggcactgaacagcagatcccggatgactgtgcgtgcgtgtgtgtgtgtgtgtgtgtgtgtgtgttggagggcagtggtgcacayatttatcagatgatggggcttagggcagaatccccttttacctgggctgaaaggagttactaccgcgggtaaggaacagagctggggtgtgacctcaggc

SEQ ID NO: 40437 - DNA, 201 bp, Homo sapiens
cagaggtcagtggagagtggagacaggaggacataggctctctctctggggtgtgggaagggacaggaccaccatcaggttcacatctgcattttttgggraccaaaggcttcttgccctgggagagagaaagcaggggcgggacagttggtcccctcccatccaccctgcccaagcctgtcctgagtggtgtcttctgac

SEQ ID NO: 40438 - DNA, 201 bp, Homo sapiens
gtttaaagcagatacaatgcattttgaccatcagatgtctgtttgtcttgtggttctaggctgtgttctggagagtgaagggtgccagataaataagttayttagcctgttacttagcctgttactgtttgttttttgtgtctaaatggcctgaagtgagaggaagaatggagaacaggggaggaaagtgagcaggacctc

SEQ ID NO: 40439 - DNA, 201 bp, Homo sapiens; identical to SEQ ID NO: 8878

SEQ ID NO: 40440 - DNA, 201 bp, Homo sapiens
actcacagttctggaggctgtacgggaaccatggttagggaggcctcaggaaacttacaatcatggccgaaggtgaaggggaagcaagcatcttcttaacrtggtggagtggaggagagagaaagagtgaagggggaattgctacatgcttttaaacaaccagatctcatgagaactcactatcttgaggacagcaagggg

SEQ ID NO: 40441 - DNA, 201 bp, Homo sapiens
gactgagatcaaggtatcagcagatccccagtaacctccgaaggctctggcagaggatccttccttcctcttccagcttctggggaatcctgttcctggcrtgtggctgcatcactgccatctccggctctgtccttacatggccttcctctctgtgtgtctgtgttctttccccttcttagaaggatatcaggaacattt

SEQ ID NO: 40442 - DNA, 201 bp, Homo sapiens
gatcatggcttactgcagcctcgacctcctgggctcaagcaatcctcccacctctgcctcctgagtagctgggactataggcatccaccaccgttcctggstaatgatttttttttttttttttttttttttttttttttttttagagatgggggtcttgccatgttgcccaggctgatcttgaatcctgggcctgggccc

SEQ ID NO: 40443 - DNA, 201 bp, Homo sapiens
cactctggctcataagtcaaagtggggcttgtgatggtcagggatagagtcttagctgtagtctgactctcagtagatttgcttggtccatgcccaccccraagttattttctgagctcctgaataaacaattagagtaagcacacttggtaattatccattttcttctctcttcttcccatttttgttttatatgcaagt

SEQ ID NO: 40444 - DNA, 201 bp, Homo sapiens
gcacaagtccttattggagggagccaggtccctatccctctctgggcccagaatgtggccagactggtgggggtgggtgcttcactgcagagggaggaaaraggagctaccctatgcaaactcggggacaggggtcattgcggcttaatttttttttttttttttttttggtagagacaaggtcttgctatgttgcccagg

SEQ ID NO: 40445 - DNA, 201 bp, Homo sapiens
ctcaaactcggggtggagtgggtccctcaacccttttccccacttctgcgggaccctcggcccctccccgtgtcccctgcctccagcctggaaggaggttmtgacgaattggagggctgcagatccccctgctggctccacagcctttgtaagcagctcattacgtcttccccatcctattcctcattagccgcaggtgct

SEQ ID NO: 40446 - DNA, 201 bp, Homo sapiens
cactatcttgaggacagcaagggggaagtccgcccccatgatccagtcacctcccaccaggtcccttctccaacattggggattacaattcaacaggagayttgggtgggacacagagccaaaccatatcaggaattgaacttctaccttccatgcctcataggaacattagaaagcgagttccattgtcctctgtgggtg

SEQ ID NO: 40447 - DNA, 201 bp, Homo sapiens
tgcaaatgtaaatttgcttctatttttagttttcccttccctctgttacttgggtctaagagagaagctttagctacacgaagaaagatttaggagcaataaaaaaagaaaactctttaagaggaaacgttgcagcacacaccaggaagctgggataacagattccctttggctccaatcagggaggcagtaaaactgaaa

SEQ ID NO: 40448 - DNA, 201 bp, Homo sapiens
cagttattttacgtgatgtttctcctttgccctactgcccttgccgggacttcgtttgatgttgagttgttgcgcagtggcaaacttccttgccttggtgkcaatctttttttttttttttttttttttttttgagacagagtctcgcactattgttgccagggctggagtgcagtggcgtgatctcggctcaccacaccc

SEQ ID NO: 40449 - DNA, 201 bp, Homo sapiens
acttcgtttgatgttgagttgttgcgcagtggcaaacttccttgccttggtgtcaatctttttttttttttttttttttttttttgagacagagtctcgcmctattgttgccagggctggagtgcagtggcgtgatctcggctcaccacaccctctgcacccgggttcaatcaattctcctgcttcagcctcccgagtagc

SEQ ID NO: 40450 - DNA, 201 bp, Homo sapiens
ctcggctcaccacaccctctgcacccgggttcaatcaattctcctgcttcagcctcccgagtagctaggactaaaggtgcgtaccaccatgcctggctaakttttgtatttttagtagagtctgggttttgatatgttggccaggctggtctcaaactcctcacctcgtgatccacccacctcagcctcccaaagcgctgg

SEQ ID NO: 40451 - DNA, 201 bp, Homo sapiens
gcacccgggttcaatcaattctcctgcttcagcctcccgagtagctaggactaaaggtgcgtaccaccatgcctggctaatttttgtatttttagtagagwctgggttttgatatgttggccaggctggtctcaaactcctcacctcgtgatccacccacctcagcctcccaaagcgctgggattacaggcatgagccact

SEQ ID NO: 40452 - DNA, 201 bp, Homo sapiens
cagcctcccgagtagctaggactaaaggtgcgtaccaccatgcctggctaatttttgtatttttagtagagtctgggttttgatatgttggccaggctggkctcaaactcctcacctcgtgatccacccacctcagcctcccaaagcgctgggattacaggcatgagccactgtgcccggccaccttggtgtcaatcttaa

SEQ ID NO: 40453 - DNA, 201 bp, Homo sapiens
gaaggatgaaggtggttgttgacaggctcagctcttgaaggacatcaggggtcacatcaaggacagacttgtaagcagaattatgacatcactggagaacrcagggctctctgggtatagctcggagaatataggggctcagagagggatcagacaaagagtgataacatacaccataaaatagatatttcactagactct

SEQ ID NO: 40454 - DNA, 201 bp, Homo sapiens
gtggccagtgtgggaatgatagaggggctgatgacacaggcccgacccgggtcatgagaagccaggccctgcctgcctctccccaggactgtttttgcctrgaggtgggataggcacccattctagaaatgtccccgtccctggcctccccacttaccttgtactctttctctgcctctccagccctgttcctcctataca

SEQ ID NO: 40455 - DNA, 201 bp, Homo sapiens
caagcttcagggggagcctgaggtttgactgttgggtagagggggaagctgcttatggtggcctaggctgcctgcacaactaaccccatcctttgcttccrcaggtcccacccacctctgcctccgccatggctgcaagaaccgttatcattgaccacgggtctggctttttgaaggctggcacggccggctggaatgagc

SEQ ID NO: 40456 - DNA, 201 bp, Homo sapiens
gcagcaatcataccagcattattggagttttaataagagtcaattggttattgtcctcgctgcgtcggacactgtcgacgtaatcctccgaagcccctcgrgaagatagggagtttgctttctttgctggaatattatttacgttaataacaaggattagaggcttgttctatgtgtttaggagaagcagagcttttcttt

SEQ ID NO: 40457 - DNA, 201 bp, Homo sapiens
ctttttctgtaaaagaccagattgtaaacattttgggctttgtgggccatatggtctctgtcggacgctgcaactcagctgttgtaacttgaaagcagccrtagatagataatatgtaaatgatgggcgtggctgtgttccaataaaactttatttatagacactgaaatttgaatttcagatacttttcatgtgtcacaa

SEQ ID NO: 40458 - DNA, 201 bp, Homo sapiens
aatttgtcttttctcttaccgaagtgcttttgcagctcaaatcctccctgcacctcagagctgtgccctccttctgtcgacagcactacatacaaccagcytccacggtgtgtggattcaggttgctgtttgtttctatgaagttgagccggggctgctggggagtgtttccctgggccctgaatggtactagtcatgagg

SEQ ID NO: 40459 - DNA, 201 bp, Homo sapiens
ttttcttttttcttttcttttcttttcttccttcctttcctttttccttcgttctggcgtcttttttcttgtctgtcttatctttctggtctgtcttttcyagtcttcctccactgtttggagacagtggtgaatacgcaacacttgtttcttttctaatctgttcttccttctaaagaggcggttcaggctgcacatgtg

SEQ ID NO: 40460 - DNA, 201 bp, Homo sapiens
cagctgttgctgtgtagggcttcttgggccacatctttggattattttcaagaaaatccagaaatctgaactatgctccaaaataattgaaattttaaatrttagcaacttatttgaaatttttgaaagatagtataggccaataatagtagctccatggcctgaaactggcctgtggagtcaccagcttgcagtgtctgg

SEQ ID NO: 40461 - DNA, 201 bp, Homo sapiens
tcatatgaattgttcagggtttcgaaatgttcccaagctgcagcgttgagctgttgtgaacgctgttctaatttagctgctaattcgtatacctctactaycccaatgaggagcatgaagagaaacaagaaaatggatgccctgcatttctaggaaatgagtcttcatttcgtgggaatctattgcaggagtgctaacagg

SEQ ID NO: 40462 - DNA, 201 bp, Homo sapiens
gtttactaggtaaaatacgtgatgcctagttagacttgagtttcagataaattacaaataatgtcttagtatttaagtatgtttcatattgcatggggcayacttacactacaatattatttattattgatctgacattcacatgtaactgggcatcctgtagttttatttgctgaatttggcaacccttactgtctatcc

SEQ ID NO: 40463 - DNA, 201 bp, Homo sapiens
caaacaaacaaaaaaacccaacagaaaccaacaaattgccccacaaacatttcccaagaacctagtgaatgcctggtgtgccactaagcaggggagctcayggaggccccacctgcagacggacatgcagcaaccaacgtgcttggtggaaagggggttaccagggagacgtggaatatttgcttatggattccataattg

SEQ ID NO: 40464 - DNA, 201 bp, Homo sapiens
ctagggctgggttgcctggaataggaggggcgtttggggaatggagctctgagtcaggctcactgcaggggcgaaggcctggaggctgggtttggtggagktgaggggcagagttgctgactcactgctagggagtggggagtgaggctggagctgcaggctgaagatgtctttggacaccaggctgaggagtgtagtctt

SEQ ID NO: 40465 - DNA, 201 bp, Homo sapiens
cagcattgctcagcatctcattcccctgatgcccctttctgccagggctgaaccctcaggaagtcccctggggcctttaaaagctgagctagggagggagrgagcccagctggtggctcgctctgctcagtgggggctgctgggaaatgctgctctttcctgggtgtcttaccagggtggagatgttgaagtcagcaatgg

SEQ ID NO: 40466 - DNA, 201 bp, Homo sapiens
gtttggggagaggatcactcctggaaaggaattttggggtgctggtgtcagaagaagagaggctgggcacttggctgctacaagtacctcctgtaccctaraagagccacacatgtgagctgtgttttggtcttttaagatgctaaggatggaggatatcatcaaatggaatgttaaagtacaggaccgagttcctctgag

SEQ ID NO: 40467 - DNA, 201 bp, Homo sapiens
ctcattgttgcctttatttacttatttcacacgagacaatgtccctgcttggcttctcggctcagtctgatgccgtgactgctgacacgggaggaatgacrctgcgttactcaagcaggtggcagtgtggcttttctcgaaagcatgaggccccagcctccctgggtgtgcagaatgggtgctcgtgaatccctctggtgg

SEQ ID NO: 40468 - DNA, 201 bp, Homo sapiens
ccccaccgtactttgtcctcattgactagtttcaggaccggcctagcttctagggaggcctgggaaaggagtcctcattctgtgcaaacttgggcttcttwgagcctatttcctccactataaacagtctgactgccttgcagggttcgtgtgaggattaaataagaatgtagtaaaatataacaggtgttctgcaaatgt

SEQ ID NO: 40469 - DNA, 201 bp, Homo sapiens
ccaagctttgaccatactgccatataaatcatctagaaagccataattcctggaacttactgcatttttttctcaggggtgttcatttgttcattcattcytaagctatggttgaatgaatgaatgaatgaatctattatgtactgaccattgttctaggtgctgaggattcagtcctgggcaaaacagacaaagttttgc

SEQ ID NO: 40470 - DNA, 201 bp, Homo sapiens
ctgtacttgctgcctgtttcctctctgaaccctgaatctcatttcttcctctgaggagtggggagatgaatccccagccttccaggtggctgataattaarttgtgggatggaagtaaagcggtttgcacagggcctggccgtcagtgggcttccagcaaacgggagccaatgttcctggcaggggctgggtacagggcag

SEQ ID NO: 40471 - DNA, 201 bp, Homo sapiens
cagatggggaaatagaagctcagagagatgcagtcgcttggccaaggctgctcagcagtggagagtgggtaatatctgaacctaggtctggctgacctttwagcccgtggttaagagcccagtggagtggaatcacagtactgccatttcctagctgtgtgaccttggacatagttacttaacttccttttcctcatctat

SEQ ID NO: 40472 - DNA, 201 bp, Homo sapiens
caaacacttggtgagccatgttgactggaaaggttccattctgcaacatgtctctgattcttgataggaacatttggactatccccttttgtcctgggagrtaagaggacgcacctaataggttgttgtgacaatgaaatgagcaaatgcaggtaaatttcctagagcagttgacagcacagatgtacactgccttgctgg

SEQ ID NO: 40473 - DNA, 201 bp, Homo sapiens
acagatggggaaatagaagctcagagagatgcagtcgcttggccaaggctgctcagcagtggagagtgggtaatatctgaacctaggtctggctgaccttwtagcccgtggttaagagcccagtggagtggaatcacagtactgccatttcctagctgtgtgaccttggacatagttacttaacttccttttcctcatcta

SEQ ID NO: 40474 - DNA, 201 bp, Homo sapiens
gcacctaataggttgttgtgacaatgaaatgagcaaatgcaggtaaatttcctagagcagttgacagcacagatgtacactgccttgctggtccttcaggktcttagatttcaaccctctcatcccactgtgacagggatgcttgtagggtcctttgccctaactcactatggctccagatagttgttagctagtttatat

SEQ ID NO: 40475 - DNA, 201 bp, Homo sapiens
actaagaagctcttgtttaagcagaaagagctcagacttccaaacccaccagggttgggatccaaatccctcccgcctctctgtggtccctgctgcctgasagtttcagtttctgcacctctccaggcaggacagcagctgccacctgctagggctactgtggcagttcgcggtgatgccgatgttgtgcccaagccctgt

SEQ ID NO: 40476 - DNA, 201 bp, Homo sapiens
ctgtggtccctgctgcctgagagtttcagtttctgcacctctccaggcaggacagcagctgccacctgctagggctactgtggcagttcgcggtgatgccsatgttgtgcccaagccctgtcatgagggcacttgatgcatggtagctattagtcataatttaggacctctctgtccctcctatgagaccacgtatgcttt

SEQ ID NO: 40477 - DNA, 201 bp, Homo sapiens
caggtatccagcatttctcaagcttgaccaataatcagaccttcctgtcctgccttcagaatgcagtgtagtgtgcagtcgagagaatattctggaagccyacaggcctgggtgtggctctggcagcttcctgtacttgctgcctgtttcctctctgaaccctgaatctcatttcttcctctgaggagtggggagatgaat

SEQ ID NO: 40478 - DNA, 201 bp, Homo sapiens
aggtatccagcatttctcaagcttgaccaataatcagaccttcctgtcctgccttcagaatgcagtgtagtgtgcagtcgagagaatattctggaagcccrcaggcctgggtgtggctctggcagcttcctgtacttgctgcctgtttcctctctgaaccctgaatctcatttcttcctctgaggagtggggagatgaatc

SEQ ID NO: 40479 - DNA, 201 bp, Homo sapiens
ttattgcatgtttgaatggtttattgagtaattctcacatttaagtgattaattctccagagttcagaacgactggttagttttacattaatgggggtttytgaatgccaagagacaatcaatcaagccttcctgccagggagagtaatgttaagatacctcaaggtacaatgaggttaagaagaggcataattaaaaccc

SEQ ID NO: 40480 - DNA, 201 bp, Homo sapiens
tatttagggtttggcagagtgtgctttcatacgacagcatctgagttaagttgttgcagcagagactgtttgagaccatacatcaagttaaaggctaaaayatttactattgtaggtttactaggtaaaatacgtgatgcctagttagacttgagtttcagataaattacaaataatgtcttagtatttaagtatgtttca

SEQ ID NO: 40481 - DNA, 201 bp, Homo sapiens
tttactttcttaatccttatgacagctctatagagctagatactgtttattatctcctccttgcagatgagacaagacacagagaggttaatttactcaargtcacacagctggtcaggcccatctctagcatttgcaatactggggaagagtataaatggacacacagcaattctagatatttaaagctgtaaaacaaga

SEQ ID NO: 40482 - DNA, 201 bp, Homo sapiens
ccaatgtcacattgtcttgatgactgggttttctgtctttttttttttttttgagacagggtctggctgtgtggcccaggttggagtgcaatgatctgatstcagctcactgcagcctctgcctcctggcttggcctcccaagtagctgggactacaggtgcatgccactgaacctggctaatttttttattttttgtatt

SEQ ID NO: 40483 - DNA, 201 bp, Homo sapiens
aatgatctgatgtcagctcactgcagcctctgcctcctggcttggcctcccaagtagctgggactacaggtgcatgccactgaacctggctaatttttttmttttttgtatttttagtagagatggggtttcatcatgttgcccaggcttgtctcgaactcctgagctcaagtgatctgcctgccttggcctcccaaagtg

SEQ ID NO: 40484 - DNA, 201 bp, Homo sapiens
atgatctgatgtcagctcactgcagcctctgcctcctggcttggcctcccaagtagctgggactacaggtgcatgccactgaacctggctaatttttttattttttgtatttttagtagagatggggtttcatcatgttgcccaggcttgtctcgaactcctgagctcaagtgatctgcctgccttggcctcccaaagtgc

SEQ ID NO: 40485 - DNA, 201 bp, Homo sapiens
tgtgtgtgtgtgtgtgtgttggagggcagtggtgcacatatttatcagatgatggggcttagggcagaatccccttttacctgggctgaaaggagttactmccgcgggtaaggaacagagctggggtgtgacctcaggctgcctgattcgagtcatatccccgatcataacatcatgtaactttctctaccatattgtctt

SEQ ID NO: 40486 - DNA, 201 bp, Homo sapiens
tcagctcactgcaacctccgcctcccgggctcaagcaattctcctgcctcagcctcccaagaagctgcgactacaggcgtacgccaccacgccctgtcaattttttttttttttttgtattttagtagagatggggtttcactgtgttgcccaggctggtcatgaacttgtattttagtagagatggggtttcactgtgtt

SEQ ID NO: 40487 - DNA, 201 bp, Homo sapiens
aatgagcaaatgcaggtaaatttcctagagcagttgacagcacagatgtacactgccttgctggtccttcagggtcttagatttcaaccctctcatcccaytgtgacagggatgcttgtagggtcctttgccctaactcactatggctccagatagttgttagctagtttatatctgctattcttcatctcaatcttcact

SEQ ID NO: 40488 - DNA, 201 bp, Homo sapiens
actagaccttagaggccctcaggcacaaatctttgtctacactacatctcttcatgaccacttccatcccaaccacttttcttttttctttctttcttttytttttttcgagatggagtctcactctgtcacccaggctggagtgcagtggcatgatctcggctcactgcaccctccatctcctgggttcaagcaattctc

SEQ ID NO: 40489 - DNA, 201 bp, Homo sapiens
gggcaacagagcaaggccctgtctcaaaaaaacaaacaaacaaaaaaacccaacagaaaccaacaaattgccccacaaacatttcccaagaacctagtgartgcctggtgtgccactaagcaggggagctcacggaggccccacctgcagacggacatgcagcaaccaacgtgcttggtggaaagggggttaccagggaga

SEQ ID NO: 40490 - DNA, 201 bp, Homo sapiens
gattgggcaccaggaattctgctttttaagataaattgccaaccaggtgtggtggcttatgcctgtaatcccaacactttgggactcccaggcaggcagaytgcttgagcccaggagttcaggaccagcctgggcaatatagtgagacccctgtctctataaaaaatacaaaaattagccaggtgtggtcccagctacctg

SEQ ID NO: 40491 - DNA, 201 bp, Homo sapiens; identical to SEQ ID NO: 8873

SEQ ID NO: 40492 - DNA, 201 bp, Homo sapiens
ggtagagggggaagctgcttatggtggcctaggctgcctgcacaactaaccccatcctttgcttccgcaggtcccacccacctctgcctccgccatggctkcaagaaccgttatcattgaccacgggtctggctttttgaaggctggcacggccggctggaatgagcctcagatggtcttcccgaacatcgtgaactacct

SEQ ID NO: 40493 - DNA, 201 bp, Homo sapiens
ctggcacatagttggctctctataaagcttggatgaacaccagtgggcaagccaggggggactggtcataaagtcagcctgaaaactgggggttcacttcyttccagcccaatgtttcttcttattgctctgttaggcatggtcaggaatgctacgaggttctgacaggcagcttccagtcctgggtacccttggaggtgg

SEQ ID NO: 40494 - DNA, 201 bp, Homo sapiens
tctgttccatggatctatgtttgtgactattcccttttttttctttttgagatggagtctcactctgtcgcctagtctggagtgcagtggcacaatcttgkctcactgcaacatccgcctcccggtttcaagcgattcttgtgtctcagcctcccaagtagctgggattacaggcgcactaccacaccagctaatttttgt

SEQ ID NO: 40495 - DNA, 201 bp, Homo sapiens
tttgtaagcagctcattacgtcttccccatcctattcctcattagccgcaggtgctctccatgagagggttgccaggatttctgagttttagtggcacctrgggcaggggaaggcttatggcaaaatgttccttagtcttttctcccccattccctccccctgcagaaaaggatgagcggttgggagccttggggctgaca

SEQ ID NO: 40496 - DNA, 201 bp, Homo sapiens
tttcaccatgttggccaggcttgtctcgaactcccgacctcaggtggtccgccctcctcggcctctcaaagtgctgggattacaggcgtgagctgccgcgsccggccctgttcttaacacatgacttagctctaatgcctccagcatctagggaaggagatcacatcgtgggtttctcctcatctcaggtgggaaggtctc

SEQ ID NO: 40497 - DNA, 201 bp, Homo sapiens
agtggaaatgcaggtcatacggtaggtgtatgttgaacttttttttttttttttgagatggagttttgctcttgtcacccaggctggagtacaatggtgcratcttggctcaccgcaacctccacctcctgggttcaagggaatctcctccctcagcccccccagtagctgggattacaggtatgtgtcaccacgcccagc

SEQ ID NO: 40498 - DNA, 201 bp, Homo sapiens
tggtgtgatcttagctcactgtaacctctgcctcttgggttcaagtgattctcctgcctcagcctcccaagtagctgggattacaggcacccaccaccacrcccagctaatttttgtatttttagtagagacggggtttcaccatgttggccaggcttgtctcgaactcccgacctcaggtggtccgccctcctcggcctc

SEQ ID NO: 40499 - DNA, 201 bp, Homo sapiens
tgggcggattgcttgagcccgggagtttgagaccagcctaggctgttgcctaggaaaattagctgggtgtgcatggcttgcacctgtagccccagctaccyaggaggctgaggtgggaggattgcttgagcccaggagattgaggctgaagtgagacgcgatcgtgccactgccctccagcctgcgcaagagcgagatcct

SEQ ID NO: 40500 - DNA, 201 bp, Homo sapiens
tgttagcaacttatttgaaatttttgaaagatagtataggccaataatagtagctccatggcctgaaactggcctgtggagtcaccagcttgcagtgtctrgattatttgggtctcctccagccagatgagctatggctacatttaataggcgtataaataaaaataaaatatttgccttctagatatgttgatttgtatt

SEQ ID NO: 40501 - DNA, 201 bp, Homo sapiens
tccagtatcctccctccactcaccgtgtccttgctacacaggcctgctggctgatcctagaactcatctgaccttgtcttcctcagggcctttgcacttgytgttcctttggggtggaatgcttttccaggtattcacatgccttattccctcacttcattcagttttctgctcagatgtcaccctagaaggaggcctttg

SEQ ID NO: 40502 - DNA, 201 bp, Homo sapiens
gcttagagacaactctggacctagaaggtggggcacagctgcccgttgctgtgcagtgctgggcactttctgatgccttcttgtggcatccctcagaggartgggtggacaaggtggccttgggttctgggcactttgcccagccccctgacaatcacctcagctggcatcttgcctgtccaagccccgagctgctgtgcc

SEQ ID NO: 40503 - DNA, 201 bp, Homo sapiens
taacttccatgttgctaaatccaatggatagtcctttgttttcctcctaatttctcatcccattcgattcttcccttcttgaaatactttctctgctcggycccgggacactgttccctctgggtttcttgccctcctccctggccattctcactcagtcctctttattggtgccttcccaaggcctggccactagacctt

SEQ ID NO: 40504 - DNA, 201 bp, Homo sapiens
ggtttttcacaggcgtgcataggatcgttggcaggactgagtgggatgaagcatgaggggcacttggcatggggctggcatggagcagatgcacagtggtkgcagccaacaggactgccatttttaggtgtttcaggcaggatgtcctagcttccccctggtgctagccattatgtgttcacagtccaagagcccaggggg

SEQ ID NO: 40505 - DNA, 201 bp, Homo sapiens
atatagtccatgacgactcctgggcctattagtctccttgttttggggagtgagtgagaacttacaaggatgatagctgcatctttttagatagaaatacrcagttgtgttgttgtacaggacttcagtggtgtgcaggaggattcatatggaagctaagtagtcaaagagatgggcttttctggttatcaattattgctt

SEQ ID NO: 40506 - DNA, 201 bp, Homo sapiens
ccccttgaggaaggagcctgcatcattgccataaatacttattgtaaatcttcctccaaaccttcctccaaagggacctgtgaccatttaccaaaataatrgggaaatggacatacccagacagttctggagttacttggcactaactctgaactgatgctgtttcctggggatctaaaatgccactctggctcataagtc

SEQ ID NO: 40507 - DNA, 201 bp, Homo sapiens
ttttctcaggggtgttcatttgttcattcattcctaagctatggttgaatgaatgaatgaatgaatctattatgtactgaccattgttctaggtgctgagsattcagtcctgggcaaaacagacaaagttttgcccccgtgcagttccattctagttgggggagacaagatatgcagatgatgaatgtggtttcaggttgg

SEQ ID NO: 40508 - DNA, 201 bp, Homo sapiens
tatcccttgaataggggctcttcccagggggcctcagccctgggggcctcttcttgggaacttttttttaaacctctagtgggggacttatctttggggawcctatgaaagcccccaggggctctttcttggggactctaccttggccttgaggggttcttccttgagagctttgtccagctctggtttgggggattctta

SEQ ID NO: 40509 - DNA, 201 bp, Homo sapiens
gcctgccggggcctgctcccactcgggagcgggaaacagactgacactatgtctggactgattgggcaccaggaattctgctttttaagataaattgccawccaggtgtggtggcttatgcctgtaatcccaacactttgggactcccaggcaggcagattgcttgagcccaggagttcaggaccagcctgggcaatatag

SEQ ID NO: 40510 - DNA, 201 bp, Homo sapiens
gtatgtgcataaaggtttttgtgtgaacgtacgttttcatttcccttgagtaaatacgtaagagtggaaatgcaggtcatacggtaggtgtatgttgaacttttttttttttttttgagatggagttttgctcttgtcacccaggctggagtacaatggtgcgatcttggctcaccgcaacctccacctcctgggttcaag

SEQ ID NO: 40511 - DNA, 201 bp, Homo sapiens
gttgagtgcctgtcactgggggtgtcaagcagaggacagatactcctgacatgctgcagtggagggggcgtgctcaccggctggacaaatggacactgagrtgctggggtcaccaccgtttcttgcagcaccatcaaggctaatggaagagggggtgttttcctattcttccacggtccttttcttaattcgtgaagtatc

SEQ ID NO: 40512 - DNA, 201 bp, Homo sapiens
atggtgcgatcttggctcaccgcaacctccacctcctgggttcaagggaatctcctccctcagcccccccagtagctgggattacaggtatgtgtcaccaygcccagctaattttttttgtttttgtatttttagtagagacagggtttctccatgttggtcgggctggtcttgaactcctgacctcaggtgatctgcccg

SEQ ID NO: 40513 - DNA, 201 bp, Homo sapiens
ccaaatacagtggtaggtgccggcttagctctacccttatgcgtttatttatgatgccatagagtggagcagctttgtatcaggattgagcatttccagastgcccggttctgtcctagttacttgacacaagctggggagcaatttagcctgatgaagaggaggcggggctgcaaggctcacatttctgctctcccctta

SEQ ID NO: 40514 - DNA, 201 bp, Homo sapiens
acatgcacaggccacattctccccatttgaacaggagagacagagacagaaagcaggagaacagggaggtggtgggagacaggatgcagcgctaaccttcrctgtggaccttgtgcagtgcatgcgcttcgtgtatccccgtgaggctgagctctgctgggtgtagtcttccgtgttcacctagtgtttctaggggaaaag

SEQ ID NO: 40515 - DNA, 201 bp, Homo sapiens
ctggtgagcatcagaagcctgtggtaatgtaccttaatgccattttttttttttttctgatctgggatcagaaactgtgcgtggtgttggctgccatgtcyttcaattttgaacacttctttaatatttcattgttgtgtatgctgtgatatttttgcagagcctgggccagtttggtagaattgctctcaatctctcacc

SEQ ID NO: 40516 - DNA, 201 bp, Homo sapiens
gagggctgaaggaggcttacttcatcctggtgagcatcagaagcctgtggtaatgtaccttaatgccattttttttttttttctgatctgggatcagaaamtgtgcgtggtgttggctgccatgtctttcaattttgaacacttctttaatatttcattgttgtgtatgctgtgatatttttgcagagcctgggccagttt

SEQ ID NO: 40517 - DNA, 201 bp, Homo sapiens
ttttgaggacgtttactctgtcacaggtggcaggagggtgtctcttcgggactctaccgcagccctcaggggctttttctttgtggactttatttcagccytcggaggggactcttccttgggggatcaatcacagccctgggtagggggccccttccttggtagctctgggagctcttctttggggctctatcttatccc

SEQ ID NO: 40518 - DNA, 201 bp, Homo sapiens
tttttcattttgtctagaatttttagtcctactcagtaggaaagagggctgaaggaggcttacttcatcctggtgagcatcagaagcctgtggtaatgtaycttaatgccattttttttttttttctgatctgggatcagaaactgtgcgtggtgttggctgccatgtctttcaattttgaacacttctttaatatttcat

SEQ ID NO: 40519 - DNA, 201 bp, Homo sapiens
aatttctattgatatttgaaaatccccttactcattcctctgtcgtctctattctatggagcagaacttttctttgtttttattttttattctaaattaaraatttacaattgtataaatgtatgggatacaacatgttataatttatgaatacaaggtggaataagtaaatcaagctggttaacacatccattacctcta

SEQ ID NO: 40520 - DNA, 201 bp, Homo sapiens
ttacaattgcctacagtatttagtacaataacatgcagtaccagtttgtaccatagcaagactccatatctaccaacagtacgtactattattttacaatygcctgcagtattcagtacaataacatgctgtacccgtttatagcatagcaagactccatatctaccaataaaacaagacaatacataccattatgttaca

SEQ ID NO: 40521 - DNA, 201 bp, Homo sapiens
acaatacataccattatgttacaattgcctacagtatttagtacaataacatgcagtaccagtttgtaccatagcaagactccatatctaccaacagtacrtactattattttacaattgcctgcagtattcagtacaataacatgctgtacccgtttatagcatagcaagactccatatctaccaataaaacaagacaat

SEQ ID NO: 40522 - DNA, 201 bp, Homo sapiens
taagtaaatcaagctggttaacacatccattacctctaatccttaacattatttgtgatgagagctttcagaacttactgtcagcgaatttgaaatgtacrgtactctgttacgaactatattcaccatgctatgcaatagaactcaaaatattaatagcttttttttttttttttgagaccaggttttgctcccatagtc

SEQ ID NO: 40523 - DNA, 201 bp, Homo sapiens
cagccagcggtatatttggagagatacaaatccagctttgttaaacactcagctttgccctccaccccctctggggtaaatgggcataatccctacagggratgctgggactctccaacccccagctctcacagctaccctgtggctcataccggattcaaaccccaggtccacccggcttcaaaagccagccgtgtgctt

SEQ ID NO: 40524 - DNA, 201 bp, Homo sapiens
gtttgcacagggcctggccgtcagtgggcttccagcaaacgggagccaatgttcctggcaggggctgggtacagggcaggggagcaggaaatctgacttgrctgtaggaggcgaggaggtgggagcaggatcattgagaaactgaaatgctgtcgaatctgagtggggcagaggacggaactgagtctccctccataaagg

SEQ ID NO: 40525 - DNA, 201 bp, Homo sapiens
accctcagcctttggatgatattgtgaccaaaatgtgagaagcaatgacaccctgtgacactcccagcccttgtaattgaggctttgaaagcactgctgaygtctccaaaggcatctgggtgctccacggctgtgatggaggtgggacctctgaaccctggctttttgactttggctgctttgcaaatgtagtgactaata

SEQ ID NO: 40526 - DNA, 201 bp, Homo sapiens
tccacgttgatatagtcagggtacaaaacattttcaaaccatatggatcccttatgatgcctttttatagctataccatcttctgtcccaccctcctttacctctggcaaccactaacctgttctccatttctataattttgtcatttgaagaatattatataaatggaataatccggtatatacccttgtgggattgatt

SEQ ID NO: 40527 - DNA, 201 bp, Homo sapiens
agggtacaaaacattttcaaaccatatggatcccttatgatgcctttttatagctataccatcttctgtcccaccctcctttacctctggcaaccactaayctgttctccatttctataattttgtcatttgaagaatattatataaatggaataatccggtatatacccttgtgggattgattttcttcactcagcataa

SEQ ID NO: 40528 - DNA, 201 bp, Homo sapiens
gaattacttgaacccttgaggcagaggttctggtgagcagagattgcaccactgcacccctggctgggagacacagcaagtcacacacgcgcgcgcgcgcrcacacacacacacacacacacacacacacacacagaaaaaagaaaaagaaaaaaagagttgtctgcgaagaaaaattagaaaatggaattctagttaagc

SEQ ID NO: 40529 - DNA, 201 bp, Homo sapiens
gcgcgatctctgcattgctcactgcaacctccacctcccgggttcaagcgattctcctacctccacctccgagtagctgggattacaggtgcccatcaccmctcctggctaatttttttgtatttttagtagagacggggtttcactatgttggccaggctggtctcgaactcctgacctcatgatcttctggcttcgtcc

SEQ ID NO: 40530 - DNA, 201 bp, Homo sapiens
attacttgaacccttgaggcagaggttctggtgagcagagattgcaccactgcacccctggctgggagacacagcaagtcacacacgcgcgcgcgcgcgcrcacacacacacacacacacacacacacacacagaaaaaagaaaaagaaaaaaagagttgtctgcgaagaaaaattagaaaatggaattctagttaagcaa

SEQ ID NO: 40531 - DNA, 201 bp, Homo sapiens
cactgcacctggcctttacttttaaatatgcaacccattttgagtttgaggtttgttttgtttgtttggcctgaagatatccaattatgctagaataattygttgaaaggaatttttcctcctttgttgaattgcttttacaccattataaaaaatcagttgcctatagttttgtgggggctattctgggttctttttatt

SEQ ID NO: 40532 - DNA, 201 bp, Homo sapiens
gtagctatataataagttttgaaatcagaatgattcctcccattttattcttcattttgaaaattgtagctgttttaattcctttgcctttccatataagygttagaataattctgtttatagctatagaaattcttgctggaattttgataggagttgccttaaatctgtacatcaatttggggagaactgatatatttt

SEQ ID NO: 40533 - DNA, 201 bp, Homo sapiens
ttacaggtgcccatcaccactcctggctaatttttttgtatttttagtagagacggggtttcactatgttggccaggctggtctcgaactcctgacctcaygatcttctggcttcgtcctcccaaagtgctgggattacaagtgtgagccaccctgccgggccattttatttttatttatttatttatttttgagacagtc

SEQ ID NO: 40534 - DNA, 201 bp, Homo sapiens
ttggtaggaggctcttttcttttctttttttttgagatggagtctggctctgtcgcccaggctggagtgcagtggcgcgatctcggctcaccgcaacctcygcctcccaggttcatgccgttctcctgcctcagcctcccgagtagctgggactacaggcgcccgccaccacgcccggctaattttttgtatttttagtag

SEQ ID NO: 40535 - DNA, 201 bp, Homo sapiens
ggtttttgttttgttttagattccttgggatttttcatgtcatctgcaaatcatcatgtcatctataaataaggatattttatttcttcctttccaatctrtatgccttttgtttctttttcttgccttattgtgttggctagcacttcaagcactatgttgattaagagttaagagaaaagatgttcttgccttgtttcc

SEQ ID NO: 40536 - DNA, 201 bp, Homo sapiens
taggtgtggtggctcacgcctgtaattccagcacttcaggaggccaaggtgggtggatcgcgtgagctcaggagttcaagaccagcttcggcaacatggcraaaccccatctctacaaaaaatgcgaaaattagttgggcatggtggcgctcacctgtagtcccagctacttgggaggctgaggcacaagagtcccttgaa

SEQ ID NO: 40537 - DNA, 201 bp, Homo sapiens
tgtcatatcaaataattttttttttcttttttttttgagacggagtctcattctgtcacccagactggagtgcagtggcgcaatctcggctcactgcaaaktccgcctccgggttcacgcaattctcctgcctcagcctactgagtagctgagattacaggcgcacaccaccacacctggctaatttttttttgtattttt

SEQ ID NO: 40538 - DNA, 201 bp, Homo sapiens
ggcattcctatttcttcctctctttgtattttctccatagcacttagcactatttgacatactgtatgttttacttatttgtttgcctccctaccaatcacccccccacataccccccaacagtttgtcagctccatgaggcagggctgttagatctgtccattgctgcctatctaccagctagaataatgcctgacacat

SEQ ID NO: 40539 - DNA, 201 bp, Homo sapiens
tttttgagacggagtctcattctgtcacccagactggagtgcagtggcgcaatctcggctcactgcaaattccgcctccgggttcacgcaattctcctgcytcagcctactgagtagctgagattacaggcgcacaccaccacacctggctaatttttttttgtatttttagtagagacggggtttcactacgttggccag

SEQ ID NO: 40540 - DNA, 201 bp, Homo sapiens
agacaaaggtaaggctaaggtgtaagcatcctgggagatgctgtggtcaagtctgtttagggtgaaggggcacagttctaatttttttcacaggatttcaytgtgagactgcttgcaactgggaagtcgtccggatctgagacatctgtatctgttttttctgcttctccttcctgttatccttctggcctatgggttgtc

SEQ ID NO: 40541 - DNA, 201 bp, Homo sapiens
atccttctggcctatgggttgtcttgtgtttcaatcagctgtgtgtgtgtcttgtccaggtgaatggggaacaatgagataaggtatcgtggtacaaaccwcaattgcctaggcaatgagtgctatggaggagggcagtttgccataggaggctcatggagcagatgctgagatacctgcctctcacagaaagaccaattt

SEQ ID NO: 40542 - DNA, 201 bp, Homo sapiens
ctggcactatggtgtggcccacttgagagctgaatcatctgaaacagttactgcccacgggcttggatggggcccctctctggagaaggtgtggttaataytcatgtctgctccctccatcagctggcagtgtttatttactatgctgtgtggaagcctcagaaacagtggatcacgttggacacaggcatcttggagagt

SEQ ID NO: 40543 - DNA, 201 bp, Homo sapiens
ttaggatcctatatctatcccaaagacaatgggaaaccattgaaggatttttaagccgagagttaatacactctgatttacggttttgttttgcttcattrttggagggaggcaggagtggaaacagagtgaagactaatttgggagggtaatttcgggtcagacatcagtaatctactcaatggaagaatacaaagatga

SEQ ID NO: 40544 - DNA, 201 bp, Homo sapiens
caagaataggtgtggtggctcacgcctgtaattccagcacttcaggaggccaaggtgggtggatcgcgtgagctcaggagttcaagaccagcttcggcaayatggcaaaaccccatctctacaaaaaatgcgaaaattagttgggcatggtggcgctcacctgtagtcccagctacttgggaggctgaggcacaagagtcc

SEQ ID NO: 40545 - DNA, 201 bp, Homo sapiens
atctcttttcttcctcaatttctaaattttcagattaaaaaaaaaactgatccagtaagtattgagtgatagctgatagttgaggattaatgatagagagwtgggggagcggggggcaggtggcagcgggcaaccgttcaagaagcccagaccaagagggtgactaatgtggcttttgaaatctccaagcattctagaatc

SEQ ID NO: 40546 - DNA, 201 bp, Homo sapiens
gatgctgagatacctgcctctcacagaaagaccaatttttaaattaaaaattttaattttggaataattttacctctatagagatattgtaaagatagaayagaaagttcctgtaggccgggcgcagtggtgcacgcctgtaatcccagcactttgggaggctgaggtgggcggatcacaaggtcaggagattgagaccat

SEQ ID NO: 40547 - DNA, 201 bp, Homo sapiens
ctgcccgaaaagtcccgaggaacatacttggagagagctaactgcttcccgcctcccgtgttcatcatctccatcagcctggccgaggtgaatggggagcrgggtgggcaccggggtaagtggcatggggaagctgggaacaaactaggggtcagatctagatctagagaagagactgggaacatgggagagagcttcgtg

SEQ ID NO: 40548 - DNA, 201 bp, Homo sapiens
ctccttttctcccaaggtgtcttttgcagctcacattgcaggtggatttgctggaatgtccattggctacacggtgtttagctgctttgataaagcactgmtgaaagatccaaggttttggatagcaattgctgcatatttagcttgtgtcttatttgctgtgtttttcaacattttcctatctccagcaaactgacctgc

SEQ ID NO: 40549 - DNA, 201 bp, Homo sapiens
gaagaggagaaaatgagagaggatgggggaggtaaagatcgggccaagagtaaaaaggtccacaggattgtctcaaaatggatgctgcccgaaaagtcccraggaacatacttggagagagctaactgcttcccgcctcccgtgttcatcatctccatcagcctggccgaggtgaatggggagcggggtgggcaccggggt

SEQ ID NO: 40550 - DNA, 201 bp, Homo sapiens; identical to SEQ ID NO: 8882

SEQ ID NO: 40551 - DNA, 201 bp, Homo sapiens
tacttgaacccttgaggcagaggttctggtgagcagagattgcaccactgcacccctggctgggagacacagcaagtcacacacgcgcgcgcgcgcgcacrcacacacacacacacacacacacacacacagaaaaaagaaaaagaaaaaaagagttgtctgcgaagaaaaattagaaaatggaattctagttaagcaaat

SEQ ID NO: 40552 - DNA, 201 bp, Homo sapiens
gtagtagagaacgtagtgccagagagcagggtgtccaagagcagggcaaaaggggttcagaaagtcttccttacaatgtgagctagcactgctcccaaccrtcagaggaagtggggtacggtggaaaccatcacagaggggatggtgaagaagtgtatttcatgtcaccttctggcactatggtgtggcccacttgagagc

SEQ ID NO: 40553 - DNA, 201 bp, Homo sapiens
tctccggtgagttcagtttctttcttttataaaatagaaattagtttactgtcaaaaagggttatcaaataggggttacaacgctgtgatttagggcagcsaaatttccatttggaagttaagaaaatttttaaggaaatcagacttttgaattgtccttcccacttaactctctcacagccctgatcactggctctactt

SEQ ID NO: 40554 - DNA, 201 bp, Homo sapiens
catcacagaggggatggtgaagaagtgtatttcatgtcaccttctggcactatggtgtggcccacttgagagctgaatcatctgaaacagttactgcccaygggcttggatggggcccctctctggagaaggtgtggttaatactcatgtctgctccctccatcagctggcagtgtttatttactatgctgtgtggaagcc

SEQ ID NO: 40555 - DNA, 201 bp, Homo sapiens
ctagggggcggagattgcagtgagccaagattgtgccactgcactccacactctagcctgggcaacagagcgagactctgtctcaaacaaacaaacaaacmaaaaaaaaaaaaaaaaaaagaaaaggaataaagaaaactgcaagtagtttggtgtacaggtacgtatttgagtaaaggtctaaagccagatcatggaggc

SEQ ID NO: 40556 - DNA, 201 bp, Homo sapiens
gacaaaaaatttgatcttggagccgattttaacttgtaaaaaataattgtagttattaacttaaaaatgtatgagacagaacagagcttctttaaaaaaattttttttttttttgcgactgagcctagctttgtcacccaggctggagtgcagtggcatgatctcagctcactgcaacttctgtctcctgggttcaagtga

SEQ ID NO: 40557 - DNA, 201 bp, Homo sapiens
taggaagttcctaatgtaacccttttagttcccactgatgcactgatgcctcagcttccttatcacaaactgtattagtcaagagttcttcagaaaaacasaatcaataggtgtgtgttccctgggggaagagagattaatatttattttaaggaattagctcaaatgattatggagacttggcaagtccaaaatcttcag

SEQ ID NO: 40558 - DNA, 201 bp, Homo sapiens
gggggcggagattgcagtgagccaagattgtgccactgcactccacactctagcctgggcaacagagcgagactctgtctcaaacaaacaaacaaacaaamaaaaaaaaaaaaaaaagaaaaggaataaagaaaactgcaagtagtttggtgtacaggtacgtatttgagtaaaggtctaaagccagatcatggaggccct

SEQ ID NO: 40559 - DNA, 201 bp, Homo sapiens
acaaaaaatttgatcttggagccgattttaacttgtaaaaaataattgtagttattaacttaaaaatgtatgagacagaacagagcttctttaaaaaaattttttttttttttgcgactgagcctagctttgtcacccaggctggagtgcagtggcatgatctcagctcactgcaacttctgtctcctgggttcaagtgat

SEQ ID NO: 40560 - DNA, 201 bp, Homo sapiens
ggcccattataaatgaatatgagttgaatgattggctttgcctgttagtgagccaggcctactgctctgcctggatatctcacatgactgttatcctttaygtagtttgcatgcagtgattaaaatatttgtttcttgtttgcagagtagaaaagattcataaaataaataatccaatagtgccagtgatataaacaaaga

SEQ ID NO: 40561 - DNA, 201 bp, Homo sapiens
caggctcagctccatgccttccatctatccatccatccatctaaaactcattcatccatccacagccaataacaactaataattatagggtgtttactacrtgccagatacagttcttttctttttcttcgagacacagtcttgctccatcacccagtctggagtgcagtggtgtgaatttggctcactgtaacctctgcc

SEQ ID NO: 40562 - DNA, 201 bp, Homo sapiens
tctggtatttttgcaaggggaaggactgaagtgtcatttttttgcatatggatgtctgttctaacatcatttgttgaaaagacagtcctttctccattgamttgctttagtatctgttgaaaatacaaattgcttttgtatctttgttgaagttgttgtttgtatatatgagtgtgttaatttctggaggttctattctgt

SEQ ID NO: 40563 - DNA, 201 bp, Homo sapiens
attatgttgtctgtacttgctaatttcccttttgatgttttctttgacacatgggttatttaaaatgtgttatttagtttttaaatatttgtgtgtttttycaaagatgttctgttgttaatatctagtttaactgtggttaggggctgggcgtggtggctcacgcctgtaatcccagcactttgggaggttgaggtgggc

SEQ ID NO: 40564 - DNA, 201 bp, Homo sapiens
gggcggtgactcatgcctgtagtcccaacattttgggaggctgaggtaggaggattgcttgaagccaggagttcaaagccagcctgggcaacaagcgagaycctgtctcaaaaaaaaaagaagtcctggcacggtggctcacgccagccgtagtaatcccagcactttaggaggccaaggtgggagaattgcttgagtcca

SEQ ID NO: 40565 - DNA, 201 bp, Homo sapiens
gtggtggcttatgcctgtaatcccagcacttggggaggccgaggtgggcggatcatcaggtcaggagttcgagaccagcccgaccaacatggtgaaacccsgtctctattaaaaatacaaaaaaattagctgggcatggtggtgtgcacctgtaatccaagctactcaggaggctaaggcaggagaatcgcttaaacctgg

SEQ ID NO: 40566 - DNA, 201 bp, Homo sapiens
ttttaagagtacttgtggccaggtgggatctttctatgtttcctcttgagaatacttgtggattacaggctctctcacacctgtaatctcaatgctttgasaggtcaagcagggaggatcccttgaattcaagggtttgagactagcctggacaacatggggaggccaccatttcaaaataataataataataaagtttaa

SEQ ID NO: 40567 - DNA, 201 bp, Homo sapiens
tgagcttctgtttcaagggaagtgagtaactggtggtggagccctgcccctctgcagtgtgtggttttgtcctgatatattttaagattgagatgtaactyacctgtcataaaatgcccagacttatgatgtgtggaaacaaaagagttttccagtacagaaagttacttagcctctctggtgctgtgtaagcaacaggta

SEQ ID NO: 40568 - DNA, 201 bp, Homo sapiens
tctgtatgcagctttctgctctctggtaccctgtcttgtaaactctagcagtccagatctatctggactctaaacttcatctcatcaacttaaagtttgcygagatctgcctgggttcctgcttcatgcgctgtattctgtaatctccctcaaggtagtacctgggcaatcagataactcatctattaataactgattccc

SEQ ID NO: 40569 - DNA, 201 bp, Homo sapiens
aggcgggaggatcgcttgagcccaggagtttgagaccagcctgggtaacacaagaagaccccatctcaacaaagaaaaaaaaaatagctgggtatggtggygtgtgtgcttgcagtcccagctacttgggaggctgaggtgggaggctcacttgagcctgggaggtagaggctgcaatgagccgtgatcctgccactgtac

SEQ ID NO: 40570 - DNA, 201 bp, Homo sapiens
ccactcagatatcttgtgggagcttcaggaggagtctatgctctgatgggaggctattttatgaatgttctggtggtaagaaccatggggatggagtccaygagtctcttaaaaaaacagaaaacagtaactcttctttgtttcaacgaaccttcatttatcaatatttactgagcactcaattttctgagaattgtatgg

SEQ ID NO: 40571 - DNA, 201 bp, Homo sapiens
taaatgtccaaaggcacagttgttggaacatatgatagtggcatattttattttttaatttaatttaatttaattcattaatttatttattttgagatggwgtcttgccctgtcgtccaggctggagtgcaatggtgcgatcttggctcactgcaacctccgtttcccaggttcaaatgattctcccgcctcagcctcctg

SEQ ID NO: 40572 - DNA, 201 bp, Homo sapiens
gaattgtatggcaatgccattttgtttcctttcttttctttctttttttttgagacagagtcttgcaccattgcccaggctggaatgcagtggtgtgatamtggctcactgcacttctgcctcctgggctcaagcaatcctcccacctcagcctcctaaatagctgggactacaggtgtgggccaccatgcctgactaatg

SEQ ID NO: 40573 - DNA, 201 bp, Homo sapiens
ggtgtgtgtgcttgcagtcccagctacttgggaggctgaggtgggaggctcacttgagcctgggaggtagaggctgcaatgagccgtgatcctgccactgyactccagcctgggtgacagggagagatcttgtctcaaaaaaattaaataaaaaaaccccaaatgtttctaattgctagtaatgtgctcatttggtgctag

SEQ ID NO: 40574 - DNA, 201 bp, Homo sapiens
gtagtcccagctactctggaggctgaggcaggagaatcgcttgaacccgggaggtggaggttgcagtgagccaaaattgtgccactgcactccagcctggygacagagtgagactccaactcaaacaacaacaacaacaacaacaacaaaattctaggtagaaaagtgtaaagcaattataaaactgttccaaatatagaa

SEQ ID NO: 40575 - DNA, 201 bp, Homo sapiens
ttggattgcaacccattagtggttgtagactcactttaaggaactgtggccaaaagttaaacccaagaaaaaaaaagtcagtgttattgtttgatttatgygtgtactgggttgttatgtaaattatttcttactgtaggtcatggtcacaagagtttgaaaataattgatttagagtaaacatgcctatttcagcatctt

SEQ ID NO: 40576 - DNA, 201 bp, Homo sapiens
aggtgatccatccgccttggcctcccaaagtgctgggattacaggtgtgagccactgtgcccttaaggccagtatactttatattgcattataactgcccratattagtatttaggaatattaatgagaagagatcaaatcattgcaaaaccaaaagcatgttcccctagttgtctaatgttgttaaatatactctttagg

SEQ ID NO: 40577 - DNA, 201 bp, Homo sapiens
tgttatgtaaattatttcttactgtaggtcatggtcacaagagtttgaaaataattgatttagagtaaacatgcctatttcagcatctttactccttgggragagagttactaatttgaaagtgaagggacaagtaattcaataaattatattagaaatgtctcgctcagcagttcgccactgacgcataagggacccaaa

SEQ ID NO: 40578 - DNA, 201 bp, Homo sapiens
ttcagactgctgatcatcatcctgataagtaagtgtgttttgtgaatacttcatactgtccaagtgaaaataaaatatagagacaaatctctaaacatttyatttgggaatcacaggattgcaatttggggcatacacacagacctgggaggtctatggtatgtctgaagtacaaaagaaaaggctgggggttttattaga

SEQ ID NO: 40579 - DNA, 201 bp, Homo sapiens
tcacctgtagtcccagctacttgggaggctgaggcacaagagtcccttgaactggggaggtggagcttacagtgagctgagttcgtaccactgcactccakcctgggcgacagagtcagaccttgtctcaaaacaaacaaataacagaaaaaccaagagccattttatttcttcataattatgcaagtcagggatttgggc

SEQ ID NO: 40580 - DNA, 201 bp, Homo sapiens
aagtaatggatccagaattcaagtctaggtcagactctaaactccatgctttttgctctggtgcttgctgtctttcaagtttctctgtattagaaagaccmggctgggggcggtgactcatgcctgtagtcccaacattttgggaggctgaggtaggaggattgcttgaagccaggagttcaaagccagcctgggcaacaa

SEQ ID NO: 40581 - DNA, 201 bp, Homo sapiens
tgggcatggtggcgtgcacctgtagtcccagccactctggaggttgagggaggagaatcgcttgaacccaggaggcagaggttgtagtgagtcaagattgygccgctgcactccagcctgggcaacagagtgagacactgtctcaaaaaaaaaaaaattagcaatgagaatgacactacctgatttgcatttcagaagtga

SEQ ID NO: 40582 - DNA, 201 bp, Homo sapiens
gagggaaatggcagggaagggctgaggatgaggacagagtaattccattcctcttccctgcccttcacactggctttccctccagccatcacgttctcccyagcaccccctaccctcctaagtttttctaactccaactaagccagttcctagccctttgctgacctggacactggagaccacagccagggagacagtctc

SEQ ID NO: 40583 - DNA, 201 bp, Homo sapiens
ttatattgcattataactgcccaatattagtatttaggaatattaatgagaagagatcaaatcattgcaaaaccaaaagcatgttcccctagttgtctaaygttgttaaatatactctttaggctatgaaaatggtggtgctgaataaccagtctcctcctccaccatcatacatcaaacaaaatttagttcatggccggg

SEQ ID NO: 40584 - DNA, 201 bp, Homo sapiens
actttgagaggccgaggcgggtggatcacaaggtcaggagattgagacatcctggctaatatggtgaaaccctgtctctactaaaaatacaaaaaattagstgggtgtggtggcgggtgcctgtagtctcagctacttgggaggctgaggcaggagaatggtgtgaacccgggaggcggagcatgcagtgagccgagactg

SEQ ID NO: 40585 - DNA, 201 bp, Homo sapiens
ccaaccttgtgtgtatgagttgtagggaagggagagggctaggtagaaggaacagcaagtacaaagaccttgagacaggagaagatttggtgtattccagkaacagaaagacgtccctgtggctgcagcactgagtcgttgggagaaagtagtagaaagtgaattccacaaagaaggtaggagctaggtcatataggatct

SEQ ID NO: 40586 - DNA, 201 bp, Homo sapiens
agagctctttccatgatacttcccttttccttccttctccattcatgggattgttaattcagcaaatacttgctgagaaatattttccacttttgtggagstcatattctagcagaaagagacagacaataaataaactaactatttttagataatgataagtgctgggagaatataagtggggaaatgtagtagagcata

SEQ ID NO: 40587 - DNA, 201 bp, Homo sapiens
ggagctgttaaaaaggcatgcagatttcttttttcttttttcttttcttttttttttttgagacggagtctcgctctgtcacccaggctggagtgcagtgrcgtgatctcggcttactgcaagctctgccttcctgggttcacaccattctcctgcctcagccttccgagtagctgtgactacaggcgcccgccaacacgc

SEQ ID NO: 40588 - DNA, 201 bp, Homo sapiens
ctcaaactcctgacctcatgatctgcctgccttggcctcccaaagtgctgggattagaggtgtgagcaactatgcctggcctgagccactgcgcctggccttttttttttttttttcttgagacagagtctctgtcacccaggctggagtgaagtagcatgatcttggctcactgcaacctccacctcccaggttcaagca

SEQ ID NO: 40589 - DNA, 201 bp, Homo sapiens
tactattacaaatactataatagggtacacaaatatatgtaatatgttaaatagctgtggggcggcccagactctggtctgagattcccaggtttgtgccycagctttgctgtacctaggtatgtaatcatggatgcctcttttttgccctagttatttacctgtaaaatgggaataataaagaggtcttcacagagcaga

SEQ ID NO: 40590 - DNA, 201 bp, Homo sapiens
caatgtcagagctctttccatgatacttcccttttccttccttctccattcatgggattgttaattcagcaaatacttgctgagaaatattttccactttygtggagctcatattctagcagaaagagacagacaataaataaactaactatttttagataatgataagtgctgggagaatataagtggggaaatgtagta

SEQ ID NO: 40591 - DNA, 201 bp, Homo sapiens
tgtgttggccaggctggtctcaaactcttgacctcgtgatctgcccgcctcggccccccaaaatgctgggattataagtgtgagccaccgcgcccagccattttttttttttttttgagacagtcttgctctgtcactcaggctggaatgcagtggcgcgatctctgcattgctcactgcaacctccacctcccgggttca

SEQ ID NO: 40592 - DNA, 201 bp, Homo sapiens
gttttacagctgaggaaactgaggcccagtggaaaactaaatgtggatgctgggagtagaattcaggtctttatagtgtcaaacacaaggcaggctattctcaaaggcagatggcaagccctttttttggtagccattatgacatggcagcttcacagtgatggtgcccagtgatggtagaatgataatggaagtggtgcg

SEQ ID NO: 40593 - DNA, 201 bp, Homo sapiens
aaaaagcagaaacagagaccaggtacctagaattacaccaaattccatcacagagccagataggtgaggacagcctcagtgctgctgctgctgaacgcccmgtgctgctgcgtttgtcacagccacagctggcgttggatgctggatgccatgctgaccccagtggcaaggcgtctggacactggatactgctgccactgc

SEQ ID NO: 40594 - DNA, 201 bp, Homo sapiens
acagagaccaggtacctagaattacaccaaattccatcacagagccagataggtgaggacagcctcagtgctgctgctgctgaacgcccagtgctgctgcstttgtcacagccacagctggcgttggatgctggatgccatgctgaccccagtggcaaggcgtctggacactggatactgctgccactgctgcaaccactg

SEQ ID NO: 40595 - DNA, 201 bp, Homo sapiens
ggcagcagagctgctgcaggagctgagctgcctcctcagttgttcagggtcacacccagaatcagaggacacattgtttgggcacagaattgttgtcaccygagatacggggtcttcagtcagtctgcttcatttctaaaagttctttggcctggtttacctactattgaaaatgggaagagttacaacacataccagatt

SEQ ID NO: 40596 - DNA, 201 bp, Homo sapiens
ttacaacacataccagattaataaaatataagtgcatctgtatttgaaatgtgtttctttggaaatgtatataattttgtaatatgtaatatgtaatgtgkataaagttgtaaatattcttctttttttttttttttttttttgagacggagtctcgctctgttgcccaggctggagtgtagtggtgtgatcttggcttac

SEQ ID NO: 40597 - DNA, 201 bp, Homo sapiens
cgctctgttgcccaggctggagtgtagtggtgtgatcttggcttactgcaacctccgcctcctgggttcaagcaattctcctgtctcagcctctcctgtcwacaggtgcatgccaccatgcctggctaattattgtatttttagtagagatggggttttaccatattggtcaggctggtctcgaactcctgacctcaggtg

SEQ ID NO: 40598 - DNA, 201 bp, Homo sapiens
atgtggcagtgttttttaaaaacactttcctagacccatgggcatgttatttatgtggaccaggaaatgcaaatgatgattgaaaatatgggccaggcacrgtagctcacgcctgtaatcgcagcactttaggaagccgaggcgggtggatcacgaggtcaggagatctcatggtgaaaccccgtctctactaaaaataca

SEQ ID NO: 40599 - DNA, 201 bp, Homo sapiens
aaaaattgtccacttcacagcactaagcagaaagaagtaaacgaaggagttttacaggctctcatgggtggttcttagacatgcctacgtgatgtattttkgcttttagtatctttatggagtgggggaagccaagagaatagagccctaggcaccccctctacttgaaccacaatagcttcacttatattttatatactg

SEQ ID NO: 40600 - DNA, 201 bp, Homo sapiens
ggatgggtgtggaatgtgatagctgcaagagatgtttccaagcactacacatatagggcagagttcttctaggccaagaagtcggaagctccttttgcagygcagatccgacttacttgacgactgcctaacttctggctctcacagttttattggagaatatggaatgatttcctttcatggcctgacaccttcagaact

SEQ ID NO: 40601 - DNA, 201 bp, Homo sapiens
tcaagtgactcttttttttctttttttagacagagtctaactcttgtcgcccaggctggagtgcagtggtggatcttggctcactgcaacctctgcctctsaggctcaagcgattctcctgcctcagtctcccaagtaactgggattataggcatgcaccaccatgcctggctaatttttgtgtttttagtggagatgggg

SEQ ID NO: 40602 - DNA, 201 bp, Homo sapiens
agctgcaagagatgtttccaagcactacacatatagggcagagttcttctaggccaagaagtcggaagctccttttgcagtgcagatccgacttacttgamgactgcctaacttctggctctcacagttttattggagaatatggaatgatttcctttcatggcctgacaccttcagaactcccgatggtaattacaggca

SEQ ID NO: 40603 - DNA, 201 bp, Homo sapiens
tatttttccagctggtcttccagttcctgttcttgctcccttatagtctacttcctatatggcagctagaataatctttgtaaaaccatcagtgtggttgmtcaagcctgtaatcccagcactttgggaggtcgaggtgggtggatcacctgaggtcaggagttcgagagttggagaccagccttgtcaacacggtgaaat

SEQ ID NO: 40604 - DNA, 201 bp, Homo sapiens
ctcaagcctgtaatcccagcactttgggaggtcgaggtgggtggatcacctgaggtcaggagttcgagagttggagaccagccttgtcaacacggtgaaaygctgtctctactaaaaatacaaaaattaaccgggcatagtggcacatgtctgtaatcccagctaatcaggaggctgaggcacgagaattgcttgaacctg

SEQ ID NO: 40605 - DNA, 201 bp, Homo sapiens
cttgggaataagaaaactgaaacttattgctcaaacatttgatggtcatctacaagctggtgggcagcatggcagagcagaaaattattttggagtcacaragacacttggctttttatcccatatctcctgtttacctcctgagcctcagtttcctcagctataatttttttttaaagagacagggtcttgctaccttgc

SEQ ID NO: 40606 - DNA, 201 bp, Homo sapiens
ataagggcaaatgtaatccttatttttgtagctccttttatacagttgtattgttaacaatgtgacattttatttcctcataaaatgattatgtatgatayttagatacaaaaaggctgatttatacaatgtgaactgtccctaattgaacttatttttaaaatgctttaatatttgtggttaaaagctgctgatcttaaa

SEQ ID NO: 40607 - DNA, 201 bp, Homo sapiens
ctgtaatgtagtggtgccatctcagctcaatgcaacctccgccttccaggttcaagcaattctagtgcctcagccccccgagtagttgggactacaggcaygtgccaacatgcctggctaaatttttgtatttttagtaaagacggggtttcaccgtgttagccaggatggtcttgatctcctgacattgtgatcctcccg

SEQ ID NO: 40608 - DNA, 201 bp, Homo sapiens
ttgtgaagacctgtgaggtatgacactgataaacatcgccggccatgtgtttgctggtggggatgaagtttctggttaggtgaggggaagtagcttatccrtaggtaagcaggggcagaattggagcaaggaccaggattttctgactcctgcaatgtcagagctctttccatgatacttcccttttccttccttctccat

SEQ ID NO: 40609 - DNA, 201 bp, Homo sapiens
gagctcagtgtcctggagaaagagcagaggctgccaccggctccctggctaagacccaagcaggcgaagaggaggactcattcatccagggccagcccagkagcaagactgccaagcaggccggcccagcccagctgggaggggatttcctcagcctccctcctcctgggctgggcagctttggaacctgtctggaggatt

SEQ ID NO: 40610 - DNA, 201 bp, Homo sapiens
gtgctcgagtgccaagtaaatgaatggacagatgttgatgcttgaatatttctttgagactagaatgtgttgtaatcattattttgttttgagactcctgmtccattcaattgggcttccaaaaattctggtaatctgacgtgtgtttctgaacgctgtatcccaagtttgacctatagagcccatggagtttatatacag

SEQ ID NO: 40611 - DNA, 201 bp, Homo sapiens
tgtgttgtaatcattattttgttttgagactcctgctccattcaattgggcttccaaaaattctggtaatctgacgtgtgtttctgaacgctgtatcccargtttgacctatagagcccatggagtttatatacaggccatgcccaaggaaggacaaaattaatgacaacatgaccttcgattagatttgctttgtgaggc

SEQ ID NO: 40612 - DNA, 201 bp, Homo sapiens
gggcgtggtggcagtcacctgtaatcccagctactcgggaagctgaggcaggagaatcgcttgaatctgggaggcggaggttgcagtgagccgagatcgcrccactgcactccagcctgggtgacagagtgactctgtctcaaaaaaacaaaaaacaggagagaatggattttcctgtccacatagaataaaaagcagttg

SEQ ID NO: 40613 - DNA, 201 bp, Homo sapiens
gggtggatttctagaggttggatgtttctgttgaaaggtatatgcttttaatagtttatacacattggccaattgctttccaaaaggctgcattaatttayacctcatacattgcacccattgccacacacctcataaatatgggatattctcagccttttttttttcttttttttgagatggagtttcactcttgtcacc

SEQ ID NO: 40614 - DNA, 201 bp, Homo sapiens
gctactcgggaagctgaggcaggagaatcgcttgaatctgggaggcggaggttgcagtgagccgagatcgcaccactgcactccagcctgggtgacagagygactctgtctcaaaaaaacaaaaaacaggagagaatggattttcctgtccacatagaataaaaagcagttggtttagccaggcatggtggcatgtgcctg

SEQ ID NO: 40615 - DNA, 201 bp, Homo sapiens
ggaggctaaggcaggagaatcgcttaaacctgggaagcagaggttacagtgacctgagattgcgccactgtactccagcctgggtgacaaagcgagactcyatctcaaaaaaaaaaaataataaaaaaaataaaaaaataaaatgaaataaagtaaaacaaaacaaaaacaaaaattagcttggtggtgcacacctgtagt

SEQ ID NO: 40616 - DNA, 201 bp, Homo sapiens
ttatacacattggccaattgctttccaaaaggctgcattaatttatacctcatacattgcacccattgccacacacctcataaatatgggatattctcagycttttttttttcttttttttgagatggagtttcactcttgtcacccagggttgagtgcaatgacacgatatcagctcactgaaacctctgcctcctggtt

SEQ ID NO: 40617 - DNA, 201 bp, Homo sapiens
gggtttttgtttgtgatgaaaaagttttggaactagtggtgatggctgcacaacattgcaaatgtactcaatgtcactgaattgtacactctaaatggttraaaacagggccggcttcggtggctcacgcctgtaatcccagcactttgggaggcctaggcgggtgaatcacttgaggtcaggagttcgagaccagcctgg

SEQ ID NO: 40618 - DNA, 201 bp, Homo sapiens
tgctgtctggagaggggatggaagtgcagctgagtctgagagtaaaggtagattccagatgacagcaggccatagagcatggaagaaaacaagagcaaagktgggggtggtaactggtgttgacagacctgctccagttgaagttctctccacctggagggctgtggaagaatgacagaccctggggtcagacctgaaagc

SEQ ID NO: 40619 - DNA, 201 bp, Homo sapiens
gagtgcagtggtgcaatctcagctcactgcaacctgcaccgggttcaagcaattctcctgcctcagcctctcgagtagctgggactacaggcatgtgccamcatgcccggctaatttttgcatttttagtagagacggggtttcaccatgctggccaggctggtctcagactcctgacctcaggtgatccactggcctcgg

SEQ ID NO: 40620 - DNA, 201 bp, Homo sapiens
ctgaggtgggagaattcgcttgagcctgggaggtcaaggctgcagtgagccgtgaacatgccactgtagtctagcctgggcagcagagcgaggttgtctcaaaaaaaaaaaaatccatatgaaggcaactcttttaaagtaaatgttaaatttttaaggaggacaatggtttggcttcttggaataagggcttattttcag

SEQ ID NO: 40621 - DNA, 201 bp, Homo sapiens
ttttgtactctaagaatgggtgaaaatgacatttttaagctttgtatctttcagagtatctccttctctctgtgcacatggagttttgtgtctcttttgcyttacccctagttctctagacctttaagactcttgtttaactgtgacggtatttgtgtttgaataagagagatgcaactgaaatacacaattagcattgtc

SEQ ID NO: 40622 - DNA, 201 bp, Homo sapiens
gggtcacagtgaatctgttcctcctaataaaagtttggaaatttataaatagtttccttttgtataatctggaataagttcaaggatactacttgcaatamcttgtgctttcttatgccagagagctagagatggaggtgtagaagggtttccaggaattatatctagctctgagtgtgcccagtgagggtgtgtcaaact

SEQ ID NO: 40623 - DNA, 201 bp, Homo sapiens
acacctgacattcttcaaaatttttatggggatttatgaagacttgtggacacagcacggtggataactcctgtaatcccagctctttgggaggccaaagkgggtggatcatttgaggtcaggattttgagaccagcccagcctacaagtgaaagcccatctctactaaaaatacaaaaattagctgggcatagtggtggg

SEQ ID NO: 40624 - DNA, 201 bp, Homo sapiens
gatcaaacttgattttcctactgtgatttctttccaatttcttcatcaagttaaaaattctgtattgagagcagtttcctacattacctcaaatcctgttsaaacaaggattatccctagaagtcagaaaggagggaaaacaagcttagtcacagaagactactctatacttgagcttctgtttcaagggaagtgagtaac

SEQ ID NO: 40625 - DNA, 201 bp, Homo sapiens
gagttgagactctgtcataaacaaacaaacaaaatctatcatgtcactcctgtgctcaagagctttcaaagacttcctatcactcagtaaaggttgaagtscttacaatggcccatatagaccctacataatctgtcccctgctacctgtctgacctcatcacccacaaccttatccctaactctagtccagaatcacttg

SEQ ID NO: 40626 - DNA, 201 bp, Homo sapiens
gtccttacaatggcccatatagaccctacataatctgtcccctgctacctgtctgacctcatcacccacaaccttatccctaactctagtccagaatcacytggaggtcttgttaaaacaaagttgttggaaacaactttaccacagttggtagttggaaaacacagccatggaagtaggaatctactaaggagagtacaa

SEQ ID NO: 40627 - DNA, 201 bp, Homo sapiens
tctgaagtacaaaagaaaaggctgggggttttattagaaagataaattttacatattattttgaaagaaagctcattggcactagagcagcctttgggagytggttggtgagtgatggtagtggggagaactagtcttagacttgtgttgtttagacctgattcttagactcaatttgtttcagcagctattaggtaaaac

SEQ ID NO: 40628 - DNA, 201 bp, Homo sapiens
ctagtccagaatcacttggaggtcttgttaaaacaaagttgttggaaacaactttaccacagttggtagttggaaaacacagccatggaagtaggaatctrctaaggagagtacaactcaccttctgaaaacaaaaacaaaaacaaaaacaaaaacagaaagctgagtcccacccttaagttttctggttcagtaggtctg

SEQ ID NO: 40629 - DNA, 201 bp, Homo sapiens
aatcacttggaggtcttgttaaaacaaagttgttggaaacaactttaccacagttggtagttggaaaacacagccatggaagtaggaatctactaaggagmgtacaactcaccttctgaaaacaaaaacaaaaacaaaaacaaaaacagaaagctgagtcccacccttaagttttctggttcagtaggtctggggtgggtt

SEQ ID NO: 40630 - DNA, 201 bp, Homo sapiens
gaggtcttgttaaaacaaagttgttggaaacaactttaccacagttggtagttggaaaacacagccatggaagtaggaatctactaaggagagtacaactyaccttctgaaaacaaaaacaaaaacaaaaacaaaaacagaaagctgagtcccacccttaagttttctggttcagtaggtctggggtgggtttaagagttt

SEQ ID NO: 40631 - DNA, 201 bp, Homo sapiens
gctgctggtcttggtaaaaaccactttgaaaactactgatccagccagctcaactgctttggtatttttcaaacacaccaggcacattcctgcttagggastttgtacttggtcttccctctctctgaaacactcttatgtcaaatagcagcatgacttggacccttacctctgtccagcgtcatattctcaaagagatcc

SEQ ID NO: 40632 - DNA, 201 bp, Homo sapiens
tctactaaaaatacaaaaattagctgggcgtggtggcagtcacctgtaatcccagctactcgggaagctgaggcaggagaatcgcttgaatctgggaggcrgaggttgcagtgagccgagatcgcaccactgcactccagcctgggtgacagagtgactctgtctcaaaaaaacaaaaaacaggagagaatggattttcct

SEQ ID NO: 40633 - DNA, 201 bp, Homo sapiens
tgggcgtggtggcagtcacctgtaatcccagctactcgggaagctgaggcaggagaatcgcttgaatctgggaggcggaggttgcagtgagccgagatcgyaccactgcactccagcctgggtgacagagtgactctgtctcaaaaaaacaaaaaacaggagagaatggattttcctgtccacatagaataaaaagcagtt

SEQ ID NO: 40634 - DNA, 201 bp, Homo sapiens
tgggggtgttgcggaggtgtaggtctgcagtgagtgcccgcatgtctctgcaggcgggaccacatactggccattctggcgctgcgccgactgggccgccrgcggaaccagcatctcttgcagcacactcaagacctgctgagagctgcggccggggcggcgggtgcggaggcccctcggggccgcgtgctcttcgaggag

SEQ ID NO: 40635 - DNA, 201 bp, Homo sapiens
gctgagggacctggagggcagtgaaggagctggtgggggctggggggagggttttaggcctcaggacctaacatctgggaaggcctagatgtggctgctgrtcctgccctcgggtgttgtgagctgtggtctggactgggccccagaactgcatgtcagtgccctcctccaattctaatgggagggtctggcctggcagag

SEQ ID NO: 40636 - DNA, 201 bp, Homo sapiens
ggttcgcctcatgctggggctgggggtgttgcggaggtgtaggtctgcagtgagtgcccgcatgtctctgcaggcgggaccacatactggccattctggcrctgcgccgactgggccgccggcggaaccagcatctcttgcagcacactcaagacctgctgagagctgcggccggggcggcgggtgcggaggcccctcggg

SEQ ID NO: 40637 - DNA, 201 bp, Homo sapiens; identical to SEQ ID NO: 8889

SEQ ID NO: 40638 - DNA, 201 bp, Homo sapiens; identical to SEQ ID NO: 8890

SEQ ID NO: 40639 - DNA, 201 bp, Homo sapiens; identical to SEQ ID NO: 8891

SEQ ID NO: 40640 - DNA, 201 bp, Homo sapiens
gccctgccccctcccccagcacagctcttcctggcctcagtcaatctgacctccctgaccatcctggaatgcagagtgactcatactaactcccaagcccrtgggttcgcctcatgctggggctgggggtgttgcggaggtgtaggtctgcagtgagtgcccgcatgtctctgcaggcgggaccacatactggccattctg

SEQ ID NO: 40641 - DNA, 201 bp, Homo sapiens
gtgagtgcccgcatgtctctgcaggcgggaccacatactggccattctggcgctgcgccgactgggccgccggcggaaccagcatctcttgcagcacactsaagacctgctgagagctgcggccggggcggcgggtgcggaggcccctcggggccgcgtgctcttcgaggagatcaaggtgcccagtgccatggctgtgct

SEQ ID NO: 40642 - DNA, 201 bp, Homo sapiens
gactacaggagggctgacgctgcgggagggctgacctcgcactgacctcgcgctcttgcaggagttggagcagcggtggggagagggctgttggggcaggyggtggctctgtctcgcagggttccgaggccacatggttggaccaagccatccagtgcgtggctgagatcctgggcgagacctacaaagatgacatccagc

SEQ ID NO: 40643 - DNA, 201 bp, Homo sapiens; identical to SEQ ID NO: 8894

SEQ ID NO: 40644 - DNA, 201 bp, Homo sapiens
cacagggccacaacaggtttctgcatctgctcctatggccactccttcttgcccccagctctcctgctgccaagatgccatcaccacagacagacactccygggccggagctgcagagtcccaaggaggctgaggagccacagactccagctcagggctcccggcgaacaagcagcaggaaagagcccaatgcccaccgca

SEQ ID NO: 40645 - DNA, 201 bp, Homo sapiens
tgtggctgctggtcctgccctcgggtgttgtgagctgtggtctggactgggccccagaactgcatgtcagtgccctcctccaattctaatgggagggtctrgcctggcagaggccgagtgacggtgggcacctgcggagaccctttttgggggatggtctcaggaaaggctcctgatggaagcagctgtctatatctccgt

SEQ ID NO: 40646 - DNA, 201 bp, Homo sapiens
cccacttgactctgctcgcagacagctacaatggggagccccacgggctgcccttcacattgtagtctaagtgagtggagctgtgtgcccggctctattcyccagcctggtctcccttgcccacctcatcgctggtcctggcccctccccaggaccagtcttctctccaggttcccaggaacccaagaggagctggagaag

SEQ ID NO: 40647 - DNA, 201 bp, Homo sapiens; identical to SEQ ID NO: 8896

SEQ ID NO: 40648 - DNA, 201 bp, Homo sapiens
tgttccggtccttccggcaagccctgaatgacggcccagctaccggccattcccaggccactcctgaggtgccctcgggggtcatgaatggtgtcagccarcaggcatccactggggcagcgtctgaggaactgaaacccgaggcaggtaagggcctcagaaacaacacgaagcatgaaaggaaacgggccagaggtcagg

SEQ ID NO: 40649 - DNA, 201 bp, Homo sapiens
agggcctggtaggggcggcatgactgcccttcggtgctcgcctctgtgtggggagtggtggcagtgactagggccttagcgccgggagggcttttggcagsagtggttctccccactctggatcaggtggaacagggactggggcgcctgtggggctggggggtggagggaaccaggtgggagggcggcactttgcataca

SEQ ID NO: 40650 - DNA, 201 bp, Homo sapiens
ccaaggaagatacgggcctgttccggcgaagctcctgctccctgttccggtccttccggcaagccctgaatgacggcccagctaccggccattcccaggcsactcctgaggtgccctcgggggtcatgaatggtgtcagccagcaggcatccactggggcagcgtctgaggaactgaaacccgaggcaggtaagggcctca

SEQ ID NO: 40651 - DNA, 201 bp, Homo sapiens
ctgctctactgtgtccctggctgcggggactgcgtatagcctggccctcagtttcctcaacagtgaaatagggacatggtcaccttcagggggcagttatraggctcagggtagggtatgttccaggcatggctatgccgcactgtttatcaccaagagggatggaaggtctgtcccagagctgccagaggggaacgggtc

SEQ ID NO: 40652 - DNA, 201 bp, Homo sapiens
ggctggggctgggacttcccaggccaagccaggccgagctgggggtgggatggcagctcctagaggatgcagtcagggaggctgggggcagaggcggggcygagaccggggcaccctgggtgcctcagtcctggggtctggccactggcctttctgctctaaggggtggaggctgagcccatgagaccttgcaatgagcct

SEQ ID NO: 40653 - DNA, 201 bp, Homo sapiens
agggaatttttgtcgtcagcagccaagcgcagctgtcaggccagaaggagcagccgtgcaggaggcatttcaggcatcgttgaggggagtgttttggggcygcagagctctcaatgctgcctatcgggcgggggggggcctcccgcccgactgtccagcttcaccctccagtctgaaagtgaagagcagagtatttattta

SEQ ID NO: 40654 - DNA, 201 bp, Homo sapiens
tcaggcatcagattcactttcctggtttccccgggaaagtgccgagtactagccatggctgggggctgagtcaggctcactccctgccttgcgggtctccyggtctccaggctctgtaactgtccctccgtcatggcaggtgtgcccagggctgggatcaggcccacagcaggaggtgccgaacatggtatgggctcagct

SEQ ID NO: 40655 - DNA, 201 bp, Homo sapiens
aggaggtaggccttggaccctcagaccctcaaggctggagggggaatggagagagccccttctcctaatctgctcttggccatcctccatcagccccaccrggggtgggcacgcctccagtcctggaatctgagggggaggcggaccccccacccctggggagaaagccctctctgaaagccaggggattctgagacctgg

SEQ ID NO: 40656 - DNA, 201 bp, Homo sapiens
ggaccacatactggccattctggcgctgcgccgactgggccgccggcggaaccagcatctcttgcagcacactcaagacctgctgagagctgcggccgggrcggcgggtgcggaggcccctcggggccgcgtgctcttcgaggagatcaaggtgcccagtgccatggctgtgctgatcacctgcgtctagttctctctggc

SEQ ID NO: 40657 - DNA, 201 bp, Homo sapiens
agtgcgtggctgagatcctgggcgagacctacaaagatgacatccagcggcacctggagactcttatccggagctaccccgacatcaggtgtgtaccccayctgcttccactagcttcctaccagagcttcagggccaagggggctggtattggagcaaccccagcccagacctgactgcccaggggcctgaagaccagag

SEQ ID NO: 40658 - DNA, 201 bp, Homo sapiens
acagctcactgcgaccttggcctcctgggctcaagcgatcctcccacctcaactttctgagtagctgggactacaggtgtaagccactgcacccggctaattttttttttttttttttgacactgactctcactctatcacccaggctggagtgcagtgacgcaatcttggctcactgcaacctccacctcccaggttcaa

SEQ ID NO: 40659 - DNA, 201 bp, Homo sapiens
ttggctcactgcaacctccacctcccaggttcaagtgattcttctgcctcaggcccccaagtcactaggactacaggtgcgtgccaacacacctggttaatttttttttttgcatttttagtaagacggggtttcaccatattggccagcctggtcttgagctcctgacctcgcgatccgccccctcagcctcccaaagtg

SEQ ID NO: 40660 - DNA, 201 bp, Homo sapiens
cagctgtcaggccagaaggagcagccgtgcaggaggcatttcaggcatcgttgaggggagtgttttggggccgcagagctctcaatgctgcctatcgggcgggggggggcctcccgcccgactgtccagcttcaccctccagtctgaaagtgaagagcagagtatttatttaaaaaataaatgtgaattaaaatggtgcct

SEQ ID NO: 40661 - DNA, 201 bp, Homo sapiens
agtgagtgcccgcatgtctctgcaggcgggaccacatactggccattctggcgctgcgccgactgggccgccggcggaaccagcatctcttgcagcacacycaagacctgctgagagctgcggccggggcggcgggtgcggaggcccctcggggccgcgtgctcttcgaggagatcaaggtgcccagtgccatggctgtgc

SEQ ID NO: 40662 - DNA, 201 bp, Homo sapiens; identical to SEQ ID NO: 8912

SEQ ID NO: 40663 - DNA, 201 bp, Homo sapiens
tacctggcaccaaagggctttctggcaagagatccagagagatgaaatcaggccttccccaggagtttgcatgtagggaagcttttaagagtgtgaacttytaaaaaacaaatgagaccaagaaacattcagtgaacttgtaaaatctttctagaaactattttctggtaagccacctgcactgcccctcccctccctggc

SEQ ID NO: 40664 - DNA, 201 bp, Homo sapiens
gggtcgcatcccctgtatctccggcacaccacactgctatcctagcactgggaatcgacaatgggccaacccttcaaaatgacctggcatcagaaagaaarcctgagccctggcatgcttgcattctcccctcatttacttggccaacaacagctgtgatgcctctcctgcaccgcaggagtgtggggagcaagacacact

SEQ ID NO: 40665 - DNA, 201 bp, Homo sapiens; identical to SEQ ID NO: 8902

SEQ ID NO: 40666 - DNA, 201 bp, Homo sapiens; identical to SEQ ID NO: 8925

SEQ ID NO: 40667 - DNA, 201 bp, Homo sapiens; identical to SEQ ID NO: 8926

SEQ ID NO: 40668 - DNA, 201 bp, Homo sapiens
tggatgctggagaaactatgggcttcaccaaggttttggctgaagcctagtaaattagccagcccttagctaataacagtgataactggcctgccagtttyggggatctgatgccctacattaactcacaagacccaaatgcagtttaagtcctctttaaccattgggtgaaacttcaacattttcagctcacttgcctgt

SEQ ID NO: 40669 - DNA, 201 bp, Homo sapiens; identical to SEQ ID NO: 8917

SEQ ID NO: 40670 - DNA, 201 bp, Homo sapiens
gggaggggtggccagtctgtcctggtcagtatgaaaagctgttggccccctagggacagagggcccagctaaggctgcctgaggatacaaactgcttgctwtcccactcctggggagcagggtctgcagggactgagagtgggtcccaccttgagaacgcatgcaaggtccgtcctgtcttgatgtcttgatgtgactgta

SEQ ID NO: 40671 - DNA, 201 bp, Homo sapiens; identical to SEQ ID NO: 8905

SEQ ID NO: 40672 - DNA, 201 bp, Homo sapiens; identical to SEQ ID NO: 8908

SEQ ID NO: 40673 - DNA, 201 bp, Homo sapiens; identical to SEQ ID NO: 8907

SEQ ID NO: 40674 - DNA, 201 bp, Homo sapiens
gcccctgaaccactgttctggggcttagctgtcctcaagacccttaagtacttgggctgcatgagattacctggcaccaaagggctttctggcaagagatycagagagatgaaatcaggccttccccaggagtttgcatgtagggaagcttttaagagtgtgaacttttaaaaaacaaatgagaccaagaaacattcagtg

SEQ ID NO: 40675 - DNA, 201 bp, Homo sapiens
ttcctggttttcagggagttgcatttggtcctggggacaaggaagtggggggacaagtggtccacttttcctgcaacttggtggctgaatacacaatgcarttcctagtccacatcatccctcaattgattgcagtctgtagaaaaaataaaataaaatgagccccttactcaagatttcctcctacttccccagcattct

SEQ ID NO: 40676 - DNA, 201 bp, Homo sapiens
tctttcgctgaagagaaactcgctgcgctgtcacaggacaccgatgcaaaccaaaataaactgttgcctctgaacacacaaaacaaaaccctgtggctcargccgctgagcttccttggctgtgaagtttcctgcaaagagttgaaggacactctgagtgctcttgcagccgcgggctgtgcaggcccagcgcgcctcgag

SEQ ID NO: 40677 - DNA, 201 bp, Homo sapiens
gtatgtgccctgggggctcactgtggtttacaagtggcttgtgaagctcctgggagcaggtggtacacccagtgctgaagacagggtcgccgtggaagagygaagagcctgaccgggattcctggtgggttgaaactaggaagtgctcacaccagtcagagccaaatgaggggtgcgctatggtcactgctctgtccagca

SEQ ID NO: 40678 - DNA, 201 bp, Homo sapiens
cccgtctgttgtcgcagggcctctgaagggagatgcatggccaaggtggcaacttggaagtagggattggccccagggcctccgcgcaggccgctgtcctkctggagctggctgggtgtggggggaacctgccttaatggtgtttccctctgttcttgtcaacaggaggttcaagatgtgagagggtcagacgcctgagga

SEQ ID NO: 40679 - DNA, 201 bp, Homo sapiens
actcccctcccgtctgttgtcgcagggcctctgaagggagatgcatggccaaggtggcaacttggaagtagggattggccccagggcctccgcgcaggccrctgtcctgctggagctggctgggtgtggggggaacctgccttaatggtgtttccctctgttcttgtcaacaggaggttcaagatgtgagagggtcagacg

SEQ ID NO: 40680 - DNA, 201 bp, Homo sapiens
cgccggtgccgggtaagcagtgtgccctgtccccgtcgtatgaccactctgatgggcctctctgtgccttcgtgcgtctgccacgcccagtgcttgccacrtgtctgtcctctgctttctgccatccatgggtccctccgcttcagcctggctgcgtctcgcactcccctcccgtctgttgtcgcagggcctctgaaggga

SEQ ID NO: 40681 - DNA, 201 bp, Homo sapiens
agggcagcagcatcctgagcctcagccccacgccggtgccgggtaagcagtgtgccctgtccccgtcgtatgaccactctgatgggcctctctgtgccttygtgcgtctgccacgcccagtgcttgccacgtgtctgtcctctgctttctgccatccatgggtccctccgcttcagcctggctgcgtctcgcactcccctc

SEQ ID NO: 40682 - DNA, 201 bp, Homo sapiens
gtccctgaggctgtgtctgcacactgaccccccccccccccccgcaagtcatggggcatgtttctagtttttattgctggatattcttctgttcctgtaargtctctggtttgggcagttattgactgattggtgggatgagcgcggaggtgtcacagtgcgccgctctgggaaatggtgctgccccctccccggagggct

SEQ ID NO: 40683 - DNA, 201 bp, Homo sapiens
gttttagggccctagaaaatgaatgttttttcagtactttgcctacaacatgatactttatctcttgtgaagagtattttaaagatgctcaatttagctascttggacctgctttacagcactgatcatgctggtttactggcctggaaatgcaccttgaagttgaagatgccaaatacaattctcaggtctgagcagaca

SEQ ID NO: 40684 - DNA, 201 bp, Homo sapiens
ctcactgtgttgcctgaggagatggcctttcccaacatacaccagtaacctggaacttaccccagtgatgccgtctcttgatccttaatcgctgcaccaaytgctgcagcccagacacacattaccaaaatctggcagggtagtaaagtgccttgttgtccttacctcttctagggaagcccgtcagcctgagctacagat

SEQ ID NO: 40685 - DNA, 201 bp, Homo sapiens; identical to SEQ ID NO: 8913

SEQ ID NO: 40686 - DNA, 201 bp, Homo sapiens
gcgcggcgcagctgtcgggcttgtgccacccgccaggccgcgcttctgcacagctccgcggtccgcagcgacgcggacctgggcgcgcgtccagccgctgycttcctgtctcttctcgggttcacctgagagaggcccagggaccctccgagcctcacacgccccctccccagctccccaaacacacctgcagacaggctc

SEQ ID NO: 40687 - DNA, 201 bp, Homo sapiens
cccacaaagacccctgcatgtcagacacaccctgtcccggagcgtggtgtccccttgagctttaatgagctccctgtgatcacagccatgccttctcctcsttggggaggtgtcctaggatgcttcagccaaagacctttgtttcccgctgctatctcttttacctggacaactctcctggcccacgttcctcttgccagc

SEQ ID NO: 40688 - DNA, 201 bp, Homo sapiens
ccctctcatgctcaagaggtcctgtgtctgaacacggggaagcgagggctcagggagtctcctggagaggatttgattgctcagaagttctagtgctaaawatggggtggggagacagcagttggaaccaaagctacaactttcccaagacttttccacccaacaccaaatgtttttacttttgattttagaaaactgttt

SEQ ID NO: 40689 - DNA, 201 bp, Homo sapiens
tcaaaatttttgctatgtctccagccacctagactagcacttgctatgttagcttcaattgacttactttttaaaacttgaaccatatattaaaaaaaaawcctgagcaatatctgaaatatctgcctttactgtgctagttatattttttcttattactttaaaaaaataaatacataaatctatattttatagatttca

SEQ ID NO: 40690 - DNA, 201 bp, Homo sapiens
gaactttcctgcaccctccttccctgcccatgtagatgtatgtgtgagattttttggcaagtttctctaatctggaccgggaggatggaagagcaaggacsccatttcagtagtgctcggaaaaaggatgcgttgaatttctcagcccttctccacctcacataaacacccgcccaccctgcacccggatcctgggtcata

SEQ ID NO: 40691 - DNA, 201 bp, Homo sapiens
cggcttctgtatttatgtgctttttaaggcccttgttggtctgctaagttatgaagaaagtagttgtgcagagactggggcgggggtctgtgacgcggagsctgtgtgctcaggactctgtccagaatagcctgggagctccaggaatgcccaggttgctgagccccccagcctgccctccacttcctctcttagaaggcc

SEQ ID NO: 40692 - DNA, 201 bp, Homo sapiens; identical to SEQ ID NO: 8921

SEQ ID NO: 40693 - DNA, 201 bp, Homo sapiens
tgcagtgctgacttcccctgcagggtcccagtgcagctgctggaagctggccccagaggtgcctttctggagttagatcaggtgtaactgtgaaggctgcyttaggtctctccagtgccatgagtcaccagcaccctgatgcttggctttttcctggttttcagggagttgcatttggtcctggggacaaggaagtggggg

SEQ ID NO: 40694 - DNA, 201 bp, Homo sapiens
tgtccccttgagctttaatgagctccctgtgatcacagccatgccttctcctcgttggggaggtgtcctaggatgcttcagccaaagacctttgtttcccrctgctatctcttttacctggacaactctcctggcccacgttcctcttgccagcactgggggtcacaggcctgagccctgggtacaggggtgccctagtct

SEQ ID NO: 40695 - DNA, 201 bp, Homo sapiens
ggaagagcaaggaccccatttcagtagtgctcggaaaaaggatgcgttgaatttctcagcccttctccacctcacataaacacccgcccaccctgcacccrgatcctgggtcataattttaataaatgcagaaagagaaagtggttggaggatggagcacatggaattcaggagaaaacccacaaagacccctgcatgtca

SEQ ID NO: 40696 - DNA, 201 bp, Homo sapiens
actggggcgggggtctgtgacgcggagcctgtgtgctcaggactctgtccagaatagcctgggagctccaggaatgcccaggttgctgagccccccagccygccctccacttcctctcttagaaggcctgcgctcactggggagctcaccagctccacacacttgcagtctgcattcctgtggagaccaggctgtggccac

SEQ ID NO: 40697 - DNA, 201 bp, Homo sapiens
agaggtggcctcgccaggaagggggtgtgccacccctctgtggccctcaggaaaggtgaaaactgactgacccttaggaatgggccctggctttttccaaatacccattgcctttccctccagcactctgccacctgggaaggggcttcttcagcccctccttcctgggttgtgggagtggctttatccccaagcccgggt

SEQ ID NO: 40698 - DNA, 201 bp, Homo sapiens; identical to SEQ ID NO: 8903

SEQ ID NO: 40699 - DNA, 201 bp, Homo sapiens; identical to SEQ ID NO: 8914

SEQ ID NO: 40700 - DNA, 201 bp, Homo sapiens
tgggagctccaggaatgcccaggttgctgagccccccagcctgccctccacttcctctcttagaaggcctgcgctcactggggagctcaccagctccacayacttgcagtctgcattcctgtggagaccaggctgtggccacctggccagtgtgcagggcaacctgctagcccagcagaggtggcctcgccaggaaggggg

SEQ ID NO: 40701 - DNA, 201 bp, Homo sapiens; identical to SEQ ID NO: 8924

SEQ ID NO: 40702 - DNA, 201 bp, Homo sapiens; identical to SEQ ID NO: 8927

SEQ ID NO: 40703 - DNA, 201 bp, Homo sapiens
cctgcactgccagcgctgagctttccccagcacaccgcgagcacctctggagcctgagcgtaccaagtggagcacggggtgccagcgagggccctagatgrgtgttgggggagcggatgcacacgttgcagccgcgccttcctcctgtgcagccgcacactgttgccattctgttttcacagagcccggctgaagaacaac

SEQ ID NO: 40704 - DNA, 201 bp, Homo sapiens
atttattttaatgaattactgataaacagtgctttgaccaggggcctccaggcctgagactgaaggcacagtttaaccagtacacgggccagtgttaaatyttatgcagactgagacgaacttttgtttatttccacattattaatggttctactaattttatctaagggggcgcagagaagaaaaagtggggaaaaaaga

SEQ ID NO: 40705 - DNA, 201 bp, Homo sapiens
aggcctgagactgaaggcacagtttaaccagtacacgggccagtgttaaatcttatgcagactgagacgaacttttgtttatttccacattattaatggtwctactaattttatctaagggggcgcagagaagaaaaagtggggaaaaaagaaaagataggaaaaaagaagcgacagaagaagagaaaggctgcccagaaa

SEQ ID NO: 40706 - DNA, 201 bp, Homo sapiens; identical to SEQ ID NO: 8918

SEQ ID NO: 40707 - DNA, 201 bp, Homo sapiens; identical to SEQ ID NO: 8906

SEQ ID NO: 40708 - DNA, 201 bp, Homo sapiens
ctcctgaacttaaaagttaaaaaaaaaaagaagaagggggttttcacaagcttcacctctcgtccacccactcatccaatatgtatgcactgtagctgctktcacccacctccctgccacccagcacctgggacatggagatcagcattcctcacctgcacaaggatgcctcttctgacttcccctttctgctacaccata

SEQ ID NO: 40709 - DNA, 201 bp, Homo sapiens; identical to SEQ ID NO: 8899

SEQ ID NO: 40710 - DNA, 201 bp, Homo sapiens; identical to SEQ ID NO: 8900

SEQ ID NO: 40711 - DNA, 201 bp, Homo sapiens
ggcttagctgtcctcaagacccttaagtacttgggctgcatgagattacctggcaccaaagggctttctggcaagagatccagagagatgaaatcaggccytccccaggagtttgcatgtagggaagcttttaagagtgtgaacttttaaaaaacaaatgagaccaagaaacattcagtgaacttgtaaaatctttctaga

SEQ ID NO: 40712 - DNA, 201 bp, Homo sapiens
ttctctcttctttccaaacctgtgttcttcagcacagcacagctggatgctggagaaactatgggcttcaccaaggttttggctgaagcctagtaaattasccagcccttagctaataacagtgataactggcctgccagtttcggggatctgatgccctacattaactcacaagacccaaatgcagtttaagtcctcttt

SEQ ID NO: 40713 - DNA, 201 bp, Homo sapiens
aagatgccaaatacaattctcaggtctgagcagacactaaattaacaaagaataggccccagatttggaccccaatgtgggttgctccgagccacacccayctctgcacccctcttcacctaatggacaggctgcttgaagactccctgggtgcccctgaaccactgttctggggcttagctgtcctcaagacccttaagt

SEQ ID NO: 40714 - DNA, 201 bp, Homo sapiens
cgagcacctctggagcctgagcgtaccaagtggagcacggggtgccagcgagggccctagatgagtgttgggggagcggatgcacacgttgcagccgcgcyttcctcctgtgcagccgcacactgttgccattctgttttcacagagcccggctgaagaacaacaacagacaagtgtgcattgacccgaagctaaagtgga

SEQ ID NO: 40715 - DNA, 201 bp, Homo sapiens
tgcctacaacatgatactttatctcttgtgaagagtattttaaagatgctcaatttagctagcttggacctgctttacagcactgatcatgctggtttacyggcctggaaatgcaccttgaagttgaagatgccaaatacaattctcaggtctgagcagacactaaattaacaaagaataggccccagatttggaccccaa

SEQ ID NO: 40716 - DNA, 201 bp, Homo sapiens
gactgagcacaggaagggttcactacttggttcctgggaactggtgtggggactgggagcacagatctgaacccctggggccttgggtctgatttgccctrtgagccctggtagtccgacagtcccggggaatgtcccaggaaataccaactgtgctattgtgaaatatatatttggtctttgtcccagcttcctggcatg

SEQ ID NO: 40717 - DNA, 201 bp, Homo sapiens
ctgcactgccccggaaagacttctgttcacatttccatgtctctgcaatggaacttcctgcactgccagcgctgagctttccccagcacaccgcgagcacmtctggagcctgagcgtaccaagtggagcacggggtgccagcgagggccctagatgagtgttgggggagcggatgcacacgttgcagccgcgccttcctcc

SEQ ID NO: 40718 - DNA, 201 bp, Homo sapiens
ccgcaagtcatggggcatgtttctagtttttattgctggatattcttctgttcctgtaaggtctctggtttgggcagttattgactgattggtgggatgakcgcggaggtgtcacagtgcgccgctctgggaaatggtgctgccccctccccggagggctggagagaggattggaatgaggaacctcggtctttgagttat

SEQ ID NO: 40719 - DNA, 201 bp, Homo sapiens
gtggccaaaaaacaaggagttaaaggactattttcctgcctttttgttagttttttttttttttttttggagacggagtcttgctctgtcacccaggctgkagtgcagtggtgcgatcttggcttactgcaacctctgactcctgggttcaaggaattctcctgcgtcagccttcagagtagctggaattacaggcatgcg

SEQ ID NO: 40720 - DNA, 201 bp, Homo sapiens
tcaagcatttgtttaaacgagtagtccctaaattctgctacatattagatcacctgggcaacttacaaacatctcagtgcttaggttgtgccctgtctcarttaaatcagagtgtttggcgtcaatattttttaacgatccttgggcatttctactgtgcagcagtttgggaactgctggtttaaaaacttatatccaatg

SEQ ID NO: 40721 - DNA, 201 bp, Homo sapiens
accctacacgacatagctaggagccatggggaggttacagggagacagattccaactcaataccaatggctgagtaaccctcagagtggtggagattgcarggcctgtcagagtggttggactctgggtcttggccctccacacaagtcttgggtagcttggtctgtgaataatgagctcttagtgctggaaatggccaag

SEQ ID NO: 40722 - DNA, 201 bp, Homo sapiens
tttctagtaagagcagctgctgagtctaagcagactcttgactgaactagagggtatggctaacttgtcctggcctcagtgtgcagcctctacatcttgtytcctattatctgctgaggctgggataggttgcagatcatggggccctggccttctctgactttctgttgctctacataagtgggatggctgacttctcct

SEQ ID NO: 40723 - DNA, 201 bp, Homo sapiens
tttggattgatcaaggatgttgctcgcttccgacctgagctcaaggtcctggtggcttcagccacaatggacactgcccgtttttccaccttctttgatgrcgcccctgtgtttcgaatccccggacgcaggtttcctgtggacatcttctacaccaaggtgccccctcagggaggatgggcttaagtctgtggcagaaaa

SEQ ID NO: 40724 - DNA, 201 bp, Homo sapiens
tttatgccaatctgccctctgacatgcaggcccgtatcttccagcccacaccacctggggcacgaaaggtcagttggagaaacccacactcttcacccctrtgcttcccacaactagtagtgaaaaagctgtgtgcctgccccatgcaaggtgagtcctgcgcactgctgcacacagctgaggagcagccagtcccttgtt

SEQ ID NO: 40725 - DNA, 201 bp, Homo sapiens
tccagcctgggtgacagtgcgagactccatctcaaaaaagaaaaatggctgagaagtcatcagaggaaggcccaaggtatgtttgaggtcagagtgtgagmtagtaggcttagtgggaggttcatgtggtgaaggagtaggagacaaggctaaaaacaatttggggctaagattagggagggcctttgatgacaggaaagt

SEQ ID NO: 40726 - DNA, 201 bp, Homo sapiens
gggagtggagaaggagcctcctgagtccgacctccggcctcctcacaggggtgagcgcgccccagagccggcttcgtgaaggggaaaggaggccggggcgrgggggtagggggggaaggggctgagggagggaaacggagatgtcccgcgcttgcgcactgcaggctcgagggaagcggctgaagcgctctgtcggctgta

SEQ ID NO: 40727 - DNA, 201 bp, Homo sapiens
tgaccatacacataaggatctaggttggggctgggcatagtggctcatttttgtaaaccatcccagcactttgggaggccaaggcaggatcctagcacttygggaggccaagatcagcccaggcaacatagtgagaccccaactatacaaaaaattaatggtgcactgtgatgtgtgcctgtagtctcagctacttgggag

SEQ ID NO: 40728 - DNA, 201 bp, Homo sapiens
cctccctctttgagcaacagccacgctggctgctctaccacgaacttgtcttgaccaccaaagagttcatgagacaggtgaggagaacatcctgtgcccaygcaggtggagactatgtagagagatggtgtcctggcaagctaagaacccaggttcaagttgctgggactggtacagaaagaggaaggtagggtaaaatag

SEQ ID NO: 40729 - DNA, 201 bp, Homo sapiens
tctccttcatttcctaggtcactgcccctttgtttacagctcctgcctcctcccttgaccacagcctggtttacaaattccatcagctcccagccccaccygccaaagtcccaggtttacaagccacgcttacttgctgtgtctgcgtggaattctctcctctgtcccctccagtctcctcattggagtgacctgaaggtg

SEQ ID NO: 40730 - DNA, 201 bp, Homo sapiens
ctttagtcctgctgtatacttaattatctctcctttctttttaactgtcttcccagtgggctgagagtggttactcttcccagtggtgctatgagaacttygtacagttcagatcgatgcgccgagcccgggatgtgcgggaacagctggaagggctcttggaacgtgtggaagttggtctcagttcctgccagggggact

SEQ ID NO: 40731 - DNA, 201 bp, Homo sapiens
tccccatgctaagaaaatgcccaaaaaaataggcaaaacacgagaagagctagggtaagagaaggacgtaaacagaacctgacaccagctccttttccttrtatacattatttaatacctattaaataaaattatttttggaataaagcttgtgggaacatttgggatctagagaaagtgatatgtgaaattctatctcat

SEQ ID NO: 40732 - DNA, 201 bp, Homo sapiens
ggcctagggagccaagatcagaagacaaaaggaaagactttctgatagagtgtatagggagagaggatacagaggaagcacagtgtggatgctgatggggkggtcaggtttctagaagaggggcttggttgttaggagccagctgaggatagacttatgttgttgagggaaggatccttcttaagttgtagggggaaggag

SEQ ID NO: 40733 - DNA, 201 bp, Homo sapiens
gagtgtgaaggcatcagctgcagggagaaaggttaatgccagttgggggaggcacacaaatgttctaccctttaccccacccagccctacctaggactcaktttatctagacgatggcgacaaatgaggccactggaattcaggtagaaagtggagtaggcatcataggtcctggggaatagagggaggcttactgaggga

SEQ ID NO: 40734 - DNA, 201 bp, Homo sapiens
ataacttttgaccatacacataaggatctaggttggggctgggcatagtggctcatttttgtaaaccatcccagcactttgggaggccaaggcaggatcckagcactttgggaggccaagatcagcccaggcaacatagtgagaccccaactatacaaaaaattaatggtgcactgtgatgtgtgcctgtagtctcagcta

SEQ ID NO: 40735 - DNA, 201 bp, Homo sapiens
aaccgggatgagcagtttgcatccttccagatttcttgcataaatactgcctttttcttttccctgaccaaattgtcagccagcctgttcccctttctttmcaggcctcagccaatcagcgagctggcagggcaggtcgggtggctgcagggaagtgcttccgcctgtataccgcctgggcctatcagcacgagcttgagg

SEQ ID NO: 40736 - DNA, 201 bp, Homo sapiens
gcacagtgtggatgctgatggggtggtcaggtttctagaagaggggcttggttgttaggagccagctgaggatagacttatgttgttgagggaaggatccytcttaagttgtagggggaaggaggctacccataagtcctccttgactcttaactttaggatcaaatatactctattagtgaatgaaattgtgagctttcc

SEQ ID NO: 40737 - DNA, 201 bp, Homo sapiens
ctccaaaatccgggagctcctggtgctgcccatttatgccaatctgccctctgacatgcaggcccgtatcttccagcccacaccacctggggcacgaaagmtcagttggagaaacccacactcttcacccctatgcttcccacaactagtagtgaaaaagctgtgtgcctgccccatgcaaggtgagtcctgcgcactgct

SEQ ID NO: 40738 - DNA, 201 bp, Homo sapiens
tccgcggtacgggaagacagctttgggatgtcggaagatcctagaggtcccaaggtagctgacttgcgaagctgaggctccagccgagggctccaggcctstgaccggcccagcagtgagcgcggctgcccgacgcttcagggccgggagcagggagcgtgagtcgccatggcgacgccggcgggtctggagcgctgggtt

SEQ ID NO: 40739 - DNA, 201 bp, Homo sapiens
cccctccagtctcctcattggagtgacctgaaggtgtggcttcctccactttttctcagtattactttgccttagttttccccaagagggaaggctggaamtcttaactctgtaccccttgatagttatttaattctgtttctcctagtggttcacaattgaactgaattgagatggtgtcgggtggctaaggagacacct

SEQ ID NO: 40740 - DNA, 201 bp, Homo sapiens
tggtcccaaagctgaattcaagcatttgtttaaacgagtagtccctaaattctgctacatattagatcacctgggcaacttacaaacatctcagtgcttargttgtgccctgtctcaattaaatcagagtgtttggcgtcaatattttttaacgatccttgggcatttctactgtgcagcagtttgggaactgctggttta

SEQ ID NO: 40741 - DNA, 201 bp, Homo sapiens
gcggaaatttaccaggttgtaaggctcaacatatgagacaggacttttcatttgttcagtacttttgtgtgtgtgtgtgtgtgtgtgtgtgtgtgtgtgtgacagggtttcactctgtcacccaggctggagtccagtaatgtgatcacggctcactgcaacctcaacctcccaggttgaagtgattctctcatctcagcc

SEQ ID NO: 40742 - DNA, 201 bp, Homo sapiens
ggcggaaatttaccaggttgtaaggctcaacatatgagacaggacttttcatttgttcagtacttttgtgtgtgtgtgtgtgtgtgtgtgtgtgtgtgtgtgacagggtttcactctgtcacccaggctggagtccagtaatgtgatcacggctcactgcaacctcaacctcccaggttgaagtgattctctcatctcagc

SEQ ID NO: 40743 - DNA, 201 bp, Homo sapiens
aggcggaaatttaccaggttgtaaggctcaacatatgagacaggacttttcatttgttcagtacttttgtgtgtgtgtgtgtgtgtgtgtgtgtgtgtgtgtgacagggtttcactctgtcacccaggctggagtccagtaatgtgatcacggctcactgcaacctcaacctcccaggttgaagtgattctctcatctcag

SEQ ID NO: 40744 - DNA, 201 bp, Homo sapiens
caggcggaaatttaccaggttgtaaggctcaacatatgagacaggacttttcatttgttcagtacttttgtgtgtgtgtgtgtgtgtgtgtgtgtgtgtgtgtgacagggtttcactctgtcacccaggctggagtccagtaatgtgatcacggctcactgcaacctcaacctcccaggttgaagtgattctctcatctca

SEQ ID NO: 40745 - DNA, 201 bp, Homo sapiens
agaggcaggcggatcacgaggtaaggagatcaagaccatcctggctaacacggtgaaaccccgtctctactaaaaaatataaaaaattagctgggcgtggkggcgggcacctgtagtcccagctactcaggaggctgaggcaggagaatggcgtgaacgcaacccaggaggcggagcttgcggtgagccgagatcgtgcca

SEQ ID NO: 40746 - DNA, 201 bp, Homo sapiens
gtgcttagaggccgaaaaagtacagccccttccgggctccgcggtacgggaagacagctttgggatgtcggaagatcctagaggtcccaaggtagctgacytgcgaagctgaggctccagccgagggctccaggcctctgaccggcccagcagtgagcgcggctgcccgacgcttcagggccgggagcagggagcgtgagt

SEQ ID NO: 40747 - DNA, 201 bp, Homo sapiens
cagaattagaaaaccaaactggcttctaaggaatggggaacagctgtgagaagcagtctaggaacttctctgggaagtgaaaagggtcatgtatatacctytgggtgcttttcctccccagtgccctacctgtgccccaattctcacttggtacgtatgttgaggatctcattgatgaattccacatccaaggaatacaga

SEQ ID NO: 40748 - DNA, 201 bp, Homo sapiens
cccttcaatttgtgtgggggggaagggtgggcagaaggcagaggctctcactcattctctaacattattgccccctctcccacagatgagtcctgccggcrgtgaccatcttccaacatagggatatacctccctccttcttataactgaagatcctggagcccggaagattcagggcagacagaccctgataatgagcct

SEQ ID NO: 40749 - DNA, 201 bp, Homo sapiens
atctcgcccgggagtaccgggcagctggggagcaggagaagctggaggccaccaatcgctaccacatgcccaaggaaacccgaggacaggtgaggtgaagyggcgtctgcttcagccttggtccccaagacaagttgtggggaaggcttcaggggattgggcaacacgtgggtcatcccctttcttgccttgccgttccca

SEQ ID NO: 40750 - DNA, 201 bp, Homo sapiens
aagaacatctaactggggctgaagattgcctcctgttggccccctcactggtttctatctttgtctgaattgttttcggtttgagtcctgtgcttctaaaygctggattagccttttattttccccctttccactaatttgaataaaatggcaagagtaaaatataagctacgcagacatctccctagtgcatctatatta

SEQ ID NO: 40751 - DNA, 201 bp, Homo sapiens
actctggaacaaggtgtcggcaggggtggggaggggccctgtgatttgtcccggtgaggctggcctaacggtccatcgagaagttaagaaagctcagttcrcaagcacttattctttgtccgttgtcgcgtaggtactgtgctagctgctggacgcccagctcagtggagaagattgaggagggcttaggtgtgtcgggtt

SEQ ID NO: 40752 - DNA, 201 bp, Homo sapiens
atctcagtgggccggcccgggacttcgccctgagactctggaacaaggtgtcggcaggggtggggaggggccctgtgatttgtcccggtgaggctggcctmacggtccatcgagaagttaagaaagctcagttcacaagcacttattctttgtccgttgtcgcgtaggtactgtgctagctgctggacgcccagctcagtg

SEQ ID NO: 40753 - DNA, 201 bp, Homo sapiens; identical to SEQ ID NO: 8963

SEQ ID NO: 40754 - DNA, 201 bp, Homo sapiens
tgaagggactctgttccatccatcacacctctttctagggatccatgacctaatgcactttgatttcctggaccctccaccatatgagacactgctgctgyctttggagcagctgtatgctctgggagccctcaaccaccttggggagctcaccacggtgagtcgggggacagcatgggtggaggcaggatgataggggtc

SEQ ID NO: 40755 - DNA, 201 bp, Homo sapiens
agctgcactcggtgttggggctgagcgagcggcacgtcgcccagtttctgatcggtaccgcacagcgctgcacctctgccgaggagttcgtgcagcgcctycgagacactgataccttggatctcagtgggccggcccgggacttcgccctgagactctggaacaaggtgtcggcaggggtggggaggggccctgtgattt

SEQ ID NO: 40756 - DNA, 201 bp, Homo sapiens
aagagcagctgctgagtctaagcagactcttgactgaactagagggtatggctaacttgtcctggcctcagtgtgcagcctctacatcttgtctcctattrtctgctgaggctgggataggttgcagatcatggggccctggccttctctgactttctgttgctctacataagtgggatggctgacttctccttagagccc

SEQ ID NO: 40757 - DNA, 201 bp, Homo sapiens
ggaccctccaccatatgagacactgctgctggctttggagcagctgtatgctctgggagccctcaaccaccttggggagctcaccacggtgagtcgggggrcagcatgggtggaggcaggatgataggggtcaggatggctccagggacccctgtagtagtagcgggaaacctgagggaggactgggctcaactctctctc

SEQ ID NO: 40758 - DNA, 201 bp, Homo sapiens
gggtctgtgactcagtctacagttccctcaggtccctacagcagaagtcttggtgctgccccacttcacctttccccaagttcctttcagggcacaccagsccacacttggttgctaatggttcccttgaccaggttggctacagcatccgctttgaggactgcacatcagagcgaactgtcctccgctacatgacagatg

SEQ ID NO: 40759 - DNA, 201 bp, Homo sapiens
acatcattttctcaggaaaatgtttataatatatttctatgcctgcctcatggttccaaaaaagaatccagttgactatccctgtacgtccaaggattacscacatccttcccactgtagacgaaggccacttttgcactgacttacctcttgtctcagtctctcatacatgacagacagatgttcctccatactaggatc

SEQ ID NO: 40760 - DNA, 201 bp, Homo sapiens
accggtaatgctcgtctttgtcacgcttgtagaaccgcaaaaagagcaagtggacgggcagccccacaagccgccaccgggcttgcagggtccagttctckgggtggcgggtcagctgtaaaacctccaaacgaaggtgtgcaaaataattccaggccaggaaacggcagagggtcagtgaaagaatgtaccatgtccggc

SEQ ID NO: 40761 - DNA, 201 bp, Homo sapiens
ctctacataagtgggatggctgacttctccttagagccccctccgtcaacagtcattcttgaactctttgtgtccattactcccctctcatccagttaacyctggtgtctgatactgcattgcctagcgctcttccctcattgctctcctattccctccccagcgtggtgatggtggatgaggcacacgaaaggaccctac

SEQ ID NO: 40762 - DNA, 201 bp, Homo sapiens
ttatctgctgaggctgggataggttgcagatcatggggccctggccttctctgactttctgttgctctacataagtgggatggctgacttctccttagagycccctccgtcaacagtcattcttgaactctttgtgtccattactcccctctcatccagttaaccctggtgtctgatactgcattgcctagcgctcttccc

SEQ ID NO: 40763 - DNA, 201 bp, Homo sapiens
acccacttcaactcaggcccagcagaaagagtccatccaggccgtccgccgcagcctcccggtgttcccatttcgagaggagctcctggctgctattgcayatcaccaagtcctcatcattgaaggcgagacaggctcagggaagaccacccagatcccgcagtatctctttgaggaggtacagtcatctcacccttcagc

SEQ ID NO: 40764 - DNA, 201 bp, Homo sapiens
gctacatattagatcacctgggcaacttacaaacatctcagtgcttaggttgtgccctgtctcaattaaatcagagtgtttggcgtcaatattttttaacratccttgggcatttctactgtgcagcagtttgggaactgctggtttaaaaacttatatccaatgtttgtggctgagtctaacaatttattgggattctac

SEQ ID NO: 40765 - DNA, 201 bp, Homo sapiens
agctccagggtgatgaggtaagaggggagctgggagactttctgaggaagacccgtagcgagctatttagctcacacctccttctctttccttaggagccytcagctccacccacttcaactcaggcccagcagaaagagtccatccaggccgtccgccgcagcctcccggtgttcccatttcgagaggagctcctggctg

SEQ ID NO: 40766 - DNA, 201 bp, Homo sapiens
atcaggagcccctggggaggagcagcggcgctgggaggaggcgcggcttggggcagcgtccctgaagtttggggcccgagatgctgcctctcaggagcccyagtatcaactggtgctggaggaggaggagaccattgagtttgtccgggccactcagctccagggtgatgaggtaagaggggagctgggagactttctgag

SEQ ID NO: 40767 - DNA, 201 bp, Homo sapiens
atctgaggagtttgagaccagcctgggcaacatgatgaaaccccgtctctactaaaatacaaaaaattagctggacgtggtggcacgcacctgtagtcccrcctactcaggaggctgaggcaggagaattgcttgaacccaggaggtggaggctgcagtgagccaagatcacgccactgcattccagcctgggcgacagag

SEQ ID NO: 40768 - DNA, 201 bp, Homo sapiens
ctcgagggaagcggctgaagcgctctgtcggctgtaagcgcgcctgcgcccgcgggctcggagactgcctgagtgcgcttgcgcaagttacagcctccccygcccccccaagcgctgtattcacagctgaggcctttgagcaaaaagctgagcaaaaacagggctgaaggctgaatgggtgcaacgacagtgaggggtgag

SEQ ID NO: 40769 - DNA, 201 bp, Homo sapiens
acagctgtgagaagcagtctaggaacttctctgggaagtgaaaagggtcatgtatatacctttgggtgcttttcctccccagtgccctacctgtgccccayttctcacttggtacgtatgttgaggatctcattgatgaattccacatccaaggaatacagactgtagtcgtgggactgaaggaagagcttgggaagctag

SEQ ID NO: 40770 - DNA, 201 bp, Homo sapiens
taagcggcgagtgcgggatctcgcccgggagtaccgggcagctggggagcaggagaagctggaggccaccaatcgctaccacatgcccaaggaaacccgargacaggtgaggtgaagcggcgtctgcttcagccttggtccccaagacaagttgtggggaaggcttcaggggattgggcaacacgtgggtcatcccctttc

SEQ ID NO: 40771 - DNA, 201 bp, Homo sapiens
tgtttcttgaatctttgaattcagtcattgacagtcgttcataatcggacaacagatttttccccccagtctttggactcaggggaagggtcagatagaaktactcactatagacaggaattccagcattgctttataatttaaaaacatctaggagttattttaggacatcaagttagttgttggaaagcagtatgaatg

SEQ ID NO: 40772 - DNA, 201 bp, Homo sapiens
atggtgcacatttaaagtgtgtttctcttatagatggttctgtatgtagggggttcgtaggatgcttgtggtgtttcttgcgccgggctgcggttcttacragctgtgaaaactactacggcttctcaggttagatgattgcttttctcgttctggcaggtggcttcagtaagttccaagccgagttctccctgcattgcg

SEQ ID NO: 40773 - DNA, 201 bp, Homo sapiens; identical to SEQ ID NO: 8969

SEQ ID NO: 40774 - DNA, 201 bp, Homo sapiens; identical to SEQ ID NO: 8970

SEQ ID NO: 40775 - DNA, 201 bp, Homo sapiens; identical to SEQ ID NO: 8971

SEQ ID NO: 40776 - DNA, 201 bp, Homo sapiens
ttcagtctgctgagatcttgcttttctttttgtgttcacagatgaagcccggggcaagaactgtggtgtcttggtacattgcttggctggcattagccgckcagtcactgtgactgtggcttaccttatgcagaagctcaatctgtcgatgaacgatgcctatgacattgtcaaaatgaaaaaatccaacatatcccctaa

SEQ ID NO: 40777 - DNA, 201 bp, Homo sapiens; identical to SEQ ID NO: 8974

SEQ ID NO: 40778 - DNA, 201 bp, Homo sapiens
gacaggaattccagcattgctttataatttaaaaacatctaggagttattttaggacatcaagttagttgttggaaagcagtatgaatgctgaatgttatscagttgaatgatgcggtgatactggtaacagtgagacagtgggtaacctgagcccagcaggaagaactgtgggctggaagcctgggagaagtgaatctcc

SEQ ID NO: 40779 - DNA, 201 bp, Homo sapiens
cgtcgctctgacatttaaatgcaaaattcctagccattcatagagtttaagctgttaatcgttcttgctgcttgctaatttgtctgactgcaggtctctamtgttcctagagcgtccttaattctggtttatcttcttgctaaaggaagaaaacctgccttttgacatggctgcagatcacaggtgtatttgaaacgctgt

SEQ ID NO: 40780 - DNA, 201 bp, Homo sapiens; identical to SEQ ID NO: 8977

SEQ ID NO: 40781 - DNA, 201 bp, Homo sapiens
ctgaaacgtctcggggtgggaacttctgtgacagatcgtggaggacagggggagtcaactccagcgcaggcctcccccggctgaaactagaagatacccartgaaatatacgagttttgttccaaggactgcccaaaaatggtgcggagaggagctcggcaatccccacctttgtcgaacacgctcctccaggggcggcct

SEQ ID NO: 40782 - DNA, 201 bp, Homo sapiens; identical to SEQ ID NO: 8980

SEQ ID NO: 40783 - DNA, 201 bp, Homo sapiens; identical to SEQ ID NO: 8983

SEQ ID NO: 40784 - DNA, 201 bp, Homo sapiens; identical to SEQ ID NO: 8985

SEQ ID NO: 40785 - DNA, 201 bp, Homo sapiens; identical to SEQ ID NO: 8986

SEQ ID NO: 40786 - DNA, 201 bp, Homo sapiens; identical to SEQ ID NO: 8988

SEQ ID NO: 40787 - DNA, 201 bp, Homo sapiens
agcataatttaatagacccttgcagtctggttgtctgtgtaaaaggcattcacgaacatattgcagggtttctggtattcacatgccgaggcaaagaatgyacccattaaggagttttttgttggcagaaacttaatacaaaagctctcttttcagaaaatatctgaaatatgtaattgtgtccagtgtacatgtttcatt

SEQ ID NO: 40788 - DNA, 201 bp, Homo sapiens
gattcaagcgaataagggttccctggcgaggcgggcccgttcgttccattcccgatggtgcacatttaaagtgtgtttctcttatagatggttctgtatgwagggggttcgtaggatgcttgtggtgtttcttgcgccgggctgcggttcttacaagctgtgaaaactactacggcttctcaggttagatgattgcttttc

SEQ ID NO: 40789 - DNA, 201 bp, Homo sapiens
ccattgttagctgcacaacatttggagcataatttaatagacccttgcagtctggttgtctgtgtaaaaggcattcacgaacatattgcagggtttctggyattcacatgccgaggcaaagaatgcacccattaaggagttttttgttggcagaaacttaatacaaaagctctcttttcagaaaatatctgaaatatgtaa

SEQ ID NO: 40790 - DNA, 201 bp, Homo sapiens; identical to SEQ ID NO: 8968

SEQ ID NO: 40791 - DNA, 201 bp, Homo sapiens
ggcagccggcgaggtaggggccgcgaaccgcgcgttccgcaccagagaaccgggccggctcagaatccactcgcttccggctgcgggtaccggcggtttcyttctaacgggttctgcgccttcttagccagaacatcctccaccatcaccctgttttctatcgttcgattttgaattaagatttgcaggacgggagagatt

SEQ ID NO: 40792 - DNA, 201 bp, Homo sapiens
ttccgccggggtttagggagggaaggccggattagggcccgcgccttccggctgcatccctctcgcgccgcgccggccgcacacaggtggttttccgctcrggaggggcaggcttcggcacttttatataacaatagagctctgcgcgccgggaacgcgcctccccgccgccgcggcccccacccggccacgcctccatcc

SEQ ID NO: 40793 - DNA, 201 bp, Homo sapiens
aaatggtgcggagaggagctcggcaatccccacctttgtcgaacacgctcctccaggggcggcctgcctgaagcagagctccaaaattggcaacctaggcstcgcagccgcctttttttagcctacatttcccaaaccagggaagaggcgggtgactaaaaatgcaaattgcagcgggggtgttagcaggcatgcccgtgg

SEQ ID NO: 40794 - DNA, 201 bp, Homo sapiens; identical to SEQ ID NO: 8973

SEQ ID NO: 40795 - DNA, 201 bp, Homo sapiens
ggagcataattgagcctggcccattcagcaagtgtctgactgcaatttggggagagggagctcgctgcatctaagcagctcaagctgtgaaaaaaaaaaaagtttccaataaattgggagcaaatggtctttgtcaccagtctgaataaaggagagagagagtatgaagagcttagagcctccataaagttgcaatgtttg

SEQ ID NO: 40796 - DNA, 201 bp, Homo sapiens
ccactatgttgttatttcatgatatgtccagatataacttttataatgaacccaccaacagccttaagcagtgttgtttagactggagtttggggctcccwagggttctattaatatattcttgggggatctgcaagttcttaaagtttgaaaaactgagctaaagcattcctgtattgtggacacacacagttacttcca

SEQ ID NO: 40797 - DNA, 201 bp, Homo sapiens; identical to SEQ ID NO: 8975

SEQ ID NO: 40798 - DNA, 201 bp, Homo sapiens; identical to SEQ ID NO: 8976

SEQ ID NO: 40799 - DNA, 201 bp, Homo sapiens; identical to SEQ ID NO: 8978

SEQ ID NO: 40800 - DNA, 201 bp, Homo sapiens
tatgccgacgtggaagactgcaacttagaacggctaaatgatttaactaagggcgcttacctaggaagaagcgggggacataatgcaaacgagggccgtcycactccagaagcccttttcgcagcatttctagtactgagcagtcagaacgccactttaatcaatgcgccaggaaacactggcattcccttggcgataaag

SEQ ID NO: 40801 - DNA, 201 bp, Homo sapiens; identical to SEQ ID NO: 8981

SEQ ID NO: 40802 - DNA, 201 bp, Homo sapiens; identical to SEQ ID NO: 8979

SEQ ID NO: 40803 - DNA, 201 bp, Homo sapiens; identical to SEQ ID NO: 8984

SEQ ID NO: 40804 - DNA, 201 bp, Homo sapiens; identical to SEQ ID NO: 8982

SEQ ID NO: 40805 - DNA, 201 bp, Homo sapiens; identical to SEQ ID NO: 8987

SEQ ID NO: 40806 - DNA, 201 bp, Homo sapiens
attgctttataatttaaaaacatctaggagttattttaggacatcaagttagttgttggaaagcagtatgaatgctgaatgttatccagttgaatgatgckgtgatactggtaacagtgagacagtgggtaacctgagcccagcaggaagaactgtgggctggaagcctgggagaagtgaatctccaggcattgtaatgca

SEQ ID NO: 40807 - DNA, 201 bp, Homo sapiens
tgcggttcttacaagctgtgaaaactactacggcttctcaggttagatgattgcttttctcgttctggcaggtggcttcagtaagttccaagccgagttckccctgcattgcgagaccaatctagacggctcgtgtagcagcagctcgccgccgttgccagtgctggggctcgggggcctgcggatcagctctgactcttc

SEQ ID NO: 40808 - DNA, 201 bp, Homo sapiens
ggttctgtatgtagggggttcgtaggatgcttgtggtgtttcttgcgccgggctgcggttcttacaagctgtgaaaactactacggcttctcaggttagaygattgcttttctcgttctggcaggtggcttcagtaagttccaagccgagttctccctgcattgcgagaccaatctagacggctcgtgtagcagcagctcg

SEQ ID NO: 40809 - DNA, 201 bp, Homo sapiens
cgaggaccgggaccgcttcacccggcgctgtggcaccgacacagtggtgctctacgacgagagcagcagcgactggaacgagaatacgggcggcgagtcgktgctcgggctgctgctcaagaagctcaaggacgagggctgccgggcgttctacctggaaggtacgcgcccagggaactccgcgcgcggggcagggctagg

SEQ ID NO: 40810 - DNA, 201 bp, Homo sapiens
ttcacaccttacagagtattagtgagtgaatacaggacagaaaccttacaaatgtaatgaatgcggcaagttctttagttgcaattcaaaccttgcacaamatcgaagaattcatactggagaaagtctcagaaacagaatgaatgtggcaaaatatttaacgagtggttagacctcactgcccatcttgtaattcatact

SEQ ID NO: 40811 - DNA, 201 bp, Homo sapiens
gaagcaaggagtcccctgaccacttcttccaaacatattcttttgtctttaattcccgcgttccttctcctttgttcagtccaacagggtccacggcaacrtggcacccatacacagggataggaggacatgaaggaagaaggtctgctggagcagaagaagtgaaattgatcagatgaatggggacaccaggaggagtct

SEQ ID NO: 40812 - DNA, 201 bp, Homo sapiens
gaaaccttacaaatgtcatgaacgtggcaaggtcttcaggcatagtttatccctaagcaatcatcagagaattcatactggagagaggccttacaaatgtwatgaatgtggcaaggtcttcaatcaaattgcacaccttgcacgacattggagaactcatactggagagaaaccttacaaaagtaatgaatgtggtaagat

SEQ ID NO: 40813 - DNA, 201 bp, Homo sapiens
agaattcatacaggagagaaactttacaaatgcaataaatgtgccaaagaatttggtgggcattcaagcctcactacccatctgttaatccacactggaargaaaccttatacatgtaaggaatgtgataaggacttcaggaacaagttctccttaacaattcatcagagaattcatactggagagagacataaatgtaac

SEQ ID NO: 40814 - DNA, 201 bp, Homo sapiens
atcagagaattcatactggagagaaaccttacaaatgtaatgagtgtggtaaagtcttcaggaataattcataccttgcatgacatcagagaattcatacyggagagaaaccttacaaatgtaatgaatgttacaaggtctttactcagagttcacaccttgcagaacattggataattcatactggagagaagccttaca

SEQ ID NO: 40815 - DNA, 201 bp, Homo sapiens
tgttggagaattcatacaggagagaaactttacaaatgcaataaatgtgccaaagaatttggtgggcattcaagcctcactacccatctgttaatccacaytggaaagaaaccttatacatgtaaggaatgtgataaggacttcaggaacaagttctccttaacaattcatcagagaattcatactggagagagacataaa

SEQ ID NO: 40816 - DNA, 201 bp, Homo sapiens
cagaaaccttacaaatgtaatgaatgcggcaagttctttagttgcaattcaaaccttgcacaaaatcgaagaattcatactggagaaagtctcagaaacakaatgaatgtggcaaaatatttaacgagtggttagacctcactgcccatcttgtaattcatactggagagaaccttacaaatgtaaaaaaatttggcaaag

SEQ ID NO: 40817 - DNA, 201 bp, Homo sapiens
ctattcatacctagcacaatgttggagaattcatacaggagagaaactttacaaatgcaataaatgtgccaaagaatttggtgggcattcaagcctcactrcccatctgttaatccacactggaaagaaaccttatacatgtaaggaatgtgataaggacttcaggaacaagttctccttaacaattcatcagagaattca

SEQ ID NO: 40818 - DNA, 201 bp, Homo sapiens
ggcgacagagaaagactctgtctcaaaaaaaaaaaaaaaagaaagaaagaaaagaaagaaaaaatttcttctggtgtgaaaactcacgttaataaatgtaagtggtgatttttttgattctccattgctcccacaagaacagaaaacacacattagggaaaaatcttatgaatgtaatgagcatggcaaagtctttagagt

SEQ ID NO: 40819 - DNA, 201 bp, Homo sapiens
tgtcacaagatcttcaggtttttgaaccaggagaatatattgctcaattgttgcttattctctgcaaattacacccttctccatgaaaagagaaatgaggraacaaagggtttgggagcacaactacatgggaaatctatcccaacccataaactctaatagacctacctgtgtaatacaaattaaagaaaagaaatttta

SEQ ID NO: 40820 - DNA, 201 bp, Homo sapiens
catgacataatcctggatccagataaactttacaaatgtaatgagtgtggtaaagtctttaggaaaaattcatacattgtacaacatcacagaattcatayaggagagaaatcttacaaacgtaatgaatgtgcaaggtctttaatcgcaattcacatcttgcagaacatctgagaattcatactggagagaaaccttaca

SEQ ID NO: 40821 - DNA, 201 bp, Homo sapiens; identical to SEQ ID NO: 9039

SEQ ID NO: 40822 - DNA, 201 bp, Homo sapiens
accacctcttcaagcctaggatggagccccacggggcaccaaagatgtctgaccccagcactgtttatctggctgcaaacccactaataacatagtcaacracagtcagtacagagcaggggccccataccttatttctgccaaggctttatggatgactctctcccccttcaacaaatgctcattaatgttcccaccatc

SEQ ID NO: 40823 - DNA, 201 bp, Homo sapiens
tgcttcatgacttcaagatcttataaacttttataagggaaacaaatatctttatgtacaacaataaataatacagtaaaatttaataggagttcagagtrgagttacaatagtaagggaaagattcattaaactctgagtcatggaattataaatagtttggcctagaaagaaccttcataaccacataatctaatccca

SEQ ID NO: 40824 - DNA, 201 bp, Homo sapiens
ggcctttgccgtgttcttaatgtcttctttacatacctaggaaaagtgaaggagaggtgagaaagacagagtggggaggaacccgtgtctgtgggtttgtrctagatgccaacctggctcttcacatcctctgtctcatccagtcaagcagccacactgagtcccccagcatgagaacagcttccacagagcaggagattc

SEQ ID NO: 40825 - DNA, 201 bp, Homo sapiens; identical to SEQ ID NO: 9040

SEQ ID NO: 40826 - DNA, 201 bp, Homo sapiens
gtaccggagctctctcctgaccccagacccagaatctgctccgtggaggctgttcacatgctggggagctcggtgcagctgcttgctccccagaccccagscaactcagcctctctctccatgattttctgttgtttattccaaaataggggagtctacaccctgtggagctcaagatggtcctgagtggggcgctgtgct

SEQ ID NO: 40827 - DNA, 201 bp, Homo sapiens; identical to SEQ ID NO: 9045

SEQ ID NO: 40828 - DNA, 201 bp, Homo sapiens; identical to SEQ ID NO: 9046

SEQ ID NO: 40829 - DNA, 201 bp, Homo sapiens; identical to SEQ ID NO: 9047

SEQ ID NO: 40830 - DNA, 201 bp, Homo sapiens
gcaaaagcctagtgctcacaaagagctggaaagcctcaaggaagttcttcaatatttctggaaggaaactgtctccagaagcttccctccccacgacagayaatgagcagcaagtgcttctggcgacttagggtgatgtgaaatcacgctgggaatcctgctcctcctcaggtcctggcagtttcagggcccctccctagg

SEQ ID NO: 40831 - DNA, 201 bp, Homo sapiens
attagcataggcctacagagcccaggcattagggcagcacaaaccaggctctaagcaaaggcaaataaaatactacacctctcagcaaagtgaagacacasgctctggggccacctgaagcttctgtgcagaagtgggaatgttttccaagaggcttgtcttgtcattcccttacaggtagatttaggtcaagcattgcat

SEQ ID NO: 40832 - DNA, 201 bp, Homo sapiens
cattgaatttcttccagctctttgagctgacactgacccagagtgggagtcatcagcttgctatccaccttcacccagggccctccactttgttgccccayctagatctgggcacagctaccacactgcccactgtcctgctgctacaaccaaagaagccccagtggtttggccaaggggagcccatcatcaagtgggctt

SEQ ID NO: 40833 - DNA, 201 bp, Homo sapiens
gcattagggcagcacaaaccaggctctaagcaaaggcaaataaaatactacacctctcagcaaagtgaagacacacgctctggggccacctgaagcttctrtgcagaagtgggaatgttttccaagaggcttgtcttgtcattcccttacaggtagatttaggtcaagcattgcattccctgggagccagtaagtaccaag

SEQ ID NO: 40834 - DNA, 201 bp, Homo sapiens
ctgccatgggcactgactcttagggtctgaaagcccctgagatgcaaaagcctagtgctcacaaagagctggaaagcctcaaggaagttcttcaatatttytggaaggaaactgtctccagaagcttccctccccacgacagataatgagcagcaagtgcttctggcgacttagggtgatgtgaaatcacgctgggaatcc

SEQ ID NO: 40835 - DNA, 201 bp, Homo sapiens
cccatcatcttagtgtagcaatggggaggctcaggcccagagtgggcgagagagttgtctcctgcgactcagcagcattggaggcatagatggggcaagawcctagggctctgactcaccgtgcagcttctcttccaacaggagatgggttggggcagaaaaggttgaatagggtgaaggagcaaaccacagactccagtg

SEQ ID NO: 40836 - DNA, 201 bp, Homo sapiens; identical to SEQ ID NO: 9057

SEQ ID NO: 40837 - DNA, 201 bp, Homo sapiens; identical to SEQ ID NO: 9060

SEQ ID NO: 40838 - DNA, 201 bp, Homo sapiens; identical to SEQ ID NO: 9061

SEQ ID NO: 40839 - DNA, 201 bp, Homo sapiens
gctctctgaagatcctcagtcacttagagtggagggacccagagaacaggtggcattgttggacctcctgcttgctcactctgccccatgcactgcaacasgtccctctctaaaatagtttgcacctgcccacctggggcacccttgctgagcacagatgccaggtagatccttcagctaggccatatgtgtatgtgtgtg

SEQ ID NO: 40840 - DNA, 201 bp, Homo sapiens
ctaataacatagtcaacgacagtcagtacagagcaggggccccataccttatttctgccaaggctttatggatgactctctcccccttcaacaaatgctcmttaatgttcccaccatcttattattcatgctgtaccaaagacattgtgaaatgcccaggctcttcttccttcatgtcctgcagccaattatagagattgg

SEQ ID NO: 40841 - DNA, 201 bp, Homo sapiens
accggagctctctcctgaccccagacccagaatctgctccgtggaggctgttcacatgctggggagctcggtgcagctgcttgctccccagaccccagccmactcagcctctctctccatgattttctgttgtttattccaaaataggggagtctacaccctgtggagctcaagatggtcctgagtggggcgctgtgcttc

SEQ ID NO: 40842 - DNA, 201 bp, Homo sapiens
gcacaaaccaggctctaagcaaaggcaaataaaatactacacctctcagcaaagtgaagacacacgctctggggccacctgaagcttctgtgcagaagtgrgaatgttttccaagaggcttgtcttgtcattcccttacaggtagatttaggtcaagcattgcattccctgggagccagtaagtaccaaggagagaactaa

SEQ ID NO: 40843 - DNA, 201 bp, Homo sapiens
tggggaggctcaggcccagagtgggcgagagagttgtctcctgcgactcagcagcattggaggcatagatggggcaagaacctagggctctgactcaccgwgcagcttctcttccaacaggagatgggttggggcagaaaaggttgaatagggtgaaggagcaaaccacagactccagtgggagactgtggggtcatcctc

SEQ ID NO: 40844 - DNA, 201 bp, Homo sapiens
tgcatgcaggcatatatgtgtgagcatatgtgtgcatgcatgtatctgtatgtaaccatgtatgtgtgagtgcaggtatgtaggtatgagcatgtgtgtgwatatgtatatgtgtgcatgcatgtatctgtgcatgtatgtatctgatgtatgtgggtggtgaggggatgtacagagaggaatgagaccctcttttgctct

SEQ ID NO: 40845 - DNA, 201 bp, Homo sapiens
ccttcagctaggccatatgtgtatgtgtgtgcttactggtgtatgtatgtgtgcatgcaggcatatatgtgtgagcatatgtgtgcatgcatgtatctgtrtgtaaccatgtatgtgtgagtgcaggtatgtaggtatgagcatgtgtgtgtatatgtatatgtgtgcatgcatgtatctgtgcatgtatgtatctgatgt

SEQ ID NO: 40846 - DNA, 201 bp, Homo sapiens
tgcatgcatgtatctgtatgtaaccatgtatgtgtgagtgcaggtatgtaggtatgagcatgtgtgtgtatatgtatatgtgtgcatgcatgtatctgtgyatgtatgtatctgatgtatgtgggtggtgaggggatgtacagagaggaatgagaccctcttttgctctcagcaacctcacagggtgtagaaagttgtcca

SEQ ID NO: 40847 - DNA, 201 bp, Homo sapiens; identical to SEQ ID NO: 9041

SEQ ID NO: 40848 - DNA, 201 bp, Homo sapiens; identical to SEQ ID NO: 9043

SEQ ID NO: 40849 - DNA, 201 bp, Homo sapiens; identical to SEQ ID NO: 9042

SEQ ID NO: 40850 - DNA, 201 bp, Homo sapiens
ggaggaagtgagttctggatagacccgttgtccagctctgagcaggagggaggaagggaggggctgccattgcagctgggaaattgtgaccagcacctcaytgctcttagagttttcccagcctttttcaaataggggcaggactggggcaggccatctcacaaggggtccctgatgctgagggggacaagtgaacctccc

SEQ ID NO: 40851 - DNA, 201 bp, Homo sapiens
tatgtgtgcatgcatgtatctgtgcatgtatgtatctgatgtatgtgggtggtgaggggatgtacagagaggaatgagaccctcttttgctctcagcaacmtcacagggtgtagaaagttgtccaaacaattccaaaggggggcttattaagacagggttcagaaaaaggcctgagacccaaggggcattaaaggaggggg

SEQ ID NO: 40852 - DNA, 201 bp, Homo sapiens; identical to SEQ ID NO: 9044

SEQ ID NO: 40853 - DNA, 201 bp, Homo sapiens
gaccagcacctcattgctcttagagttttcccagcctttttcaaataggggcaggactggggcaggccatctcacaaggggtccctgatgctgagggggayaagtgaacctcccagtctagagctccagccaagtctatccaaggtgggaacgggggccaggatccctgctcagagctccgccattgtcccccatcacagt

SEQ ID NO: 40854 - DNA, 201 bp, Homo sapiens
gttgtccaaacaattccaaaggggggcttattaagacagggttcagaaaaaggcctgagacccaaggggcattaaaggagggggttgagtctattttgggktgtagaggcttgaagatttgaccctgaactagagggtggagtggaggtggtacaatgtgcttccatgccttgatgtccactctgggccagtggacaggag

SEQ ID NO: 40855 - DNA, 201 bp, Homo sapiens
tctatccaaggtgggaacgggggccaggatccctgctcagagctccgccattgtcccccatcacagtgaatggatgtaagctcacccactctgtgcccctrcctccctgctactctttggggataataataaaacaaaaaccattaccatcagtcagtctgtccacccactggcatgtaccaagccagacactctgccgtg

SEQ ID NO: 40856 - DNA, 201 bp, Homo sapiens
actctttggggataataataaaacaaaaaccattaccatcagtcagtctgtccacccactggcatgtaccaagccagacactctgccgtgttctgggcttwacaacagaggatgagagtggtcctttctctcagtctaataaagcacttcccacgatgtgttctatgggactcgattagaggagtcccacagaggcatcca

SEQ ID NO: 40857 - DNA, 201 bp, Homo sapiens
ccatgccttgatgtccactctgggccagtggacaggagaagccatgtcatgacagctgctgagaagcctcccttctgcccagcctgggggcaggccgtctyacagcagtcctgtgccctagagcccaggacaggggaagaaggagggaaaggcatccagggccctgcatctggcctctttcccacaggtgaagagatcagc

SEQ ID NO: 40858 - DNA, 201 bp, Homo sapiens; identical to SEQ ID NO: 9048

SEQ ID NO: 40859 - DNA, 201 bp, Homo sapiens
acccactggcatgtaccaagccagacactctgccgtgttctgggcttaacaacagaggatgagagtggtcctttctctcagtctaataaagcacttcccaygatgtgttctatgggactcgattagaggagtcccacagaggcatccaggagatgctttacacagtggagctctctgatcaagtaaatgcagggaattctg

SEQ ID NO: 40860 - DNA, 201 bp, Homo sapiens; identical to SEQ ID NO: 9049

SEQ ID NO: 40861 - DNA, 201 bp, Homo sapiens
tgctttacacagtggagctctctgatcaagtaaatgcagggaattctgctttctacatcctctcataagagaaccacagcccagctcagcatatgagtgaytgaggttttctgaagtaaggcaacttgttgaatcgtatttagctatgcatcgacccaatttttacactgcatccttttcccccatataacttttggagaa

SEQ ID NO: 40862 - DNA, 201 bp, Homo sapiens
tgcagggaattctgctttctacatcctctcataagagaaccacagcccagctcagcatatgagtgactgaggttttctgaagtaaggcaacttgttgaatygtatttagctatgcatcgacccaatttttacactgcatccttttcccccatataacttttggagaaacccactttaggatacatcttccacctcatagga

SEQ ID NO: 40863 - DNA, 201 bp, Homo sapiens; identical to SEQ ID NO: 9050

SEQ ID NO: 40864 - DNA, 201 bp, Homo sapiens
tctgctttctacatcctctcataagagaaccacagcccagctcagcatatgagtgactgaggttttctgaagtaaggcaacttgttgaatcgtatttagcyatgcatcgacccaatttttacactgcatccttttcccccatataacttttggagaaacccactttaggatacatcttccacctcataggatgccaggaaa

SEQ ID NO: 40865 - DNA, 201 bp, Homo sapiens; identical to SEQ ID NO: 9051

SEQ ID NO: 40866 - DNA, 201 bp, Homo sapiens
tggatgttatccaacccatcatcttagtgtagcaatggggaggctcaggcccagagtgggcgagagagttgtctcctgcgactcagcagcattggaggcakagatggggcaagaacctagggctctgactcaccgtgcagcttctcttccaacaggagatgggttggggcagaaaaggttgaatagggtgaaggagcaaac

SEQ ID NO: 40867 - DNA, 201 bp, Homo sapiens
tgagtctattttgggttgtagaggcttgaagatttgaccctgaactagagggtggagtggaggtggtacaatgtgcttccatgccttgatgtccactctgrgccagtggacaggagaagccatgtcatgacagctgctgagaagcctcccttctgcccagcctgggggcaggccgtctcacagcagtcctgtgccctagag

SEQ ID NO: 40868 - DNA, 201 bp, Homo sapiens; identical to SEQ ID NO: 9052

SEQ ID NO: 40869 - DNA, 201 bp, Homo sapiens; identical to SEQ ID NO: 9053

SEQ ID NO: 40870 - DNA, 201 bp, Homo sapiens
cagagtgggcgagagagttgtctcctgcgactcagcagcattggaggcatagatggggcaagaacctagggctctgactcaccgtgcagcttctcttccarcaggagatgggttggggcagaaaaggttgaatagggtgaaggagcaaaccacagactccagtgggagactgtggggtcatcctccttgtagggcatgagc

SEQ ID NO: 40871 - DNA, 201 bp, Homo sapiens
acccactttccttggtctctatacactctcaggggagggggcctgaagagggcttagaatagtcatacagattagcataggcctacagagcccaggcattrgggcagcacaaaccaggctctaagcaaaggcaaataaaatactacacctctcagcaaagtgaagacacacgctctggggccacctgaagcttctgtgcag

SEQ ID NO: 40872 - DNA, 201 bp, Homo sapiens; identical to SEQ ID NO: 9054

SEQ ID NO: 40873 - DNA, 201 bp, Homo sapiens; identical to SEQ ID NO: 9055

SEQ ID NO: 40874 - DNA, 201 bp, Homo sapiens
agggtgtagaaagttgtccaaacaattccaaaggggggcttattaagacagggttcagaaaaaggcctgagacccaaggggcattaaaggagggggttgartctattttgggttgtagaggcttgaagatttgaccctgaactagagggtggagtggaggtggtacaatgtgcttccatgccttgatgtccactctgggcc

SEQ ID NO: 40875 - DNA, 201 bp, Homo sapiens; identical to SEQ ID NO: 9056

SEQ ID NO: 40876 - DNA, 201 bp, Homo sapiens; identical to SEQ ID NO: 9058

SEQ ID NO: 40877 - DNA, 201 bp, Homo sapiens
tcccccatcacagtgaatggatgtaagctcacccactctgtgcccctacctccctgctactctttggggataataataaaacaaaaaccattaccatcagycagtctgtccacccactggcatgtaccaagccagacactctgccgtgttctgggcttaacaacagaggatgagagtggtcctttctctcagtctaataaa

SEQ ID NO: 40878 - DNA, 201 bp, Homo sapiens; identical to SEQ ID NO: 9059

SEQ ID NO: 40879 - DNA, 201 bp, Homo sapiens
aggaaagagggagggaagaaaggaagggaaaagggagggagtgagtgaatgaaagatggaaagaaggaagaaagggagggaggcagggaggaaagaaagtygcgcttcccttgagctgccatgggcactgactcttagggtctgaaagcccctgagatgcaaaagcctagtgctcacaaagagctggaaagcctcaaggaa

SEQ ID NO: 40880 - DNA, 201 bp, Homo sapiens
ccatctcacaaggggtccctgatgctgagggggacaagtgaacctcccagtctagagctccagccaagtctatccaaggtgggaacgggggccaggatccytgctcagagctccgccattgtcccccatcacagtgaatggatgtaagctcacccactctgtgcccctacctccctgctactctttggggataataataaa

SEQ ID NO: 40881 - DNA, 201 bp, Homo sapiens
ctatgagcaggcctataaagagacttacgtggtaaaaaatgaagtctcctgcccacagccacattagtgaacctagaagcagagactctgtgagataatcratgtttgttgttttaagttgctcagttttggtctaacttgttatgcagcaatagataaataatatgcagagaaagagaaacaaatgcatttgttttatta

SEQ ID NO: 40882 - DNA, 201 bp, Homo sapiens; identical to SEQ ID NO: 9093

SEQ ID NO: 40883 - DNA, 201 bp, Homo sapiens
tctctcatggccagaccatggtattccctgctgaccctaaacacttccacagaataccggtgtacaacaatattactctgttgtgagatcccaaatcattscaaaatcatgtcttcatatagacagaaaaggttgctctgtgaaccacaaaaacgaaaaacatgcccctctcctgcttaatataaacatctgccactcttt

SEQ ID NO: 40884 - DNA, 201 bp, Homo sapiens; identical to SEQ ID NO: 9095

SEQ ID NO: 40885 - DNA, 201 bp, Homo sapiens; identical to SEQ ID NO: 9094

SEQ ID NO: 40886 - DNA, 201 bp, Homo sapiens; identical to SEQ ID NO: 9096

SEQ ID NO: 40887 - DNA, 201 bp, Homo sapiens; identical to SEQ ID NO: 9097

SEQ ID NO: 40888 - DNA, 201 bp, Homo sapiens
atgggcaactcacaaaaatcttggtttcctgactaacagaacaaacctggaaaaaacaaaaacaaaacaaaagacatcaaaagcaaaacctctccaaagayaaaaactctgcaatctttttcgtcactcttcaccaggtcataatagagtaacgcctcaagagatttctttttagttttgatagaacaatttatttgaaaa

SEQ ID NO: 40889 - DNA, 201 bp, Homo sapiens
atgaacccctccttaggatccccactgctcatcatagtgcctacctttgttaaagtactagtcacgcagtgtcacaaggaatgtttacttttccaaatccycagctagaggccagggatgggtcatctatttctatatagcctgcacccagattgtaggacagagggcatgctcggtaaatatgtgttcattaactgagat

SEQ ID NO: 40890 - DNA, 201 bp, Homo sapiens; identical to SEQ ID NO: 9099

SEQ ID NO: 40891 - DNA, 201 bp, Homo sapiens; identical to SEQ ID NO: 9101

SEQ ID NO: 40892 - DNA, 201 bp, Homo sapiens; identical to SEQ ID NO: 9100

SEQ ID NO: 40893 - DNA, 201 bp, Homo sapiens
ttactcagaaactgtgacctgtgaggatgcccaaaagacctgccctgcagtgattgcctgtagctctccaggcatcaacggcttcccaggcaaagatgggygtgatggcaccaagggagaaaagggggaaccaggtacgtgttgggctgttctgtctctgcaattctttaccttccagaggaaactgcctggggatatgag

SEQ ID NO: 40894 - DNA, 201 bp, Homo sapiens; identical to SEQ ID NO: 9102

SEQ ID NO: 40895 - DNA, 201 bp, Homo sapiens; identical to SEQ ID NO: 9104

SEQ ID NO: 40896 - DNA, 201 bp, Homo sapiens
ataagtgtgtctgaaaaattatatgggagatatactaaaatattcattgtttgtctgaaattcaaatttaactggacatactatattttatccggcaactstactctagaagactttttcttgagaaataccttgagttgggcttaaggatgagtgagtttcacccactttttcacattttagggctgaccttctctctgg

SEQ ID NO: 40897 - DNA, 201 bp, Homo sapiens
ttatccggcaactctactctagaagactttttcttgagaaataccttgagttgggcttaaggatgagtgagtttcacccactttttcacattttagggctsaccttctctctgggcaaacaagttgggaacaagttcttcctgaccaatggtgaaataatgacctttgaaaaagtgaaggccttgtgtgtcaagttccagg

SEQ ID NO: 40898 - DNA, 201 bp, Homo sapiens
actactggtaaaaacaaatgcagttaattttcactttgcaccctccctgcagcaacctccacgtggcaactttatttcttaagttattgctctcaggtgcmcaccatacagttattgagagcagtgctcagaaaggtcagtcctgggtcaaggtctcctttctcctgagaagggattgggcatcaaactcttgaagagaga

SEQ ID NO: 40899 - DNA, 201 bp, Homo sapiens
ccacgtggcaactttatttcttaagttattgctctcaggtgcacaccatacagttattgagagcagtgctcagaaaggtcagtcctgggtcaaggtctccyttctcctgagaagggattgggcatcaaactcttgaagagagagagcaagaacatagatattaagtcacatttcctttgtcttccaacaggccaagggctc

SEQ ID NO: 40900 - DNA, 201 bp, Homo sapiens
acctgtgaggatgcccaaaagacctgccctgcagtgattgcctgtagctctccaggcatcaacggcttcccaggcaaagatgggcgtgatggcaccaaggragaaaagggggaaccaggtacgtgttgggctgttctgtctctgcaattctttaccttccagaggaaactgcctggggatatgaggagactgatgtcctat

SEQ ID NO: 40901 - DNA, 201 bp, Homo sapiens
gaaactgtgacctgtgaggatgcccaaaagacctgccctgcagtgattgcctgtagctctccaggcatcaacggcttcccaggcaaagatgggcgtgatgrcaccaagggagaaaagggggaaccaggtacgtgttgggctgttctgtctctgcaattctttaccttccagaggaaactgcctggggatatgaggagactg

SEQ ID NO: 40902 - DNA, 201 bp, Homo sapiens
aacagtctaatgtgaggccctggtcctagagggagaaaacaggccatctaagtgtgggcttattatacctatttttacaaaagcatgtaaccatggtatgycatattttacttcataagaaaccaagccaaagcttaatagcttaaaaacatagccgtcaatttaaatcacaagtctgtgggtcggccatgtgatttctct

SEQ ID NO: 40903 - DNA, 201 bp, Homo sapiens
tgaaattcaaatttaactggacatactatattttatccggcaactctactctagaagactttttcttgagaaataccttgagttgggcttaaggatgagtsagtttcacccactttttcacattttagggctgaccttctctctgggcaaacaagttgggaacaagttcttcctgaccaatggtgaaataatgacctttga

SEQ ID NO: 40904 - DNA, 201 bp, Homo sapiens
tcatgtcagacccctattcacttcagtagggatggcaccaggttcaagaggccaaagaagagatggagtcagcaaacaaacataggttttactgggggaayctgtttacagggagatccagcagcagtgggctggacaggagaacaacaactactggtaaaaacaaatgcagttaattttcactttgcaccctccctgcag

SEQ ID NO: 40905 - DNA, 201 bp, Homo sapiens
tcagctctcattctctggcatctcagaattccacacagcagtttgtgactaatagttgtcttgccagcccaggaaagtggcccacaggtcaggccatcccrtgggacacaggatgaatttttcttctctgggtcattgtcatgtcagacccctattcacttcagtagggatggcaccaggttcaagaggccaaagaagaga

SEQ ID NO: 40906 - DNA, 201 bp, Homo sapiens
ctccagttaattctgggctgggttggtgactaaggttgaggttgatctgaggttgagaccttcctctttggatcaccagctttcagctcagggcctgccamtgagtaaatgatagttaacaggtcctggaggggaatcagctgcccagatacaaagatgggattcaggtggcagatggacccgaagaggacatggagagaa

SEQ ID NO: 40907 - DNA, 201 bp, Homo sapiens
agtgaaggggcagaaggaagaatggcagtaaggaatgtctgaggagagtctgaaagccacatgtgttctgatttctgtggcaaaagagcaggtctttgctrtcctaactactgagctgcctttcactgcagccaccctgtgttcaaggccatgtcacagataagcatgtctctatcacatgggcagatatgacaccctctg

SEQ ID NO: 40908 - DNA, 201 bp, Homo sapiens
gggctgttctgtctctgcaattctttaccttccagaggaaactgcctggggatatgaggagactgatgtcctatttgagtatatttttctcaactatactrtaactcaaaacagagattcagctctcattctctggcatctcagaattccacacagcagtttgtgactaatagttgtcttgccagcccaggaaagtggccc

SEQ ID NO: 40909 - DNA, 201 bp, Homo sapiens; identical to SEQ ID NO: 9098

SEQ ID NO: 40910 - DNA, 201 bp, Homo sapiens
atatggattgctaggtaatcagggagtatatgtgtgcatgtgatatgtatgcgtactttgggatacagtaaacagacaaagagggacatttggggttggayggaaatagcgatttttcattctttgggcttttcagtattttttattttccttcaaagtgtaaacatcaatgtaaaataagctttttttttcagtttgaaa

SEQ ID NO: 40911 - DNA, 201 bp, Homo sapiens
ctcaagagatttctttttagttttgatagaacaatttatttgaaaaaaaaatctgtgaagaacctggcatatggattgctaggtaatcagggagtatatgygtgcatgtgatatgtatgcgtactttgggatacagtaaacagacaaagagggacatttggggttggatggaaatagcgatttttcattctttgggctttt

SEQ ID NO: 40912 - DNA, 201 bp, Homo sapiens
tcctgagtatggtggcagcgtcttactcagaaactgtgacctgtgaggatgcccaaaagacctgccctgcagtgattgcctgtagctctccaggcatcaayggcttcccaggcaaagatgggcgtgatggcaccaagggagaaaagggggaaccaggtacgtgttgggctgttctgtctctgcaattctttaccttccaga

SEQ ID NO: 40913 - DNA, 201 bp, Homo sapiens; identical to SEQ ID NO: 9106

SEQ ID NO: 40914 - DNA, 201 bp, Homo sapiens
cctctgccggactctgttctgcaggactctgttctgcaaactccagccactgcggcctccctgggctctcagctttctctcttcaatttagggagtcagcrgggctccaactgagatgccccgtcctgctctgcaccatggaaattctggacagtagctgagaccgttgtttcttggggattacgattcctgaaaaccatc

SEQ ID NO: 40915 - DNA, 201 bp, Homo sapiens
tggctaaaaatcggaagaatggggctcgaatcccccagcagttgagacctcaggctgaggcagtggccttctcatcggcttatctgtgcctatttctttcttttttttttttgagacagagtctcactcaatccctcaggctggagtgcagtggcatgatccaggctcactgcaacctctgcctcctgggttcaagcgatt

SEQ ID NO: 40916 - DNA, 201 bp, Homo sapiens
cactccgggtgggaatggcaggctgcgtcccactgctccagggcctggtcctggtcctcgccctccatcgtgtggagccctcaggtaggcatctggcttayctgtctgttgtgcctgtgctgtgtctttcttgactcggtccatggtggatttgtagatgaggctttttccaggagccagaggagccctgagtgcccagac

SEQ ID NO: 40917 - DNA, 201 bp, Homo sapiens
gcaaggctgtgataaaatgaacatggaccaacacacagaactgtgtgcaaggctgtgataaaatgactatttccaagctagcatttccttttttttttttyccttttcagctaaaaatgaatgtcacccagagcggactgatgggtgtcaacacttctgcctcccaggacaggaatcctacacgtgcagctgtgctcaggg

SEQ ID NO: 40918 - DNA, 201 bp, Homo sapiens
taattcccctgaaaaagctgtttggatctttatcatttggtgacaagtatttgggacatgatagtgtcacttggggtcctcccaagagatgcccaaatggraagaagcctgtgtgcaggggattcagccgggaaaggccggggagaggggagggggaaagggggaggagtggggggaggcctgggttgggcattggacgag

SEQ ID NO: 40919 - DNA, 201 bp, Homo sapiens
tcatttggtgacaagtatttgggacatgatagtgtcacttggggtcctcccaagagatgcccaaatggaaagaagcctgtgtgcaggggattcagccgggwaaggccggggagaggggagggggaaagggggaggagtggggggaggcctgggttgggcattggacgaggggagggggtggggcaggctgagcccagactg

SEQ ID NO: 40920 - DNA, 201 bp, Homo sapiens
gataagcagttgccacgactcagaaggtggtccgcgtctccacgctggagcaatggccatgctagaaagtgcagtttctgtcactagtgcttgctcggacyactctgagctaaaccatgagtgctgtgaggggtggtttaactccagtctgtgtgtctgtgaattactgcacattcatcagcattaaggataagattataa

SEQ ID NO: 40921 - DNA, 201 bp, Homo sapiens
tgtgaaaaacctctgccttttaattggggtatttaggccattttacatttattgtaattgtcgatatgtttacggttaaagctatcatcttgctatctttyatttttcttatctgttcttttcccctttttctgccttctgttagattaactatatattgttatgattctgttttctctcctttgttggtttatcatctct

SEQ ID NO: 40922 - DNA, 201 bp, Homo sapiens
caggcatcctgactttgatgggctactgactgcactgaccaacctctattcacacttccaaccatgttctaatgccgagttcataactaatacaaaaggasagcattatttacagcccccaagacctttcctctgcagttccaaactgttaccaatgtcattttctcagaacataagcatctcaaaatctctgctctcggc

SEQ ID NO: 40923 - DNA, 201 bp, Homo sapiens
tcccctcctgacctgggtgctggttttggcataggtcttacatctacagatgttataaatgccactctatacttccattatttttgtttaaacagtatcckgtaaagaagtttaaagaataaggaaaaaaaccttacatatatagtggaatgtggataaatatttaatgggatgtcataaccttttccagtgttccttgct

SEQ ID NO: 40924 - DNA, 201 bp, Homo sapiens
gtaatgaatataaacattattgaggttatttgcctttttcctttacactgaatctttggaatctggtgtgaatttacactgaggtgcagccctcgtgtccmcaatgctccgtacccgagtgtggctgccgtgtggatggcacagcctcaggggccccccttgtgagtaataagcccctgaggtttctgtgtgtgacacccg

SEQ ID NO: 40925 - DNA, 201 bp, Homo sapiens
ttaaagaataaggaaaaaaaccttacatatatagtggaatgtggataaatatttaatgggatgtcataaccttttccagtgttccttgctgctttgtgtaratccaggcctccctctggtatcgttttcctcctgcctaaagggcccctttgatatctgctgtgctgtgaggcgtctggggaagaagccttcttgcgtttg

SEQ ID NO: 40926 - DNA, 201 bp, Homo sapiens
cctcctgacctgggtgctggttttggcataggtcttacatctacagatgttataaatgccactctatacttccattatttttgtttaaacagtatcctgtraagaagtttaaagaataaggaaaaaaaccttacatatatagtggaatgtggataaatatttaatgggatgtcataaccttttccagtgttccttgctgct

SEQ ID NO: 40927 - DNA, 201 bp, Homo sapiens
gggctggagtgtagtggtgtgatcatggctcactgcagcctcaacctcctgggttcaggtgatcctcccacctcagcgtcttgagtagctgggaccatagktgtgcacgaccacacacagctaatttttaaatttcatgtagagatggggtcttgctatgttgctcaggctggtctcaaactcctgggctcaagcaatcct

SEQ ID NO: 40928 - DNA, 201 bp, Homo sapiens
tgtgatcatggctcactgcagcctcaacctcctgggttcaggtgatcctcccacctcagcgtcttgagtagctgggaccataggtgtgcacgaccacacasagctaatttttaaatttcatgtagagatggggtcttgctatgttgctcaggctggtctcaaactcctgggctcaagcaatccttccacctcagcctccca

SEQ ID NO: 40929 - DNA, 201 bp, Homo sapiens
aggcccagagtgcagtggtcctccataggtagtgacagggtctggctctaccacctgcaggctgtctccagcttcccagcttacccaagggaagagagggygcggttctagtctgcaaccgtagcactcataccagcaaggctaagagccatataaccagggaggaggcattctctaaacacagctggtgtgtttaagaca

SEQ ID NO: 40930 - DNA, 201 bp, Homo sapiens
cacacacagctaatttttaaatttcatgtagagatggggtcttgctatgttgctcaggctggtctcaaactcctgggctcaagcaatccttccacctcagmctcccaaagtgctgggattataggcgtgagccaccatgcctggcccattattttcagattttttttctctcctccttctccctgctctgttttgggactc

SEQ ID NO: 40931 - DNA, 201 bp, Homo sapiens
tgctcagggctacaggcttggtgaggaccacaaacagtgtgtgccccacggtgagtgctcagaccacagcggcctccagcttccaatgccagcgaccccgwccacatcctccttccttctgtagtactgggtgaagcccgcggatttgtgataagcagttgccacgactcagaaggtggtccgcgtctccacgctggagca

SEQ ID NO: 40932 - DNA, 201 bp, Homo sapiens
tttgtatttttagtagaaatggggttttgctatgttggaaaagctggtctttactcctggccttaagtgatcgacctgcctcggcctcccgaagcgctggkattacagatgtgagccactgtgcctggcccttaaatatttttcaatcaacaaaataacgtgaaaaccacttctcaacagccaatgtttgactggcctgga

SEQ ID NO: 40933 - DNA, 201 bp, Homo sapiens
ggctgatccattcgcccagaggatgaagtgcttgcctacctcgggggagggagtagcggggtggccctgaggccctcgcaggctgagagcctgtggagacrgacggggctggggctggcggccggccggggaggaagccaggcagctctggaaagcagggccctcggtgctcccagtcacctgccttcttgtctcgtctgt

SEQ ID NO: 40934 - DNA, 201 bp, Homo sapiens
ctcttcgagggaaacttggaaaaagaatgttatgaagaaatctgtgtctatgaagaagcaagagaagtgtttgaaaatgaagtagtcactgtatgtacccscaccacaaaccacaggcctcctcattatttagacttctgctggcccagggagcatcatttctcagagattaagcttaattaattagcctatttacttacc

SEQ ID NO: 40935 - DNA, 201 bp, Homo sapiens
tgaataattctcctaattttagatactcctaccccaaactaagcgtccccactccctacagaggtatatatctttaaaattcaactcggtttataaaaagygaaaaggtgatgtgacttctatatcatgtgcttttgtggagggtggcgtggagattggccctagaagggaagggccacgttaggggctgtgggtggtggg

SEQ ID NO: 40936 - DNA, 201 bp, Homo sapiens
cactccaaaacagaagaactaaccttgactgtttttaaaggctgtggcacttggttgcaatcgtgcaatctgtgagtggcctttctgtccgcagaaaggcmcagtgtccacaccacggggcggtgagcctgcgggtcctccagggccggtctctccctcctcacgtggctccctgagaagctcgtttgagcattatgtccc

SEQ ID NO: 40937 - DNA, 201 bp, Homo sapiens
ttgacaaacctgagctttccaccgctattacatccagaatgaaattcaggtatgctggcagaaattccaatattcaaattactgcaagaaaatcatttaartcaaaagttgaaggatgttcaaggcccatgcagagcagcagggaagatcagatttccgtacccaacactgcaagagaacggggccccactggacacatgg

SEQ ID NO: 40938 - DNA, 201 bp, Homo sapiens
gcagctgtgctcagggctacaggcttggtgaggaccacaaacagtgtgtgccccacggtgagtgctcagaccacagcggcctccagcttccaatgccagcraccccgtccacatcctccttccttctgtagtactgggtgaagcccgcggatttgtgataagcagttgccacgactcagaaggtggtccgcgtctccacgc

SEQ ID NO: 40939 - DNA, 201 bp, Homo sapiens
ttcatcagcattaaggataagattataatggttagtaccatagacggaattatgcaacggttaacaccatagacagagtccgatattcgctgagaaggcgytgatttttattctcatgttgctgccgcaaatgcagaccagtgtgcctgcggggtgctgacctctgagaagcgtgcaccggatctacaggacctcccgtgg

SEQ ID NO: 40940 - DNA, 201 bp, Homo sapiens
gtgaggccccggccgtccccttcccccaagggcctccctgggcaggtgggcctcacatcctcggccagagtcccaatgggcccctcctgaggtgtagccaygaaggtgcctgtgtgaaccgcgatttggctcaccccaggggattcctctcatcccaaccagattctcctccagaaaccacgccgggggctggctgcattc

SEQ ID NO: 40941 - DNA, 201 bp, Homo sapiens
ttctgtccgcagaaaggcacagtgtccacaccacggggcggtgagcctgcgggtcctccagggccggtctctccctcctcacgtggctccctgagaagctygtttgagcattatgtccccttgaaaatcagactgtaaagaactgacgattgttcatgatttcagattttaacagaacgagccaagacccgctgatgatca

SEQ ID NO: 40942 - DNA, 201 bp, Homo sapiens; identical to SEQ ID NO: 9109

SEQ ID NO: 40943 - DNA, 201 bp, Homo sapiens; identical to SEQ ID NO: 9111

SEQ ID NO: 40944 - DNA, 201 bp, Homo sapiens
gacagcattatttacagcccccaagacctttcctctgcagttccaaactgttaccaatgtcattttctcagaacataagcatctcaaaatctctgctctcrgctgctggcctggcattctagctttgttactttgttcactaaatttctctagtttggcattcatttttgttctccttttcccctccttggctggtttaga

SEQ ID NO: 40945 - DNA, 201 bp, Homo sapiens
cctgacctgggtgctggttttggcataggtcttacatctacagatgttataaatgccactctatacttccattatttttgtttaaacagtatcctgtaaaraagtttaaagaataaggaaaaaaaccttacatatatagtggaatgtggataaatatttaatgggatgtcataaccttttccagtgttccttgctgctttg

SEQ ID NO: 40946 - DNA, 201 bp, Homo sapiens
tcattttctcagaacataagcatctcaaaatctctgctctcggctgctggcctggcattctagctttgttactttgttcactaaatttctctagtttggcrttcatttttgttctccttttcccctccttggctggtttagaagttaaccattcatttgtttttggtttgttttttttgagatggagtctcaatctgtcac

SEQ ID NO: 40947 - DNA, 201 bp, Homo sapiens
ttataaatgccactctatacttccattatttttgtttaaacagtatcctgtaaagaagtttaaagaataaggaaaaaaaccttacatatatagtggaatgyggataaatatttaatgggatgtcataaccttttccagtgttccttgctgctttgtgtagatccaggcctccctctggtatcgttttcctcctgcctaaag

SEQ ID NO: 40948 - DNA, 201 bp, Homo sapiens
ggacatgatagtgtcacttggggtcctcccaagagatgcccaaatggaaagaagcctgtgtgcaggggattcagccgggaaaggccggggagaggggaggrggaaagggggaggagtggggggaggcctgggttgggcattggacgaggggagggggtggggcaggctgagcccagactgcaatgtgggcagagagagcct

SEQ ID NO: 40949 - DNA, 201 bp, Homo sapiens
tgaagtgcttgcctacctcgggggagggagtagcggggtggccctgaggccctcgcaggctgagagcctgtggagacggacggggctggggctggcggccrgccggggaggaagccaggcagctctggaaagcagggccctcggtgctcccagtcacctgccttcttgtctcgtctgtagtatttctcccggcctccaaag

SEQ ID NO: 40950 - DNA, 201 bp, Homo sapiens
gtcctcccaagagatgcccaaatggaaagaagcctgtgtgcaggggattcagccgggaaaggccggggagaggggagggggaaagggggaggagtgggggkaggcctgggttgggcattggacgaggggagggggtggggcaggctgagcccagactgcaatgtgggcagagagagccttggccaggccagccaggaatgc

SEQ ID NO: 40951 - DNA, 201 bp, Homo sapiens
gctgactcagttttgggatatttttcttctcattatgggtcacattttcctgtttgtatgccgtaatggatttccagacatgtgaattttatcctgttagrtgctgaatattttgtgctctatacatacacttggatattgtcctaggacacagttaggttggaaatactttcatcctttggcacattgctcttaagattt

SEQ ID NO: 40952 - DNA, 201 bp, Homo sapiens
cctttggcacattgctcttaagatttgtcagtaggaccagggcagcgctcaagtctagagctagttattctgactactgaagtgaaacccttctatgcatyctgccccgtgccccactgagtcagggatgttttaactcagctggtggaagcaattgctattcccagcttgtgtgagtgtctagcacaggtccctctcaca

SEQ ID NO: 40953 - DNA, 201 bp, Homo sapiens
tttccttttttttttttcccttttcagctaaaaatgaatgtcacccagagcggactgatgggtgtcaacacttctgcctcccaggacaggaatcctacacrtgcagctgtgctcagggctacaggcttggtgaggaccacaaacagtgtgtgccccacggtgagtgctcagaccacagcggcctccagcttccaatgccag

SEQ ID NO: 40954 - DNA, 201 bp, Homo sapiens
agctggtggaagcaattgctattcccagcttgtgtgagtgtctagcacaggtccctctcacactcttgggtggttcttacccggccataattagtctccaygtacacgtgatcaccactgctctgctgaaaactgctaggcatgtggccatcctccagcattctctaccaagctctctcctctgccggactctgttctgca

SEQ ID NO: 40955 - DNA, 201 bp, Homo sapiens
acagcaaaatgttcactgttacacaggaatattactgtaaaaacatgtaagtattttatcatgagtttttataaaaccacattggaaatacactatcctaygtaagaatgaaatgacaaatttaaaactggactgtttctaatgcaacatagaactgaatttactgtcaataaaactgagatacttatcaactcaggaagc

SEQ ID NO: 40956 - DNA, 201 bp, Homo sapiens
caaggcccacacactgatcagacacccagcatacattttctttctaggcttcaagtctgaataattctcctaattttagatactcctaccccaaactaagygtccccactccctacagaggtatatatctttaaaattcaactcggtttataaaaagcgaaaaggtgatgtgacttctatatcatgtgcttttgtggaggg

SEQ ID NO: 40957 - DNA, 201 bp, Homo sapiens
aactgctaggcatgtggccatcctccagcattctctaccaagctctctcctctgccggactctgttctgcaggactctgttctgcaaactccagccactgyggcctccctgggctctcagctttctctcttcaatttagggagtcagcagggctccaactgagatgccccgtcctgctctgcaccatggaaattctggaca

SEQ ID NO: 40958 - DNA, 201 bp, Homo sapiens
tctacaggacctcccgtggcaggtaacagagcgctctccgcgtgcttcaatttattgttatgactttcacctcacttgtcatttcctaaatagaaatgttracaactaagtgaatcaggcatcctgactttgatgggctactgactgcactgaccaacctctattcacacttccaaccatgttctaatgccgagttcataa

SEQ ID NO: 40959 - DNA, 201 bp, Homo sapiens
tcaaccactattgtcctattaagtgaataaaatcaacattttcttaccttcaagttcatctacaggaaagaatatagaaaaacaaatatcccatttgtaayatttttatgttttaactctaaaggatgaattctggagacgatataagggtaagtggtttccttcgtctcctcagaagtattaattcctcgggatgaggtg

SEQ ID NO: 40960 - DNA, 201 bp, Homo sapiens
taccttcaagttcatctacaggaaagaatatagaaaaacaaatatcccatttgtaacatttttatgttttaactctaaaggatgaattctggagacgatayaagggtaagtggtttccttcgtctcctcagaagtattaattcctcgggatgaggtgcgtgggtgggcttaggacgcttcacgaccccagctcagcggatg

SEQ ID NO: 40961 - DNA, 201 bp, Homo sapiens
cccatttgtaacatttttatgttttaactctaaaggatgaattctggagacgatataagggtaagtggtttccttcgtctcctcagaagtattaattcctygggatgaggtgcgtgggtgggcttaggacgcttcacgaccccagctcagcggatgccaagcctctggctccaggacccacggtgtctctccagggaaggg

SEQ ID NO: 40962 - DNA, 201 bp, Homo sapiens
caagacagctgtgcccagcccactcattctggcagttgtgtggactggcagagaacaggatggagctcaaggacttgaagccacccagctccaaggtggaraggaagaaaccgaagggaggcaaagcagacggagtgatggaaggcggggatggaagcgggaatggtctatcaccagctttgcaaacttcctctcaatctt

SEQ ID NO: 40963 - DNA, 201 bp, Homo sapiens
agagagcacaagagaggctgaggaggcacgccggcgtctcacggggttgtgcacccgcccttctctgggagggttcccacggaaggttccggggcccgaartcagggctgagcactgagacccagctctctgctcgtcccaccaggtggctcttggacaactgttccacctcttcatgcctcagggtcgcccagggtagaa

SEQ ID NO: 40964 - DNA, 201 bp, Homo sapiens; identical to SEQ ID NO: 9117

SEQ ID NO: 40965 - DNA, 201 bp, Homo sapiens
cgctgggattacagatgtgagccactgtgcctggcccttaaatatttttcaatcaacaaaataacgtgaaaaccacttctcaacagccaatgtttgactgkcctggagacgttccacatcactgcttcctgctttttaatcatttcaccacaccccactgcactccaaaacagaagaactaaccttgactgtttttaaagg

SEQ ID NO: 40966 - DNA, 201 bp, Homo sapiens; identical to SEQ ID NO: 9110

SEQ ID NO: 40967 - DNA, 201 bp, Homo sapiens
aggaaagctgcaagtcaaaacacccagcatccccgctggccccatggtctcccgctggccccatggtctcccaccctgagagggtgatccccccgccctgycctgcccagcacttaccgtagccggacttagctgagccccccctgctgtaaccctcagcaccgagagaaaaggagggaggatgggaagggcctgggcttt

SEQ ID NO: 40968 - DNA, 201 bp, Homo sapiens
cacagcctacataaggatgacttcatttcccactgaaattgagcagttgtggcataagagatggataattggctaaaaatcggaagaatggggctcgaatsccccagcagttgagacctcaggctgaggcagtggccttctcatcggcttatctgtgcctatttctttcttttttttttttgagacagagtctcactcaat

SEQ ID NO: 40969 - DNA, 201 bp, Homo sapiens
gaggtggaagcgtgcgggctcctatcttctggaagaactcttcgagggaaacttggaaaaagaatgttatgaagaaatctgtgtctatgaagaagcaagaraagtgtttgaaaatgaagtagtcactgtatgtacccccaccacaaaccacaggcctcctcattatttagacttctgctggcccagggagcatcatttctc

SEQ ID NO: 40970 - DNA, 201 bp, Homo sapiens
taacatttttatgttttaactctaaaggatgaattctggagacgatataagggtaagtggtttccttcgtctcctcagaagtattaattcctcgggatgargtgcgtgggtgggcttaggacgcttcacgaccccagctcagcggatgccaagcctctggctccaggacccacggtgtctctccagggaagggcagctccg

SEQ ID NO: 40971 - DNA, 201 bp, Homo sapiens
ccagggcagcgctcaagtctagagctagttattctgactactgaagtgaaacccttctatgcatcctgccccgtgccccactgagtcagggatgttttaaytcagctggtggaagcaattgctattcccagcttgtgtgagtgtctagcacaggtccctctcacactcttgggtggttcttacccggccataattagtctc

SEQ ID NO: 40972 - DNA, 201 bp, Homo sapiens
acggggtttctccatgttggtcaggctggtctccaactctcaatctcaggtgatctgcctgccttggcctctgaaagtgctgggattacaggcgtgagccwccacgcccggcatctacactttattataaaataaaatcggctttgtgtttgattttgcctaagagtggaggcttctgagtatgttaaggaaggctagagt

SEQ ID NO: 40973 - DNA, 201 bp, Homo sapiens
cctgcagatgtaggagcgagctaaggagtgctgctgaagccctggggcagctcctgcatccaggggaacctgaggaaggagccacacaaagtgagtcctgygccgcgcggcccggagagagagaaagagggattcacactttgtagaatagcctctccttgaacaagcagctttcaaatgcagtaactttgcaaagatgag

SEQ ID NO: 40974 - DNA, 201 bp, Homo sapiens
gcacttggttgcaatcgtgcaatctgtgagtggcctttctgtccgcagaaaggcacagtgtccacaccacggggcggtgagcctgcgggtcctccagggcyggtctctccctcctcacgtggctccctgagaagctcgtttgagcattatgtccccttgaaaatcagactgtaaagaactgacgattgttcatgatttcag

SEQ ID NO: 40975 - DNA, 201 bp, Homo sapiens
cacatggctggggaggcctcaggaaacataatcatggcaagcaggcacctcttcacagggtggcaggagagagaaaatgtgtgtcaatcacagggggaagycccttataaaatcattagctcttgtgagaatgcactcactatcacaagaaccacctccatgattcaatcacctccacctggtcctgcccttgacctgtgg

SEQ ID NO: 40976 - DNA, 201 bp, Homo sapiens
gtcagggatgttttaactcagctggtggaagcaattgctattcccagcttgtgtgagtgtctagcacaggtccctctcacactcttgggtggttcttaccyggccataattagtctccacgtacacgtgatcaccactgctctgctgaaaactgctaggcatgtggccatcctccagcattctctaccaagctctctcctc

SEQ ID NO: 40977 - DNA, 201 bp, Homo sapiens
ggtttcaccatgttggacaggatggtctcgaatgcctgacctcaagtgacccacctgccttggcctcccaaagtgctgggattacaggcgtgagccaccaygcctggcctcatcattcactttctgtttacttaatggtcactcttgacacataaacatccatatttagcacaagtagtcagctatttctccctcctcagg

SEQ ID NO: 40978 - DNA, 201 bp, Homo sapiens
ctcatttgccttctcctcctggaaatcgcagagcctgctgcaatgtataagtttcttctttatgtgttttatcaagatgttaaatgctgcgcacagaggcrgcacaggagctgatggctcttggtccccagttctcagtacggggacctttgaccccagctcagccttccttcgcactcagacccaaaacccagttggagc

SEQ ID NO: 40979 - DNA, 201 bp, Homo sapiens
tcaaattttggaaagtcatggccccgatggagactttggttaggagactcctcccaagggaggagctctaggtgggcaactgcagaagagcatgggacagragtaacacagatggagacccacggggctgggggaggccagggtaaggacccacctgggaatgagtaagcaaagagctgcagccaccaccagacaagcacg

SEQ ID NO: 40980 - DNA, 201 bp, Homo sapiens
ttctcctccagaaaccacgccgggggctggctgcattctgagctgccccttccagacaggcccccatacttttcatagcaggggcccctctcctccccccmccacctcaaccattcacaatctgctcacaggctgggggggtcacacacaggcgtcctcagtgccagactcccagtgggagactgcagacagggaagacgc

SEQ ID NO: 40981 - DNA, 201 bp, Homo sapiens
ccagacaggcccccatacttttcatagcaggggcccctctcctcccccccccacctcaaccattcacaatctgctcacaggctgggggggtcacacacagkcgtcctcagtgccagactcccagtgggagactgcagacagggaagacgcaaagcacgtaaacaaatatccttaaatacccgccaaatgtcagtgtccatc

SEQ ID NO: 40982 - DNA, 201 bp, Homo sapiens
ctcacatgtccttacctgtggcacttttaagattttaaatgctttttaattttaactttctaagatttcctctatcatggattttgaatttaattatactstgtattgttttcatgtttcttgcacatagggtttgttgagattcttgtatttgtgggctaatatcgcttgtcaaatttgaaaaatatttggtcataattt

SEQ ID NO: 40983 - DNA, 201 bp, Homo sapiens
agttggaaaaacactttctcacttggctcagcattttgcattagacggttgaaaactgcaacacttaacacttccagagccagtacccgtgctatgtgggsacatgctttatttcatttaatctttcaaacaacttctcgttttctccttttgtatccctggtaatattatttgctctaaaatcccctttgtctgatattg

SEQ ID NO: 40984 - DNA, 201 bp, Homo sapiens
gccacggtaaagttggaaaaacactttctcacttggctcagcattttgcattagacggttgaaaactgcaacacttaacacttccagagccagtacccgtrctatgtgggcacatgctttatttcatttaatctttcaaacaacttctcgttttctccttttgtatccctggtaatattatttgctctaaaatcccctttg

SEQ ID NO: 40985 - DNA, 201 bp, Homo sapiens
gtctggcagactgatggcgcaagtgccgtcttctctcgaacttggttttatcccctttaaagtgaggatctcacccctagaggtgcagtgaggattacagrtaacgttcttgacttatggtaggtattcaacaagtggcagctattattcataaacacatgaagagttccaggaacgacgccacggtaaagttggaaaaac

SEQ ID NO: 40986 - DNA, 201 bp, Homo sapiens
aattttcctaaaacaaactttgaaaaggagaataattaagtgacctagcaggacatagggttgaagattatctttagaacttccttgtttcttacatcctmgggaagaagtatcactaaaagtctggcagactgatggcgcaagtgccgtcttctctcgaacttggttttatcccctttaaagtgaggatctcacccctag

SEQ ID NO: 40987 - DNA, 201 bp, Homo sapiens
acttcagtattataaattgttctgaagttatttaactgaatatatggaattttcctaaaacaaactttgaaaaggagaataattaagtgacctagcaggayatagggttgaagattatctttagaacttccttgtttcttacatcctagggaagaagtatcactaaaagtctggcagactgatggcgcaagtgccgtcttc

SEQ ID NO: 40988 - DNA, 201 bp, Homo sapiens
cccccatacttttcatagcaggggcccctctcctcccccccccacctcaaccattcacaatctgctcacaggctgggggggtcacacacaggcgtcctcastgccagactcccagtgggagactgcagacagggaagacgcaaagcacgtaaacaaatatccttaaatacccgccaaatgtcagtgtccatcatcgccaac

SEQ ID NO: 40989 - DNA, 201 bp, Homo sapiens
tgttctacatgcacattcctgaaatacggacatgtgggaaacactgacacagaggacaacgatctgaagagaatgagaacacatggaccaacacaccagawctcttgtgtgcaaggctgtgataaaatgaacatggaccaacacacagaactgtgtgcaaggctgtgataaaatgactatttccaagctagcatttccttt

SEQ ID NO: 40990 - DNA, 201 bp, Homo sapiens
aagcgggaatggtctatcaccagctttgcaaacttcctctcaatcttttatcacttttcctgcccaagctttctaagacagttcttcctatcgctgtctgmcccatgagtgcgctgagggtcggtacttgggaggcccagagtgcagtggtcctccataggtagtgacagggtctggctctaccacctgcaggctgtctcc

SEQ ID NO: 40991 - DNA, 201 bp, Homo sapiens
catggtctcccgctggccccatggtctcccaccctgagagggtgatccccccgccctgccctgcccagcacttaccgtagccggacttagctgagcccccyctgctgtaaccctcagcaccgagagaaaaggagggaggatgggaagggcctgggctttgaccctcccggagagggagagaacatgctttgggaccctcag

SEQ ID NO: 40992 - DNA, 201 bp, Homo sapiens
gcctggctaatttttgtatttttagtagagatggggtttcaccatgttggccaggctggtcttgatctcctgacctcgtgatccgcccacctcggcctccyaaagtgctgggattacaggcatgagccaccgcgcccggcctcactcacggagtctttgttctacatgcacattcctgaaatacggacatgtgggaaacac

SEQ ID NO: 40993 - DNA, 201 bp, Homo sapiens
ctttatttcatttaatctttcaaacaacttctcgttttctccttttgtatccctggtaatattatttgctctaaaatcccctttgtctgatattgatatasacactttactttctaattattagtgttagcatgacttatctttttccaatcttctacttttagcctatttgtatttttataaagtgcatgtttaaaaaat

SEQ ID NO: 40994 - DNA, 201 bp, Homo sapiens
caccctgagagggtgatccccccgccctgccctgcccagcacttaccgtagccggacttagctgagccccccctgctgtaaccctcagcaccgagagaaarggagggaggatgggaagggcctgggctttgaccctcccggagagggagagaacatgctttgggaccctcaggtgggaagaggctccagagaccactgccg

SEQ ID NO: 40995 - DNA, 201 bp, Homo sapiens
aacaaataggctgtaaaacaggaaaattgtgcattgtttcaaccactattgtcctattaagtgaataaaatcaacattttcttaccttcaagttcatctayaggaaagaatatagaaaaacaaatatcccatttgtaacatttttatgttttaactctaaaggatgaattctggagacgatataagggtaagtggtttcct

SEQ ID NO: 40996 - DNA, 201 bp, Homo sapiens
tatttcatttaatctttcaaacaacttctcgttttctccttttgtatccctggtaatattatttgctctaaaatcccctttgtctgatattgatatagacwctttactttctaattattagtgttagcatgacttatctttttccaatcttctacttttagcctatttgtatttttataaagtgcatgtttaaaaaataaa

SEQ ID NO: 40997 - DNA, 201 bp, Homo sapiens
gggaagggcctgggctttgaccctcccggagagggagagaacatgctttgggaccctcaggtgggaagaggctccagagaccactgccgcgggtcaactcrtttgccttctcctcctggaaatcgcagagcctgctgcaatgtataagtttcttctttatgtgttttatcaagatgttaaatgctgcgcacagaggcagca

SEQ ID NO: 40998 - DNA, 201 bp, Homo sapiens
ggcctttctgtccgcagaaaggcacagtgtccacaccacggggcggtgagcctgcgggtcctccagggccggtctctccctcctcacgtggctccctgagmagctcgtttgagcattatgtccccttgaaaatcagactgtaaagaactgacgattgttcatgatttcagattttaacagaacgagccaagacccgctgat

SEQ ID NO: 40999 - DNA, 201 bp, Homo sapiens
tggtttgttttttttgagatggagtctcaatctgtcacccagcctggagtgcagtggtccagtcccggctcacagcaacctctgcctcctgggcacaagcrctttccctgcctccacctcctgagtagctgggattacaggaatgtgccaccacgcccggctgatttttatatttttagtagagacggggtttcaccatgt

SEQ ID NO: 41000 - DNA, 201 bp, Homo sapiens
tttagaagttaaccattcatttgtttttggtttgttttttttgagatggagtctcaatctgtcacccagcctggagtgcagtggtccagtcccggctcacwgcaacctctgcctcctgggcacaagcgctttccctgcctccacctcctgagtagctgggattacaggaatgtgccaccacgcccggctgatttttatatt

SEQ ID NO: 41001 - DNA, 201 bp, Homo sapiens
tggctggtttagaagttaaccattcatttgtttttggtttgttttttttgagatggagtctcaatctgtcacccagcctggagtgcagtggtccagtcccrgctcacagcaacctctgcctcctgggcacaagcgctttccctgcctccacctcctgagtagctgggattacaggaatgtgccaccacgcccggctgattt

SEQ ID NO: 41002 - DNA, 201 bp, Homo sapiens
tccgggtgggaatggcaggctgcgtcccactgctccagggcctggtcctggtcctcgccctccatcgtgtggagccctcaggtaggcatctggcttacctrtctgttgtgcctgtgctgtgtctttcttgactcggtccatggtggatttgtagatgaggctttttccaggagccagaggagccctgagtgcccagactag

SEQ ID NO: 41003 - DNA, 201 bp, Homo sapiens
aggagggaagcacacagctgcacaggtcgtgccccgaggctcctgctgccggcacctcccccagcctggactttggctgtgtttgtagccctgtcccagcrctccgggtgggaatggcaggctgcgtcccactgctccagggcctggtcctggtcctcgccctccatcgtgtggagccctcaggtaggcatctggcttacc

SEQ ID NO: 41004 - DNA, 201 bp, Homo sapiens
ttgtagccctgtcccagcactccgggtgggaatggcaggctgcgtcccactgctccagggcctggtcctggtcctcgccctccatcgtgtggagccctcargtaggcatctggcttacctgtctgttgtgcctgtgctgtgtctttcttgactcggtccatggtggatttgtagatgaggctttttccaggagccagagga

SEQ ID NO: 41005 - DNA, 201 bp, Homo sapiens
caggtgggagggtaaatctgatcactgttacttcacctgggccgaaaggggaagtgccggccccatttaatccctaagcaaacaaaagcttagactgtcawcaattcgttaacaatcctgtaccatttgagtgctggggcaagaatcaaatacggctgtctgcctttggcggggggtgggggtgggggtgggggggtggtc

SEQ ID NO: 41006 - DNA, 201 bp, Homo sapiens
gggagggtaaatctgatcactgttacttcacctgggccgaaaggggaagtgccggccccatttaatccctaagcaaacaaaagcttagactgtcaacaatycgttaacaatcctgtaccatttgagtgctggggcaagaatcaaatacggctgtctgcctttggcggggggtgggggtgggggtgggggggtggtccatat

SEQ ID NO: 41007 - DNA, 201 bp, Homo sapiens
attcacaatctgctcacaggctgggggggtcacacacaggcgtcctcagtgccagactcccagtgggagactgcagacagggaagacgcaaagcacgtaarcaaatatccttaaatacccgccaaatgtcagtgtccatcatcgccaactacagcaacaagcgtgctccgctctcagcaccactggtcaacttggagcccg

SEQ ID NO: 41008 - DNA, 201 bp, Homo sapiens
tatgcatcctgccccgtgccccactgagtcagggatgttttaactcagctggtggaagcaattgctattcccagcttgtgtgagtgtctagcacaggtccstctcacactcttgggtggttcttacccggccataattagtctccacgtacacgtgatcaccactgctctgctgaaaactgctaggcatgtggccatcctc

SEQ ID NO: 41009 - DNA, 201 bp, Homo sapiens
tgttacacaggaatattactgtaaaaacatgtaagtattttatcatgagtttttataaaaccacattggaaatacactatcctatgtaagaatgaaatgayaaatttaaaactggactgtttctaatgcaacatagaactgaatttactgtcaataaaactgagatacttatcaactcaggaagcatatgtaaaataccag

SEQ ID NO: 41010 - DNA, 201 bp, Homo sapiens; identical to SEQ ID NO: 9154

SEQ ID NO: 41011 - DNA, 201 bp, Homo sapiens
agagttcagtcaacagagccatgggcctgggcagtccgatgatgcctgctctgagcccaccaacaagaagatgcgccgcaaccggttcaaatgggggcccrcgtcccagcaaatcttgtaccaggcctacgatcggcaaaagaaccccagcaaggaagagagagaggccttagtggaggaatgcaacaggtaacaccacca

SEQ ID NO: 41012 - DNA, 201 bp, Homo sapiens; identical to SEQ ID NO: 9158

SEQ ID NO: 41013 - DNA, 201 bp, Homo sapiens
tgtgtgaattaacttgagcgagagctcacttatcaccaaggggatggcgctgagccattcataagggatctgcccctgtgatccaatatctcccaccaggycttacctccaacactgggtatcgtatttcaacatgagatttggaagggacacacatctaaaccatatcactaggtatcaaggacatacgagtgaggggag

SEQ ID NO: 41014 - DNA, 201 bp, Homo sapiens
acacagtgcattgattttggcagaaggaaaatgggaatggggaagcatttagagaactcacaatataaatgatcattttaaatgtattgccttttgactgrgccctctggtatatggaatatggtaattatactaataccagagtttggaatgagataagatacctaaaaccagcttgtttgccatttagaagatttgatt

SEQ ID NO: 41015 - DNA, 201 bp, Homo sapiens; identical to SEQ ID NO: 9160

SEQ ID NO: 41016 - DNA, 201 bp, Homo sapiens
cgcgactgaaggtgcgagtgggtgcagtgaaaccgctgcgacttcccgggagcagagcctcgcgccgctgcaagccccaggccgcgcatttttcctgcgcsctgcctcgggtctggaaagccgcatgtcggcctcggacacattgacctgcatgatgacctgcagttctttgccgaaggacaggcggcatccggagccggg

SEQ ID NO: 41017 - DNA, 201 bp, Homo sapiens
ctgtgcagtgtgggaactgtttggcctctatcgattactagataagtaggtgacaaccttgaacttcatgtcagaagctctcagaatttggtcttgttgawggtctttttttcatctgagccctgcaaatcacacttcatccactgccatgggcttcccaggaggttccttcatgggatcagggttctctatcctttcctt

SEQ ID NO: 41018 - DNA, 201 bp, Homo sapiens
catcaacagtgtggccggcagcctggcagccctgcagcccgtccagttctcccagcagctgcacagccctcaccagcagcccctcatgcagcagagcccargcagccacatggcccagcagcccttcatggcagctgtgactcagctgcagaactcacacagtaaggacacgggcatgtggagggagggagcactcaggac

SEQ ID NO: 41019 - DNA, 201 bp, Homo sapiens
gttgagggggttgaaagaagtgctcttacataggggtgaagagcacaagccttgctgttgtgagaccccggccaacttacttatcacctctccaggccacrcttccctcatctgtaaaaccggaattataatcatgacttttaattaatggagccacaatgaatctcacataagttcatggtcatagaagtgacttatctg

SEQ ID NO: 41020 - DNA, 201 bp, Homo sapiens
cgtaagaattagatgaaggaatatatttagaggatttggcacaatacctcaccacagaaaaggttcaataaatgtgaaccgttattgtgtctgttcacatyaaatgaaaaaatctcacattgctcccaggcccttgggatgatccacactggctttcgccattggtgactctactggtgccacacagggcccacggggagg

SEQ ID NO: 41021 - DNA, 201 bp, Homo sapiens
tatgttcgattactggatttttattcattaaacagaattaattttatttgacatatttaaaggcgccatttagaaataaaattgcttattatgttgcaatrctgtatctatttcagcctctacaccgttttcttttttgtttcacctgaaactagttttcccttccgttttttttcttgttctatcaagctaatatatata

SEQ ID NO: 41022 - DNA, 201 bp, Homo sapiens
gctgggtaaaagaggttcaaaggctcatggttctgcaggctgcacaggaagcatgatgccagcatctgcctctgctgaaggcctcagaaggtttacaagcrtggcggaaggtgcagacagggcaggtgcatcacgtggtgagagtgtgagcaggagggagaagggagaggccctgccctgggctcttatttatttatttat

SEQ ID NO: 41023 - DNA, 201 bp, Homo sapiens
cacctgcctcggcctcccaaagtgctgggattacaggcatgagccaccgtgcccggccaacacatttttaaaagataagaatccaataaaaagattaccasagttttatacccgttaaatagttaagaaatatatcaatgctatacaatagtaaatatggcaagtttgcctagggaagtgggcatcagaagtgctgcgggt

SEQ ID NO: 41024 - DNA, 201 bp, Homo sapiens
ttacaggggtgaagcaccatgcccagccaataattgttattgagtgaatgaaggaatgaatttgagaactagtcatgccaaggaatcgctaagtcacatcrtgttggaaactgctctttgtggtccaagtccacccatgtttctcttgtttttttctctccatcagatctcagtctcaggaggaggtttgcccccagtcag

SEQ ID NO: 41025 - DNA, 201 bp, Homo sapiens
actataaccaccagcccttttatctacctgaggagatgggagctatggtgtgggatgggggctctgtacctgtgtctttgcctgtgtatgcaccttgattytgtcttcactctgtctctccagtgtacgcacacaagcaggaacccccccagtattcccacacctcccggtttccatctgcaatggtggtcacagatacca

SEQ ID NO: 41026 - DNA, 201 bp, Homo sapiens
ttcttcccccaacttcccagaaagcaagaacacaggaacacaatcgaccccaggaagcaggtccaggtgtcttctctcctgatcgtcctgtccccactccsatcctaccttagctgtcttcctccgtgtcgctctcagggaggagatagagcatgggtaccaggggatccaatcctcagagtgctggcccgggttctaaag

SEQ ID NO: 41027 - DNA, 201 bp, Homo sapiens
ccctggtcgtggtctctgcaaacaaaaatgaaagggcattcctgggggaggcattttgcagccctcttctcctactcccacctatcccttaagaaagattmttctccatgtgaagaaccacttgtgtcagttacctgtgagaggcacagacaagtctttctgacttctcaagagtgtcccaaacaagttagggttaaggat

SEQ ID NO: 41028 - DNA, 201 bp, Homo sapiens
gccctggtcgtggtctctgcaaacaaaaatgaaagggcattcctgggggaggcattttgcagccctcttctcctactcccacctatcccttaagaaagatwcttctccatgtgaagaaccacttgtgtcagttacctgtgagaggcacagacaagtctttctgacttctcaagagtgtcccaaacaagttagggttaagga

SEQ ID NO: 41029 - DNA, 201 bp, Homo sapiens
aattccttattctctactcattctcacctcttcatcctattctctttctcatctcttccctggactggatagcatacttcccaagcaagaaccagtgcccrgaaacagaaacagatgaaaaggtcaagacttacccactgagggagctggaatgacatcagaggctctcaatcctggaattgaggcacatcaggatcacag

SEQ ID NO: 41030 - DNA, 201 bp, Homo sapiens
acagaaggctagtctcaacccccaaatcctcaaagaactgtgcggaagcaataacaaacagaatccatccagtcattcatttattcatcagaagtttaccragtggctattcagtgccaaggcactggggatacatcagtgaacaaaacaaacgagataaaaatttcctgccctcgtggcgcttacattctagaattaaat

SEQ ID NO: 41031 - DNA, 201 bp, Homo sapiens
gcaaggcccggaattatccgggatccccaacgcgggtttagatttgcaaagggcatgttccatgcagggtccgggtggacacgcgcggggccaaagaaacsaagcgcggtggtgtgggggcgaacgcgtctcagacctcagttcgcagaggatctggtctcagtctgagaaaggagggcgtttccagacctcgctgcccac

SEQ ID NO: 41032 - DNA, 201 bp, Homo sapiens
gcagtctgctaggctataaggatgcaacaagtaaagactcatctctttctttaagaggcagagaaaagtaaacatatcatcagcgtgcatgcagggtgacygactcctgccgtaagtctctgtctagtgcatgtaaaatacaaaggaaggagcagccatctcccaggatgaatcaagaagagcttcacaggggggcgacat

SEQ ID NO: 41033 - DNA, 201 bp, Homo sapiens
ctgcctctgtccttaagaaaagtaaagtgtttagggagaaggtagagttatcaggacacagtactgggtccatcaagcctggcccagtctctccctgtcayctccccaacataatgatttggcttcatagaaaagatggctgtgtctactcataatttatgaacaatgaacatagttattaccttttggaagagctttctc

SEQ ID NO: 41034 - DNA, 201 bp, Homo sapiens
attatctaaggagccgagcggttccctgagacagcacgtcgctcccgggccactccgctttaggacagagcccatcgcgtggcttcggacactgaagcgcygcgatttcggggctgagccttggccgcacgtccgcagcggcggtttggggtgggatatgaccttgcatttgaatttgtgctccgagggcctggcggtttg

SEQ ID NO: 41035 - DNA, 201 bp, Homo sapiens
catgtagactttcccaagggaagcctacctgagccaaggtgagctggttatggccagtcccttctcaggaccggattcagatgcgtgtgtctgggtagccmagtatagcacccaaatcaggcttggcttgggttgtggttctgtcactatccggcagtgtgaccttaagttattagcttctctgtcccaatacctatcccc

SEQ ID NO: 41036 - DNA, 201 bp, Homo sapiens
aggtgggtggcctcatcatctatccccttcggctattcctctcccagcttcttcactgggtgaggaagcagagtgttctgatggttgggagcatcgacctrggagttaggcagatctgggctcaacattctaccactttctacctgtgtgacctcagagaaatgtcttagcctctttgagcctctgtttgctcacctgtaa

SEQ ID NO: 41037 - DNA, 201 bp, Homo sapiens
tatctaaggagccgagcggttccctgagacagcacgtcgctcccgggccactccgctttaggacagagcccatcgcgtggcttcggacactgaagcgccgsgatttcggggctgagccttggccgcacgtccgcagcggcggtttggggtgggatatgaccttgcatttgaatttgtgctccgagggcctggcggtttgcc

SEQ ID NO: 41038 - DNA, 201 bp, Homo sapiens
ttgctaaagcaatattcacttttaaaatgcaatttttcccctaaggttcgaggcgtcttgttcgtagccgttgaaagtatttttccatcctaaaaatatckgtggaaatattgaccagaaataaacttttaaatgatctgtgatgtttacaaggatatgtctaaaacgtttattacattattttcctcttaatgtgaattc

SEQ ID NO: 41039 - DNA, 201 bp, Homo sapiens
agtgggccgtcctctggcttatagatgaggaagctggtgctcacccaagaaattgatagcagagctgagattaaaacagggatcccccagtttccagccgrgcctctatcacttaaccaggggcttttaaaggaacgttcaaaggtctaggctcatctgtcttttgacagagcagctccaccgttatatttcttatataat

SEQ ID NO: 41040 - DNA, 201 bp, Homo sapiens
gagcgtgcgggacggaccctgcgggcgccgcggccggcgtttgacacctgcgcttgggacacaatggccgcaggccctcttcgggaccggtgcctttctcsgtgttagggaacctctgaacctgagctgtgttttcaaacaaacaaacaaaaataaccagctctcccggctcttcccggtgaacacacgtgaattttgggg

SEQ ID NO: 41041 - DNA, 201 bp, Homo sapiens
cccttggagggctgctaaaatgatcaagggttacatgcagcaacacaacatcccccagagggaggtggtcgatgtcaccggcctgaaccagtcgcacctcycccagcatctcaacaagggcacccctatgaagacccagaagcgtgccgctctgtacacctggtacgtcagaaagcaacgagagatcctccgacgtaagtg

SEQ ID NO: 41042 - DNA, 201 bp, Homo sapiens
ccaccgtgttcccttaagacgaaaagcaaagagaaagaaaagtcgcgttttggagttcctggagttctagtaaacctcctggaagagaaaggcaggggagraaggtcgggactgcgcgcttcccggtccccggctcccggccggagctggcctttctcgcggcctcgaggcaggtgcgccgggggcgtctagaaagtgggc

SEQ ID NO: 41043 - DNA, 201 bp, Homo sapiens
aaaggaacgttcaaaggtctaggctcatctgtcttttgacagagcagctccaccgttatatttcttatataataaagttttgttggggagaaaacaaagtrtaaaaaccacagcagccttggaatatgctgcctggattctaacaaatggctcttgagtctctcctgacatgctcccttgtaaagaagccttttgtttcct

SEQ ID NO: 41044 - DNA, 201 bp, Homo sapiens
gaacctctgaacctgagctgtgttttcaaacaaacaaacaaaaataaccagctctcccggctcttcccggtgaacacacgtgaattttggggtcagagggytgtgaaggtataactgcgccatcttactcctcactcttttaagtcggacttaaaaggttttgccattatttataaggttcttgggggctttttttaaacc

SEQ ID NO: 41045 - DNA, 201 bp, Homo sapiens
tgctgtgattgtgtgtttttggccaagcaccaacaagtccccccgccccccctcactcaccatctcccctccatccattcccagggcagaatgtttgcagygaggggtgtccccctccaaagcccacggcctgggctccaacttggtcactgaggtccgtgtctacaactggtttgcaaaccgcaggaaggaggaggcatt

SEQ ID NO: 41046 - DNA, 201 bp, Homo sapiens
aagttgaaaccattctagacaaataaaattcaaaggtgctaaaactagcagtttacacacctgtgtttatgagaaatgaaaagtataaccatgttcttatycagtatttaaaatttatgagaaacataatacaggaaaacaagcatctaaaattgttaatgtccgaaattgaagttatttgtccccattagcccagtagat

SEQ ID NO: 41047 - DNA, 201 bp, Homo sapiens
tttttcatctgagccctgcaaatcacacttcatccactgccatgggcttcccaggaggttccttcatgggatcagggttctctatcctttcctttgccccratctccttccagccctagagtgcagtggagcaggtgggttctattcctggttctgccatttgcttggtgaccttgacctccctgagccttcatttcttca

SEQ ID NO: 41048 - DNA, 201 bp, Homo sapiens
aggtgatgattccagagtaacacaatgagaccttttagtagctggggtctgtgcagtgtgggaactgtttggcctctatcgattactagataagtaggtgrcaaccttgaacttcatgtcagaagctctcagaatttggtcttgttgaaggtctttttttcatctgagccctgcaaatcacacttcatccactgccatggg

SEQ ID NO: 41049 - DNA, 201 bp, Homo sapiens
taaataaaacaagagcttttctttttgcttaataagagagagtggtggtggtgcttttttattcctgaagatgggaagtcctcttttgcccactaacctcrgaagaaagggatgaggtgtaccgtacaggggcagtcaccttctcctctgtttagcttccattttggcctcatgtctaccccaaagttgtagcttagatgg

SEQ ID NO: 41050 - DNA, 201 bp, Homo sapiens
ccttgatacgtgaccatcagtcaatttccaaagaagacatttcgttgcagtcaataatattgattactattactgttaatttcctcctctctggaaaaagyatcaacaatagaatgcatttgtatagagagatatattcagaacttcaccctgttcttggaggatagtgggagggattgaatcctgaggcaatttaaggtg

SEQ ID NO: 41051 - DNA, 201 bp, Homo sapiens
ctctgtagttcctggaaagcctaaaaaaattctcaggagccattgtctccaaagacccaacaacgcttgggccctgcccaatttaagctttatgcagcatytccagtctgtgctgcctctctgtattcaatgagaatttcttcagaaaggagaaggaggcaggaaaggcagactggaaacttctcaaaagacagaggtcca

SEQ ID NO: 41052 - DNA, 201 bp, Homo sapiens
gataactaatatgagaaatccccactataaccaccagcccttttatctacctgaggagatgggagctatggtgtgggatgggggctctgtacctgtgtctktgcctgtgtatgcaccttgattctgtcttcactctgtctctccagtgtacgcacacaagcaggaacccccccagtattcccacacctcccggtttccatc

SEQ ID NO: 41053 - DNA, 201 bp, Homo sapiens
ccatccaatcccatcctctgtttctctgcctttcatcctgagtcccaggcttccaatcctctggccaggtctggctatagcccctgacacaggagtttgggaggaatcatggcttctctgcttcagaaaccccaaggaagtgttcagtataaagcactagtcttagatcagacagacctggatttaaatcctggctgtgat

SEQ ID NO: 41054 - DNA, 201 bp, Homo sapiens
ctcccgttccgtaccggaggcctccctggtaggccctgtgttctgagagcaggtggtctctccctcacagccaagcatccacatgctttcgggagttggtyatgtgacttggaatttacatgaatcttatggataactaatatgagaaatccccactataaccaccagcccttttatctacctgaggagatgggagctatg

SEQ ID NO: 41055 - DNA, 201 bp, Homo sapiens
accacagttttatacccgttaaatagttaagaaatatatcaatgctatacaatagtaaatatggcaagtttgcctagggaagtgggcatcagaagtgctgygggttgtgagttactgtgaagcagtggagaaagggttatctgacatgggaaggaaaagatgtgactccatattgcatggatgtgtcttaccagtgcacac

SEQ ID NO: 41056 - DNA, 201 bp, Homo sapiens
gcccatgaagagagagcccatggtgccctggaccaggaaataacctgcctccctgcatgagaagggcaagccgaggcaacagccagtgacctttgctcccrttccgtaccggaggcctccctggtaggccctgtgttctgagagcaggtggtctctccctcacagccaagcatccacatgctttcgggagttggttatgtg

SEQ ID NO: 41057 - DNA, 201 bp, Homo sapiens
ctggcccttttccatcagccaaattaaataggctaaatccagagactgtttgacttgagactgaatcgatgatggggacaggctgggaggtgaaaacacamctgactcccagcgttatcaacactctctcaggagcagagcctctcggggaggtaaatagctggttagggagtcagagaaagcaggagaaaaacagggtga

SEQ ID NO: 41058 - DNA, 201 bp, Homo sapiens
accagatcttgtgtgaattaacttgagcgagagctcacttatcaccaaggggatggcgctgagccattcataagggatctgcccctgtgatccaatatctyccaccaggccttacctccaacactgggtatcgtatttcaacatgagatttggaagggacacacatctaaaccatatcactaggtatcaaggacatacgag

SEQ ID NO: 41059 - DNA, 201 bp, Homo sapiens
acttatactttgcagcaccacgagggatgccagggaaacatttctaaaaggcattttaaagaataaaaaatactccagccagtaacagaaggctagtctcmacccccaaatcctcaaagaactgtgcggaagcaataacaaacagaatccatccagtcattcatttattcatcagaagtttaccgagtggctattcagtgc

SEQ ID NO: 41060 - DNA, 201 bp, Homo sapiens
aaattaaataggctaaatccagagactgtttgacttgagactgaatcgatgatggggacaggctgggaggtgaaaacacaactgactcccagcgttatcamcactctctcaggagcagagcctctcggggaggtaaatagctggttagggagtcagagaaagcaggagaaaaacagggtgaagtccagttcctccaaaaga

SEQ ID NO: 41061 - DNA, 201 bp, Homo sapiens
agggtttcaccatgttggccaggctagtctcgaactcctgacctcaagtgatccacctgcctcggcctcccaaagtgctgggattacaggcatgagccacsgtgcccggccaacacatttttaaaagataagaatccaataaaaagattaccacagttttatacccgttaaatagttaagaaatatatcaatgctatacaa

SEQ ID NO: 41062 - DNA, 201 bp, Homo sapiens
accatacccagctaatttttgtatgtttagtagagacagggtttcaccatgttggccaggctagtctcgaactcctgacctcaagtgatccacctgcctcrgcctcccaaagtgctgggattacaggcatgagccaccgtgcccggccaacacatttttaaaagataagaatccaataaaaagattaccacagttttatac

SEQ ID NO: 41063 - DNA, 201 bp, Homo sapiens
cattaaaatataatggtgattacaatataggatccttgaccaaaaaagaaaaaaaattttgtaatgtgtactggagatgtggaaaaagtagagaaaccttrtaatggctaatctcccccaacccttagtaatttctgaagctggctagtaactcagacagtcaacaatagatgcaccatgagggcagggatcactgtctgt

SEQ ID NO: 41064 - DNA, 201 bp, Homo sapiens
tggtgtgactttgttttagaaagatatcccaggctgcagcagtgtgaaaggaccctagagacggtgctggcacaggaaggcagagcaaggatgctggcttyttggaaccatgcacctgtgccatgcctttggcacttctgaccagtcatattggatagaaaccgaatgatctgcgtctgtatccaggaatagcccaacacc

SEQ ID NO: 41065 - DNA, 201 bp, Homo sapiens
cttatcccaggagctgtctgtgatcttttcctcttgctcccacaggcctcaacacctcccaagcacagagtgtccctgtcatcaacagtgtggccggcagsctggcagccctgcagcccgtccagttctcccagcagctgcacagccctcaccagcagcccctcatgcagcagagcccaggcagccacatggcccagcagc

SEQ ID NO: 41066 - DNA, 201 bp, Homo sapiens
actgtggttgtggatatctctttgagagttttaatgttgatgagtattcagcatatttccagcttcactatgacagctcaggtgtcgttgtttctcaaaascatccttgtgacccttggatgtattgctggatgtcttgggagagatctaagggtaacacattggtcatctttctttcaaccttgtattgctccattgtcc

SEQ ID NO: 41067 - DNA, 201 bp, Homo sapiens
aaaattataaagattatttataaagggactcttagaaggcaatgatggtgaaagaggtttgtgtttcttccctagctgcatcggataagctgtgggtttgrgggagaacagccaagtccagccttctatcttcagggctcaatccccactcgggcctgtggagctggtttctgagcaccatctcacattccaatcacattt

SEQ ID NO: 41068 - DNA, 201 bp, Homo sapiens
tcttcctgtcttcttctgttcctccaaactcccaatctctgcctgttacccattgccaaagctgcttccacatcttcaagtatcttttttttttgcggggrgggggggcggcggggcggggggacggagttttgctcttgttgcccaagctggagtacaatggtgtgatctcagctcactgcagcctccacctcccaggtt

SEQ ID NO: 41069 - DNA, 201 bp, Homo sapiens
attctaaactttccttcatcttcctgtcttcttctgttcctccaaactcccaatctctgcctgttacccattgccaaagctgcttccacatcttcaagtaycttttttttttgcggggagggggggcggcggggcggggggacggagttttgctcttgttgcccaagctggagtacaatggtgtgatctcagctcactgca

SEQ ID NO: 41070 - DNA, 201 bp, Homo sapiens
tttttagtgagaggtgatgcacaggctggtagttaggagcctgcaagcctgcaggctgggctcgtgtccaggctcctgccccaagtccacatgactttggrcaagtcacttcaccagtctgaacctcagtttcttcatctgtaaaatggaggtggctatacttctcacatggagcggtcgtaagaattagatgaaggaata

SEQ ID NO: 41071 - DNA, 201 bp, Homo sapiens
aggaggaagagggagaagggtcagctttggaataccacggacttgctgggagaccccctagcaaggagcggtgcaaacaaccttgtcctctccgaacctcrgttttccactctgtcaaatgggtgcttgtgacacattgagaagcagatgggtgtaacatactctcagatgtgaggactgcccaagttatcaagtgccagg

SEQ ID NO: 41072 - DNA, 201 bp, Homo sapiens
taggaggaagagggagaagggtcagctttggaataccacggacttgctgggagaccccctagcaaggagcggtgcaaacaaccttgtcctctccgaacctcagttttccactctgtcaaatgggtgcttgtgacacattgagaagcagatgggtgtaacatactctcagatgtgaggactgcccaagttatcaagtgccag

SEQ ID NO: 41073 - DNA, 201 bp, Homo sapiens
accatgaatttcctgtaactaacagggcatttttcttttttctttttcttttaatttttttttttgagacagagtctcgctatctcccaggctggagtgcrgtggcgcgatctcggctcactgcaagctccgcctcccgggttcacgccattctccggcctcagcctcccgagtagctgggactacaggcgtccaccacca

SEQ ID NO: 41074 - DNA, 201 bp, Homo sapiens
tcccatcctctgtttctctgcctttcatcctgagtcccaggcttccaatcctctggccaggtctggctatagcccctgacacaggagtttgggaggaatcrtggcttctctgcttcagaaaccccaaggaagtgttcagtataaagcactagtcttagatcagacagacctggatttaaatcctggctgtgatacttacca

SEQ ID NO: 41075 - DNA, 201 bp, Homo sapiens
gcggagcttgcagggagcagagatcacgccactgcactctagcctgggtgacagagcgagactccgtctcaaaaaaaaaaaaaacgctctgtgggctaggkgtggtggctcacacctgaaatcccagaactttggaaggccaaggcaggcagatcacttgaggtcaggagtttgagaccagcctgaccaacatggtgaaac

SEQ ID NO: 41076 - DNA, 201 bp, Homo sapiens; identical to SEQ ID NO: 9137

SEQ ID NO: 41077 - DNA, 201 bp, Homo sapiens
gtgtgcagaataccgaaaaaaaaaaaaaaaaaaaggccgggtgcggtggctcacgcctgtaatcccagcactttgggaggccgaggcgggcggatcacgargtcaggagatcgaggccatcctggctaacacagtgaaaccccgtctgtactaaaaatacaaaaaattagccgggtgtggtggcgggtgcctgtagtccca

SEQ ID NO: 41078 - DNA, 201 bp, Homo sapiens; identical to SEQ ID NO: 9138

SEQ ID NO: 41079 - DNA, 201 bp, Homo sapiens
catgttgctgaggagagcccaaaatccaccgtcagcactagcaaccccaaagactgagctggggggaacaaggcccgaatccctccacacccactctccasgctctcccctctccaaacatcagcacctgagccaggagggctggcagcaccttggagacgaagcttccccagaaccctcttcctagagaggaagagcagc

SEQ ID NO: 41080 - DNA, 201 bp, Homo sapiens; identical to SEQ ID NO: 9139

SEQ ID NO: 41081 - DNA, 201 bp, Homo sapiens; identical to SEQ ID NO: 9141

SEQ ID NO: 41082 - DNA, 201 bp, Homo sapiens; identical to SEQ ID NO: 9142

SEQ ID NO: 41083 - DNA, 201 bp, Homo sapiens
attatcaggaagttgttgccataatctaagcataggtgatgagagctgatctgattctgtattttgaaggtacaggatttgaagataccaggatttcctgwtggtttagatgtagaatgtgagaaagagtgataaaaaataattccaagatttgggccctaaacaaagtaggaaatagaaattagtgttgttggccaggtg

SEQ ID NO: 41084 - DNA, 201 bp, Homo sapiens
ctcccaccataatccccagcaatctcaaaacctcatcatgacacccctctctggagtcatggcaattgcacaaagtaagttctattcttggttggaaaacytgggggcagggagaagaagaatgggaagcaaattaatgtggtgaaaaataactgtaggtctccttcaaactcacccacgactagtagatttggtttaact

SEQ ID NO: 41085 - DNA, 201 bp, Homo sapiens
gccccttcaccaaagaggagacatttatttctgtggctgctgctcctccctttcgctgaactctattcctccctctccaagcccagtggacttgacttccytgatgtggcttagagcttgaaaaacagagaatcctgcctcctgcctctcgctcatcccccttcacagcccctcccaggttacctgagggaatctaaccct

SEQ ID NO: 41086 - DNA, 201 bp, Homo sapiens
cggccacgccaagggccgcttgtccggcgacgagggctccgaggacggcgacgactatgacacacctcccatcctcaaggagctgcaggcgctcaacacckaggaggcggcggagcagcgggcggaggtggaccggatgctcaggtaggcgcagagcgaggtggaggggacccacccgaacccctggagccccggccccgg

SEQ ID NO: 41087 - DNA, 201 bp, Homo sapiens
ctctgttacagtcaagggagttggcacctgatttctctgggggtctttgtacagtctactaaataagggtctcccaacctcatactcccgggactatggamgttgtttttagtcaaaatttgggtccctgcacactcctgccctctactggacagaccgatctgggcaataacctgtgcctcagtgtggacatctttaact

SEQ ID NO: 41088 - DNA, 201 bp, Homo sapiens; identical to SEQ ID NO: 9169

SEQ ID NO: 41089 - DNA, 201 bp, Homo sapiens
tcaagtaaacaggtaatgccagcaggatttgcgggggttggggtgtgggcagggtgtgataaggccatggatgtgcagaggttgtggcaagcatggactcrgccagaaattaggtccttctgaggctccctgttgtttgcaaagggaatccttaaggtcccagggcaaaaaaaaagggccacaggctgaaagggcttattg

SEQ ID NO: 41090 - DNA, 201 bp, Homo sapiens
attcagtgcttggtctacatgcagtcaaaggaggctgggagaagaaaatgtctcaggattactaccatctctcaagcacatcctacctcttgggcctgggytccggatccctgtttcccattctcctgctgatacacagactccctgctcacctatttcccaggaaaaaagcaaatagttcagggcctgtcaaagcaccca

SEQ ID NO: 41091 - DNA, 201 bp, Homo sapiens
tagactcttttaaacagccagatctcacgtgaactaactcaagcatgaattcctcacccatcaccatgatccattacctcccactgagccccacctccaasactgggaatcacatttcaacatgagatttggaggggacacacatccagaccatatcattccacccctggcctcccaaatctcatgtccttctcacattga

SEQ ID NO: 41092 - DNA, 201 bp, Homo sapiens
aattcacgataatcacctacttcaaagggtcgacgtaagaactcgaggcagtgatgcttgtgaagcccttggtatggtgcctggcacacagtaggatgtcrataaatgttagctcttaccattatgtaacaaatcctcttagaataaggatgtccttcacatttgccacagctaccacacctttcagacggagggccccgc

SEQ ID NO: 41093 - DNA, 201 bp, Homo sapiens
ttttattgattgaatgcctcataaaggagcaagcccggtgggacactgtttgttttggggcttgccaatgacatttgtgttgataaaatgttcattcatcyctccccccaaggcctccaaagccaattttttaacttagagagcacctcactttgacacaagccccctcttcctccttaccatccccttggtactgacaag

SEQ ID NO: 41094 - DNA, 201 bp, Homo sapiens; identical to SEQ ID NO: 9144

SEQ ID NO: 41095 - DNA, 201 bp, Homo sapiens; identical to SEQ ID NO: 9147

SEQ ID NO: 41096 - DNA, 201 bp, Homo sapiens; identical to SEQ ID NO: 9149

SEQ ID NO: 41097 - DNA, 201 bp, Homo sapiens
gcccagcctggtagccattttaaacagtatggacaaggaagaagagagtggccactgagaacgtgacgtctgagagccctaaggctgctgagtcagccatrtggacatctaggaggagagcattccaggcagaggtaatagcaagtgcaaaggccctggggcaggaagagaaacatatagcagagccgctagagcagagag

SEQ ID NO: 41098 - DNA, 201 bp, Homo sapiens; identical to SEQ ID NO: 9151

SEQ ID NO: 41099 - DNA, 201 bp, Homo sapiens; identical to SEQ ID NO: 9152

SEQ ID NO: 41100 - DNA, 201 bp, Homo sapiens
ttgttattgttatttttgttttatttatttatttatttatttaactttttgagacggggtctcgctctgccacccagactggagtgcagtggcgcgatctyggctcactgcaagctccgcctcccgggttcacgccattctcctgcttcagcctcccaagtagctgggactgcaggtgcccgccaccacacctggctaatt

SEQ ID NO: 41101 - DNA, 201 bp, Homo sapiens
agtagttaaaactttctaagtgataccaatgtgtagctaaatttgagaaccagttctaaggttctcaaatttagcttctcaaatgttaaagtgcatgccarttccctggggtggggggtgttaggatacagattctcattctataggcctggggtgaggcctgggtttctgcattttcaacaagttcccaggtgctgttga

SEQ ID NO: 41102 - DNA, 201 bp, Homo sapiens
aggatcctggtggaggttgcagtgagccaagatgccgttgcactccagcctgggtgacaagagcaaaactccacatcaaaaaaaataataataaataaatwaattaattaattaaataaaacaagagcttttctttttgcttaataagagagagtggtggtggtgcttttttattcctgaagatgggaagtcctcttttgc

SEQ ID NO: 41103 - DNA, 201 bp, Homo sapiens
ttgagaaccagttctaaggttctcaaatttagcttctcaaatgttaaagtgcatgccaattccctggggtggggggtgttaggatacagattctcattctrtaggcctggggtgaggcctgggtttctgcattttcaacaagttcccaggtgctgttgaagaggatggtctgggacacacttttgagtactggagttggat

SEQ ID NO: 41104 - DNA, 201 bp, Homo sapiens
attagcaactaactcccctttgcctcccaacctgtgtaatttgcctcaccatcaccagccttgacatctaatatggggaaatgctcttttaaatccagccrgcacagtgacaaaattacaggctatggaggcagacccaaattccaaccttcactttggcacttactgctgtgtgaccttgggcaagtctctggaatctct

SEQ ID NO: 41105 - DNA, 201 bp, Homo sapiens
caccgcgcccggccatttttcttttttaattaaaggaggtgtgagtactcctctcatgtgtattgcttgttagtaattagccctgggaacctgccaggtasaggggtgtgggatgttcctggtggaggctgcatctgggaagcttaatggcccccaaacttcaggcgaaggagcatttaagaaggagaaggtgcacacagc

SEQ ID NO: 41106 - DNA, 201 bp, Homo sapiens
tgcagaagggcactctgtgtccccacagcctttaggcctaacgatgtccaccattaacccttcttagttttactctagtttctttggagaaaggggcattkaaaagttattcatgttgccacagtaaattcccattaattgactcttctccttatccccaaatcaacccagtagcccccaaactcggttcttcaaatgtga

SEQ ID NO: 41107 - DNA, 201 bp, Homo sapiens
gtattgcttgttagtaattagccctgggaacctgccaggtagaggggtgtgggatgttcctggtggaggctgcatctgggaagcttaatggcccccaaacktcaggcgaaggagcatttaagaaggagaaggtgcacacagccccacggtgagcaaagggaaacctcagagctcctaagggctgattttctggaaaccact

SEQ ID NO: 41108 - DNA, 201 bp, Homo sapiens
cactcttgcattctgtgcatctgcaggcttaacatcacatgaaacccaccaaagcttacagactgcaccctctagagtggtggtctgagctgtacctgggkccctttgagccagggctgaagctagagcagcatgtatgcagggagcagtgtcccaaggctgtgcagggcagcagggcctttggtctggcccccaaaacca

SEQ ID NO: 41109 - DNA, 201 bp, Homo sapiens
tggggcttaggaggaagagggagaagggtcagctttggaataccacggacttgctgggagaccccctagcaaggagcggtgcaaacaaccttgtcctctcygaacctcagttttccactctgtcaaatgggtgcttgtgacacattgagaagcagatgggtgtaacatactctcagatgtgaggactgcccaagttatcaa

SEQ ID NO: 41110 - DNA, 201 bp, Homo sapiens
caaagctccagttatatttatttcaaagcatgttccaaaaggtttggggtttttctaaaaacctgactttataatgtagatacctaggatataggaagagrgaggagaggtggggagtgctatctacagcctctgaatattttgtgcaagtgtaaattgtacctttgagcagttctcccctggatgtgagacttgattgag

SEQ ID NO: 41111 - DNA, 201 bp, Homo sapiens
caggcattaaatcttaaagctccaaaataatccttgattccatgtcccacatcctgggcacattggtgtgccaggtgggctcccaaggccttgggcagctstgttcctgtggcttttccatgctgaggttgcaagctgctagtggctttaccattctgaggtctagagggtggcaggcccattcccacagctccattaggc

SEQ ID NO: 41112 - DNA, 201 bp, Homo sapiens
catggaatctcctatgtaacaggctcagcccggtgactgggacattgagcgggggctcaaatgatggcatccatccacctctccttatcccaggagctgtctgtgatcttttcctcttgctcccacaggcctcaacacctcccaagcacagagtgtccctgtcatcaacagtgtggccggcagcctggcagccctgcagcc

SEQ ID NO: 41113 - DNA, 201 bp, Homo sapiens
tgccttggcctctcaaagtgctgggattacaggcgtgaggcactgcgccaggccttcagccccactcttaagagtactgaggagcagcaggggcttgggcygaagaaccccatgttaataataacaattgtgccaaggaccatgctcaggactccacaggtgttgactcatctaatcacacaacaactcccatattatagg

SEQ ID NO: 41114 - DNA, 201 bp, Homo sapiens
aatgcccatctccaacccacaactcattgtggaacttgagcaagtaaattaatatctccaagtctccgtttctttacacttgcctcccatggaatctcctrtgtaacaggctcagcccggtgactgggacattgagcgggggctcaaatgatggcatccatccacctctccttatcccaggagctgtctgtgatcttttcc

SEQ ID NO: 41115 - DNA, 201 bp, Homo sapiens
gtgagagataatgcaaataaaacagacgaatcacaaaggcccagttctgccagtctcaggtgttggggcttttctggaaagcagtgaggagccatcagatrtttccaagcagagcagaggcatggtgtgactttgttttagaaagatatcccaggctgcagcagtgtgaaaggaccctagagacggtgctggcacaggaag

SEQ ID NO: 41116 - DNA, 201 bp, Homo sapiens
gtagctgggactacaggtgtgcaccaccatgcccagctaatttttgtatttttagtagggatgtggtttcactatgttggccaggctgatctcgatctccygaccttgtgatccacctgccttggcctctcaaagtgctgggattacaggcgtgaggcactgcgccaggccttcagccccactcttaagagtactgaggag

SEQ ID NO: 41117 - DNA, 201 bp, Homo sapiens
aaggatgctggcttcttggaaccatgcacctgtgccatgcctttggcacttctgaccagtcatattggatagaaaccgaatgatctgcgtctgtatccagraatagcccaacacccatgatgctgatgcctaggaatagaggaaagtagatgatctactcaccagggcctcagggatgtctcaactccaccttggatggct

SEQ ID NO: 41118 - DNA, 201 bp, Homo sapiens
atctgtcccttccagagcacatacgtctccctccttctcaactcttgggtgctggcaagttatctctgagtgggtttgtgcctgagttcaacaatgcccckctagtctggaaacaagaccacagcaaccactgacctcagttagaacaagtgcaggcaggttgtgagccaactcctgtttccacagtgttctctccccgct

SEQ ID NO: 41119 - DNA, 201 bp, Homo sapiens
cccagcagatcttgaactgggcttaagcgatcctcctgccttggcctcctaaatagctgggattacaggctctagccacagggcccagctattttttttttaaacgattggaaagccttgggaaatctttttacttcattcctgccctgttctccctgactccagtattgactttctaaaacttcagctctttggtctggc

SEQ ID NO: 41120 - DNA, 201 bp, Homo sapiens
catccacatgctttcgggagttggttatgtgacttggaatttacatgaatcttatggataactaatatgagaaatccccactataaccaccagcccttttrtctacctgaggagatgggagctatggtgtgggatgggggctctgtacctgtgtctttgcctgtgtatgcaccttgattctgtcttcactctgtctctcca

SEQ ID NO: 41121 - DNA, 201 bp, Homo sapiens; identical to SEQ ID NO: 9146

SEQ ID NO: 41122 - DNA, 201 bp, Homo sapiens; identical to SEQ ID NO: 9148

SEQ ID NO: 41123 - DNA, 201 bp, Homo sapiens; identical to SEQ ID NO: 9150

SEQ ID NO: 41124 - DNA, 201 bp, Homo sapiens
gccagtcccttctcaggaccggattcagatgcgtgtgtctgggtagccaagtatagcacccaaatcaggcttggcttgggttgtggttctgtcactatccrgcagtgtgaccttaagttattagcttctctgtcccaatacctatccccttaggggtgcaatgaggcttaaatatgatcagacacacccagtgccaagcac

SEQ ID NO: 41125 - DNA, 201 bp, Homo sapiens
ggccgttcttcttcattgtctacaaccctacagccaggggaactagagggtttgcatccctacctgtaaacttcaatctcaccgtgaagaagaaggtcccygaagtctctgaacaccttgctctgtatgtatgtattctgagtggcagaattgtgggctgtaccaacatctgagcctgaggtagctttcttcatcattgtg

SEQ ID NO: 41126 - DNA, 201 bp, Homo sapiens
tgaaaccagcccagcatttaaattgctttcatcttgcatcagctttttcttccacatttgcagatttttaatcttctaaactctttgcaaacatgaatctktatcctctcagaggaggaaatattaataagaactagcaaaagtccagtgctacaaacaaggaaactgaggcagcaatgctaactcattcaaaagctttca

SEQ ID NO: 41127 - DNA, 201 bp, Homo sapiens
acatgaatctgtatcctctcagaggaggaaatattaataagaactagcaaaagtccagtgctacaaacaaggaaactgaggcagcaatgctaactcattcraaagctttcatttctggagttctcaatttcaagccagggaattgttcacattcttttcttccaaatgggcctctcagaagttcaccagacagaatcattt

SEQ ID NO: 41128 - DNA, 201 bp, Homo sapiens
ggctgaggcgggcggatcacttgaggtcaggagtttgagaccagcctggccaacacggtgaaactctgtctctaccaaaaatacaaaaatttagctgagcktggtggtgggcgcctgtagttccagctactcaggaggctgaggcaggagaatcacttgagcccgggaggcgaaggttgccgtgagccgagattacgccac

SEQ ID NO: 41129 - DNA, 201 bp, Homo sapiens
cactttcactacaataaatacacaactgactgtattttctacttctgctagacgtgatgctccttgtctggggcatgggtgctcaaagctgctggggtttyattccttcagtcaataaatatgcacagtaccaggcagtctgctaggctataaggatgcaacaagtaaagactcatctctttctttaagaggcagagaaaa

SEQ ID NO: 41130 - DNA, 201 bp, Homo sapiens
tccaggcagaggaaacagcaaaggtgcagaggcaggagatggtcaggccatttgagaagtgcattaagattgtggtgagagataatgcaaataaaacagaygaatcacaaaggcccagttctgccagtctcaggtgttggggcttttctggaaagcagtgaggagccatcagatgtttccaagcagagcagaggcatggtg

SEQ ID NO: 41131 - DNA, 201 bp, Homo sapiens
ctccaccttggatggcttttgctgctggacacaattgctgtggttcatagagccaacaatggggatggggccagtgagtggcttgagctaggaagtaagtrgaaggtgaatggctaccatctgccactgtcatttctcctatgggtcctctgtggctattaacctggcatctttggttaatcaatattaaaccagagccct

SEQ ID NO: 41132 - DNA, 201 bp, Homo sapiens
cggcctgaaccagtcgcacctctcccagcatctcaacaagggcacccctatgaagacccagaagcgtgccgctctgtacacctggtacgtcagaaagcaaygagagatcctccgacgtaagtgttttcatcctgcctctgcctcaacctgaagtgacctttgccctctcaccccattggctgcctcagtttccctttcatc

SEQ ID NO: 41133 - DNA, 201 bp, Homo sapiens
ggacacgggcatgtggagggagggagcactcaggaccctcagtggccaaccactttccctctctgggtctgaactttctcggaagtttattggcttggtcrcttttccctgcctatgatcaaccgactaagacaatttctcaagcataactcttgagtgttgctgtaccttttctagtcctcttctctacccctgagattc

SEQ ID NO: 41134 - DNA, 201 bp, Homo sapiens
gtgtggctctcactctatccttagctgcttggaaattgacacacagtgcattgattttggcagaaggaaaatgggaatggggaagcatttagagaactcayaatataaatgatcattttaaatgtattgccttttgactgggccctctggtatatggaatatggtaattatactaataccagagtttggaatgagataaga

SEQ ID NO: 41135 - DNA, 201 bp, Homo sapiens; identical to SEQ ID NO: 9140

SEQ ID NO: 41136 - DNA, 201 bp, Homo sapiens
caaactcccaatctctgcctgttacccattgccaaagctgcttccacatcttcaagtatcttttttttttgcggggagggggggcggcggggcggggggayggagttttgctcttgttgcccaagctggagtacaatggtgtgatctcagctcactgcagcctccacctcccaggttcaagcgattctgcctcagagtcct

SEQ ID NO: 41137 - DNA, 201 bp, Homo sapiens; identical to SEQ ID NO: 9145

SEQ ID NO: 41138 - DNA, 201 bp, Homo sapiens
tggtctctgcaaacaaaaatgaaagggcattcctgggggaggcattttgcagccctcttctcctactcccacctatcccttaagaaagattcttctccatrtgaagaaccacttgtgtcagttacctgtgagaggcacagacaagtctttctgacttctcaagagtgtcccaaacaagttagggttaaggattacccaggc

SEQ ID NO: 41139 - DNA, 201 bp, Homo sapiens
taactaatatgagaaatccccactataaccaccagcccttttatctacctgaggagatgggagctatggtgtgggatgggggctctgtacctgtgtctttscctgtgtatgcaccttgattctgtcttcactctgtctctccagtgtacgcacacaagcaggaacccccccagtattcccacacctcccggtttccatctg

SEQ ID NO: 41140 - DNA, 201 bp, Homo sapiens
agcaggaggtaggaaagggaaacacggtcatcggtcatcagggtatctggtgagatgctggcttgaggagacgctgagccccctggggaactggagacagygctgttctgagggtgatcagagggtggcacccccagcccccacccaggagagccagaagcaggattcatcccctgtcctttctgctcaggggtctcgcct

SEQ ID NO: 41141 - DNA, 201 bp, Homo sapiens
tcggtcatcagggtatctggtgagatgctggcttgaggagacgctgagccccctggggaactggagacagcgctgttctgagggtgatcagagggtggcasccccagcccccacccaggagagccagaagcaggattcatcccctgtcctttctgctcaggggtctcgccttttaggtttctgataacagtatcagctaaa

SEQ ID NO: 41142 - DNA, 201 bp, Homo sapiens
gcaggattcatcccctgtcctttctgctcaggggtctcgccttttaggtttctgataacagtatcagctaaagctctgagtaggcaattgttgaggactcygtgttatctccattgatgacttccctcaaacctgcctatgaaaccgtctccatttcaggaaagcctctctaggtgtcccttccacatccacctaaaacag

SEQ ID NO: 41143 - DNA, 201 bp, Homo sapiens
caatctaaacttccaagcagccattatcaaatgatcacaattggcatctaatttgcatcctgtttgccttccctaaaagagaagaatcttctagagtcccrtgtcctccaatttatacaccccaaacatctctaatcaagaaccatgaacacaagtgaaaaataccagtggcatgccatcctgggcattagagtttcttcc

SEQ ID NO: 41144 - DNA, 201 bp, Homo sapiens
gcttcagaaaccccaaggaagtgttcagtataaagcactagtcttagatcagacagacctggatttaaatcctggctgtgatacttaccagctgtgtagcytaatgcaagttacttagccactctaagtccaatctctacatccataaaatggaaatagtatgcatttagagtcattatgaatatgaaataaacatagggg

SEQ ID NO: 41145 - DNA, 201 bp, Homo sapiens
ggagcactgatcaatgcgataacagtggcctttagtggtattggtaggtgtaagtgtgtgtgtgtgtgtgtgtgtgtgtgtgtgtgtgtgtgtgtgtgtgtttggggggatcttgagagaataagccactaagtcaaaggcagaaccttagatgccggcaaaagcaaaagggaaggaggagacacagggagacaaaaagag

SEQ ID NO: 41146 - DNA, 201 bp, Homo sapiens
gggctcaatccccactcgggcctgtggagctggtttctgagcaccatctcacattccaatcacattttagtggcttctgaaaatctgccacagcctgtagsagagtctgagaccacatgtgccccacttcccttcctcccagagcctggtgatgtgctccccacttaccccatcccttcacctggccaggcttcctcagtg

SEQ ID NO: 41147 - DNA, 201 bp, Homo sapiens
gttggagcactgatcaatgcgataacagtggcctttagtggtattggtaggtgtaagtgtgtgtgtgtgtgtgtgtgtgtgtgtgtgtgtgtgtgtgtgtgtgtttggggggatcttgagagaataagccactaagtcaaaggcagaaccttagatgccggcaaaagcaaaagggaaggaggagacacagggagacaaaaa

SEQ ID NO: 41148 - DNA, 201 bp, Homo sapiens
tggttggagcactgatcaatgcgataacagtggcctttagtggtattggtaggtgtaagtgtgtgtgtgtgtgtgtgtgtgtgtgtgtgtgtgtgtgtgtgtgtgtttggggggatcttgagagaataagccactaagtcaaaggcagaaccttagatgccggcaaaagcaaaagggaaggaggagacacagggagacaaa

SEQ ID NO: 41149 - DNA, 201 bp, Homo sapiens
agttgtaaacgcggcttagaggggggaaggagatcaaaacgcgggcgcggggctgctcgccgctcccagcgcgcacccagccaggcgccccgtgcggcccygcggcctcaccgctctggcgcgggacgcgggctctgtgagcgcccgagccgcccgcggagcccccgggtcgccgacacccgcaggcccggccggcggaga

SEQ ID NO: 41150 - DNA, 201 bp, Homo sapiens
catttgcatcactataaaggaatacctgaggctgggtaacttaaaaagaaaatatgtttaattggctcatggctctgcaggttgtggtgccagcatctgcwtctggtgagggccttaggaagcttacagtcagggcagaaggtaaagggggaataggcatgtcatatggtgagataaagagcaagagagagaaagggaaga

SEQ ID NO: 41151 - DNA, 201 bp, Homo sapiens
acaggggaagaatgtgtgtgacagagccccagccagttgagtaatgtttactctgttggtggctgggacgctcacttacgctggcagaggtccaccagccrgaggaacattcctgcattatcagggatgggaggttggctctgaaatgtcaagggtgaaaggcatcccaccagattctgggtgcagctcatagacttcagt

SEQ ID NO: 41152 - DNA, 201 bp, Homo sapiens
gtgcagctcatagacttcagtgaaaggaacccccaggtttcagtgccaaaagccacatcgtgggcaagctgagccccacattgcccaggaatccccacttycctcatttcttcttactaaaagaacaattctggtcctgttttctttgttgacattgctcttctgtttacccagcagaaccagtgcatctctgacattatt

SEQ ID NO: 41153 - DNA, 201 bp, Homo sapiens
atatgaagcgtttgcggggtacgtggcttgggttttgtttttagtgagaggtgatgcacaggctggtagttaggagcctgcaagcctgcaggctgggctcrtgtccaggctcctgccccaagtccacatgactttgggcaagtcacttcaccagtctgaacctcagtttcttcatctgtaaaatggaggtggctatacttc

SEQ ID NO: 41154 - DNA, 201 bp, Homo sapiens; identical to SEQ ID NO: 9153

SEQ ID NO: 41155 - DNA, 201 bp, Homo sapiens
cccacaactcattgtggaacttgagcaagtaaattaatatctccaagtctccgtttctttacacttgcctcccatggaatctcctatgtaacaggctcagyccggtgactgggacattgagcgggggctcaaatgatggcatccatccacctctccttatcccaggagctgtctgtgatcttttcctcttgctcccacagg

SEQ ID NO: 41156 - DNA, 201 bp, Homo sapiens
taatgccagcaggatttgcgggggttggggtgtgggcagggtgtgataaggccatggatgtgcagaggttgtggcaagcatggactcggccagaaattagrtccttctgaggctccctgttgtttgcaaagggaatccttaaggtcccagggcaaaaaaaaagggccacaggctgaaagggcttattgctcccccagattc

SEQ ID NO: 41157 - DNA, 201 bp, Homo sapiens
ccacaggctgaaagggcttattgctcccccagattccccaggaagagcactaaacaaggacagaagtttgataggttgctggagactggatgacatagagygcttaggcatttagattgagtgttccctaatagaatgatcaatggtccatggaaaaggtatttccaaggagggctcaggaggacagatcccctgctgagg

SEQ ID NO: 41158 - DNA, 201 bp, Homo sapiens
atgacatagagcgcttaggcatttagattgagtgttccctaatagaatgatcaatggtccatggaaaaggtatttccaaggagggctcaggaggacagatyccctgctgaggttcatgctttgcaagagggatccctgaggatccacaaagtagtcagcggagaaagtgagtaggaagtcagaggtcctgaggctgattcc

SEQ ID NO: 41159 - DNA, 201 bp, Homo sapiens
ctcagaaggtttacaagcatggcggaaggtgcagacagggcaggtgcatcacgtggtgagagtgtgagcaggagggagaagggagaggccctgccctgggytcttatttatttatttatatttttatgttttgagacagggtcccgttctgtcacccaggctggagtgcagtggcgcaatcacagctcactgcagctttaa

SEQ ID NO: 41160 - DNA, 201 bp, Homo sapiens
gtcatctaggggtgtagagaggtgggtggccttctcttgccgtcatgctcccagtgtctgtgtaggctttactgctgattgaggtgaagaagagttgaatsccccagtaagactccacaagtcgctcagagggaatctggccagagcaggagctagcacccttttcttccctgcaactcacaggggtaaagtcatagagtc

SEQ ID NO: 41161 - DNA, 201 bp, Homo sapiens
tttttgcattttttttgttttgccatgttgcccaggctggtctcaaactcctgcgctcaagtgaactgcctgccttggcctcccaaagtgctgggattacmggtgtgagccaccatgcctagccctagactcttttaaacagccagatctcacgtgaactaactcaagcatgaattcctcacccatcaccatgatccatta

SEQ ID NO: 41162 - DNA, 201 bp, Homo sapiens
tggccacctagacagctagtttgaagctgtggctccacactctcctagttcttaaaccatggacaattcactgactctcttttagccttgttttcctaatytgtcaaatagacataatggtatcctcatatagggttatggttggagcactgatcaatgcgataacagtggcctttagtggtattggtaggtgtaagtgtg

SEQ ID NO: 41163 - DNA, 201 bp, Homo sapiens
ggcacattggtgtgccaggtgggctcccaaggccttgggcagctctgttcctgtggcttttccatgctgaggttgcaagctgctagtggctttaccattcygaggtctagagggtggcaggcccattcccacagctccattaggcagtatcctggtagggactctgtgtgtggggcgggtggggctccaatcccacatttc

SEQ ID NO: 41164 - DNA, 201 bp, Homo sapiens
ttcatgggatcactgaaaggactaactgcacgaagacctgtaaaatacttcactcagcgcatgtcccaaaggaaacacccagcccatggaagctgggtcaytcttggcttcccctgctagcacccctgagcggctctgagtttgggaaaagggtcttacgtggcaaagggcatttatttccccgtgttgagggggttgaaa

SEQ ID NO: 41165 - DNA, 201 bp, Homo sapiens
ccaatcccacatttcccctcagcactgccctagtggaggttctctgtgggggctctgcccctgcagcaagcttctgcctgggcacccaggctttctgatamagcctttgaaatctaggtggaagctgccaaacctccttcactcttgcattctgtgcatctgcaggcttaacatcacatgaaacccaccaaagcttacaga

SEQ ID NO: 41166 - DNA, 201 bp, Homo sapiens
tccttctgcatctactgccatctgtcccttccagagcacatacgtctccctccttctcaactcttgggtgctggcaagttatctctgagtgggtttgtgcktgagttcaacaatgccccgctagtctggaaacaagaccacagcaaccactgacctcagttagaacaagtgcaggcaggttgtgagccaactcctgtttcc

SEQ ID NO: 41167 - DNA, 201 bp, Homo sapiens
agatcttctgggccaggcccccgtggggctgcgtgtgctgggcctccagttctaagggaccacagtgcaccccttatcagatgtttgtgtttagactctgraggaggcaaataactctagttcttttgacaacattttgggctctgccaccattttattatgtgagcaaacatttgatagctgggaagcccatccctaatg

SEQ ID NO: 41168 - DNA, 201 bp, Homo sapiens
ctcttgcattctgtgcatctgcaggcttaacatcacatgaaacccaccaaagcttacagactgcaccctctagagtggtggtctgagctgtacctggggcyctttgagccagggctgaagctagagcagcatgtatgcagggagcagtgtcccaaggctgtgcagggcagcagggcctttggtctggcccccaaaaccata

SEQ ID NO: 41169 - DNA, 201 bp, Homo sapiens; identical to SEQ ID NO: 9162

SEQ ID NO: 41170 - DNA, 201 bp, Homo sapiens; identical to SEQ ID NO: 9163

SEQ ID NO: 41171 - DNA, 201 bp, Homo sapiens
tttcaaagaggcctcgcctgattcccatatctaagttaatctctttttcctcaagctgccctaacctctatgcttatttttctatggagtgctcatctccmcctaaagttgtagtgtgtgtgtgtgtgtgtgtgtgtgtgtgcacgcatttgtttacttgtttattattcaaagccttcactaggaggtaaagcctgtgaa

SEQ ID NO: 41172 - DNA, 201 bp, Homo sapiens
ctcatctgtgctcactcctgggtgatctcctccagtcccatggctttaggtcaagtgtacacgccgatggttcctgtaattctgtgtacagtccggtcttmcctactgagtgctcactcacagatccagtgctgcttcggcagggacagacgcatgtctaaaatatctaataagcctcttgaattcaacgtgcctaaaata

SEQ ID NO: 41173 - DNA, 201 bp, Homo sapiens
acaactcattgtggaacttgagcaagtaaattaatatctccaagtctccgtttctttacacttgcctcccatggaatctcctatgtaacaggctcagcccrgtgactgggacattgagcgggggctcaaatgatggcatccatccacctctccttatcccaggagctgtctgtgatcttttcctcttgctcccacaggcct

SEQ ID NO: 41174 - DNA, 201 bp, Homo sapiens
gcttccattttggcctcatgtctaccccaaagttgtagcttagatggggggaaaattcagaattttgcatagaccataggtagcaccccctagaaaaagartgtttctccccagatgtctcccactagtaccctaaccatctgcttgtctgtctagtgaggacccttggagggctgctaaaatgatcaagggttacatgca

SEQ ID NO: 41175 - DNA, 201 bp, Homo sapiens
caataattgttattgagtgaatgaaggaatgaatttgagaactagtcatgccaaggaatcgctaagtcacatcgtgttggaaactgctctttgtggtccawgtccacccatgtttctcttgtttttttctctccatcagatctcagtctcaggaggaggtttgcccccagtcagcaccttgacgaatatccacagcctctc

SEQ ID NO: 41176 - DNA, 201 bp, Homo sapiens
aagtgataccaatgtgtagctaaatttgagaaccagttctaaggttctcaaatttagcttctcaaatgttaaagtgcatgccaattccctggggtgggggrtgttaggatacagattctcattctataggcctggggtgaggcctgggtttctgcattttcaacaagttcccaggtgctgttgaagaggatggtctgggac

SEQ ID NO: 41177 - DNA, 201 bp, Homo sapiens
acatcagcacctgagccaggagggctggcagcaccttggagacgaagcttccccagaaccctcttcctagagaggaagagcagcctttctctaacagcacsttccctcccagccatgcttaccatgctgtggcccacttgcccacgatgaccacggtgtgaccctagtcctggaatgtccggcacaataggggtggcagga

SEQ ID NO: 41178 - DNA, 201 bp, Homo sapiens
aagacacggagatggatcaggtccctccagctccaggaggctcatattcaacagcaagcctgtgccctcccatacatgggccatcttgaggcatgagaagkctgaagggaactgtggttgtggatatctctttgagagttttaatgttgatgagtattcagcatatttccagcttcactatgacagctcaggtgtcgttgt

SEQ ID NO: 41179 - DNA, 201 bp, Homo sapiens
cctgaccaacgtctcaagaatgtggaagggtcagaagcctgtctcctcacatgcacgcactgctcagcccccctcttttttttttttttttttttttttggtgagaccaagtcttgctctgtcgcccaggctggagtgcagtagcataatatcggctcaccacaacctccgcctcctgggttcaaacgattctcttgcctc

SEQ ID NO: 41180 - DNA, 201 bp, Homo sapiens
aagtggagaaaggacatgaatagacatttctcaaaagaggacataaaaataaccaacagatacatgaaaaaatcgttaccattactaatcattagagaaaygcaaaccaaaaccaaaatgacatataatcttataccagtcagaatggctattaataaaaagacaaaatacaacagatgttgctgaggatatggagaaaag

SEQ ID NO: 41181 - DNA, 201 bp, Homo sapiens
tttataattcaggtactgcaactactgtgacttacagtgagacaaaagatacgaacacaacagaaatttcagcaactagtggactagttcctggaggtattgagttcagtactgcaaactgttaatctcaactaacagccacactctttgtatctacagcttaaataattaatgcagcctttaactactatttctgcccca

SEQ ID NO: 41182 - DNA, 201 bp, Homo sapiens
gaagtcaactgcaaaaatggtaagggtttcttcttgttggttaagcaatggattgctctgaccagacccactcatggaatctctcttctttgtttctcttygtagtcaatcagtgcttgggccctggaaaattcaagtgcagaagtggagaatgcatagatatcagcaaagtatgtaaccaggagcaggactgcagggact

SEQ ID NO: 41183 - DNA, 201 bp, Homo sapiens
ggctagtaagttaggattaatgaataaagatcaatgtattagattttgggacaagaatcttgaacggaccaatcttgatgcattttcagtggggcatcctytctcttaataggcaatataacatgtagtcccgacgagttcacctgctccagtggccgctgcatctccaggaactttgtatgcaatggccaggatgactgc

SEQ ID NO: 41184 - DNA, 201 bp, Homo sapiens
agatcaatgtattagattttgggacaagaatcttgaacggaccaatcttgatgcattttcagtggggcatcctctctcttaataggcaatataacatgtastcccgacgagttcacctgctccagtggccgctgcatctccaggaactttgtatgcaatggccaggatgactgcagcgatggcagtgatgagctggactgt

SEQ ID NO: 41185 - DNA, 201 bp, Homo sapiens
gtatggctgttgtacctttatgagtaagtgcctctaaaaggtacagccagtgactacaatagtcaaactaaacatgaaattgtacttgagaacaatgctgstaacctcataatacagcagtataggtcaaatagcagatctctcccctagatatgtaccttgatcattccttttgcatatgataccatgaatacctaccag

SEQ ID NO: 41186 - DNA, 201 bp, Homo sapiens
ctctctttcaaacatacacactctctcacttaaagacacatttagttttcggcaaaacggcatctcagcgtgcgattgagaccggcatcccaaaccccacwtttgagcagcccaaacgtttggagcccctccgcttcatcactttctgagtggatagaggaggcccgaagaagatgctacctaccagcctctctcaggggc

SEQ ID NO: 41187 - DNA, 201 bp, Homo sapiens
gcatgtgactcaaatacttctaagccagagttgttcctggtgttcaattgttgtagatactgaacatcaatattggatgcaaaggttttggctccttaccygatgggtaaatttctaagtctgaatacagatccttctaaactgattccttttattcctctgtagggatcaatgtgaccacagcagtatcagaggtcagtg

SEQ ID NO: 41188 - DNA, 201 bp, Homo sapiens
aacttagttcagcagtggtttgtctattttacctggttttaaaataaccttttacatggcttgtctggacaaaacagctagccatgctggaaccctggcaytaaccaggttcttggtttttataattcaggtactgcaactactgtgacttacagtgagacaaaagatacgaacacaacagaaatttcagcaactagtgga

SEQ ID NO: 41189 - DNA, 201 bp, Homo sapiens
ttgaacccgggtggcagagatttcagtgagccgagataacgccactgcactccagcctgggctacagtgcgagaatccatctcaaaaaaaaaaaaaaaaaattgctacaaagatgaggtgaaggtaccctcataggcctagggaacagggacctttataacctagagtctttcaaagtattctagctagtaaaacaaccag

SEQ ID NO: 41190 - DNA, 201 bp, Homo sapiens
atgttagaacttaatagttctcccacatgctgtgaataaacagggtttctattttatagactgcctctaatctttcattttcttaagaaagacttccccasatctgaggtattaactgatctgtatgttcactaagtaggttgcagattgatgttggtcatctttgtgcatcttctggaaaccacttaatgtacatctact

SEQ ID NO: 41191 - DNA, 201 bp, Homo sapiens
ccattaaaaagtggagaaaggacatgaatagacatttctcaaaagaggacataaaaataaccaacagatacatgaaaaaatcgttaccattactaatcatyagagaaatgcaaaccaaaaccaaaatgacatataatcttataccagtcagaatggctattaataaaaagacaaaatacaacagatgttgctgaggatatg

SEQ ID NO: 41192 - DNA, 201 bp, Homo sapiens
gtgtgtgtaatgcctggctaatttttgtatttttagcagacactgggtttcaccatgttgaccaggctggtcttgaacccctgacctcaggtgatctgccygcctcagcctcccaaagtgctgggattacaggcatgagccaccgtgcctggcccaaactggttcttacaatgtttcagaggctgactttaaggccagagc

SEQ ID NO: 41193 - DNA, 201 bp, Homo sapiens
gtagaaacactaaaaaaggactaacatgaacacagtttaggtctaaagtgtgattatgaaagaaaatcaaatagaaaggaagataaggctgttactttcarttttctagataagaagtgaggggagtaatattggtcaaggcaagtgagttcaaggcctgtgagctaaagacaggttgtgtaaagattcagcctcaacttt

SEQ ID NO: 41194 - DNA, 201 bp, Homo sapiens
gtttcactcttgttgcccaggctggagtgcaatggcactatctcggctcactgcaacttctacctcccaggttcaaacaattctcctgcatcagcctcccmaggagctgggattacaggtgtgtgtaatgcctggctaatttttgtatttttagcagacactgggtttcaccatgttgaccaggctggtcttgaacccctg

SEQ ID NO: 41195 - DNA, 201 bp, Homo sapiens
tacataggtaaaaactgaggctacaaacaatctatggttccaaatcctatgtgcttactgccgtcttctcttagaaggggatgcagtactgtacaaagatygagctggatgtcgcattgcatgtttgctgagtcctcctcattgctgatgttaggatccttcaacagtttctcagatgccagctatggctggcatccagta

SEQ ID NO: 41196 - DNA, 201 bp, Homo sapiens
aatggaaattgaatgtaactgacaattgaactgtaaaattcacttatttccatgactcagaagaattagcctacatattcaccactttttagtggcccccraactagtgtttttgttgctgtttgtttgtttgttttcgagatggagtttcactcttgttgcccaggctggagtgcaatggcactatctcggctcactgca

SEQ ID NO: 41197 - DNA, 201 bp, Homo sapiens
tgagggtgttattggtatatgctacaaccctgaaaatgaaagagccacttacattatgggtagaagctgtagcttcttaaccttagtgcagtggttctcamagtgtggaccgaaattggcaacattaattcaatgttaattgagttcatgtgtcaacattgactcattagaaatgcaaacttaggccctgttctagacctg

SEQ ID NO: 41198 - DNA, 201 bp, Homo sapiens
aaagatgacagagactcagaagtagggggaaagggagagcagatgaaaggaagtgggttaaagaatacaaacctacagtaaggtagaagaaataacgtcartgactgtagttaacaaaaacgtgctcgcgtgatggacaccctaaatcctcggatttcatcagtatagattcattacatacatgtaacaaaattttacatg

SEQ ID NO: 41199 - DNA, 201 bp, Homo sapiens
gaatccatctcaaaaaaaaaaaaaaaaaattgctacaaagatgaggtgaaggtaccctcataggcctagggaacagggacctttataacctagagtctttsaaagtattctagctagtaaaacaaccagtcacacttggtttcaagttctgaaaaagctgggggaaatgtttttgacaaaagtttttagttcagaccagct

SEQ ID NO: 41200 - DNA, 201 bp, Homo sapiens; identical to SEQ ID NO: 9179

SEQ ID NO: 41201 - DNA, 201 bp, Homo sapiens
tcaggaggctgaggcaggagaatcgcttgaacccgggtggcagagatttcagtgagccgagataacgccactgcactccagcctgggctacagtgcgagamtccatctcaaaaaaaaaaaaaaaaaattgctacaaagatgaggtgaaggtaccctcataggcctagggaacagggacctttataacctagagtctttcaa

SEQ ID NO: 41202 - DNA, 201 bp, Homo sapiens
ctcttcctctgtagcacatctaaattcctatttgtctctcaaggcccagttcacatatcctttctttaccctcccagtctatgctccaaatgaagagagakaaccatacggcaatttgtctgtctctgtttatcttttgctcaaacactgtggtatacagccaatctttcacatcctccttacgttttctaagacttaaaa

SEQ ID NO: 41203 - DNA, 201 bp, Homo sapiens
attaccaagaacttagactttaatttcaaaaagccagaaataattctatgtctgcagataatcctacaaaagtgatatgactaaagcaacaatggattacwgccagtattaccaaagagcattaaaacatgtcagaagtaaaatctgcgtctgatatatcacactcaactttaccagttagccgctgctaaccttctcagg

SEQ ID NO: 41204 - DNA, 201 bp, Homo sapiens
gaagattgctatttcaatgttgacacatcagctgtacaacttagttcagcagtggtttgtctattttacctggttttaaaataaccttttacatggcttgyctggacaaaacagctagccatgctggaaccctggcattaaccaggttcttggtttttataattcaggtactgcaactactgtgacttacagtgagacaaa

SEQ ID NO: 41205 - DNA, 201 bp, Homo sapiens
ttttgcatgaagattgctatttcaatgttgacacatcagctgtacaacttagttcagcagtggtttgtctattttacctggttttaaaataaccttttacrtggcttgtctggacaaaacagctagccatgctggaaccctggcattaaccaggttcttggtttttataattcaggtactgcaactactgtgacttacagt

SEQ ID NO: 41206 - DNA, 201 bp, Homo sapiens
aaagtaaggcattttgtgtttcaaccacaagtagaacctacaacaagcaatataataagacacaagcttggatttttaagaattctgtcttagctaattcwttgaatagatttgagaagatatctgctattgtatgccgggttatcatgtcatttctttagaactgactttaacccatttcaacattaaatgagtttatag

SEQ ID NO: 41207 - DNA, 201 bp, Homo sapiens
tgacaattcttttcctacctagaccttataaaaagtcgcctctattggcttgattctaagttgcacatgttatccagcgtggacttgaatggccaagatcrtaggatagtactaaagtctctggagttcctagctcatcctcttgcactaacaatatttgaggtaagatgtgtctcacatcaaagtgtgtacctttgagct

SEQ ID NO: 41208 - DNA, 201 bp, Homo sapiens
ctcattactgaactattaaatccattgcctactggatatttgaaagtaaattagcatatcatatataggggagttggcttaaagtcagtgtattgagtaasattcacttagccaaaattattatatgctttgctttaaaaaggtatcccaccgcccttagtatagctagcttttcttccagcaatagtcactcacttgttc

SEQ ID NO: 41209 - DNA, 201 bp, Homo sapiens
tatatttaaacaccaaagacttaaaacttgcatatcttttcctgactgatcttaaaggtttctagtagagaactgtcagtgaaatggctactacagcatgkgactcaaatacttctaagccagagttgttcctggtgttcaattgttgtagatactgaacatcaatattggatgcaaaggttttggctccttacctgatgg

SEQ ID NO: 41210 - DNA, 201 bp, Homo sapiens
tagagacaaacagaagattgcttagaaggggcttttttccccttttaattttcaaatggctctgatcctagaaaagaaggcaagccatggacatgagaaaatcccataaagtttcagggggttaattaacccttgacatagaaactacaagccagcacagatcaaagatcagataaggattcttttttaattctctgccta

SEQ ID NO: 41211 - DNA, 201 bp, Homo sapiens
ggccacttttagaatcaattgtggttctcatctcaaattaatttccagtcttcaactattttcttggttctttatttctgttcttcttatttattgtgtgscttcattttttgtacaatgagactgtacaaaagttcttgatttaactccattgtagcctttaagttgggctagtaagttaggattaatgaataaagatca

SEQ ID NO: 41212 - DNA, 201 bp, Homo sapiens; identical to SEQ ID NO: 9180

SEQ ID NO: 41213 - DNA, 201 bp, Homo sapiens
attcctctgtagggatcaatgtgaccacagcagtatcagaggtcagtgttcccccaaaagggacttctgccgcatgggccattcttcctctctgtaagtakatttcctacaagtctgggttcaagaacttcttagataccagatgaagattttttgttcatctggagctacccctttcatgggcctttatgctgtctagca

SEQ ID NO: 41214 - DNA, 201 bp, Homo sapiens
ctataatcgttgatgagcaaatgcaaagctgcgctagcaatttcccttctcctcatcccaggctgggttatttcagtcttgttctattacagaggaccagmcacaaccgcgcgcactctctttcaaacatacacactctctcacttaaagacacatttagttttcggcaaaacggcatctcagcgtgcgattgagaccggc

SEQ ID NO: 41215 - DNA, 201 bp, Homo sapiens
gagcccaccttaatgacctcattttaacttgattacctctgtaaatatcctatcctcaatatctccaaataagatcacattctgaggtactaggacttcawtatatgaattttagggaggaacaccattcaactcataacacctactttccccctgtgacacacctgatataggattgtgtagattctcaaacacatcggg

SEQ ID NO: 41216 - DNA, 201 bp, Homo sapiens
agagatcctttgcctactttgtagtttagagatgctggaaactataagatgaagcctctggctagagcagctgattttgccaacttgggggccatctgggkagcctttatgtatgtagacgaggtggtggggatggggggacttgcaatttgccaaccaagggacataacaaagcctcggcgatagacagcatttgtgagt

SEQ ID NO: 41217 - DNA, 201 bp, Homo sapiens
gtgtctactggatagatggggaaaatgaagcagtctatggtgccaataaattcactggatcagagctagccactctagtcaacaacctgaatgatgcccargacatcattgtctatcatgaacttgtacagccatcaggtaccgtggagaagcacagtccttaataactactttaagggaagcagcatgacacagaacctg

SEQ ID NO: 41218 - DNA, 201 bp, Homo sapiens
tggcttttaagtaaaaatcatctcaattttactgtctgcatttttcaaactaaatcagtgtctctttgctaagttcgtctattggcttgcaacaaaaactstaaacactgttaataccacttagttaagtacactaactgcactgcaggaaccaaatgagatggcaggtgataacacaggttaagtgtcctttatctgaaa

SEQ ID NO: 41219 - DNA, 201 bp, Homo sapiens
tttactggtcagactggggtgaaccagctaaaatagaaaaagcaggaatgaatggattcgatagacgtccactggtgacagcggatatccagtggcctaayggaattacacttggtatgtatgttcttccttctcgaccacccactcaactatcttcatagtgtttccatttatctccatggtgaattctggactagcaga

SEQ ID NO: 41220 - DNA, 201 bp, Homo sapiens
tagcaaaggtgacagtctccatgctcaaaagaagtgaagacctgatccaagtgtctctacctgtcataaaattgaataaccgtaaacttgacttgagtagkttcattacagttttggaagaggaaaaaagttgttacaagccccttctgctccaggagaggtatcaaattgataagacttaacaagaactcctagagtaga

SEQ ID NO: 41221 - DNA, 201 bp, Homo sapiens
agattggcttagagaggaaagaatatatccaactagttgaacagctaagaaacactgtggctctcgatgctgacattgctgcccagaaactattctgggcygatctaagccaaaaggctatcttcaggtaactttcagttccttttgtggtgtcttgacataagtcattgtcacttgggaagtgatctgtgggatagtttg

SEQ ID NO: 41222 - DNA, 201 bp, Homo sapiens
cgggcttggggaacagcggggttcggggtgccccgacgcctcgcctgaactagtcttctgcccctcactccgcctcccccagagccgctgctttgcctcgyttctcgccctcttgacgggcgccgaggtgcgtgggcttctgagcattgaacaatggttctgcctcctctgccaggcgcagtgttgggaaggaggcagagg

SEQ ID NO: 41223 - DNA, 201 bp, Homo sapiens
caggcgggcaccatgggcacgtccgcgctctgggcgctctggctgctgctcgcgctgtgctgggcgccccgggagagcggcgccaccggaaccggtgagtraggacgcgcccctccgccggcgggcgggacccagccggggcaccgggagaccccgaggcgtaggtctccgtttgcccacccgcctcctaggaggcgcctc

SEQ ID NO: 41224 - DNA, 201 bp, Homo sapiens
tgttgatagcttgtatattacaactaaattcagagaccctctttaaggcaatagtagagtaaatatcagccttgggatactgtatgcccatacttaatccsaggccactctgagtgcctaggaaatctgtagcttcaaactcattcttaaggaggttgtcttccaggtaccttaaccctgaggtgggaaactatcaattga

SEQ ID NO: 41225 - DNA, 201 bp, Homo sapiens
atcagccttgggatactgtatgcccatacttaatcccaggccactctgagtgcctaggaaatctgtagcttcaaactcattcttaaggaggttgtcttccrggtaccttaaccctgaggtgggaaactatcaattgacattgacctttaagttgctattcaaatctgattacaaggtttccattttgattatgtagatatc

SEQ ID NO: 41226 - DNA, 201 bp, Homo sapiens
caatgtattagattttgggacaagaatcttgaacggaccaatcttgatgcattttcagtggggcatcctctctcttaataggcaatataacatgtagtccygacgagttcacctgctccagtggccgctgcatctccaggaactttgtatgcaatggccaggatgactgcagcgatggcagtgatgagctggactgtgccc

SEQ ID NO: 41227 - DNA, 201 bp, Homo sapiens
ttaaaaagtaattattctctttgtgttgcacaagtctttttttaccatgtgactcagtaggaactaacctgggtcaacttgggatttttctaaaatagtcytgtataagtactctctactagccacatggtaggagagtttggcaaagaaaaagaggtagatgtatatctaatcaagatcatttgaggcaggaaaaattat

SEQ ID NO: 41228 - DNA, 201 bp, Homo sapiens
gataaggattcttttttaattctctgcctacaatagttgctaattctaaagcattagcagggcggaagacattctctccccaagagaatggggatacagtrtcacagccatcaatcagcatctattaaaagatcactgtgagaaatgcctatgtatgcaatctatacaacctcatgtcaagccaaaatagctgagaactgc

SEQ ID NO: 41229 - DNA, 201 bp, Homo sapiens
tatgttctcaatcgtatgtggaagcttaaatatttcattccatggaggtagatggtagaaagatgacagagactcagaagtagggggaaagggagagcagrtgaaaggaagtgggttaaagaatacaaacctacagtaaggtagaagaaataacgtcaatgactgtagttaacaaaaacgtgctcgcgtgatggacaccct

SEQ ID NO: 41230 - DNA, 201 bp, Homo sapiens
tagtaccccttatcaaagactgatcactcatgtgagcagggactgcgtaaaggaaggtcaccagccaagccctccttggcagtaacagcttcatgaaatcyagtgtagctttgttccctggatcaccctcttgcccactttatgtggcatttacctatagtgcctgtcctgtgtcattttgattgtttgcttttatggcct

SEQ ID NO: 41231 - DNA, 201 bp, Homo sapiens
ccgctacagggaaaattagacaatggcggctgacttctatatgcattaaaaaccctgagtttccctctaggacattggtctagacaaggaatttatgaaaragacctcaaaagcttaggccacaaaaacaaaatagacaaatgggacttaattaaactaaaaagcttctgcacagcaaaagaaataatcaacaaagtgaag

SEQ ID NO: 41232 - DNA, 201 bp, Homo sapiens
tttagattttttcagattttgggacattcacacatacataataaggtatcttggggatgggacccaagtctaaacatgaaattcgtttatatttcacatayaccttatacacatagcctgaaggtaattttatagactatttttaatgattttgtacaagaaacaaagttttgactgcaacttgtcacgtgatgtcaggtg

SEQ ID NO: 41233 - DNA, 201 bp, Homo sapiens
tgctaggaatgcacctaaactactgacatgagttagtcaaagccagatgttcaccttgtattgggcaggtgaggatccttttcactttgtcacatgtgaartatttgacatgccatgaacaatggaaaaacaaattcttcaaaggagaggaagcagattcttccagaactggaggaaatttgggctgaggcagttattgac

SEQ ID NO: 41234 - DNA, 201 bp, Homo sapiens
gggatgggacccaagtctaaacatgaaattcgtttatatttcacatataccttatacacatagcctgaaggtaattttatagactatttttaatgattttrtacaagaaacaaagttttgactgcaacttgtcacgtgatgtcaggtgtggaatttccacacttacggcatcatgtcagcactcaaagttttggattttgg

SEQ ID NO: 41235 - DNA, 201 bp, Homo sapiens
gacaattatccaggaaggtgagagaaaagtttcgtttttgctgcatgtcccttccactagaggttaactttaccttatagaatgctaggaatgcacctaawctactgacatgagttagtcaaagccagatgttcaccttgtattgggcaggtgaggatccttttcactttgtcacatgtgaaatatttgacatgccatgaa

SEQ ID NO: 41236 - DNA, 201 bp, Homo sapiens
actgaggtattccacaatacctttattttctaagtgctcctctgctgggaggaggtggtttagaaagaccttgccttcttaaagcaaaactaagtaacccwgacttccatcttgcaggcaaagagccaagtctgatcttcactaatcgaagagacatcaggaagattggcttagagaggaaagaatatatccaactagttg

SEQ ID NO: 41237 - DNA, 201 bp, Homo sapiens
ccggagcgtgtgaactgggactggcctttccgccctctgcgattggttagcggtgcgatcacgtttaggttggtcacatggttccgcggactcttaagtgrgcagcatgggcagtgttattttcaatggaaagtaggagactccacaggctcttacgggctgttctctcaaatgccttcccctgcctggactctttgaaga

SEQ ID NO: 41238 - DNA, 201 bp, Homo sapiens
tattgagtaagattcacttagccaaaattattatatgctttgctttaaaaaggtatcccaccgcccttagtatagctagcttttcttccagcaatagtcastcacttgttcttcagatgaaacccaagtggagtatttggccttcacgtaggaaacaggctgaacaaaacaagtattgatcactcccctctcaaactccgg

SEQ ID NO: 41239 - DNA, 201 bp, Homo sapiens
gttgtcaagtgactactacatttttattccagatataaacgaatgcttggtaaataatggtggatgttctcatatctgcaaagacctagttataggctacragtgtgactgtgcagctgggtttgaactgatagataggaaaacctgtggaggtgagtctaagaagaaaacctggaccctgcaggtgatgggaaaggatag

SEQ ID NO: 41240 - DNA, 201 bp, Homo sapiens
taaagcatgtggtcaaggagcctgtcgggcagcgcctggggtttttacgtctccgaatgcccctgccctttggttgccactgtccggagcgtgtgaactgrgactggcctttccgccctctgcgattggttagcggtgcgatcacgtttaggttggtcacatggttccgcggactcttaagtgggcagcatgggcagtgtt

SEQ ID NO: 41241 - DNA, 201 bp, Homo sapiens
gtgaattctggactagcagatgactctactgcttccgcctaaattctagcaggaattttcaatgggagtaactgaacaacacaagtaaaatggtggattarcaaattacacattccataattactggcctgttgtccagctgggcctaatatgtgacacaaattcagtgaacgttgggtcttgggtgcactcatactaaat

SEQ ID NO: 41242 - DNA, 201 bp, Homo sapiens
aaaaggcggttacaagtgtgaatgtagtcgtggctatcaaatggatcttgctactggcgtgtgcaaggcagtaggtaaatgaacttggactggtatggctrttgtacctttatgagtaagtgcctctaaaaggtacagccagtgactacaatagtcaaactaaacatgaaattgtacttgagaacaatgctgctaacctca

SEQ ID NO: 41243 - DNA, 201 bp, Homo sapiens
gtgagtctaagaagaaaacctggaccctgcaggtgatgggaaaggatagtatgtacctagtaaggtataggagcagcaagactaattctgatttccctccyagatattgatgaatgccaaaatccaggaatctgcagtcaaatttgtatcaacttaaaaggcggttacaagtgtgaatgtagtcgtggctatcaaatggat

SEQ ID NO: 41244 - DNA, 201 bp, Homo sapiens
tattctagggagaaaagccaaatgtgaaccctcccaattccagtgcacaaatggtcgctgtattacgctgttgtggaaatgtgatggggatgaagactgtrttgacggcagtgatgaaaagaactgtggtaagtaaagagtttgatgacttatgcattttgttaaaatatgatgttatcttagtctgcaaatgtattgaga

SEQ ID NO: 41245 - DNA, 201 bp, Homo sapiens
gaagaaaacctagacaatttcttaatagaacccttttcaaattcttacaccaaaatccaatattcaaaagaaagtcttggtagaggcagaggtggaacacmcagggcctctgctactgtggcctttccctccacttcaaccacccctctagcctgaggcattcttgtgaaacctcatggctttaaggaacccactaacaat

SEQ ID NO: 41246 - DNA, 201 bp, Homo sapiens
tatgagtaagtgcctctaaaaggtacagccagtgactacaatagtcaaactaaacatgaaattgtacttgagaacaatgctgctaacctcataatacagcrgtataggtcaaatagcagatctctcccctagatatgtaccttgatcattccttttgcatatgataccatgaatacctaccaggtttgcatgctctgtttc

SEQ ID NO: 41247 - DNA, 201 bp, Homo sapiens
gtaccttaaccctgaggtgggaaactatcaattgacattgacctttaagttgctattcaaatctgattacaaggtttccattttgattatgtagatatcartgtcaatgttgttgtctcattttgacttaataacctttggtaactaaaaccttaaaaaaaaaatcagaggctttcagtctttactgtatcttaactccaa

SEQ ID NO: 41248 - DNA, 201 bp, Homo sapiens
ctgtggctctcgatgctgacattgctgcccagaaactattctgggccgatctaagccaaaaggctatcttcaggtaactttcagttccttttgtggtgtcktgacataagtcattgtcacttgggaagtgatctgtgggatagtttggaggagtttcttttgtgtctagccccatctagcatcgaattacctggggacatt

SEQ ID NO: 41249 - DNA, 201 bp, Homo sapiens
tatctgcaaagacctagttataggctacgagtgtgactgtgcagctgggtttgaactgatagataggaaaacctgtggaggtgagtctaagaagaaaaccyggaccctgcaggtgatgggaaaggatagtatgtacctagtaaggtataggagcagcaagactaattctgatttccctcccagatattgatgaatgccaaa

SEQ ID NO: 41250 - DNA, 201 bp, Homo sapiens
tactattcagccatgaaaatgaatgaaatcatgccatttgcagcagcatggggatggaattggaggtcattatgctaagggaaataagccaggcacagcargacaaatatcttatgttctcaatcgtatgtggaagcttaaatatttcattccatggaggtagatggtagaaagatgacagagactcagaagtagggggaa

SEQ ID NO: 41251 - DNA, 201 bp, Homo sapiens
aagctattactgaagaggtaaggtagctagtaattgggtgatatagtgactcctgacacacatgtaacctcaagttactaaaatggagatcttacagcatrttcttaaataagagaaacttcataggtatgcaagtatatacctgtgtccttaggaaaaagtctatgagaccataaagaatgatggtttgggatcatataa

SEQ ID NO: 41252 - DNA, 201 bp, Homo sapiens
gcttctcctctcccttttccccgcctcgggcggcgtttggaaaccgctcgggtctcccgtgtagctgaacgcggagggggagtggaggggagacttaatcwggttagtttgctgaccctccttcccggtgacgtttcctcgagaggaattgagtcctaggctagtgactgtaattagccttcattctacacaatagctcaa

SEQ ID NO: 41253 - DNA, 201 bp, Homo sapiens
gcctcgggcgcaccctcgaaccccggggagtgcgggagcggacggggggagaaggtgagcgcctccggggacgcggagcgccaggggccggccgggcttcwgagtcttccggcggccgcgagctggcgcacgttcggtgggcggcggccgggaggctccgcggagccgagggcacccggactgcgactcccccggcgcggg

SEQ ID NO: 41254 - DNA, 201 bp, Homo sapiens
agggagccgggcttggggaacagcggggttcggggtgccccgacgcctcgcctgaactagtcttctgcccctcactccgcctcccccagagccgctgcttygcctcgtttctcgccctcttgacgggcgccgaggtgcgtgggcttctgagcattgaacaatggttctgcctcctctgccaggcgcagtgttgggaaggag

SEQ ID NO: 41255 - DNA, 201 bp, Homo sapiens
gttctgccggaggctgccgggagggtacagtaatgactgtagggagcgcacagccgctgcggcggcaggttccctggatcaggaaattaggacaggcaccsgggattggaggcgagggcggcgcgcgagccaaccagcggtcgccccgggcccccgtgagccccaggcgaacgcgcggagcagccgggcccctagagcggt

SEQ ID NO: 41256 - DNA, 201 bp, Homo sapiens
aagatgaagaaaactgtggtaagaagatcagtgttgagtgacgtaacccaaagacccttttcctaaaggaagggtgggcaggggaaactaatctaagcctraagacgcactgacattgactcacttttcagtgacttcactatctgctcaattacttgtccttcataactgccctaaaaccctaaaagacattcatgtggc

SEQ ID NO: 41257 - DNA, 201 bp, Homo sapiens
aaaaattgcatggtaaccctaagtataggggaaagacctgccccaggaagaattagcaacagaatcaattcctctccttaggctattttaacattagcagkcagttatggatattagcactgacagcttcaatgacttttagctggttgatgttagcctaccccttggctagaaaggctaaaatcttctctcccttgaatt

SEQ ID NO: 41258 - DNA, 201 bp, Homo sapiens
gctactccctcttttgtagcttccaaagaatatcacaggttgaattatagcaactaaccctgcagaccctctgacttcttcctccatgctcaggagaacayagaccttgaatagcacttaattcattaacattagtgtttgagtttttcagtgattttagaaacaggcatgaatctaaagctagcatggccagtcttgttt

SEQ ID NO: 41259 - DNA, 201 bp, Homo sapiens
gtgcggggtaggggagcggcggggctttacgcaggactctgctctgggcgcttctcctctcccttttccccgcctcgggcggcgtttggaaaccgctcggstctcccgtgtagctgaacgcggagggggagtggaggggagacttaatctggttagtttgctgaccctccttcccggtgacgtttcctcgagaggaattga

SEQ ID NO: 41260 - DNA, 201 bp, Homo sapiens
gtagaaatacagaagaaaagtagagtctaaatgtaggtttcatcaactgccatcttgttatgcctttacctacttcttcatgcatcattattaaaatgctrtaaagtatgcatcatggcagaccttgttctacacctgatctctcagagcagtatcacaggtgttttcatgccaatgtgtaaagcagatcagtagctcctt

SEQ ID NO: 41261 - DNA, 201 bp, Homo sapiens
acaggcatgagccaccgcgcccggcccaaactagtttatagtttaacctccttaaagataactgatcatcaatagagaaacttgactaaatgcttgaccarctggtaacttgccgaggagttagataatccaccctgaaatatatacctataaaataaatgattaggtcttagacaaatcgtgggtttgaccaggccaact

SEQ ID NO: 41262 - DNA, 201 bp, Homo sapiens
gttgctaattctaaagcattagcagggcggaagacattctctccccaagagaatggggatacagtgtcacagccatcaatcagcatctattaaaagatcaytgtgagaaatgcctatgtatgcaatctatacaacctcatgtcaagccaaaatagctgagaactgcatggcaagattacatttacataccatgaatacatg

SEQ ID NO: 41263 - DNA, 201 bp, Homo sapiens
agcttaaatatttcattccatggaggtagatggtagaaagatgacagagactcagaagtagggggaaagggagagcagatgaaaggaagtgggttaaagaatacaaacctacagtaaggtagaagaaataacgtcaatgactgtagttaacaaaaacgtgctcgcgtgatggacaccctaaatcctcggatttcatcagta

SEQ ID NO: 41264 - DNA, 201 bp, Homo sapiens
gtctctgggcaatctggattccttctattttcgtctggctccatttgcccgagatcactattccagccaccatgcccaattttcaggtaccaggaatgaasagatggaaagaaaatggatcctctatcctcttaaggacatttcccaaagttgtatataccattttagtttacattccattagtcagaatgtagccccttg

SEQ ID NO: 41265 - DNA, 201 bp, Homo sapiens; identical to SEQ ID NO: 9178

SEQ ID NO: 41266 - DNA, 201 bp, Homo sapiens
ctcatggctttaaggaacccactaacaattgcattttgccccatcttctcacctgtctgagcagaaatgcctagcacttctacttccaaggtattttttgmggtgtcattggctttagtttagcctgaagaattaaaagaatctcgagtgtagatgatttcaagctcaacttgttccctttatgaaagtataatactgaat

SEQ ID NO: 41267 - DNA, 201 bp, Homo sapiens
ttacatgtacctcataaatttatacaaacaccaccaagaagaaccctgtttttcttggagccagtgaactgccaatgtgtctgtgtagcaaagttaactayttagagaagcaaggctcccaggaaaataggtccttgaagttagtgtgcatattctatagtctgattccatctatataagtgacagtaaaagtgagaattt

SEQ ID NO: 41268 - DNA, 201 bp, Homo sapiens; identical to SEQ ID NO: 9212

SEQ ID NO: 41269 - DNA, 201 bp, Homo sapiens
ctgcagatacatgactaacaaggatagctggccatgcccagggctggtgttggttgaggaggtggtgatggtgcggggcatgtgtgtgtgtgtgtgtgtgygcgcttgaggagttgtggaagtgttcatatctgtaaagtattatttcatggatgcagaccttaatgctaggttgaataactttgttgccatagaagaaga

SEQ ID NO: 41270 - DNA, 201 bp, Homo sapiens; identical to SEQ ID NO: 9215

SEQ ID NO: 41271 - DNA, 201 bp, Homo sapiens
aaaaggggcctcaggaatcactgacattggaaccaaggtttgtctgcagcttgtcggtttctgggacagaaacccaacatactggagtgggtatcccagcratctgtaggataaaccaggacactgtggtgtcatggatagctggctgtctgccaggtgatggcccctctggttgcaatgtgagccgggcaggtcatccat

SEQ ID NO: 41272 - DNA, 201 bp, Homo sapiens
ctcccaaagagctcatccctaatgtgacatcctggaatcagatggcacggacaccggcccagccccttcccagctctgtgactaaggacaagtgacacccyccctcccccagcctcggtctcctcctgtgtacattcagaaggcagatgctgccatgaggccatgtgtgctatgtccatggtgcaaggtggcacgcatgcc

SEQ ID NO: 41273 - DNA, 201 bp, Homo sapiens
cgctaatgaggaggagcgtctctaccctgcagctgtctgtactcctgtgtcttccgtaatgtgccaagctctctgaatatatgcaaaactagtctgcaaaragccatatgtctcagcatctggctttatttctaagtgttcaggtggaatttaagccgcgatcaaatttacaatgtcactgccagctctggacacttactt

SEQ ID NO: 41274 - DNA, 201 bp, Homo sapiens
aggctgggggagagtgctgcccccgcctggagcccaagtctctgcgtgcctgggggtagagcgcggagagggaccaggcaggcgccggaggggacccgcgmggaaaaggaagaagcccaaacaaaaacgctgtccggcgccaggcgcccacctgcaagcccaagccggtgctcggccagttacaaaagaaatggtcaggat

SEQ ID NO: 41275 - DNA, 201 bp, Homo sapiens
atactcatcttccagaaggcgtcttattcctcctcgacaaaaaaaaaatgtgttggtattaaaatgctttgaggtaggctggatgaacccagcttagtgargatgacatgaaaacccttagctaatggggtctttattgagtagaactcaggtaagttcagatgtaagcagtgtctctcagtaaacatgaaaagactgaag

SEQ ID NO: 41276 - DNA, 201 bp, Homo sapiens
aagggaagcacattcaggcccacatgaaacttgggacagaagtggcttctcagagccgtgcaccaggcactttgaacaagttggaaggctacagtgccggragactccacagtagcacaggcgaagtggcttaggcgaaaacgctgggaagtaccccagctcccgggggccagagcctctagggctggcagcctcagcagg

SEQ ID NO: 41277 - DNA, 201 bp, Homo sapiens
tgccttaagattttccttaagcttttggaaatgtataatgtttgagaaaaaagaaaaagaatagactgagtggaatcgtatctagtttcagttaataacaygtttcagttgatgttactgttatagctactgggcataaagtctccttcccttttttgaatcctatttttgaggcattgaagctgtgtctgtaagagacaa

SEQ ID NO: 41278 - DNA, 201 bp, Homo sapiens; identical to SEQ ID NO: 9213

SEQ ID NO: 41279 - DNA, 201 bp, Homo sapiens; identical to SEQ ID NO: 9214

SEQ ID NO: 41280 - DNA, 201 bp, Homo sapiens
cagaccttaatgctaggttgaataactttgttgccatagaagaagaaccgcacgtcaggcttttttcattagcaaaccagtaagcactcactttgggcctytgaaatcacttccatcacctaacaccagagatacaaactgaagctagcccttaagagcctccccctaagatttagagagaatgatttctcaaccagtttt

SEQ ID NO: 41281 - DNA, 201 bp, Homo sapiens
ttcccatggtgtcccccaatcacttaggaatttagcctgtgtctaaagaccctctctgcagcctgacgtggctagccatcccagtacttccacgtttttcrtgcctttctccaacagcgttgccgtggccccttaggcggcgatcgttttatcaatggtcgctccctctttttatctgttggcaggagccctttttcaacg

SEQ ID NO: 41282 - DNA, 201 bp, Homo sapiens
tcccggcaactccagacaccaaatcgcttcccatggtgtcccccaatcacttaggaatttagcctgtgtctaaagaccctctctgcagcctgacgtggctmgccatcccagtacttccacgtttttcatgcctttctccaacagcgttgccgtggccccttaggcggcgatcgttttatcaatggtcgctccctcttttta

SEQ ID NO: 41283 - DNA, 201 bp, Homo sapiens
ggacttgggcgcgccacggcggccggagcgctccacatcagcacccctcccccagagccgctgcaggaacagggaggaggccttttccaccgcacccggarcgtttacaacgggctggagctgaatacctggatgaaagtggagaggctgttcgtggagaagttccatcagtcgttttccttggacaattaacaagttagg

SEQ ID NO: 41284 - DNA, 201 bp, Homo sapiens
gctcatgagtgatgggagagatctgggcaggcaacctcctctcatcctgcatcatcagcctggacttggaacttggctgctttttctttctgcagttagcrgagggccttggccaacacataagcctttctgccagcacttggcattccagctgacctcgacccaaggcctctgtgacttcaggaggcggcagctgggaag

SEQ ID NO: 41285 - DNA, 201 bp, Homo sapiens
tcagaagcaggctaaactcacctaggggagagtcctatcccaggtagtggtcatgcttggggacaggtggtgactaggaggggcacaaggaaggctgcagsgtccggcccatcttgttgctggcctgggtgctggtctcactgatctctgtgtggtggggcaggtcagcctcccaggcctgctggtgcctgcagtgcccag

SEQ ID NO: 41286 - DNA, 201 bp, Homo sapiens
tggaggccggcctgggaacaggggccgaagggcgagccggaccctaggggattggtagggtcggggagaaggggtccaggctaggggcgggcggggcgcasggagaccaggcggcttgagcgggaggtggggagctggaggagtgccgggttcgcgggcgggggacggggagaggggggcggggagaggggcgggagtcgg

SEQ ID NO: 41287 - DNA, 201 bp, Homo sapiens
gatttctcaaccagttttcatctttgaaagtgccatttctccctttatcattgtgatttttattcaaatgcatgagtctctgattttctaccatatacaaagggtagagactacagtttcctatagaagaaacttcacatagtggccgaaggatcttatttctcaaaattcaggaactggtttcctctttctggaaattat

SEQ ID NO: 41288 - DNA, 201 bp, Homo sapiens
gaggatgctggcacagggcactgttcacagactgcctttgctccatgccttttccatgagcatgagtggctgttcgtgtgggaaacggcagagccctcgcrgtccccatcagcactgtgcagtggtaccggaggtggcaggagacagcctgatggcccaggttgtcttcatacccggcttcatgccagggtgcatgccggg

SEQ ID NO: 41289 - DNA, 201 bp, Homo sapiens
tgctgcttctcatgtgcttcatgcccgagaccccgcgcttcctgctgactcagcacaggcgccaggaggccatggccgccctgcggttcctgtggggctcygagcagggctgggaagacccccccatcggggctgagcaggtgagaggctggaaggcagagctgacaggagtgggacagcagtcacgggagggtagcacag

SEQ ID NO: 41290 - DNA, 201 bp, Homo sapiens; identical to SEQ ID NO: 9221

SEQ ID NO: 41291 - DNA, 201 bp, Homo sapiens
tctataaatgtcacttaggtcaagttgtttaatagtctgcttcatgtcttctgtattaatcagggttctccagagattaaactaatggtgtgtgtgtgtgkgggggggggatgtatgtgtatgtagagagagatacatagagagagaaataagaaatcagttcacatgatggccaagcacggtggctcacgcctgtaaccc

SEQ ID NO: 41292 - DNA, 201 bp, Homo sapiens
gtgagggtcatctcacctgacacatggggaggctgggacttgtctgcacacctgaggacacagggggtgctgggatgaggagccaagacgtgggagtcagygctccccaagccttaggacagtagacccccagaggggggccgcttgcgggaggggagagagaaatcctgatggccagtatccgtcagagcagagctttca

SEQ ID NO: 41293 - DNA, 201 bp, Homo sapiens
ctggctcaccctggctctgacgccagcctcctccacccaccccccgcaggctgggtgctggagtggcgctggctggctgtgctgggctgcgtgcccccctycctcatgctgcttctcatgtgcttcatgcccgagaccccgcgcttcctgctgactcagcacaggcgccaggaggccatggccgccctgcggttcctgtgg

SEQ ID NO: 41294 - DNA, 201 bp, Homo sapiens
gtccccagggcagcgattaaagcggagcaggaactgcagacccgaccgggcaggacaggtgcagcttctcggagttgggggcgggaagtctcgggctgagrcccacgtgcttcgccttcgccccgcctctaccctcattggttgaagccagattgagaggaggtgccagaaaaaaaactcctccctccaacctcattggcc

SEQ ID NO: 41295 - DNA, 201 bp, Homo sapiens
ccccagaggggggccgcttgcgggaggggagagagaaatcctgatggccagtatccgtcagagcagagctttcacctggccctgctgcggcagcccggcayctacaagcccttcatcatcggcgtctccctgatggccttccagcagctgtcgggggtcaacgccgtcatgttctatgcagagaccatctttgaagaggcc

SEQ ID NO: 41296 - DNA, 201 bp, Homo sapiens
gattgcaggcatgagccactgcgcccagccataaatcctcatctgattgctggcaggtctacatctccgaaatcgcctacccagcagtccgggggttgctsggctcctgtgtgcagctaatggtcgtcgtcggcatcctcctggcctacctggcaggtatagttgtcattatctcttgcttcctgtttgtggtcatgtggc

SEQ ID NO: 41297 - DNA, 201 bp, Homo sapiens; identical to SEQ ID NO: 9228

SEQ ID NO: 41298 - DNA, 201 bp, Homo sapiens
ggaggggagagagaaatcctgatggccagtatccgtcagagcagagctttcacctggccctgctgcggcagcccggcatctacaagcccttcatcatcggygtctccctgatggccttccagcagctgtcgggggtcaacgccgtcatgttctatgcagagaccatctttgaagaggccaagttcaaggtaaaagggccct

SEQ ID NO: 41299 - DNA, 201 bp, Homo sapiens; identical to SEQ ID NO: 9236

SEQ ID NO: 41300 - DNA, 201 bp, Homo sapiens
gttcacagctgtggcggctctcatcatggacagagcagggcggaggctgctcctggtcttgtcaggtgagggttcacccctgtgcagcctccccgccatgsgggggagggccttcgccaaggccaccacactgcaggaggaggacagggagcatttgtgatgacaaacatcatggactaatgcggccatgatttgacagca

SEQ ID NO: 41301 - DNA, 201 bp, Homo sapiens
ttcacagctgtggcggctctcatcatggacagagcagggcggaggctgctcctggtcttgtcaggtgagggttcacccctgtgcagcctccccgccatggkggggagggccttcgccaaggccaccacactgcaggaggaggacagggagcatttgtgatgacaaacatcatggactaatgcggccatgatttgacagcag

SEQ ID NO: 41302 - DNA, 201 bp, Homo sapiens
gtgaggccttcagcaagagctgcggcccacggacatttggtacccagcagctgctgcgaagacgaccgtcggggctgagggttactcgctgctgcttctgygccggtacctcccatttcctcggcccagagggtctgctccgggaactttttgcagttcgctgaggtccaaggcggggtggctgccacccagtcagggctt

SEQ ID NO: 41303 - DNA, 201 bp, Homo sapiens
cgtcctcaccaactggctcatggcctttctcgtgaccaaggagttcagcagcctcatggtgagggcaggctccaccagcaccgcgttcgtgcagtcagccragaagcactttctaaaaccacttgtattgcagaagacccagggtcgtggccttacatgcagcctgagccccaccatgcctgggccactggccatcttggg

SEQ ID NO: 41304 - DNA, 201 bp, Homo sapiens
gctgggcgaggagtgggaggtgatccccccggccctgctgtggcggctcccggcaggtggggtcttccccagcctcacctctcctctcgtaagttccaagytctgcatttctagctctgaccacatgcagctgtggaactaggcccctctgcgttcctttcacttaatcccctgagcagccctcgagcaggccccgttgtg

SEQ ID NO: 41305 - DNA, 201 bp, Homo sapiens
tgcagtactggtagcacatacacagtccagcctatccgaatgccaggtcagcatcacacgtcaatgaatagtagttaagtcacactgatttgtcctgtaaratctctgttatccttcaagcaacatcacacgtgctccagtgtggggagtgatagttcgtatgtccaagcttcattcattcactcaacacacattcttgga

SEQ ID NO: 41306 - DNA, 201 bp, Homo sapiens
tgccggtacctcccatttcctcggcccagagggtctgctccgggaactttttgcagttcgctgaggtccaaggcggggtggctgccacccagtcagggctyctgcggccaaggtgccagaacaccaagctggccgttctctgggagccgggcctgcccctctcagaggcatccaggccatgctgctgcgccctgggccgtt

SEQ ID NO: 41307 - DNA, 201 bp, Homo sapiens
aaaagaagccaagaaggaggtgacaaaggacctaacagtccttttttaggagagaaaatgtccaagaggccaagagaaggccttcgaggagggagagatcrccaggtcccagaggaccaggagctgaaaagcacctttttagttctggcacgtgggaggtcacagtggtggtggatggcagggacaggttctgactgaagg

SEQ ID NO: 41308 - DNA, 201 bp, Homo sapiens
ggacctaacagtccttttttaggagagaaaatgtccaagaggccaagagaaggccttcgaggagggagagatcgccaggtcccagaggaccaggagctgaraagcacctttttagttctggcacgtgggaggtcacagtggtggtggatggcagggacaggttctgactgaaggccccatgtgctcctggggccatgctcg

SEQ ID NO: 41309 - DNA, 201 bp, Homo sapiens
ttcagggcctgccgtaaccccctgcaaggactttcctcagctctgaatggctgagacctttccattttaagaactcttggagcctgagtaaagcctcatctttttttttttttttttaatttttatttaaaaatttcggagtttcgctcttgttgcccaggctggagtgcaatggtgggatcttggctcaccgcaacctcc

SEQ ID NO: 41310 - DNA, 201 bp, Homo sapiens
ccctcgagcaggccccgttgtgaccccatctcagagacagagcctgtgcctgaggagggaagaggctggccgaggccttggcaggaaagcatggagctggygggaccacactgggatccgggaccccacagccccacaggctgggaagctgggtctcttggctctgcagcaagctgaggagcccagccctgcggaccctga

SEQ ID NO: 41311 - DNA, 201 bp, Homo sapiens
aagccaccagactggatgccagactatcctccatgtcccagagctgggtggagataaaatgggtgtggccttgggcagggcaggctggggtcaggggactrgaccccctggtggcagagctgtctcagtgatcgcgtggggcttcctgatctctccccgcgtccacccatggcctttcctctctctgcaggaggtcctcag

SEQ ID NO: 41312 - DNA, 201 bp, Homo sapiens
atgtccgcgttgtcatacccactgtcgcttccgcagctggtgtgattggcccgtgccatgtgccttcatgaacagttgtgataatggcaatgtcagtagcraacatgagggcagatgtgcagaggcagcgaggccccatctctgaagctgagtctttgaggctggcaaggcccaggctggctcaccctggctctgacgcca

SEQ ID NO: 41313 - DNA, 201 bp, Homo sapiens
ggcccatcccctggctcctcatgtcagagatcttccctctgcatgtcaagggcgtggcgacaggcatctgcgtcctcaccaactggctcatggcctttctygtgaccaaggagttcagcagcctcatggtgagggcaggctccaccagcaccgcgttcgtgcagtcagccgagaagcactttctaaaaccacttgtattgc

SEQ ID NO: 41314 - DNA, 201 bp, Homo sapiens
caagacgtgggagtcagcgctccccaagccttaggacagtagacccccagaggggggccgcttgcgggaggggagagagaaatcctgatggccagtatccrtcagagcagagctttcacctggccctgctgcggcagcccggcatctacaagcccttcatcatcggcgtctccctgatggccttccagcagctgtcggggg

SEQ ID NO: 41315 - DNA, 201 bp, Homo sapiens
tgggtgtggccttgggcagggcaggctggggtcaggggactggaccccctggtggcagagctgtctcagtgatcgcgtggggcttcctgatctctccccgygtccacccatggcctttcctctctctgcaggaggtcctcaggccctatggagccttctggcttgcctccgctttctgcatcttcagtgtccttttcactt

SEQ ID NO: 41316 - DNA, 201 bp, Homo sapiens
tggccgtgggcagcatgtgcctcttcatcgccggtaagggggcctgtgggaggctgggcgaggagtgggaggtgatccccccggccctgctgtggcggctyccggcaggtggggtcttccccagcctcacctctcctctcgtaagttccaagctctgcatttctagctctgaccacatgcagctgtggaactaggcccctc

SEQ ID NO: 41317 - DNA, 201 bp, Homo sapiens
gccgtgggcagcatgtgcctcttcatcgccggtaagggggcctgtgggaggctgggcgaggagtgggaggtgatccccccggccctgctgtggcggctccmggcaggtggggtcttccccagcctcacctctcctctcgtaagttccaagctctgcatttctagctctgaccacatgcagctgtggaactaggcccctctg

SEQ ID NO: 41318 - DNA, 201 bp, Homo sapiens
ggctggctgtgctgggctgcgtgcccccctccctcatgctgcttctcatgtgcttcatgcccgagaccccgcgcttcctgctgactcagcacaggcgccargaggccatggccgccctgcggttcctgtggggctccgagcagggctgggaagacccccccatcggggctgagcaggtgagaggctggaaggcagagctga

SEQ ID NO: 41319 - DNA, 201 bp, Homo sapiens; identical to SEQ ID NO: 9224

SEQ ID NO: 41320 - DNA, 201 bp, Homo sapiens
ggctttctccgatgaagacattatagacttgaagtaacagagttgaatctcatttgccatctttagttttcttatggaggtttatactctttaaacagttytgatgtaatttctcaacaaaatgtggcttttagcctgtcagtgatctattggaccaaaccttctgcacactcggccagttccctctccaatgtccggtgc

SEQ ID NO: 41321 - DNA, 201 bp, Homo sapiens
agggcagatgtgcagaggcagcgaggccccatctctgaagctgagtctttgaggctggcaaggcccaggctggctcaccctggctctgacgccagcctccyccacccaccccccgcaggctgggtgctggagtggcgctggctggctgtgctgggctgcgtgcccccctccctcatgctgcttctcatgtgcttcatgccc

SEQ ID NO: 41322 - DNA, 201 bp, Homo sapiens
tggccaagtgaaagtcagggagaggagggaatggtgtttcaggaagatggaacagcatacacaaaggcccagaggtgagagggatgtggctgtgtgccatygaaagagttttagcttggtaagagtgtgacagtatttcaaagtagggagaggtggtgagaaaagagtatagagaccaggtgtggtgactcacacctgtga

SEQ ID NO: 41323 - DNA, 201 bp, Homo sapiens
cagttattaagggcccattttgtgttagtcactgttcttggctccgggcatgcaagagataacaagacagattcctatcctcaccaggcttagagtcagaygggcagtcatcagacaatgacaggacacagtgatatgtgtttccatgggggacatacaagtagggactcatttgctagccatgttggggtgactggggtc

SEQ ID NO: 41324 - DNA, 201 bp, Homo sapiens
tattttagtagagaccgggtttcaccgtgttagccaggatcgtgatccacccgcctcagcctcccagagtgctgggattacaggcatgagccactgcgccyggccagcaaacagttattaagggcccattttgtgttagtcactgttcttggctccgggcatgcaagagataacaagacagattcctatcctcaccaggct

SEQ ID NO: 41325 - DNA, 201 bp, Homo sapiens; identical to SEQ ID NO: 9260

SEQ ID NO: 41326 - DNA, 201 bp, Homo sapiens
agagagagagagagaaacgtgagctgaggctcagctaggatgataataacaaagacctgccaggtcctgcaaaaagctcagatagatgatagatagatggdtagatagatagatagatagatagatagatagatagatagatagataggatctgttttacagatgcggaaactgaggcctagggaggtgaagtgtgaacca

SEQ ID NO: 41327 - DNA, 201 bp, Homo sapiens; identical to SEQ ID NO: 9261

SEQ ID NO: 41328 - DNA, 201 bp, Homo sapiens
agagagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgtt

SEQ ID NO: 41329 - DNA, 201 bp, Homo sapiens; identical to SEQ ID NO: 9262

SEQ ID NO: 41330 - DNA, 201 bp, Homo sapiens
gagagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgtta

SEQ ID NO: 41331 - DNA, 201 bp, Homo sapiens
agagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttac

SEQ ID NO: 41332 - DNA, 201 bp, Homo sapiens
gagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttact

SEQ ID NO: 41333 - DNA, 201 bp, Homo sapiens
agaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttactc

SEQ ID NO: 41334 - DNA, 201 bp, Homo sapiens; identical to SEQ ID NO: 9267

SEQ ID NO: 41335 - DNA, 201 bp, Homo sapiens; identical to SEQ ID NO: 9268

SEQ ID NO: 41336 - DNA, 201 bp, Homo sapiens
aaggagaagggaggccgtagcccagtgacaacccttccttcctaccccatggggcctgcccctcctgataccaggagtcagggtttctcctgtgacgcacycccaggcctgaaggggcacctcttgaggaggcatggcccctggagccagtgagagggcaggggtgtcccctggtcctgctcccgtctttccaacctgggt

SEQ ID NO: 41337 - DNA, 201 bp, Homo sapiens
aggggatcgcggccggggcgagggcgcgggggcagaagcggccgccgaaggggcgtagggagaaaacgtgggaacaagaggagagagatggagcgatgagrggccgccagggaagagatgacgaacagatgcgggctggggaatggaggcgcgggggtccgaggccatggaaacgggcgagttgccgggggaacgcccgag

SEQ ID NO: 41338 - DNA, 201 bp, Homo sapiens; identical to SEQ ID NO: 9271

SEQ ID NO: 41339 - DNA, 201 bp, Homo sapiens
tagatagatagatagatagatagatagatagataggatctgttttacagatgcggaaactgaggcctagggaggtgaagtgtgaaccagagttgttactcrgctgtctgactctagagccactctttgttctgtggcaggcctgaattgtgggctcaatcatttggattttattctgtagtcaatagagagccactgaagc

SEQ ID NO: 41340 - DNA, 201 bp, Homo sapiens; identical to SEQ ID NO: 9256

SEQ ID NO: 41341 - DNA, 201 bp, Homo sapiens
tctaccacgaggtgcacaggccctctcacttcctcaactttgctctcctgcaggagggggaggtttactctgcggatcgggaggacctgtatgcctgaccrtttccctgcctcctgcttcagcctcccgaggccgaagcctcagcccctccagacaggccgctgacattcagcagtttggcctctttccctctgtctgtgc

SEQ ID NO: 41342 - DNA, 201 bp, Homo sapiens
tattctgtagtcaatagagagccactgaagccactgaagtagaggcagtcaccctgtcacaccctgccaaggtgacccaggtcaccgtgggtctcatgtaytgaccagtgtccctaccctcctccctcaggccagcgagagatggagctaccgtgtccaggatgaagctgcaggtctgggggacactgaccagcttgggct

SEQ ID NO: 41343 - DNA, 201 bp, Homo sapiens
ccccttcaaccacagcttcatcgagccgccctctgccggctgggccactgatgactccttctcatccgatcctgagtctggagaggcagatgaggttcctrcctactgtgtgccaccccaagaaggtagccccccaacagcccacatagcccctgagcagccctgcccaccacgaccccctctttagtcctccagcaaagt

SEQ ID NO: 41344 - DNA, 201 bp, Homo sapiens
agccctgccattgcctttctttccctttctttttttgagtgtcagtctttccagccaccccctccctctcagggaggtgcctcgtggcagcccgcccctcyggcctggtttcctcaggaaaagccctgagaggaagcagggagggggttgggagctgtgggggccagacgaacccgagcgctcccaccgagctgcctgcca

SEQ ID NO: 41345 - DNA, 201 bp, Homo sapiens; identical to SEQ ID NO: 9264

SEQ ID NO: 41346 - DNA, 201 bp, Homo sapiens
tctgtactcctctttacctataggagatggaacccttaggttggatccacactcagcccaatgagtccccgcagttatcaccccaggatgtcaccacccaygccaagatcatggctgacaacccatcttgggatggcgagaagaccattatcatcacatgcaggtgggcctgggctccttgggaggaagtatggtggggca

SEQ ID NO: 41347 - DNA, 201 bp, Homo sapiens
ggcatctccactgctggcatccccatggctggcatcaccagggctttctccctccctgccccttttctttagggagctgctcacagaccaccgggtccccrgccttctgctcgaggccatgaaggtggctgtccggaagcagcggaagaagatcaaggccaagatgttagggacaccagaggaagcagagagcaggtaggt

SEQ ID NO: 41348 - DNA, 201 bp, Homo sapiens; identical to SEQ ID NO: 9265

SEQ ID NO: 41349 - DNA, 201 bp, Homo sapiens
tggcatctccactgctggcatccccatggctggcatcaccagggctttctccctccctgccccttttctttagggagctgctcacagaccaccgggtcccyggccttctgctcgaggccatgaaggtggctgtccggaagcagcggaagaagatcaaggccaagatgttagggacaccagaggaagcagagagcaggtagg

SEQ ID NO: 41350 - DNA, 201 bp, Homo sapiens
cttgatcaatggccctcacttctcctctctcctctgtctcagtgaggatgaggctggcccatggatcctgctctccgatgacaagggagaccatcccccayccccggagtccaaaatacagagtttgtatgttggggaaaggggaaaggcaagagtgtggggagggaggaagggccctggctggtccttctcaggatcccc

SEQ ID NO: 41351 - DNA, 201 bp, Homo sapiens
agagtgggaacaagggaaggcttcctggagggggtgtcatttgagacaggtgggccgggcgcagtgactcacgcctgtaatcccagcactttgggaggccraggtgagtggatcacctgaggtcaggagttcaagaccagcctggccaacatggtgaaaccccgtctctactaaaaatacaaaattagccgggtgtggtgg

SEQ ID NO: 41352 - DNA, 201 bp, Homo sapiens
aggaacagtgaagagcagagcagtctcctccacatgtgggggtagagcagagtgggaacaagggaaggcttcctggagggggtgtcatttgagacaggtgsgccgggcgcagtgactcacgcctgtaatcccagcactttgggaggccgaggtgagtggatcacctgaggtcaggagttcaagaccagcctggccaacatg

SEQ ID NO: 41353 - DNA, 201 bp, Homo sapiens; identical to SEQ ID NO: 9270

SEQ ID NO: 41354 - DNA, 201 bp, Homo sapiens
cagttcagctccagccaagctcttctgtctcctctgccagggatggtccctgtggcccaggcagggtcgtcagaggccagcctggctgcaggtgctttccygccccctgaggacgcctccacgccattcgccatcccgcgcacctccagcctagctcgggccaagcggccatcggtctccttcgcggaaggtaccaagttt

SEQ ID NO: 41355 - DNA, 201 bp, Homo sapiens
gaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttactca

SEQ ID NO: 41356 - DNA, 201 bp, Homo sapiens
gtgccgctagtggtgcgggcgctggagctcttggaacaggctgccgtggggcccgccccggactcggtgagtcatggccctcccttcgccacccacggggycggcagggccgaagcctgagacccgggtctccccagctgcaggtgtcggcgcagccggcggagcaggagctgcggcggctgcgggaggagaacgagcgcc

SEQ ID NO: 41357 - DNA, 201 bp, Homo sapiens
tgtcagtctttccagccaccccctccctctcagggaggtgcctcgtggcagcccgcccctccggcctggtttcctcaggaaaagccctgagaggaagcagkgagggggttgggagctgtgggggccagacgaacccgagcgctcccaccgagctgcctgccatggggctggggctgctgctcccgctgctgctgctctgga

SEQ ID NO: 41358 - DNA, 201 bp, Homo sapiens
tagtcaatagagagccactgaagccactgaagtagaggcagtcaccctgtcacaccctgccaaggtgacccaggtcaccgtgggtctcatgtactgaccartgtccctaccctcctccctcaggccagcgagagatggagctaccgtgtccaggatgaagctgcaggtctgggggacactgaccagcttgggctccacgct

SEQ ID NO: 41359 - DNA, 201 bp, Homo sapiens
ctgccctgccgttccctcagctcccacaagctaccctgggtgacaggtcagtgggcgctgggggccggggtctgggattggacagggctttgcatcaggtyctgcaggcgcctgatctggagtctctacagtctcacatcacgacccggaggtccccttcaaccacagcttcatcgagccgccctctgccggctgggccac

SEQ ID NO: 41360 - DNA, 201 bp, Homo sapiens
ggcgagaagaccattatcatcacatgcaggtgggcctgggctccttgggaggaagtatggtggggcagggattgcaggccagggcccagaacagtggcctragctgttactctgtcctcgttcctcccccagcttcacgccaggctcctgtacactgacggcctacaagctgacccccagtggctacgaatggggccgcca

SEQ ID NO: 41361 - DNA, 201 bp, Homo sapiens
catccgtgagtagccaggacagaccctcagccaaggagaagggaggccgtagcccagtgacaacccttccttcctaccccatggggcctgcccctcctgawaccaggagtcagggtttctcctgtgacgcacccccaggcctgaaggggcacctcttgaggaggcatggcccctggagccagtgagagggcaggggtgtcc

SEQ ID NO: 41362 - DNA, 201 bp, Homo sapiens; identical to SEQ ID NO: 9257

SEQ ID NO: 41363 - DNA, 201 bp, Homo sapiens
tgccccacctgtgttcaggggtcctgtgatactgtgacaggggactgtgtctgcagtgccggctactgggggcccaggtaaggatggggatcccgggggcrggagagtgccaggggcctaggtcagggctctgtgcagcatttcctgaacttccctggacagtgcccagaaatctccctgcccgtctcctgcctgcctccc

SEQ ID NO: 41364 - DNA, 201 bp, Homo sapiens
gaaggctgcggggtgcagtagccagggaaaggcgggcccttcacatgggctccagggcaagttcctcaccagggagtctgggcccacttcagagatattcttttttttttttttttttcccttaagacgaggtcttgctctgtcacccaggccagagtgcagtggtgtgatgtcagctcactgcaacctccacctcccagg

SEQ ID NO: 41365 - DNA, 201 bp, Homo sapiens
ttccctcagctcccacaagctaccctgggtgacaggtcagtgggcgctgggggccggggtctgggattggacagggctttgcatcaggtcctgcaggcgcytgatctggagtctctacagtctcacatcacgacccggaggtccccttcaaccacagcttcatcgagccgccctctgccggctgggccactgatgactcct

SEQ ID NO: 41366 - DNA, 201 bp, Homo sapiens
ggattggacagggctttgcatcaggtcctgcaggcgcctgatctggagtctctacagtctcacatcacgacccggaggtccccttcaaccacagcttcatygagccgccctctgccggctgggccactgatgactccttctcatccgatcctgagtctggagaggcagatgaggttcctgcctactgtgtgccaccccaag

SEQ ID NO: 41367 - DNA, 201 bp, Homo sapiens
aactcagagcaaagacaggatgtgtaggagacaggaaggcctgaatatcccccgtttctggctcccccaggctctggcagtcgggacactgccctcatcgygggcagccttgtgcctctgctgctgctcttcctgggtcttgcctgctgtgcctgctgctgctgggccccccgatcagacctcaaggacaggtgaacgcca

SEQ ID NO: 41368 - DNA, 201 bp, Homo sapiens
ggcccgccccggactcggtgagtcatggccctcccttcgccacccacggggccggcagggccgaagcctgagacccgggtctccccagctgcaggtgtcgrcgcagccggcggagcaggagctgcggcggctgcgggaggagaacgagcgcctccgcagggagctgcgcgcggggccacagggtaagcgcagccccggcca

SEQ ID NO: 41369 - DNA, 201 bp, Homo sapiens
ctgcggctggcatctccactgctggcatccccatggctggcatcaccagggctttctccctccctgccccttttctttagggagctgctcacagaccaccrggtccccggccttctgctcgaggccatgaaggtggctgtccggaagcagcggaagaagatcaaggccaagatgttagggacaccagaggaagcagagagc

SEQ ID NO: 41370 - DNA, 201 bp, Homo sapiens
ggcctgaatatcccccgtttctggctcccccaggctctggcagtcgggacactgccctcatcgtgggcagccttgtgcctctgctgctgctcttcctgggycttgcctgctgtgcctgctgctgctgggccccccgatcagacctcaaggacaggtgaacgccagcccgtcccttccccacacagctcaggccacagggtg

SEQ ID NO: 41371 - DNA, 201 bp, Homo sapiens
atgcgggctggggaatggaggcgcgggggtccgaggccatggaaacgggcgagttgccgggggaacgcccgagatgggggtcgcgcggctggctcgcgccrccggtttgaaccggctcctcgtctcccacgctgggttcgcgtggccgcagcgcctagcgacctagacggcggccaatggcgcggcagttcctgcgccgtc

SEQ ID NO: 41372 - DNA, 201 bp, Homo sapiens; identical to SEQ ID NO: 9269

SEQ ID NO: 41373 - DNA, 201 bp, Homo sapiens
attaggggctgagaagacccttgggttgcaccctcagcctaatgtggcccatgacccacgaggtagctcttcctcccacttgtccccgataagccattttyccctgctgttcccaggtcctgaagcccttcctggaggattccaagtaccaaaatctgctgcccctttttgtggggcacaacatgctgctggtcagtgaag

SEQ ID NO: 41374 - DNA, 201 bp, Homo sapiens
cttggggctcccctccccggacgccactgccaccttagcttccctcatgtcccacagggcagaggtgggctctggggaggctgaaaaccttggaaagcagkgtcacctcgttctgagcagaatgggccactcagctctgggaactcctcatcgcttgaggcttcatcctcctcatccgaaatccagcgctccaccacaggc

SEQ ID NO: 41375 - DNA, 201 bp, Homo sapiens; identical to SEQ ID NO: 9276

SEQ ID NO: 41376 - DNA, 201 bp, Homo sapiens; identical to SEQ ID NO: 9277

SEQ ID NO: 41377 - DNA, 201 bp, Homo sapiens
acccaacctcatcctgattcttttttttttttttttttttgagacgaagttttgctcttgtcacccaggctggagtgcaatggcacgatctcagcttactrtaacctctacctcccgggttcaaacgattctcctgcctcagcctcccgagtggcttggattacaggcgctcgccaccatgcctggctaatttttgtattt

SEQ ID NO: 41378 - DNA, 201 bp, Homo sapiens
tttttttttttttttgagacgaagttttgctcttgtcacccaggctggagtgcaatggcacgatctcagcttactgtaacctctacctcccgggttcaaaygattctcctgcctcagcctcccgagtggcttggattacaggcgctcgccaccatgcctggctaatttttgtatttttagtagagacggggtttctccatg

SEQ ID NO: 41379 - DNA, 201 bp, Homo sapiens
tggcacgatctcagcttactgtaacctctacctcccgggttcaaacgattctcctgcctcagcctcccgagtggcttggattacaggcgctcgccaccatkcctggctaatttttgtatttttagtagagacggggtttctccatgttggccaggctggtcttgaactcctgacctcaggtgatctgcctgcctcagcctc

SEQ ID NO: 41380 - DNA, 201 bp, Homo sapiens
cctccccctctccatcacttctgcagatcaaatcccaggacctattccagagctgggtggcgcagctgcgtgcccaccgcctagcccaccgcctggacatrccccgtggctcactgcccagtactgctcaccggaaggtaaggtggaccctggggtgggggcaggtaatgtggcaattcaggggcaagggctatggagaac

SEQ ID NO: 41381 - DNA, 201 bp, Homo sapiens
ccaccgcctggacatgccccgtggctcactgcccagtactgctcaccggaaggtaaggtggaccctggggtgggggcaggtaatgtggcaattcaggggcragggctatggagaactgtgagacccagggaggtgggcatcatccttcctgaccctgggctcaccccacaggttcctggtgcccagcttccaacagcagct

SEQ ID NO: 41382 - DNA, 201 bp, Homo sapiens
caccgcctggacatgccccgtggctcactgcccagtactgctcaccggaaggtaaggtggaccctggggtgggggcaggtaatgtggcaattcaggggcargggctatggagaactgtgagacccagggaggtgggcatcatccttcctgaccctgggctcaccccacaggttcctggtgcccagcttccaacagcagcta

SEQ ID NO: 41383 - DNA, 201 bp, Homo sapiens
gggcaagggctatggagaactgtgagacccagggaggtgggcatcatccttcctgaccctgggctcaccccacaggttcctggtgcccagcttccaacagmagctactgcctcagccctacctgggcttggaccgcgggagaaagtgtcttcctggctgagggacagtgatgggctggaccgctgctctcatggtgagggg

SEQ ID NO: 41384 - DNA, 201 bp, Homo sapiens
ggttcctggtgcccagcttccaacagcagctactgcctcagccctacctgggcttggaccgcgggagaaagtgtcttcctggctgagggacagtgatgggytggaccgctgctctcatggtgaggggccctaggcgcagcacctccaagggtaggccccaagctggcaggtctaggaggggataatgttacctccatccct

SEQ ID NO: 41385 - DNA, 201 bp, Homo sapiens
ccccccacaggaggtaaggaggaatttggatacatgtcacttggtggtgggatggtggattaaagtaatcttgtctctggccatagtgaagtaggacactyagccattgtcatgcacgtcattatttcagtttgactgcctgatccagatattttaagatgaaatccgcacttgattctgtattggcttttgggctctgga

SEQ ID NO: 41386 - DNA, 201 bp, Homo sapiens; identical to SEQ ID NO: 9278

SEQ ID NO: 41387 - DNA, 201 bp, Homo sapiens
cggctagaggggaggctctgacatctccttccttcctggttcctgcagcagctgctgccactgctcagcgcggtgaggagggagccggtgactcggagacrgtgactcagaggcagagcggcgcaagggccaaggagtactggcgtccatggaccctggggtaagggggctgcgtggcagcagctgacattcctgagaaga

SEQ ID NO: 41388 - DNA, 201 bp, Homo sapiens
cagatcaaatcccaggacctattccagagctgggtggcgcagctgcgtgcccaccgcctagcccaccgcctggacatgccccgtggctcactgcccagtaytgctcaccggaaggtaaggtggaccctggggtgggggcaggtaatgtggcaattcaggggcaagggctatggagaactgtgagacccagggaggtgggca

SEQ ID NO: 41389 - DNA, 201 bp, Homo sapiens
cccacaggaggtaaggaggaatttggatacatgtcacttggtggtgggatggtggattaaagtaatcttgtctctggccatagtgaagtaggacactcagscattgtcatgcacgtcattatttcagtttgactgcctgatccagatattttaagatgaaatccgcacttgattctgtattggcttttgggctctggattg

SEQ ID NO: 41390 - DNA, 201 bp, Homo sapiens
gttggtcaggctggtctcgaactcctgacctcaagcaatccacctgccttggcctcccgaagtgctgggattataggcatgagccaccgcgcccagccaartttctcaattttaaactaacactgcaaaagagttatatttatgattggcaaaataattcaacatgagtacagtgtcagattgataattgaaataatttta

SEQ ID NO: 41391 - DNA, 201 bp, Homo sapiens
cctgatgctgactcacttaaggggcagagaatactgcacatgtccttggaaatccagatttcacaggtctctgtagggagggggcgggacaggaatctgattttttttttttttttttttgagatggagtctcactctatcacctaggctggagtgcggtggcacagtctcagctcactgcaacctctgtctcctgggttc

SEQ ID NO: 41392 - DNA, 201 bp, Homo sapiens
tcagctcactgcaacctctgtctcctgggttcaagcaattctcctgcctcagcctcctgagtagctgggattacaggcacctgccaccacgcccagctaattttttttttttcgtatttttagtagagatggggtttcaccgtgttggccaggctggtcttgaactcctgacctcaggtgatccgccacctcagcctccca

SEQ ID NO: 41393 - DNA, 201 bp, Homo sapiens
ggacaaccgaatgatagccgtctgccagaatgtggctctgagtgcagaggacaagcttcttatgcgacaccagctgcggaaacacaagatcctgatgaagrtcttccccaaccaggtagggagcaggccccttggcatgggttgcccatcttccccccacccccaccagactcagacctcaccatctgctccccagtgatg

SEQ ID NO: 41394 - DNA, 201 bp, Homo sapiens
cacaggctgcccgtccaggtccaggagaagtggcagggcttctgtcaccagctcgctgcagagcagaaggagcagaggttacccaggagggcaccctggcrtggaggatgcaaagacacgcaccacagcactcacacccggaggggtggtggctcatgagctaggtaggaggtgggggagaaggtgtcatggacaggaccc

SEQ ID NO: 41395 - DNA, 201 bp, Homo sapiens
ggtgggcatcatccttcctgaccctgggctcaccccacaggttcctggtgcccagcttccaacagcagctactgcctcagccctacctgggcttggaccgygggagaaagtgtcttcctggctgagggacagtgatgggctggaccgctgctctcatggtgaggggccctaggcgcagcacctccaagggtaggccccaag

SEQ ID NO: 41396 - DNA, 201 bp, Homo sapiens
gagagctctagggtaggaggcctcatgcaagtcttcatgaaccagaaattcctaataaaggagacgggatgcttaactcagagtccaccatcatccttgaytggagcacattctgggtggatgcaggggtgacccggggaaggtggctgttcaacattccttctcggacttgaagcaatgccaccgcttccttagtcttgg

SEQ ID NO: 41397 - DNA, 201 bp, Homo sapiens
tgcaggggtgacccggggaaggtggctgttcaacattccttctcggacttgaagcaatgccaccgcttccttagtcttggacaggcactgtctggcagggwtgacctgcagcagctcttttgtggcctgggccaggaccagcttcccccagtgcctcatcctgtgctgtatgcccagggatgttcaatcactgggaagtgg

SEQ ID NO: 41398 - DNA, 201 bp, Homo sapiens
caattcaggggcaagggctatggagaactgtgagacccagggaggtgggcatcatccttcctgaccctgggctcaccccacaggttcctggtgcccagctyccaacagcagctactgcctcagccctacctgggcttggaccgcgggagaaagtgtcttcctggctgagggacagtgatgggctggaccgctgctctcatg

SEQ ID NO: 41399 - DNA, 201 bp, Homo sapiens
gtgtgttttttctccatttgggataaactagggcctccaggaggttgcctctaaccatgttgctatatgccctcccaggccggctgcctaccctccagacygtccgctatggctccaaggctgttacccgccaccgtcgtgtgatgcactttcagcggcagaagctgatggctgtgactgaatatatccccccgaaaccag

SEQ ID NO: 41400 - DNA, 201 bp, Homo sapiens
gattacatgggccccaaacttaaaatatttactgtttgaccattttaagaaaaagtttatttaaccttatcccctttttctttctctctctctctctctctttccttccttccttccttccttctttttttttctgagacggagtcttactctgtgcccaggctagagtgcagtggcatgatctcggctcactgcaacctc

SEQ ID NO: 41401 - DNA, 201 bp, Homo sapiens; identical to SEQ ID NO: 9273

SEQ ID NO: 41402 - DNA, 201 bp, Homo sapiens
agtaatcttgtctctggccatagtgaagtaggacactcagccattgtcatgcacgtcattatttcagtttgactgcctgatccagatattttaagatgaartccgcacttgattctgtattggcttttgggctctggattgggtgggcctcctgaatttccttcttgtctccaaaaatgtgtgtgtgagagctaccctagc

SEQ ID NO: 41403 - DNA, 201 bp, Homo sapiens
caacctctgtctcctgggttcaagcaattctcctgcctcagcctcctgagtagctgggattacaggcacctgccaccacgcccagctaatttttttttttkcgtatttttagtagagatggggtttcaccgtgttggccaggctggtcttgaactcctgacctcaggtgatccgccacctcagcctcccaaagtgctgggg

SEQ ID NO: 41404 - DNA, 201 bp, Homo sapiens; identical to SEQ ID NO: 9275

SEQ ID NO: 41405 - DNA, 201 bp, Homo sapiens; identical to SEQ ID NO: 9279

SEQ ID NO: 41406 - DNA, 201 bp, Homo sapiens
cttcccctgcctgagccctggcaccacataccgcaaggaggggatgcaagccaggttctcaatttgctggatcttattctgcaagaagaaaccgaagtggrgaaaccaagctgagatcagatgcgtcaggggccctttacggggacaaagccccaagaccatgtctactctgcagctggagatctggcactttgggaatga

SEQ ID NO: 41407 - DNA, 201 bp, Homo sapiens
ttgatctcaaactcctgacctcaggtgatccaccgaccttggtctcccaaagtgctgggattacaggcttgagccaccgtacccaacctcatcctgattcttttttttttttttttttttgagacgaagttttgctcttgtcacccaggctggagtgcaatggcacgatctcagcttactgtaacctctacctcccgggtt

SEQ ID NO: 41408 - DNA, 201 bp, Homo sapiens
cccagcagggactgtgcccccactcccaagccacatcgatgctagggcagtctgctcagccctgagtcctccggggagcaggggggcagagctgagcggcygcccggagcttggcgggaggaggggacaggggagagggaggtggggagatccggctagaggggaggctctgacatctccttccttcctggttcctgcagc

SEQ ID NO: 41409 - DNA, 201 bp, Homo sapiens
cctggttcctgcagcagctgctgccactgctcagcgcggtgaggagggagccggtgactcggagacggtgactcagaggcagagcggcgcaagggccaagragtactggcgtccatggaccctggggtaagggggctgcgtggcagcagctgacattcctgagaagagcttcctcccacctgaagctggtgggtctgctcc

SEQ ID NO: 41410 - DNA, 201 bp, Homo sapiens
aggctctgacatctccttccttcctggttcctgcagcagctgctgccactgctcagcgcggtgaggagggagccggtgactcggagacggtgactcagagrcagagcggcgcaagggccaaggagtactggcgtccatggaccctggggtaagggggctgcgtggcagcagctgacattcctgagaagagcttcctcccac

SEQ ID NO: 41411 - DNA, 201 bp, Homo sapiens
ctgatggctgtgactgaatatatccccccgaaaccagccatccacccatcatgcctgccatctcctcccagccccccacaggaggtaaggaggaatttggrtacatgtcacttggtggtgggatggtggattaaagtaatcttgtctctggccatagtgaagtaggacactcagccattgtcatgcacgtcattatttcag

SEQ ID NO: 41412 - DNA, 201 bp, Homo sapiens; identical to SEQ ID NO: 9316

SEQ ID NO: 41413 - DNA, 201 bp, Homo sapiens
cttctggggctaaattatttagctgtatgtggagcaggggaagattgaaggtgtgagaagacataaaaggagacaaaatatttaatttagtttaatttttytaaaaaggaaagaaaagctatgggggaggggtagtatcccacaagtctgatggaattttctttgccctaaaaatcaccaattgttccaagtaaacatgtg

SEQ ID NO: 41414 - DNA, 201 bp, Homo sapiens
atgaactttgacttcatggagtttgcaatctaaatgcaaataaataaaatatgtaagtccaggatgtctaatagtgcaaagaaaaagaaagcagtcagaartctatctgaaaaggtatcatttagcaaaaatggagttatagattttcagtccagttctatttgataacccataaggtagacacatacacatatacatctt

SEQ ID NO: 41415 - DNA, 201 bp, Homo sapiens
ccttttcgtatgggtattttgggctgcagtcatttttatggtaggtagattataccaacaccaagcactgtattcttccattgtgtgtgtgtgtgtgtgcrtgtgtgtgtacatacagagagatctttagagagcatttctcttatttgaattcttctgatgttcgatatcaagacaaacagcaccatgccgaatctttca

SEQ ID NO: 41416 - DNA, 201 bp, Homo sapiens
tctttttgtcttcagcaacagaaattcattttctcatagtcctggaggctcaggttcaagatcaagatgctgttaggattggctctaggtgaggcatctcyccttggctaacagacaccaccttctgctgtgacggcaacatggtctttatgctcacggtgggagagaaagagagagggaggaagagggagagagagaaga

SEQ ID NO: 41417 - DNA, 201 bp, Homo sapiens
aaagaggctgtagcattttgcattcccaccagcaatgaatgaaagtctgtgttttctccacatccttgccagtgttgggtgttttcagtgttctggatttragccattctaacaagcgtatagtggtatttcatcgttttaatttgcatttgcctgatgacaatatataatatgaaacatctttttatgtacttgtttgcc

SEQ ID NO: 41418 - DNA, 201 bp, Homo sapiens
gccctggactaggtcatccctgcaccttgatgatctagaggaacatatttatagcattgtggtatttagataaaatagtataaatgtgagaaattcaggarttattttctatgtaaagtttccccagaatgagaaaggaaaggaacatatggaaacaaatttatttgtattacaaattttaaatttgcaaaacataaacct

SEQ ID NO: 41419 - DNA, 201 bp, Homo sapiens
gcgtaattcctggtcctaagatatttattttcaaataagcaattttctttccatgttatatcttcctccattactaaattcatgtcttggaattactctgrtagtctttgaactattatatcccaacaagcttgcctactctatagtgccagggctgggtgtgccctcagccctggccagcatgaggaatctgagagctta

SEQ ID NO: 41420 - DNA, 201 bp, Homo sapiens
tcagaagtttgctcctggagaaatggggaagaatatgtccaagacaggaaatcccatcacgaagcacagaaagatgaaaggatatgataagttcaggtaaytgtttcatccagcttatgtatatccaaggtaggatgggagtctttatttgtaagtagatctccagtgtgaatatgaagtattttggcttaaattctgggg

SEQ ID NO: 41421 - DNA, 201 bp, Homo sapiens
atctgtaccctgatttatatgatcataattgatctaatggaatgctccagaaccctaccctcagaactgtataattagtccttgaatttggaattttcatkctttttctctgctggaaacctttagacgtctgcagactcccagggcttactctataagtgcaattctgcttctgactcttccctccactgagatgcctgt

SEQ ID NO: 41422 - DNA, 201 bp, Homo sapiens
aagatcaagatgctgttaggattggctctaggtgaggcatctctccttggctaacagacaccaccttctgctgtgacggcaacatggtctttatgctcacrgtgggagagaaagagagagggaggaagagggagagagagaagagagcaaagagaagagaaagagattgagtgctctggtgtcttcctattcttataaaaa

SEQ ID NO: 41423 - DNA, 201 bp, Homo sapiens
agattacatggcaaaagggacttatgattgctaatcaaaagattatactagatcatctgggtgtgcccaatacaatcacaagggcccttacaagtggacaygggaaagaaagagtcagaatcaagtgattcaacatgagaaggactcaacctaccactactgcctttgaagatggagaaaggggaccaagagccaaagaat

SEQ ID NO: 41424 - DNA, 201 bp, Homo sapiens
tgatcttatgcttagaaaaacccacagactccaccaaaaaactattagaactgataaattcagtaaagtttcaggatataaaatcaaaatataaaaatcartagcacttctaaatgccaacagcaaacaatttgaaaaagaaatcaagaaagtaacctcatttacaacagctacaaataaaatgagttaaccaaagaagag

SEQ ID NO: 41425 - DNA, 201 bp, Homo sapiens
tagaggtagacgctcccgggcaggctagtgttcagcagggacacagccctgggcatatagttgggagacttgggctggggttttctctgccagagcacagrtctctgatcctgtaagtcatttaaattcttgtgtttcaaattccctcactgtaaaaggagtggcttgacctagatgatctcaaaagtctctccaagcttg

SEQ ID NO: 41426 - DNA, 201 bp, Homo sapiens
cttacatttatatgtagtcaaatcaattgattttttatttgtgatttctgtcattattaagaaagtttttgtccagagctcagatgaatattccatatttkgttctttgatgttttcaatatttcaactctttgagaaactttttaaatcaaatttattgtaataaactgtattttaaggttttttaaaaaattctctcct

SEQ ID NO: 41427 - DNA, 201 bp, Homo sapiens
atacatcttagtcccattctgcattttatatgggtcccattctttgattttcatttgttttattacatttgagtctctttacaaattagctaaatatgccyaaactctaatggtgttgttgtagattttttaaagttacaaaatattttgagattggttttctacttgttgaaactggacttcatattgcagggtaatatt

SEQ ID NO: 41428 - DNA, 201 bp, Homo sapiens
ctgcttttgagtatgttttttagaagtgaaattcagataaatcaatagaaaaaaaatgccatcttgctgagactggcaagtttgatgctttccagctgttycaaatgcctccttctagcaggatattcactggaaacaacaccccaaccacattttatgtaaattgtgagccatgatattgaataccggattacatctgtt

SEQ ID NO: 41429 - DNA, 201 bp, Homo sapiens
tgcttttgagtatgttttttagaagtgaaattcagataaatcaatagaaaaaaaatgccatcttgctgagactggcaagtttgatgctttccagctgttccaaatgcctccttctagcaggatattcactggaaacaacaccccaaccacattttatgtaaattgtgagccatgatattgaataccggattacatctgtta

SEQ ID NO: 41430 - DNA, 201 bp, Homo sapiens
agagagtcagttctattgggcactatgaaaaatgagagctaaaaatcatcaagtgtaaggcagaagaccagtcctagaggctgagttaactggcaaccacragagagaagctgtgtgtgtcatagcatgagcacaggagtctggagcttttgcctgggcgtccatatgccatgtcttggaggctccgttgtgaattctgct

SEQ ID NO: 41431 - DNA, 201 bp, Homo sapiens
aatggaatgctccagaaccctaccctcagaactgtataattagtccttgaatttggaattttcatgctttttctctgctggaaacctttagacgtctgcaractcccagggcttactctataagtgcaattctgcttctgactcttccctccactgagatgcctgtacttctagggtgttccttgatctcctctaaattgt

SEQ ID NO: 41432 - DNA, 201 bp, Homo sapiens
tgaaaaagttttgtggacaattttcatcacaataaggcagtgtttatggcaatttggtcaaagaaattacatcaaaatccatataatgtcagttttataarttgaatattattatgggaaaatgcttgagctctcatatgggcttttatactgtgattattattcccataacacgttttagtgtcttacacaactcaggac

SEQ ID NO: 41433 - DNA, 201 bp, Homo sapiens
aaatatcaaaagaacaaataaacacatggataatgctttaagaaaaaccgaagttgaaagtagaaaaaaattgagaaagagaaatgcagaaagaaatacawataatttgagagagaaattgaaacgtggaatatgaataaagaacttcttaaatatggttaataggcatctctaaagaaaaaaaaagcaagggaaagaact

SEQ ID NO: 41434 - DNA, 201 bp, Homo sapiens
agtggcacttctgcctttgctcgttttctcctgccgccataaaagacttgctttgcttccccttctgccatgatttaagtttcctgaagtccctgcagccragtagaactgtgagtcaattaaacctccttcctttgtgaattacctagtctcaggtagttctttttggcagtgtgaaaacgaactaattcagcagttaag

SEQ ID NO: 41435 - DNA, 201 bp, Homo sapiens
tttcatgtatgtaaaacaggtttttgaccgagactcaagttttaaaatttatattggtgtaactaaggaaatgtatagtaggaaaataggatttgtagagwcaagaactagatccatattctacttttgctatttatcagtggtgtgcccataagcaaatagttctaaagaagatgaattcttagttctaaagaaggaaac

SEQ ID NO: 41436 - DNA, 201 bp, Homo sapiens
gaagatcaagaacacgatacggatgcccacttttaccagtgttattcaacacagtactggaagtcctagtcagacaatcagataagaaaaagaaataatgktcatccacatgggaaaggaagaagtcaaattatccttgtttgcagatgatatgatcttatgcttagaaaaacccacagactccaccaaaaaactattaga

SEQ ID NO: 41437 - DNA, 201 bp, Homo sapiens
tcaacacagtactggaagtcctagtcagacaatcagataagaaaaagaaataatgttcatccacatgggaaaggaagaagtcaaattatccttgtttgcaratgatatgatcttatgcttagaaaaacccacagactccaccaaaaaactattagaactgataaattcagtaaagtttcaggatataaaatcaaaatataa

SEQ ID NO: 41438 - DNA, 201 bp, Homo sapiens
gtggccataaacagatgaacagttaaagaaaatgtggtatctatacacagtggagtactattcagccataaaaaatgaatgagatcttgtcatttgaaacwacatggatggaactggaggacgttattttaagtgaataagccaggaacaaaaagacagactctgcatgtcctcactaagttgtgggagctaaaaatcaat

SEQ ID NO: 41439 - DNA, 201 bp, Homo sapiens
ttggtatacatatgaattgcattatttttaaaggaatatgatccttgaaaacagttttaaaagacaaatgatgcactactaatagacttatgtaggaatcycctgtcccatcctcctatctccagtgtggctaccctgaagcaagaaccttcaacttctctaccctgaatcaactgcagtgccattctccccaatggcatt

SEQ ID NO: 41440 - DNA, 201 bp, Homo sapiens
caatgatgatatgctagctttaggtaaacggtctgatgttaacacatatacagagagtataaaattccacttgactcctcaagtgcccatcaaacattttytttaaaactcttttgatacatcttagtcccattctgcattttatatgggtcccattctttgattttcatttgttttattacatttgagtctctttacaaa

SEQ ID NO: 41441 - DNA, 201 bp, Homo sapiens
acactgaggcatgtcaaaattaaattgctcaaaaccgttaatagggagacaatcttaaaaagcatctagagaaaaaaccgtatactgtatacagaggaacraaaataaggatgatagcagatttctcttatttcaaagacagtagaacaacatctttaaaggattgaagaaaaaatgtaaacctagaagtctaaactcagc

SEQ ID NO: 41442 - DNA, 201 bp, Homo sapiens
agcaatttgagataaggcccagaaaagatagtggcacatcagatgaaggacacaagtctcctgatttcttcttttatgaccttttcactatttgtctattaaaaaaaaaaaaaacctgatgtaatgttatggcagtctaaagggttttcatgctaaatagataccattatctctaaactcttctatatagcaaaacccaac

SEQ ID NO: 41443 - DNA, 201 bp, Homo sapiens
agattaaaaaaatgggcaaatgacctgaatagacatttttccaaagaagatatgcaaatggccagtgggtatatgaaaaaagtgcttaacatcactaatarggaaatgcaaatcaaaaccacaatgaaatatgacctcacaactgttaggatggctgttatcaaaaagtcaaaagatagatgttggcagggttgtggagaa

SEQ ID NO: 41444 - DNA, 201 bp, Homo sapiens
ggcaatctgtaattatttatttatgtctcttggctgtctccactactagaatgtaagctccataaaagcaagaactttgtctttcaatactgtatcctcaktacctaacattttgccagggctttatgtattttatacacatttgtaatacgatcaattcaccaaaagttgtacatttagtttctttccagtttactataa

SEQ ID NO: 41445 - DNA, 201 bp, Homo sapiens
aatgaagtcacaatttatctttcctttttattgggaaagcccatctttaatttcctgttttatttttcagagaagttttcatgatacatgctttctttcctttttttttttctttttgacctgtgtgttttttactctatgtaattttggacagctgaatcattacctttcttattcatgtttacagagagtttatttatt

SEQ ID NO: 41446 - DNA, 201 bp, Homo sapiens
attcaatgaaaaacataaattttgtgggatttcttcataactttttgacacaaaataaataagatgttagaatcagtggttgagtacgatcaaaactccakatgaaattattttttgcatctctttttttaaccaattattagcagtgctttttagagagcagcatttattttgtttaaccttgcaatgagagagtttcag

SEQ ID NO: 41447 - DNA, 201 bp, Homo sapiens
tggaagtctgggtatggttaatgatactgttgaattatagttgcaatggtgagagagaattgtaaaactcaccctcttgagtgtagcttaatgtaattataaaaaaaaaggtggtagcaaaatccaagtgacataatttatgcttgagtctagatatattctggataactctacatagagaggaaaacccagagggattgc

SEQ ID NO: 41448 - DNA, 201 bp, Homo sapiens
atgcacatgggttgacgcaacagcctccaacacacacgtttctgcttttatcagccctttaatctgaatcttgtctactgcagatggatttttctccatasaggaggaacatggattttagcatcgtctaaggttatagttttactatgctctgaccaagaaagattaaaggcttttccttagcagtttaagggagaaaaa

SEQ ID NO: 41449 - DNA, 201 bp, Homo sapiens
tgaacataattacaatattttaatattatggcctaaattgttttactatttttacattgtaattctacattgcaatttgggatgcatgtctttgtctaacrtagataagtagattcacattttgcagggtttacattttgggagtcctttttaataaaatgaattcaaaatcaaaagtacaaagttagttaaggtgaatac

SEQ ID NO: 41450 - DNA, 201 bp, Homo sapiens
gtgttggaggtttggggaaaagaaagttatgcattagtcaactagaagaatgtaggagaagctggattggactgtgggtgattgctagaaatattaagaamccacgaaggagagcatcaggataaatagctaatgcacatgggacttaatacctaggtgatgggttgataggtgcagcaaaccaccatggcacacgttcac

SEQ ID NO: 41451 - DNA, 201 bp, Homo sapiens
gggttgataggtgcagcaaaccaccatggcacacgttcacctaggtaacaaacctgcacgtcctgcacatgtatcccggaacttaaaataaaatattaaaraagaacccactggaaagaatagatcatgaagttaaagcgagatatgtacatttttgtcctagccttgctcagttatgtgagtgaatgtgatgataatgca

SEQ ID NO: 41452 - DNA, 201 bp, Homo sapiens
gtcatcctcccacatagaaagaataacaagaggccagtacattgatcccacatataattttcaataaatgaggttcagtttggtctcaatgaactcttctragaagaaaacattgaattttattaggtgtacacagagttaacaaatatattcccaaacagtttagtatgaaacattttgaacccctttagatccaatatt

SEQ ID NO: 41453 - DNA, 201 bp, Homo sapiens
ctatctgaaaaggtatcatttagcaaaaatggagttatagattttcagtccagttctatttgataacccataaggtagacacatacacatatacatcttgytaagcttgactgcctcattggtgcatgcagatggatagaaactcctctggtctcctgaaagtttgccagcaaagggagataaaagaactgtcccatttaa

SEQ ID NO: 41454 - DNA, 201 bp, Homo sapiens
gcagaagtgggaaggagaagctaaagaaaataattattcctcacactgtgtaatacactggtcctggtgattttcaatattgaaatacgttctatcatctstaaagtttctaatattgatcctgctgtatcttattctgaatatattatttcatattatttatttggatgccaaagactcagtctactgctttgataaatt

SEQ ID NO: 41455 - DNA, 201 bp, Homo sapiens
tcagctcactgcaacctctgcctcctgggttcaagcaattctcctgcctcagcctcccgagtagctgggactacaggcgtgcaccaccatacccagctaattttttttttttttgtatttttagtagagactgtgtttcaccatgttgtccaggatggtcttgatctcttgacctcgtgatccacccaccttggcctccca

SEQ ID NO: 41456 - DNA, 201 bp, Homo sapiens
tatctaactgtagattggctttcttgatgttttttcataatagatagaattttctttgtttttatattttagttgcctaaattcatctcattactgcacgktgatttttgccttccattaagcttgaaatactaatactctcatttagttcaaaaggttgagtttaatcaacatgttattaaaaattttaaaccatttatt

SEQ ID NO: 41457 - DNA, 201 bp, Homo sapiens
tatgagtcatcagattgatcttctctgcgatgtactttaaaaattacaattcatttatcatcagtaaccgaaaatggcatttaaccattctacctttttcrattgcttttcttctagaacacattacttatatttctgcacttaaatgtgcatcaaagaggatagcaacatggaaggcctgattaactaactcaattatac

SEQ ID NO: 41458 - DNA, 201 bp, Homo sapiens
tgctagctttaggtaaacggtctgatgttaacacatatacagagagtataaaattccacttgactcctcaagtgcccatcaaacattttttttaaaactcytttgatacatcttagtcccattctgcattttatatgggtcccattctttgattttcatttgttttattacatttgagtctctttacaaattagctaaata

SEQ ID NO: 41459 - DNA, 201 bp, Homo sapiens
tttgctagaaattctcttcattaggagcatagcctttcaaaaaacaatgccactcatgatatgcttcagattctatataatcatctcatgttgcacttctyctaatttattttataaaagaagttcttttttggtgagagatagattgtaaaactcaatgtattcttattcttttttttttttgcaattattcctgaatac

SEQ ID NO: 41460 - DNA, 201 bp, Homo sapiens
tcagttgctttcaagcctaggttcttggctcaatattattacataaactagaattttcctattactattaattttactttgtatttttctttataaacttygtacttattgcttgtcaaatttcagcagaagtacaactcctgagagaataatgctggctcagagttttgagatgataacccttgtctatgaaactgatga

SEQ ID NO: 41461 - DNA, 201 bp, Homo sapiens
attctcagcaaactaacacaggaatagaaagccaaaggctagtttctaggcgctcttttggtttgattttgaaatctgaaaaatcagcattgaagttatakgtgtgtgtgtgtgtgtgtgtgtgtgtatgtaagaaaagttcagtaaacacctttagcacccaaattaaacactagttagcatttttctataatatatttt

SEQ ID NO: 41462 - DNA, 201 bp, Homo sapiens
acaatggttgaactagtttacagtcccaccaacagtgtaaaagtgttcctatttctccacatcctctccagcacttgttgtttcctgactttttaatgatygccattctaactggtgtgagatggtatctcattgtggttttgatttacatttctctgatggccagtgatggtgagcattttttcatgtgctttttggctg

SEQ ID NO: 41463 - DNA, 201 bp, Homo sapiens
actacaggcacgtgccaccacacctggctgaatttttgtatttttagtagagatggggtttcattgtgttagtcagaaaggtctcgatctcctgatctccygattcacccgccttggcctcccaaagtgctgggattacaggcgtgagccaccatgcaccatggaacaataattttaagaacattaattgttgacatcttg

SEQ ID NO: 41464 - DNA, 201 bp, Homo sapiens
ggcaagttctatcttaagaacctgcacagagtaaatattcagtacattatctatcaagtagtgtgttattcactgcaaattgaaaatcatcaaattcctarttgttctgcttaatagatgcttaactatattttagcagattccaaatatatgttaatatatatttttggaattcagcatgagtatctttagatgctaatt

SEQ ID NO: 41465 - DNA, 201 bp, Homo sapiens
atatttcattgactttgattgcattcgacaggatatagctatgcctatctgtgaatgagcctgggaatagagcttcgtatttgggcacattataaacctgaaaaaaaaaatttgtctctaagaaacaagggggtcattatattgtataggcaactagcattctcattgctttttctctcattcggggaaattaagtataat

SEQ ID NO: 41466 - DNA, 201 bp, Homo sapiens
atggctcactgcagcctcaaactcatggactcaagagatcctcctgcctcagcctccagaggatctgggcctgcaggtgcatgccaccacacctagttaattttttttacattttttcagcaacagggtggccatgtgaccttatgtaagttacctaaaccctgtaagtctatgtgcctcatctgaaaaactgataaaaac

SEQ ID NO: 41467 - DNA, 201 bp, Homo sapiens
gactacatttgtttggaggaaagtaagggaagagaacatgagtctgcctggtaattcaaggaattctcctggatcttatccaggaccaccaaggagatacytttacaagtctgtaagaatcacggcattactgggcttggggtgccccctaatgcagacacagctgcaatgaccaaagatttagataacaacactcaattc

SEQ ID NO: 41468 - DNA, 201 bp, Homo sapiens
caagtgttacaccaatgagtagagagaaaataatatagaaggaaaaaagggaaatccaacataaacaaaattggtgcacttgctgaagagaacagaaaacrtagaataattttcaaagatgtaattcaagattacttgttgaaaatatgtacacttttatctgtagacagggaaaaatatgtcctgggggaaaacacatat

SEQ ID NO: 41469 - DNA, 201 bp, Homo sapiens
actaacaaactaagaaaaaagagaaaggaaatgaacagtgttataggcaagtagatgctgtggcttacaagcatatggttttctctcagaaacgccccagycctgtctcctatctcatctctaggagcccacatctacacatcaacctttcctacctgaagtcaagacctaaaatagctgtttacatttggaagatagtat

SEQ ID NO: 41470 - DNA, 201 bp, Homo sapiens
aaacatagaataattttcaaagatgtaattcaagattacttgttgaaaatatgtacacttttatctgtagacagggaaaaatatgtcctgggggaaaacamatattttaaaaaaacgacatataattcagcagtaaaatcttccatggtaaagttagtgcattcaaaagataaggaaaaaatctaatgggagaaccaagct

SEQ ID NO: 41471 - DNA, 201 bp, Homo sapiens
tttaggttatatagttcttgaatttttaaagctgttcagacactgtaccacaacctcatatcacagtggtacccagaaaatccaaatagtagtacttgtgwaaatagatttctatttcagcctctttaaaggcagttatgtagatactcttaattttgaatttttggaaatagggaggatcattatttcctaaaattatag

SEQ ID NO: 41472 - DNA, 201 bp, Homo sapiens
caattttccattatattaggttgggttagtgttggcacataaaaattttttcatttctgtatgttaattttgtcacaagataccttgccaaaatgttttaktcctttaaatgcatttgtaatttttaaaatcttgggcataaagacagaccatctgctaataatgatcttggctctttattatattgtttgtctaattttt

SEQ ID NO: 41473 - DNA, 201 bp, Homo sapiens
cccaaaagggcagggtcaactctcaaaagcttctgagaggttatataagatggtacagagaattggccactgggttggggtcattggagacattgctgaaraagtacttgtcacatagcagtatcttgaggtaattggattgggttgagatgagactggagttaagagaacagcagcaaacttctttttgggaagtttact

SEQ ID NO: 41474 - DNA, 201 bp, Homo sapiens
gcactcaagcctggggacagagcaagactctgcctaaaaaaaaaaaaaaaaaaaaaaaaaaaaaaaaaaaaaaaaattatgaggacacataagaagcatasttaattttattgtatttgtgaaattgtgtgagtaggaggatgccaatgtcacagatttggtgaagttttccttggaccttgaagaatgattggaaattta

SEQ ID NO: 41475 - DNA, 201 bp, Homo sapiens
attttaccctcaatgtagctaagaataataagacagccaacactaacatagaaagatcaagaatgagtttatagcaaaatatttttttctcagaacctggkcccagtagtgtataagttacttaatatgcaggctgcttggcaatgcaaaaaatagtcatagaagaaatttggaggggcgcaggtgcatctacttgatttg

SEQ ID NO: 41476 - DNA, 201 bp, Homo sapiens
gaccttgaagaatgattggaaatttacctgataggtatatgataatgactgaaacaaaattggtagtgatttgtggtagtggctaaatagaagttgtgaastgaggcagcaaaataataaacttacaaaaattagccaggcacgtgcctgtagtcccaactgctcaggaggctgaggcaggagaattgcttgaacccagga

SEQ ID NO: 41477 - DNA, 201 bp, Homo sapiens
ctgtaatcccagctacttgggaggccgaggcagaattgcttgaacctgggaggcagaggttgcagagagccaagatcatgccactgcactccagcctgggygacagagcgagacttcatctcaataaataaattaataaataaaattaaaatattggatgccacaacttgttatttaacttcgcagtcctacaaaccgcag

SEQ ID NO: 41478 - DNA, 201 bp, Homo sapiens
atatgccagtgtttagttcatcttttctgaagaggcacagaagccaatgaggcacattcaggaaaattacttaaaatgtgaattacttaaaattacttaaratgtgaataaatttgtcaccatgaatacatataccctgaaacgtagaaactggttctatgtaactggaatgcattgcccctcaggaataatgcaactgat

SEQ ID NO: 41479 - DNA, 201 bp, Homo sapiens
tgtaatcccagctacttgggaggccgaggcagaattgcttgaacctgggaggcagaggttgcagagagccaagatcatgccactgcactccagcctgggcracagagcgagacttcatctcaataaataaattaataaataaaattaaaatattggatgccacaacttgttatttaacttcgcagtcctacaaaccgcagt

SEQ ID NO: 41480 - DNA, 201 bp, Homo sapiens
atgcaaaggaattttaaaccattgccttgcaaagtctttttttgcataacaacgttttgataaaatgaagagactgaccaaagtaacaactctaaataatrgcatttcactgccataaggatgattgtaattatcagtggaagcctagagcattaggtcccaactcctaatattagtttcaatttttatagcctggttgtt

SEQ ID NO: 41481 - DNA, 201 bp, Homo sapiens
tgtgaataaatttgtcaccatgaatacatataccctgaaacgtagaaactggttctatgtaactggaatgcattgcccctcaggaataatgcaactgatgrtcatggcttcccacatctgtgtgtgaaggaacagttcaccatatccagaccacactgctgatggtactacagtttgcctctttctccccacagcctgcat

SEQ ID NO: 41482 - DNA, 201 bp, Homo sapiens
cctgggcgacagagcgagacttcatctcaataaataaattaataaataaaattaaaatattggatgccacaacttgttatttaacttcgcagtcctacaarccgcagtataattaagggtagccctttggaatgaaagctaagttaccgcctaatatttcattccaaatttgactgttacttggcttctctgacctatggc

SEQ ID NO: 41483 - DNA, 201 bp, Homo sapiens
gtaacaactctaaataatagcatttcactgccataaggatgattgtaattatcagtggaagcctagagcattaggtcccaactcctaatattagtttcaayttttatagcctggttgttcaaagacatgcaattaaactaacctagtattattggaatagaaaataaagaactactgttggaaacacaattaacaatacat

SEQ ID NO: 41484 - DNA, 201 bp, Homo sapiens
agagcgagacttcatctcaataaataaattaataaataaaattaaaatattggatgccacaacttgttatttaacttcgcagtcctacaaaccgcagtatwattaagggtagccctttggaatgaaagctaagttaccgcctaatatttcattccaaatttgactgttacttggcttctctgacctatggcctctggcaag

SEQ ID NO: 41485 - DNA, 201 bp, Homo sapiens
tgccataaggatgattgtaattatcagtggaagcctagagcattaggtcccaactcctaatattagtttcaatttttatagcctggttgttcaaagacatkcaattaaactaacctagtattattggaatagaaaataaagaactactgttggaaacacaattaacaatacataatagaggggccatatttccaatggctg

SEQ ID NO: 41486 - DNA, 201 bp, Homo sapiens
tatcatgaattttgaacaaattttccagggctttttctcttgttttattagagaagtaagaggtaagatgcagcctttaactggtgaaagttgtgagtgtygtcagattcactttccctgttgaagaacctaggctggtgcttttctccgagaaactatgcagaaggaatgctgtggtagacagcattcttttttccctcc

SEQ ID NO: 41487 - DNA, 201 bp, Homo sapiens
gttgtgagtgtcgtcagattcactttccctgttgaagaacctaggctggtgcttttctccgagaaactatgcagaaggaatgctgtggtagacagcattcytttttccctcccatagaaaatgatatgttgtttactcatagcatcttagtcactgcattccttccttcttgatacgaaatgcaggactgagtcaagcatg

SEQ ID NO: 41488 - DNA, 201 bp, Homo sapiens
aggaatgctgtggtagacagcattcttttttccctcccatagaaaatgatatgttgtttactcatagcatcttagtcactgcattccttccttcttgataygaaatgcaggactgagtcaagcatggttttgtttggttatgcatgcatttctgtagaagatgaaatgcttctctttattttaatactgaatggaataatg

SEQ ID NO: 41489 - DNA, 201 bp, Homo sapiens
tgaaagttcctgtaggtcctttccagaaatagagtaactttcggagacctctccaacttctaagaagaaaacaaaatccttctcttatagtactatatcayggagtgattaaaagtgtgggctctgggctgggtgtggtggttcatgcctataatcctagcactttggaagcctgaagcaggtggattacctgaggtcagg

SEQ ID NO: 41490 - DNA, 201 bp, Homo sapiens
atcataagaaccatacttattatagtttgcgctggttgaaagtgattaggttccctccattagaagtctgtttcttccagtgtccacttgttcgtggcacrtgcatcttccacagacttttatagcataaagatccagccaagtgagtgttcctatggatgtgatggtctattaaggggtaaaataattttggtagaatgg

SEQ ID NO: 41491 - DNA, 201 bp, Homo sapiens
acagtgcactaagtagattattaagtttcctgactccacgcactggctcatggacagcatttctgggccagccttgagccagggagtagcttgctgccctraagggaggaacacaatcctggctcagtttgcaacctgctgactgaagagcccctgggccttgaacaaaattggcagtagccaggcagtgtggttgctatg

SEQ ID NO: 41492 - DNA, 201 bp, Homo sapiens
tagacactctttctgactgaggaaaggagagggaagggtgggaagaactttgttttgcagcttgggtgccaactcaagtcacagcagaacagtgcactaaktagattattaagtttcctgactccacgcactggctcatggacagcatttctgggccagccttgagccagggagtagcttgctgccctaaagggaggaaca

SEQ ID NO: 41493 - DNA, 201 bp, Homo sapiens
atcaatttataaaatttgataagatatatgttgctatatatatgtgtgaatgtgtacgcatttatacatatacacgaattatgtatatgaagacatatatsttgctattattttgccaagcttattataatacatagaagaatatactttttctcttcagtggttctaacagttgtagacttttagtgaaaaactgtgttc

SEQ ID NO: 41494 - DNA, 201 bp, Homo sapiens
gtggtaatggccatggatagacactctttctgactgaggaaaggagagggaagggtgggaagaactttgttttgcagcttgggtgccaactcaagtcacarcagaacagtgcactaagtagattattaagtttcctgactccacgcactggctcatggacagcatttctgggccagccttgagccagggagtagcttgctg

SEQ ID NO: 41495 - DNA, 201 bp, Homo sapiens
gctacaagggatactcatgattttggttttcattgtcgaggtggtggttacatggctttaatttcattattgggtgttaaacgataggtagggtttatatrtacactttagtgtgcatgatattgtggaacaaaacaattcacatggcagaaatgaaacaaatgaaaatgaacattttaagggtccaaaatcgaagtaaga

SEQ ID NO: 41496 - DNA, 201 bp, Homo sapiens
gaagctgatttgggtgtgcaattcttccctctcaggccatttgctgaattttaccctgtgcagggaaagagggtgagaagttcagcagataacttggatakaagaagagaagatgtcagaactttctgggttcttacagggttggaagaaaatatagaaggttgagacttttaaagccaccagcccttttgggtcacgacc

SEQ ID NO: 41497 - DNA, 201 bp, Homo sapiens
acttatctcgggtctcctattctggatacaacatttcaagagtcttggattcctgtttgattatcaagttcacttccactgaccaataaatattggtagaygttaagttctcaggcttgagaggcttctgtcatttggtgtgtccgatgctaacagacactcttaaataaaatgcctcatgaggggccgggcacggtggct

SEQ ID NO: 41498 - DNA, 201 bp, Homo sapiens
gagatggtcaatagaaacccatgattcaactggatatcttgataggccacctggaattaagtcttcaatgaacaatgtttatagaaaagcggattttggtrtcaaagcaaaagctactgcagaaataagcatctcttttgtacataagtctctgcctatctaccagggtagtttagaggtattgcctataagtcacttgta

SEQ ID NO: 41499 - DNA, 201 bp, Homo sapiens
ccatgtatttctagatcaatttcatggacttgtccaaattttctatcatttttctcaaatttgtcaatgaaagtccctcaccctgatggtcacaaaagatrttcaagttctttctttatttgattatgggacagatcttagcagtgggcatgagatcgccatggcacacagcttggtggcctgtacccaccaaaaggctga

SEQ ID NO: 41500 - DNA, 201 bp, Homo sapiens
agtgtggatctcatctctgtgcatatgggctgtgttatcccaagagaaaatagtccccaattatatgagttcatcctcatgaactcctgcaagaactcccrtgggtatatcctggtgcctgacagtgcctgctggtaagatgtggctcctgtcccacagccttcaaaggagactggtggcaagtgtcagcctgagagctta

SEQ ID NO: 41501 - DNA, 201 bp, Homo sapiens
cagtgtccctgaaccccatctctctcttctgctctgcccttccagtatgacgtttatcattgttatggtttggctgtgtccccacgcaaatttcatcttgrattgtagtttctataatccccaagtgtcgtgggagggaccaagtgggaggtaattgaatcacgggggtggttttctccatgttattctcatgatagtaag

SEQ ID NO: 41502 - DNA, 201 bp, Homo sapiens
aaaacaagaagggataatgaagagccacctcttaattacacaatcagttcacatttcttcagggagttctctagttcatcgctgcaatttgaaggagatcrtgccgcctgagagtatgaattcagtgactcccaggcactgatggatttcttgtatgaggaagagatcagatcacacactcagactaaccctttcttaact

SEQ ID NO: 41503 - DNA, 201 bp, Homo sapiens
atacttcttgggtcccacatcttccaaagaagtccagcatacacacacactcacccacccacaacctgtcacacatccccagaaaagagaaagagtgaaakatgcttcacaaaatcggcctcagcctggtgttcaagttgcctcgctcaatatgcctgtgcagtcagacctgcaggaagaaacagctcatttttaaactac

SEQ ID NO: 41504 - DNA, 201 bp, Homo sapiens
tatggtgcctttcgaggaaacttctctgatagtcaatgaaatactccatgtggtctttgttggcagatatatcactatccatttgttaaacaagcagtagrgtgctgtacatttttttatgcctagaaatgtgaaagaaagtcttcaaaattaggataaagaaatctctaaaatcaggaaattcctcaccttgatgagacc

SEQ ID NO: 41505 - DNA, 201 bp, Homo sapiens
gtctttgttggcagatatatcactatccatttgttaaacaagcagtagagtgctgtacatttttttatgcctagaaatgtgaaagaaagtcttcaaaattmggataaagaaatctctaaaatcaggaaattcctcaccttgatgagaccacaagggaaccagcatcctttgcagactgacctgggagcagcagctcactgg

SEQ ID NO: 41506 - DNA, 201 bp, Homo sapiens
atatttcctcaagagcatgcaaatcaacctggaccctcaggaaaacaagtcaagactaaatacaattatgccatagctacgcaagaagttaaaaaacacarttgtcacaatctaaataattctgactgcactcttactttgagaagtgtgtcaagaaatggcaaacatttaatttggactttggggatttttgcagctgaa

SEQ ID NO: 41507 - DNA, 201 bp, Homo sapiens
ggcctgggcagcatagcgagacctgctccctactaaaaattttttaaaaattgccagacccagtggtgggtgactgtagtgccagctatcaggaggctaakacaggaggctcatttgagcatgggagattgaggctgcagtgagctatgatcaggccactgcactccagcctaggtgagagaattagaccctgtctcaaaa

SEQ ID NO: 41508 - DNA, 201 bp, Homo sapiens
ctagttctttttttttttttttttttccgagacagattctcgctgtgtcacccagactggagtgcagtggtgtgatctcagctcactgcaacctccacccsccggattcaaacgaatctcctgcctcagcctcctgagtagcagggactacaggcgcccatcatcacacctggctaatttttgtatttttagtagagactg

SEQ ID NO: 41509 - DNA, 201 bp, Homo sapiens
aatatttatatcatagcagccggtctactagctgaccttggcaaagggaaacctcacatcagtgggacggggatattgaagcctttgtcctttgggaaatytagcttccaaacctggtctgagatttaaaggcaagagtcacatctaagaaggtggaaaagtctggtacagctagactgagagtatcaggggaatttacca

SEQ ID NO: 41510 - DNA, 201 bp, Homo sapiens
accttgaagagaaggacccagtgctggcagaattcatcacctggctaaagagcacctgggttttgaataaatatcagtggtacccaggcagtacttgctgkgggccatgggtgagacccagggccatgctagattcaggtgtgatccaacatatttcaagctgtgttggccatggagagagatttcttttgcttgaagaaa

SEQ ID NO: 41511 - DNA, 201 bp, Homo sapiens
tgttgtttctttacttaaaacgtttcagttgcagatttaaggaaactttccctcttaagctaattataatttacagctatttgacaaaagtatacctttgttttttttttgtttttttttgtttttttttgagacggagtctcgctctgtcgcccgggctggagtgcagtggcgcgatctcggctcactgcaagctccgcc

SEQ ID NO: 41512 - DNA, 201 bp, Homo sapiens
caggataacacagagaaggaattcagaattctatcagataaatttagcaaagagattgaaataattaaaaaaagcagaaattctggagctgaaaaattcarttgacatactgaagaatgcatcagtatctatcaaccacagaattgatcaaacagaagaaagaattagtgagtttgaagacaggctatttgaatagttaga

SEQ ID NO: 41513 - DNA, 201 bp, Homo sapiens
tctgtgatgaccacaactcctttttcctgatcactttaatcacccaggctgttaactcatttttaatcactgtgttttaaaagaagcactaatgattgatycttgccccttttcaatatattttgaacttaccaattctgcagttttgttaaatatgtcaaaatactcttttcaactgcacattttttcaacgtgattttg

SEQ ID NO: 41514 - DNA, 201 bp, Homo sapiens
ataaagagagatattacacaatgaaaaagtaattatatcctaagttttaaaatgctaagtatatatacacataaagcatttcaaaatacataaatttaaaraatgacagactgaaaggggaaaaaatccacaattgtagtcaatgtcaatactcctttctcatagtcgacagaacaagtagatagaaaattagtgaggata

SEQ ID NO: 41515 - DNA, 201 bp, Homo sapiens
cctcacaaatggagttattttactgggttctcctatccctatcaagaatgttaatgataatatttgtagatcttaggcctgtattttattttacataggaracagtgggagggggaatgtattattttcctccattctagggaggcaggttttgtctttgaagcctgatttgccctctcattattagaatatagttcacag

SEQ ID NO: 41516 - DNA, 201 bp, Homo sapiens
cctctgagaaaccagccattcaatacacttttacctttggatgatgggttattagaagcctgttgtcagtgtgtcaacgatattctattcgagatggaaayctttagttataaggtgatggtgagtaatagcctttgtaatttcaggttcttgtcattgtgggaagtgcatttgttctgctgaagagtggtatatttctgg

SEQ ID NO: 41517 - DNA, 201 bp, Homo sapiens
taagcaagtctatgcctgttaagttcaggaatttaaatgaaatgggccaagtccttgaaagacacaatctgccaaaaatcaattaaaaagaaatagatgayttgaatagccaatattggtcaagcaaagtgaatcatagttaaacatttgtaaaaatgaatattctaggctccaatgattttactagcaaattctaccaaa

SEQ ID NO: 41518 - DNA, 201 bp, Homo sapiens
gaactgtcttgaatctgagtgatcagcctctgggaagcctgtcctcttatgcacagggcaagtctcggtgagaggggcagctgtgactcatcagcagttaytactgtcatcagcgagatgggtggatacatgggccccggagaggggatctgggaggcaccacaacatccactagggagacagtcagagtccagatacaaa

SEQ ID NO: 41519 - DNA, 201 bp, Homo sapiens
tgaggtcaaatttctcctgtaagagtatttatacaaatcttcttgttaacctcacacctcacacatcttgtcgctttcagtttttgaatctttgagtcttytctgcattgttgacagaagcacaatgatggagctgtccagctctacagtttccatatgtgagaggcttaatgatgtcaatactgttggaggtagagatta

SEQ ID NO: 41520 - DNA, 201 bp, Homo sapiens
ggaactggatgtgtgtatgggggagaggtataaagagggctcagccgtgtcatagccactgctatcctaatttattgagtcctcataattggttataaatycatttgtttagccaagttacgaggaaacagagacatgtatacttctcctcagctctagctgaaggtaaaagatgactctttgtgtgtcattaagttagac

SEQ ID NO: 41521 - DNA, 201 bp, Homo sapiens
taattggttataaattcatttgtttagccaagttacgaggaaacagagacatgtatacttctcctcagctctagctgaaggtaaaagatgactctttgtgygtcattaagttagacctttgctttctgcccatccttactacgtaagactctcttcacggattacttggcctgcctcatgttatgtcaaagagccttatgt

SEQ ID NO: 41522 - DNA, 201 bp, Homo sapiens
aggaaggcaagaaagaaggaaagatgacaaaacaaccagaaaacaagtaacaaaatggcaagattaagtctttacttattaataataatattgaatataartggactaaactctctaatcaaaagacatggagtgacttactggattcaaaaactaaacaaaacaaatgagacccaatgaacatttgcccacaactaacac

SEQ ID NO: 41523 - DNA, 201 bp, Homo sapiens
aatggcttaaatagaaattacaaatattcactcagtgataggaacaaaatgtttattttcttaatggtgaaactttgctttgtatgaaattcacattgaaytatgaaagtgtacaataattgggacttcccttacatatttacaggtaaatctacttatacacattagtttaggcaacctttaattatttagagctaaaaa

SEQ ID NO: 41524 - DNA, 201 bp, Homo sapiens
tcagttgacatactgaagaatgcatcagtatctatcaaccacagaattgatcaaacagaagaaagaattagtgagtttgaagacaggctatttgaatagtyagaagagacaaaagacaaaaagaatgaagtttgcttacaagacccagaaaatagcctcaaaagggtaaatctaagagctatttgtcttaaggagaagggg

SEQ ID NO: 41525 - DNA, 201 bp, Homo sapiens
aaaaactatataagaggcaagtttattatgtaatgataaaggagtcaactcagcaagaagttatagcaagtgtaaatatatatacacccaaaactggagcrcctagacatgtaaagcaaatattattagagctaaagtgagagatagaccccaatacaataagagctaaagactttaacaccccactttcagcattggaca

SEQ ID NO: 41526 - DNA, 201 bp, Homo sapiens
cctctgcacatggatcattctcaagggtagactatatgttaggccacaaaacaagtattaaagaattcaaaaatattgaaattatatcacatatcttctcrgaccacaatggaataaaactagaaatcaataacaagaggaactttggaaactatgcagacacacagaaattaaacaatatgctcctgaatgaccaatggg

SEQ ID NO: 41527 - DNA, 201 bp, Homo sapiens
atcttctcagaccacaatggaataaaactagaaatcaataacaagaggaactttggaaactatgcagacacacagaaattaaacaatatgctcctgaatgrccaatgggtcaatgaagtaattaagaaataaatttaaaaatttcttaaaacaaatggaaagactacatacccaaacctatggaatacaatgaaaacaata

SEQ ID NO: 41528 - DNA, 201 bp, Homo sapiens
caataacaagaggaactttggaaactatgcagacacacagaaattaaacaatatgctcctgaatgaccaatgggtcaatgaagtaattaagaaataaattwaaaaatttcttaaaacaaatggaaagactacatacccaaacctatggaatacaatgaaaacaatactaagaggaaagtttatagtaataaggacctacat

SEQ ID NO: 41529 - DNA, 201 bp, Homo sapiens
gaactttggaaactatgcagacacacagaaattaaacaatatgctcctgaatgaccaatgggtcaatgaagtaattaagaaataaatttaaaaatttcttraaacaaatggaaagactacatacccaaacctatggaatacaatgaaaacaatactaagaggaaagtttatagtaataaggacctacatcaaaaaagtaca

SEQ ID NO: 41530 - DNA, 201 bp, Homo sapiens
ataaggacctacatcaaaaaagtacaaaaacttcaaataaacaacctagtggtgcatgttaaagaattagaaaagcaagaacaaaccaaaccccaaattaytggaagaaaatagtgaagatcatagccgaaataaatgagatcaaattaaaaaaataacaaaagatcaaccaaagggaaagttggtgttttgaaaagataa

SEQ ID NO: 41531 - DNA, 201 bp, Homo sapiens
atttttaaattcagaatttccactttatttgttttttacagataattgtctagtgagtttctccacacagtaatattttttgaacattttaaaagtaatagatattttagtcaatgactgatgatttaagtttgttacctgcatcattttttaatctctttctattgtctgtttttttctcttttatttttagtgaatctg

SEQ ID NO: 41532 - DNA, 201 bp, Homo sapiens
ccatttagtacagtgacactggctaacaaatgccccaagaagtattaaatctcttttctgaattttgaattatcacatgcattattaatctaccataattmaatgtcattttcatatgtgaaagtgtgagagggagaatgctgaggagattgaaggagaaagactatatgggttccaaaactggctcgattttgggaagtt

SEQ ID NO: 41533 - DNA, 201 bp, Homo sapiens
aaaaaaatgtgtattggtatatttttccagggatagatctgtgttctgccagttatggttcttgattacaaacaacaaaaccaacttcattaaaagggataaaaaaatattttattagaaggctttaggctcagaatgcaactttgaacaattagctcctgcagcaacctggggaagcaaggcactgccaagaaccagttc

SEQ ID NO: 41534 - DNA, 201 bp, Homo sapiens
ccctgcctcctgctgaacctgggactacctccaagtagagattagttgaaggtcagccagcacaacactgtattgccatgtctttcaccagattctcaaagggatcgtgaccccatcatgtcagctagaaaatattatgaatcattgcattagattatctttaattacagctctgaaattatatgatcctaaatactaatt

SEQ ID NO: 41535 - DNA, 201 bp, Homo sapiens
taattttcaataaatgaggttcagtttggtctcaatgaactcttctgagaagaaaacattgaattttattaggtgtacacagagttaacaaatatattccmaaacagtttagtatgaaacattttgaacccctttagatccaatattgaacattttgcatggaatcttcattgtgtagtcaactgttcctggcctttcttg

SEQ ID NO: 41536 - DNA, 201 bp, Homo sapiens
tttacattcatatccattgtgtgtgtttgtgtgtgtgtgtgtatatatacatatatatatgtatatatatgttgagttttctaaaaactaacaatttaatygatagcccctgagggaaataagactcgtataggccaagtaaggaaacagggtggattatcgctgttcagttggctcagtttcacttaattcctcttttct

SEQ ID NO: 41537 - DNA, 201 bp, Homo sapiens
tttaagatcttctagccctggggagatctttatccacacccacattttgatggacaataagaactgctgtcatgtttgttcacatttacatttctgcagtstcagaccagtccttggagaagcttgaagggtcaaactgtcatattctcccaaagaatctactggagaagttataataataatgcttaatatctcacaatt

SEQ ID NO: 41538 - DNA, 201 bp, Homo sapiens
attaaatattccattaataatgttaaattagtaaagtaggaaatggtccaattgttcaaatctttgcctattttccaagttaaaaaataagccactaaggmaacaaagaagaaataatcagagatagaaaggcattcagaaaatagtgtgtcagggaagacaaagatagtttttcaaagaaaaaataactggccaacagca

SEQ ID NO: 41539 - DNA, 201 bp, Homo sapiens
aataatcagagatagaaaggcattcagaaaatagtgtgtcagggaagacaaagatagtttttcaaagaaaaaataactggccaacagcatcataatcagcrcagtctaattaaacaaatatagactaccgttcttgtatccacagcacaaatgtcattgtcaacgttgaaaagaataggttcagggagtaatgacagcaaa

SEQ ID NO: 41540 - DNA, 201 bp, Homo sapiens
tagcaatgagcaaggctccatggtcataggaccctccaagtcaggcgcgagatataatctcctggtgtgccgtttgctaagaccattggaaaagcgcagtrttaggaaaagtgacccgattttccaggtgctgtcttttatccctttctttgactaggaaagggaattccctgaccccttgtgcttcccgggtgaggcgat

SEQ ID NO: 41541 - DNA, 201 bp, Homo sapiens
actcaactgtgctcaggacgaataagtcacaacacctgtgaggatctggctatgttgtcttactcttgttgactggtttgcctccattcattattgcagaygcacttgtgcttttacttggcgtcaccccaggcttcgggaccgtttccccaacatcatgcaaagatggttctcggtacatggcaactagtgatgggaaga

SEQ ID NO: 41542 - DNA, 201 bp, Homo sapiens
ttcccagaaatattttttaatctgactcaaaaagagatagaacatgttaaactatcaggaattaaataaggtggctaataatcacaactgttttcatatcktactgaagatgctaccaagtgaagtcaaagtagcatagcaatgtgaaggaaaaacaattctcaaatattttagtatcagtagatctctataattttagaa

SEQ ID NO: 41543 - DNA, 201 bp, Homo sapiens
aaaaataatttattgtacatttttaaataactaaaatattggattgttttttaatacggagaaaggataaatgtttgacgtgatagatctgcatttaccckgatatgactattatgcgttgtatgcctgtatcaaaatatctcaggcaccctataaatacatacacctattatgcacccacaacaatgaaaaagaaaaatt

SEQ ID NO: 41544 - DNA, 201 bp, Homo sapiens
aagaacactgcactgaaatatatccaatatgccactttatggcaccttccaaatgctcttagtgtaaatgtatgttacaaatcccataaagcacagcaaarataacaaccaaactgttggtacaaatcatgagacagattcagtagttgtctgtttttatatgcacattcagtaagctgcttacctatgttttgttacatt

SEQ ID NO: 41545 - DNA, 201 bp, Homo sapiens
gtgggtatgaaaagaattgcattgtagtcaaacaagcaaaattttaaggtaggatatcatggacattttgcttgcctaggccagcaggttcttttaaagawgctgttggagagaaaccttcagagatcaataggagcagctcatagggagccttttaatgccaaaagatatgtgtgtgtgtgtgtgtgtgtgtatgtgtgt

SEQ ID NO: 41546 - DNA, 201 bp, Homo sapiens
aaccaaggctcagagcagtatgtatggtagagtaataaatttaagaaaactgataagtgtgtgcttgtggaagattaaacttcacattctttatcttgaakgtgcaaaggaaatatttcttttaattcctttctattttctctgatgtttctcatgagctttcttcctatttttcaactgctcactgaatgccaggaaaaa

SEQ ID NO: 41547 - DNA, 201 bp, Homo sapiens
tatatatacacatgtgcatatatatatgtatatatatatatgagagagagcatatatatacatatgagagagagagagagactgtgaacgcccttggcagkcaatgtgagcagagaattggcttttccagaaaggagtttctgggacatcactcttgggataaataggaaaaagataaaagccttcaaatggaggtaccaa

SEQ ID NO: 41548 - DNA, 201 bp, Homo sapiens
agagatacacacatttgaaactgctttaaccagtactatctgtattcgtggttattcgaattgcttcaacatgtgtataatgtgtagtgtggtatgtgtaygcatacattgatccttatttgtatcatactttagatgtgctttatcagtataatgaatattagaatcagtttttaattggtgggatatatgttgtttaag

SEQ ID NO: 41549 - DNA, 201 bp, Homo sapiens
gggaaagaatgatgctaggcacattgtgatattatagaactgacaggaattggagactgggttaagaggtggagatggggctgcaatttggtaaatgtaastagttatggacttctggctctcaaatattgcaagttctacaacccttcctccaccttatcccagagatatctgagtgtctttttggtttgaatttcaagt

SEQ ID NO: 41550 - DNA, 201 bp, Homo sapiens
ggaaagaatgatgctaggcacattgtgatattatagaactgacaggaattggagactgggttaagaggtggagatggggctgcaatttggtaaatgtaacyagttatggacttctggctctcaaatattgcaagttctacaacccttcctccaccttatcccagagatatctgagtgtctttttggtttgaatttcaagtt

SEQ ID NO: 41551 - DNA, 201 bp, Homo sapiens
gacagaagtaatactcagaaaattcatagtagagtagtggattcatttgacacataactatataccatgagatggaagtcaaaaaagttccacaggaggtaaaaaaaaaaaaataaggtattacagaaattcagaggagagacaatgagtctcacttagggatattaggtaaatcttcacagaagggtagtcgctttttgc

SEQ ID NO: 41552 - DNA, 201 bp, Homo sapiens
tttgttggaaaactaacattttattatcaatttataaaatttgataagatatatgttgctatatatatgtgtgaatgtgtacgcatttatacatatacacraattatgtatatgaagacatatatcttgctattattttgccaagcttattataatacatagaagaatatactttttctcttcagtggttctaacagttgt

SEQ ID NO: 41553 - DNA, 201 bp, Homo sapiens
ttttccaaggatagtaatggtcagagcacggcataccttggtctgagttaatataggtaatacgataggggagcgggcagctggaaaacggaaacaagttmacaaaaagagatacacacatttgaaactgctttaaccagtactatctgtattcgtggttattcgaattgcttcaacatgtgtataatgtgtagtgtggta

SEQ ID NO: 41554 - DNA, 201 bp, Homo sapiens
gggagatattgtgtaaagatacaaacgctgattttgcagagaaattaaaagtacctagaactgaattggacaagaatattctgccttttccaaggatagtratggtcagagcacggcataccttggtctgagttaatataggtaatacgataggggagcgggcagctggaaaacggaaacaagttcacaaaaagagataca

SEQ ID NO: 41555 - DNA, 201 bp, Homo sapiens
agaaatattacagattgtgagaaatattcctcgggtctgtgctgcttgtatttctcatcgtcttgcaaacctggtgtcagtcttgatagtacttaatagaygtacactgaattttttttttgaataactgaatgagtctaggcacgtacttgttgctatgggaagggtatggggatgatccagtgttccagctgaatcaaa

SEQ ID NO: 41556 - DNA, 201 bp, Homo sapiens
taatagatgtacactgaattttttttttgaataactgaatgagtctaggcacgtacttgttgctatgggaagggtatggggatgatccagtgttccagctsaatcaaagaaaaccgagttacctgagaacatgtggcagggaaggagaaagaagtaactgaagtggaaaacagatgggtgcagaataaattttaccatctt

SEQ ID NO: 41557 - DNA, 201 bp, Homo sapiens
tgccaatataatgatgttttggtaaacaaggaaccacatatatgatagggatcccattaaggttataaagccatatttttactgtttcttttctatgtttrcatatgtttagatatacagatacttactattgtgttacagttgtcttcagcattcagtacagtaatgtcccatacagatttgcagcctggaggaaatagg

SEQ ID NO: 41558 - DNA, 201 bp, Homo sapiens
gggatcccattaaggttataaagccatatttttactgtttcttttctatgtttacatatgtttagatatacagatacttactattgtgttacagttgtctycagcattcagtacagtaatgtcccatacagatttgcagcctggaggaaataggctataccatacagcccaggtgcgtggtaggctatcagggtgtgtatg

SEQ ID NO: 41559 - DNA, 201 bp, Homo sapiens
gtttcttttctatgtttacatatgtttagatatacagatacttactattgtgttacagttgtcttcagcattcagtacagtaatgtcccatacagatttgyagcctggaggaaataggctataccatacagcccaggtgcgtggtaggctatcagggtgtgtatgtacactctgtgatgctcacacagtgatgaaattgcc

SEQ ID NO: 41560 - DNA, 201 bp, Homo sapiens
gtgtcatagtttagtttgccacatttttttcttttacagtggtacataaaatgatgaaaaatctctcaatggatggttgtatttgataaactatggcatgraaagtaattcatacatcataagttctcaatgaaagtgaatggactggattttttttattagttgttgcttaccaatcttaaagaacttaggtaagccatt

SEQ ID NO: 41561 - DNA, 201 bp, Homo sapiens
tcaagaaatcacaggaaagaaccagataaccaaatccatgacttaaagttcttttaaaagaactctcatttttaagtggaattgatataaaatgaaaaatyaatgctagcagaaagagattctgatttcattggccaccacgtttggggcaggatgggaatcttgtctgaattgttaacgtgggttaacttgtttatgttg

SEQ ID NO: 41562 - DNA, 201 bp, Homo sapiens
ttaaagaaaatgtggtatctatacacagtggagtactattcagccataaaaaatgaatgagatcttgtcatttgaaacaacatggatggaactggaggacrttattttaagtgaataagccaggaacaaaaagacagactctgcatgtcctcactaagttgtgggagctaaaaatcaatgcaattgaattcatggatacag

SEQ ID NO: 41563 - DNA, 201 bp, Homo sapiens
cagccataaaaaatgaatgagatcttgtcatttgaaacaacatggatggaactggaggacgttattttaagtgaataagccaggaacaaaaagacagactytgcatgtcctcactaagttgtgggagctaaaaatcaatgcaattgaattcatggatacagagagtagaatgatggttactagaggctgggaagggcagtg

SEQ ID NO: 41564 - DNA, 201 bp, Homo sapiens
cttatataacctcctcattttaccttcaaaaacccttgtcttttgttttcctcccctgaaggtgtctgtagtttactatgctatgttattccatgctgtastgcccactgccagataaacttattatctttggagaatgtctgtctttctgcccattattaagactgacataatctggtatcaagaaatgggacagaagta

SEQ ID NO: 41565 - DNA, 201 bp, Homo sapiens
ggtgattattggtaatctttgtgttagccatttcacaaatttatttgaaggagcagtaaaaatgttctctctgtctatgaaacatcttctcctcaggcatratttgtcagctttgtgtgggggattctttacacagcccactggaattcagtgatgcaatgttgttagtaggagaggactgacatttttttcagacaaaga

SEQ ID NO: 41566 - DNA, 201 bp, Homo sapiens
ctgggttaagaggtggagatggggctgcaatttggtaaatgtaactagttatggacttctggctctcaaatattgcaagttctacaacccttcctccaccktatcccagagatatctgagtgtctttttggtttgaatttcaagttaaaaccctgaatatctggaggaacacccacgcccatcatgctctgatgttaagta

SEQ ID NO: 41567 - DNA, 201 bp, Homo sapiens
gcaaataaataaaatatgtaagtccaggatgtctaatagtgcaaagaaaaagaaagcagtcagaagtctatctgaaaaggtatcatttagcaaaaatggarttatagattttcagtccagttctatttgataacccataaggtagacacatacacatatacatcttgctaagcttgactgcctcattggtgcatgcagatg

SEQ ID NO: 41568 - DNA, 201 bp, Homo sapiens
tattaatatattttataatgtatagtacactaacatgcttctaaaagtcataactatgcagaaaagtatactcagagaatcatccctctcttcctcaaacsttgcaccctgcttaccctcaccttatagataaccaactttattgctctcttccttctctgtgcatgtatttctttttgtgtaaagataaatagacatatt

SEQ ID NO: 41569 - DNA, 201 bp, Homo sapiens
cgagggccctatattttggaaaccaccagtgtgtatcaggacctttgctctgaagatgaaaaacacagaaaaattaatttttgctgttggttatgtttctrttgcttttccaaaggcagctgatgtcaaggtataatatggatatgggaaggggtggcgtttaggaatcttaaaataatacacagacaacgcacacaagaa

SEQ ID NO: 41570 - DNA, 201 bp, Homo sapiens
ctatcagcttaaggagattttgggctgagacaatggggttttctagatatacagtcatgtcatctgcaaacagggacaaagaggaaggctttatgtgtctktctccattgcattagtatgttggaataaagtccactgtgatcacagaacacagtttgtggaaaataaagtctaggacttcattttctcatatgtaatctt

SEQ ID NO: 41571 - DNA, 201 bp, Homo sapiens
cttgttcataagtattttcgttattggtgctttccatttctgtataaatgtcataattggcttttaagctttaaaaaatcctgataagattttggttgtarttacatcgaatctatagatcaattaggggatatttggtattttaacaatattgaataataagcatacagtatttcttcacatttaaatctcaaagctttc

SEQ ID NO: 41572 - DNA, 201 bp, Homo sapiens
ttgcagagataatttattaagttgagatcatactggagtagagtgggtccttaatctgatatggctggtatccttataagaagaagaaaagaagctgggcrcggtggctcatgcctgtaatcccagcactttgggaggccgaggcaggcggatcccctgaggtcgggagttcgagaccagcctgaccaacatggagaaacc

SEQ ID NO: 41573 - DNA, 201 bp, Homo sapiens
atagagctggatctatccctgggtgcaaatcaacttacggttcaaaggataccaccaggatctaaaggtggactctgctaggcactgggatagccccacayccaggcttcacatggtggctaatgacaacagtagatacatatcatcacagcaccctgtccagtggacagagaaattatctcacctggaatcctcttgatg

SEQ ID NO: 41574 - DNA, 201 bp, Homo sapiens
tgcttcagcctccccagtagctgggattacaggcacccaccaccacactcagctgatttttgtatttttagtagagatgatgtttcgccatattggtcagrctgattttgaactcctgacttcaggtgatctgcctgccttggcctcccaaagtgctgagattacaggcatgagccacctcacccagccaatacattctta

SEQ ID NO: 41575 - DNA, 201 bp, Homo sapiens
catgactggagaaggccatgtaattggagtgattggagaggcaaagatctgagtgatgcaactgtgagctgagaaactccaagaaatgtaggtcactgccrgaagccaaaataaggcaatgaaggattctactcagagtctcaagagaccctggtcctgttcgcaccttggttttggacttcgagtctccagaaatatgag

SEQ ID NO: 41576 - DNA, 201 bp, Homo sapiens
tagagggatcagaccttctgagaaagatctttttcattcttaaaaaggaacgttaagtcagagacatgctttacttcccagaggatattctgagtgagttktatgagttggtgaggtttagactggacacagccatctggtaaccatgaagggacaagtctgagaccagagccaacagcctgaggatgaggggcaaacaca

SEQ ID NO: 41577 - DNA, 201 bp, Homo sapiens
tggcagatattcctgaaatggaaaaacagtacttcaaagttgaggctctgtggaacttcgtcatgatttttcttcatcaatctctattcttttttgtagayggcatatttggttttttttttccctgctttttgtctaactagttatatattgcttattgtagatacttttgcaaataccaaaaaaaatgaaactcccaga

SEQ ID NO: 41578 - DNA, 201 bp, Homo sapiens
ttggttgcttttagggaactggatgtgtgtatgggggagaggtataaagagggctcagccgtgtcatagccactgctatcctaatttattgagtcctcataattggttataaattcatttgtttagccaagttacgaggaaacagagacatgtatacttctcctcagctctagctgaaggtaaaagatgactctttgtgtg

SEQ ID NO: 41579 - DNA, 201 bp, Homo sapiens
gaacaatagtcaaaatgtattattttgggaaatcttgaatcaaattatttacaggtatcctgagagatctctattataataattgtaaaaggcagcaatarctttctgaaaaatatttatatattgtttcttttttaaatattgtttaattatacttattttttatttatgtctataatgtaaggtaagggttaaaaatac

SEQ ID NO: 41580 - DNA, 201 bp, Homo sapiens
tgagacaaaacatttttgttgtctggagttactcaatttgtgggactttgttatggcagttcttaggaaactaatatgatggattaaatagttgcctaaakttacatagtgagcaagtcatacaagcagaatttgagtcaagcagtctgtcattggagcctgcactccacagccctgccttatccctcctcaggggacaga

SEQ ID NO: 41581 - DNA, 201 bp, Homo sapiens
gatgaggggcaaacacagaggaagaatctgggccccatgaggtcaacagtgagctgctaaaattaacctgaaatttccctgctgggagacattgtgttgtsaaatagttttataccatcttttactaggttttcaattaccagcagttggatgcaccctgtgatccaatggatacaaatgagatttagaagtgcactttaa

SEQ ID NO: 41582 - DNA, 201 bp, Homo sapiens
aaatactatatgggattaacagcagattcacatcacagaagaaaaaacggtgaatttgaagatggagcattcgaagctatccaaattaaaacagaaaaatrtttttatttgtataaattttaggattacaagtgcagttttgctacatgaatatgttgtatagcgggggaagtctgggtttttagtgtaatcatctcctag

SEQ ID NO: 41583 - DNA, 201 bp, Homo sapiens
tcttactttcctatcaggcctgggcatattccagtctgtccaccatttcttgtgcatatccttacaataaacatgaaatttatattttataatccaaattsaggtaatgttccatttgactgtcatacaaggtttcccaatcaaaagcagatgagatagtggttgaggccaaggcatcctgggtattagttatgtatttaa

SEQ ID NO: 41584 - DNA, 201 bp, Homo sapiens
tcttttcttagaattctagatgtgacttagtttccttcctctacagtgagggaggaaataagagtgatttgtgaagatgcatattttttttcagtaaaacwggggaggtttcacttatctcgggtctcctattctggatacaacatttcaagagtcttggattcctgtttgattatcaagttcacttccactgaccaataa

SEQ ID NO: 41585 - DNA, 201 bp, Homo sapiens
cagcagtctcaaggaagagtaaaggggtccatgtgagtggaataaggtgagcaagggagagaggagcaggagatggggcgcagagataagcaggtgaggtrcaggtcatggaatggctgtaggtcattcaaaaaacttttttttttttatatttccccaagaaatgaaaagattttcagcaaaagagcacagtggtctaat

SEQ ID NO: 41586 - DNA, 201 bp, Homo sapiens
gaagttctgcaggcacaaggaaaatcatgccaagtggaaagatgaatctacactaagtcatgaaaagaactagaaatggtaattacatgggtaaatatatrtggtgcatttttcttttattcacatgtcttttaaagagaagtttgcatcaaaaagtgggtaaaggatatgaatagacagttctcaaaaaaagatatacaa

SEQ ID NO: 41587 - DNA, 201 bp, Homo sapiens
atgaatctacactaagtcatgaaaagaactagaaatggtaattacatgggtaaatatatgtggtgcatttttcttttattcacatgtcttttaaagagaartttgcatcaaaaagtgggtaaaggatatgaatagacagttctcaaaaaaagatatacaaacagctaacaaacatatgaaaaaatgctcaaaatcacgaat

SEQ ID NO: 41588 - DNA, 201 bp, Homo sapiens
atctcattactgcacgttgatttttgccttccattaagcttgaaatactaatactctcatttagttcaaaaggttgagtttaatcaacatgttattaaaawttttaaaccatttattattcatttattttataattcattctgtcagcaaatacttgttgaggcttttctctgtgcaagatactggggttacagcaaagaa

SEQ ID NO: 41589 - DNA, 201 bp, Homo sapiens
atgagagagaacgtggactgtgaggagtcaaagatcaccctgaggttttaggcctgagcctctagaaaaatgaagttatgatttatttagatggggagggstgtaggaggagcaggtttagatgtggggtaagggaaaaacaagagcttggttttgacatgtgaaactttggatgcctgttagatctccaagagaagactc

SEQ ID NO: 41590 - DNA, 201 bp, Homo sapiens
tatgaatagacagttctcaaaaaaagatatacaaacagctaacaaacatatgaaaaaatgctcaaaatcacgaatcatcagggaaatgcaaactaaaaccwcagtgagatactaccttactcctataagaatggccgtaattaggccaggtgcggtggttcacgtcggtaatctcagcactttgggagaccgaggtgggct

SEQ ID NO: 41591 - DNA, 201 bp, Homo sapiens
caaagatcaccctgaggttttaggcctgagcctctagaaaaatgaagttatgatttatttagatggggaggggtgtaggaggagcaggtttagatgtgggktaagggaaaaacaagagcttggttttgacatgtgaaactttggatgcctgttagatctccaagagaagactctgagtagcatttgtaatatagacatatc

SEQ ID NO: 41592 - DNA, 201 bp, Homo sapiens
acatcaaagaatttttttttttttgtacagttgggagacataacagtacactttatgctgaactggtggacaggcaagacatgataatgcaaagactggtraataaagaaagcattgcccttgtggagaggagtgggataggatccagtggacaaaggagggctggcctgcactagaaggcaggtgattcatccactcatt

SEQ ID NO: 41593 - DNA, 201 bp, Homo sapiens
tgatgataatgcagtctgctcttgtcaggattgtggtttggcctggagagtaatacaaaaatcttcaagtccagtgccactgtggcaatgtctcctgtggytgtgtttcccttaagaagtttaagtcagattcatgtgagtttctcaagtcattgtatcttgtgtgctagcatagagctttcagaactcatcagcccttct

SEQ ID NO: 41594 - DNA, 201 bp, Homo sapiens
gtttattatctaactgtagattggctttcttgatgttttttcataatagatagaattttctttgtttttatattttagttgcctaaattcatctcattacygcacgttgatttttgccttccattaagcttgaaatactaatactctcatttagttcaaaaggttgagtttaatcaacatgttattaaaaattttaaacca

SEQ ID NO: 41595 - DNA, 201 bp, Homo sapiens
actttggtgtgccttttactatttgaaaacctggaaggtgcctttgagtgaaaatatcattcaagtaggttttgagtgaaattgagattttttttaaactycaaacttgactgtaagtgattgtaacaattagtgccacacatatatggagagttcagtaggtgctgtttattatctaactgtagattggctttcttgatg

SEQ ID NO: 41596 - DNA, 201 bp, Homo sapiens
gaacggttaagtctccatgccacttgtgtgcctagttacgtgtgtgcctagttacatcctcctgcttattaacagctaaataccactttaagaattaaaartctattcattggcataagaataatatttatgtgataagtttcttttcccctaaagtcaatgaaaatgactcctagatttttttcctaaaatttccttcta

SEQ ID NO: 41597 - DNA, 201 bp, Homo sapiens
atacatcataagttctcaatgaaagtgaatggactggattttttttattagttgttgcttaccaatcttaaagaacttaggtaagccattataaagaattycttagaataacaaacacaataaaaataaaaatatagaagataaaccatccagttaatatcttcttgttccatagtataggtttctcattaacagaaagaa

SEQ ID NO: 41598 - DNA, 201 bp, Homo sapiens
cacaataaaaataaaaatatagaagataaaccatccagttaatatcttcttgttccatagtataggtttctcattaacagaaagaagtatatgctgttttyttctgcttttatatccaatcaattataaatagacgtaggaagacagttaatttaaaacatgacaattaaaaaacaatgaactgcattttctttccattgt

SEQ ID NO: 41599 - DNA, 201 bp, Homo sapiens
cagttaatatcttcttgttccatagtataggtttctcattaacagaaagaagtatatgctgttttcttctgcttttatatccaatcaattataaatagacstaggaagacagttaatttaaaacatgacaattaaaaaacaatgaactgcattttctttccattgtattaaatagtctttcagtacaccaggacacttcta

SEQ ID NO: 41600 - DNA, 201 bp, Homo sapiens
gatagaagaagagaagatgtcagaactttctgggttcttacagggttggaagaaaatatagaaggttgagacttttaaagccaccagcccttttgggtcaygaccttggagacaaaggaggtgcgaaaaagggagccagctattccaccctggtttttttctccaaagcatttgccaattcaagaacagtgaaagattaga

SEQ ID NO: 41601 - DNA, 201 bp, Homo sapiens
acaataaggcagtgtttatggcaatttggtcaaagaaattacatcaaaatccatataatgtcagttttataaattgaatattattatgggaaaatgcttgrgctctcatatgggcttttatactgtgattattattcccataacacgttttagtgtcttacacaactcaggacagagtctcttgaccctggcgctagcaca

SEQ ID NO: 41602 - DNA, 201 bp, Homo sapiens
gtgtttatggcaatttggtcaaagaaattacatcaaaatccatataatgtcagttttataaattgaatattattatgggaaaatgcttgagctctcatatkggcttttatactgtgattattattcccataacacgttttagtgtcttacacaactcaggacagagtctcttgaccctggcgctagcacacaacctcatga

SEQ ID NO: 41603 - DNA, 201 bp, Homo sapiens
cgaggtgggcggatcatgaggtcaggagattgagaccatcctggctaaaatggtgaaacgatgtttctactaaaaatacaaaaattagccaggcatggtgrtgcactcctgtaatcccagctacttgtgagactaaggcaggagaattgcttgaattcgggaggcggaggttgcagtgagccgagatcgcgccactccagc

SEQ ID NO: 41604 - DNA, 201 bp, Homo sapiens
atgtgcatatcttaactgtagcagctatgctgggaacatgttaaattgtatattatatagtcaaaagaaaatgagaatgtacaattatctgggaaggtttygtatcattcatacagacttttagaaaaaaaaattggttccctaaattatctgtgttgcctcagcaaataagagtctctcaagcttttgtggcacaaaata

SEQ ID NO: 41605 - DNA, 201 bp, Homo sapiens
tgggagacagagcaaaactccgtctcaaaaaaaaaaaaaaaaaaaaaaaaaaagcctaacgagaaggtaaaagagcaaggaggaaactaaagcaaggattrcttttattgcaaaagaggtggaggaatctttaaagatttctgatacagcagaaaatcagatattgcatgttctcacttacaagagaatgagctaaacaat

SEQ ID NO: 41606 - DNA, 201 bp, Homo sapiens
cctgaaattaattgatcctggaacttttctccccatgaaacaccttacagagctactgtttcatgaaatcatatttgatcgcaaatggttaaaaatatgtygtcttatagttagtaaatatcttggggaattctttcactgctatgattatacactaatattcatcttcaccttaaggataatttatttgattttctattt

SEQ ID NO: 41607 - DNA, 201 bp, Homo sapiens
ttctgatacagcagaaaatcagatattgcatgttctcacttacaagagaatgagctaaacaatgagtacacagggacataaagatagacataagatactgrggactccagaaacggggagggagggagaaggtggaggttggaaggttaccttttggatataatgttcattatttggatgatgggtacactagaagctcag

SEQ ID NO: 41608 - DNA, 201 bp, Homo sapiens
ttggcccataccaaccattgattcttactttcctatcaggcctgggcatattccagtctgtccaccatttcttgtgcatatccttacaataaacatgaaayttatattttataatccaaattgaggtaatgttccatttgactgtcatacaaggtttcccaatcaaaagcagatgagatagtggttgaggccaaggcatcc

SEQ ID NO: 41609 - DNA, 201 bp, Homo sapiens
tagattgtgtgtctataggaaatgtgtgtgtgtttatgcaaaaataaaatggcacaaagaatgggaggaaagagctgggaatttaatgttttaactcttasagttttaactctttcctagaattacatataaagtggtacaatattatttgaatgtaaactctggttggttaaagatatataatgtatacactaggacaac

SEQ ID NO: 41610 - DNA, 201 bp, Homo sapiens
ggaagcatatttccatctcttcctctgtctccatccctcccactttgatattcttattaaagtggaatatttcctcttatctggtagaatgtgaggaaaayagggcaccctaatttatttgatcaccgttcagtttttctcggtaactaagtttgtccctgaaagtttctggtctcacttatggttacattgttaattatc

SEQ ID NO: 41611 - DNA, 201 bp, Homo sapiens
tgctcaataaacaaaacagaaagcagaaaaaagaggcaaaaacaagaactgataaagctaataaaaattgcttagaaagttggtagatttatatccagcartgtaaaaaatcatgttaaatgtgatctctttaaactcaccagttaaaagatagagattgtcagattgtataaaaactgagacacgactaatctataagaa

SEQ ID NO: 41612 - DNA, 201 bp, Homo sapiens
ctaagctatgagaatgcaaaggcataagaatgatataatggactttggggacttgggagagggaagggtgtgagatgggtgagggataaaagactacccaytgggtacagtgtacactgctcaggtgatgagtgcaccaaaatctcagaaatcaccactaaagaacttcacctgtttcccaaaactattgaaataaaaata

SEQ ID NO: 41613 - DNA, 201 bp, Homo sapiens
acgagaaacttagaaaagactaggtttagaaagtttattaattatacttctgaaaaagcaattgtcattttctaaacggataaaaatgaactgcaaattaraattcccagtggaattaatgcagtgactcattacataatacatcatgggcaagtaatccatcctttgtactctcaggcaatcggatgtatttaagccaaa

SEQ ID NO: 41614 - DNA, 201 bp, Homo sapiens
tcactagggcaaaattttccttatcctaaaagtagacaaagaccttacaacaaacaaaactgcatgccagtatgatttataaacatagaacaccaaatctktaatagaatattagcaaatggaatccaatatataaagaaatatataaaaatataatacttattaccaaccaaatgaggtatatctcaagatgcaaggctg

SEQ ID NO: 41615 - DNA, 201 bp, Homo sapiens
gagggataaaagactacccattgggtacagtgtacactgctcaggtgatgagtgcaccaaaatctcagaaatcaccactaaagaacttcacctgtttcccraaactattgaaataaaaataaaaattagaaaagatcagagggaaagaatatgggggaaataagacccccatcaaaaaataagtgatgaaagatactgggg

SEQ ID NO: 41616 - DNA, 201 bp, Homo sapiens
ttaccttgccacaataatatagcaacctaatcccccgaggtctgctaaagctcttactaaccttagaaaaaattgtaaacaatagtctgaatactattttktaaatatatatttatctttaaacaaggttacacaggctatttgataattcttgacagtcagaaatcaattcctattcaatgagttttcctaaatggaaga

SEQ ID NO: 41617 - DNA, 201 bp, Homo sapiens
tttcacccaacagtcattagttaatagctttaggagggtaaataaggaggggggaataaaaataaacatttaggcacttctgactctgcatttgttgacaragtggctcgatagtctgagggcagtgacctgaagttctacaggagctggcgcatcccacctataccaacagaagttgcgaatctcggggaacctggacaa

SEQ ID NO: 41618 - DNA, 201 bp, Homo sapiens
ttcccaaaactattgaaataaaaataaaaattagaaaagatcagagggaaagaatatgggggaaataagacccccatcaaaaaataagtgatgaaagataytggggaaaaacacaggagagcaggttactggggaaataaagactatttgagaaatgggcaaaaatgataaataatgcaaatccacaatgtaagtttcata

SEQ ID NO: 41619 - DNA, 201 bp, Homo sapiens
tggctcgatagtctgagggcagtgacctgaagttctacaggagctggcgcatcccacctataccaacagaagttgcgaatctcggggaacctggacaaggyagcagccatgtctgctacccatggcaggtgccttcaagatgctgagaaaatacagccaacacatataaagcagttacagtgcagtgcaaaaattaattaa

SEQ ID NO: 41620 - DNA, 201 bp, Homo sapiens
cttttccatgtttattttaccctagaatcttctgtgaagagagtttcatgaaactgagcctccatgaactcacttcaggggataagcaacttagaatattkcttctattgatgcgtcattgggtcaatttggaagggatggatctctccctatcctgtatacattttgtttattttccccctttctttctatttttaacca

SEQ ID NO: 41621 - DNA, 201 bp, Homo sapiens
cttgtatttctcatcgtcttgcaaacctggtgtcagtcttgatagtacttaatagatgtacactgaattttttttttgaataactgaatgagtctaggcamgtacttgttgctatgggaagggtatggggatgatccagtgttccagctgaatcaaagaaaaccgagttacctgagaacatgtggcagggaaggagaaaga

SEQ ID NO: 41622 - DNA, 201 bp, Homo sapiens
gcctatcttatcatttgttactatatctttgttaggtataaatgttcaggcttcacctattaccaggcatattaaatttcacaagagaaatgtgtagttayagctccaaggcaggtgttatgatcctgtcaaattgctcaggctaattttaaatcatatcaggtctgttgctgggagatgtttgaggaacacaggaaatta

SEQ ID NO: 41623 - DNA, 201 bp, Homo sapiens
tgtaatatatctttcatcatgctatttcagaatgtgacaattactaaaagctgacatttgagatcatatcaccacctaatattttttttcaaaagtaaaartaaagtggaagataaacgagaaacttagaaaagactaggtttagaaagtttattaattatacttctgaaaaagcaattgtcattttctaaacggataaaa

SEQ ID NO: 41624 - DNA, 201 bp, Homo sapiens
ccatctcacctttaaaaagatgttcctttgacccacaaattatttcccatctctactgtgtatactttaggatctaagatgtcctatttaatataaaattwaaaaaatcacattgagtagtcttttattcctgattcaccaaattactgctaccataatgctttatcttctaaatcatttctattttctttactgtttatt

SEQ ID NO: 41625 - DNA, 201 bp, Homo sapiens
ttgctatgggaagggtatggggatgatccagtgttccagctgaatcaaagaaaaccgagttacctgagaacatgtggcagggaaggagaaagaagtaactraagtggaaaacagatgggtgcagaataaattttaccatctttattctttgaactaaggctaattctgttccaaaagaagcaattgactgtaagcacaatg

SEQ ID NO: 41626 - DNA, 201 bp, Homo sapiens
cttgaaggctcagaggttaggggttttttcaaagatagtttggtggataggggcccagggagtggggagtgctgattggttgggtcagagatgaaatcatrgggagttgaagctgttctcttgctctaagccagttcctgggtgggagccacaggactcaggactggttggcaaatgctggtggggccatccagttttcag

SEQ ID NO: 41627 - DNA, 201 bp, Homo sapiens
attctgagatagtagcagagcaagtgagttgtgttgagcacgagtgggccatggtgactcaactgagttcagaaaacttctagaagttggaataaaaaatygggcagctatagaaatatacaaagagctcagcaccaaagggatttggcttctttcataggttgtattaagtaaaactgcatcacctgcacttaaggacaa

SEQ ID NO: 41628 - DNA, 201 bp, Homo sapiens
gtttacttcatatagccctggcattccagtctcttctaagaatgtgaaataaaggattgatagatggataaacacatggtagatggaggtctgattcaggyggtgttaaaaatcaaacaaaaatctttccaaagtagggatcaaattctacttcttttgagatataaactgtttatagctttgaaatgacagttttcacct

SEQ ID NO: 41629 - DNA, 201 bp, Homo sapiens
ttgatctcctgacctcgtgatccacccacctcagcctcccaaagtgctgggattacaggtgtgagccaccgcacaggtcctggtgaggtaatttttaagtractatgtatctgttcatatgtaagtatatgtgtgtaggagtgcagatgccagtgtgtttggacctctggggaaggagagggtaagcaagagatatgatgc

SEQ ID NO: 41630 - DNA, 201 bp, Homo sapiens
atatattgtatgaaaaacacagtcatacgattccaagttgaaaagtgaatagttggactctccaaaggagttttaggaatatctcaatttgtttcacctgygttttctttttatttctatataataatatgccaatataatgatgttttggtaaacaaggaaccacatatatgatagggatcccattaaggttataaagcc

SEQ ID NO: 41631 - DNA, 201 bp, Homo sapiens
cacgtgactgagccgggcatgttcttcgggcccctgtgtgagtgccatgagtgggtgtgcgagacctacgacgggagcacctgtgcaggtaagagggcggygctgtctcctccctcgggaggtcgaaactcctcttctgggatttctgccactccctagaagagtgaagggtggggacacgcctcccttcacataagcacc

SEQ ID NO: 41632 - DNA, 201 bp, Homo sapiens
aagattatgaataaaatgcatcggtcttttttgtcctacattctcctctgcaaggtcaggagatagggtttgtcagggcccagttctagcactgtcttaaractccatcctcagaccctccttctccccgttaccatcactgcaaaacttaccctataaagcagatagcttccaaattaacctactttgaacattttttat

SEQ ID NO: 41633 - DNA, 201 bp, Homo sapiens
cagccacttattttaccctcaatgtagctaagaataataagacagccaacactaacatagaaagatcaagaatgagtttatagcaaaatatttttttctcrgaacctgggcccagtagtgtataagttacttaatatgcaggctgcttggcaatgcaaaaaatagtcatagaagaaatttggaggggcgcaggtgcatcta

SEQ ID NO: 41634 - DNA, 201 bp, Homo sapiens
aattcctttacacagaacttttctgggagtaaatctctgttaagcatgtagtagatgttgtacaaagtttattgtgtagataaatccatgggttaatgggwggaaggggaggtagaaattacagactttgtggaatgagtagatttcaaatcatccttggaattttcaagattttactcaaggagctgatatttagagctt

SEQ ID NO: 41635 - DNA, 201 bp, Homo sapiens
aataacaaacacaataaaaataaaaatatagaagataaaccatccagttaatatcttcttgttccatagtataggtttctcattaacagaaagaagtataygctgttttcttctgcttttatatccaatcaattataaatagacgtaggaagacagttaatttaaaacatgacaattaaaaaacaatgaactgcattttct

SEQ ID NO: 41636 - DNA, 201 bp, Homo sapiens
ccacttattttaccctcaatgtagctaagaataataagacagccaacactaacatagaaagatcaagaatgagtttatagcaaaatatttttttctcagarcctgggcccagtagtgtataagttacttaatatgcaggctgcttggcaatgcaaaaaatagtcatagaagaaatttggaggggcgcaggtgcatctactt

SEQ ID NO: 41637 - DNA, 201 bp, Homo sapiens
tgatggtgagcattttttcatgtgctttttggctgcataaatgtcttcttttgagaagtgtctgctcatgtccttcgcccacttgttgatggggttgtttktttttttcttgtaaatttgtttgagttcattgtagattctggatattagccctttgtcaggtgagtaggttgcaaaaattttctcccattttgtaggttg

SEQ ID NO: 41638 - DNA, 201 bp, Homo sapiens
tgtagtcccagctactcgggaggctgaggcaggagaattgcttgaacccaggaggcagaggttgcagtgagccaagattgcgccattgcactccagcctgrgtgacagaacgacactccatcacaaaaaaggaaagaaaaaaagaaagaatggcaaaatgtttgattgcatggaaagaaactttcagttgatatttctaaa

SEQ ID NO: 41639 - DNA, 201 bp, Homo sapiens
ataatatacgtgtgtgtctgtatacacacgtgtacatatgtgtgtgtatgtgtatctgttcttcatctattactagaagacactgtggacaaatacataayataatcatagaagttcagcattagagaaaactgatattcccttcaagcatgcccttgtggaaacagaatttaggaggttaagaaacctggccaaggtctt

SEQ ID NO: 41640 - DNA, 201 bp, Homo sapiens
tcagagggtgatatattgtatgaaaaacacagtcatacgattccaagttgaaaagtgaatagttggactctccaaaggagttttaggaatatctcaatttrtttcacctgtgttttctttttatttctatataataatatgccaatataatgatgttttggtaaacaaggaaccacatatatgatagggatcccattaagg

SEQ ID NO: 41641 - DNA, 201 bp, Homo sapiens
tggcttctttcataggttgtattaagtaaaactgcatcacctgcacttaaggacaatatataatcagagggtgatatattgtatgaaaaacacagtcataygattccaagttgaaaagtgaatagttggactctccaaaggagttttaggaatatctcaatttgtttcacctgtgttttctttttatttctatataataat

SEQ ID NO: 41642 - DNA, 201 bp, Homo sapiens
caaaaacaaagataaataggtgggacttaattaaactaaagagcttttgcatggtaaaagaaacagcagagtaaacagacaacccacagagtgggagaaamatcttcacaatctatacatctgacaaaggacacatattcagaatctacaaggctctcaaacaaatcagcaagaaaaaaacaatcccatcaaaactgggtt

SEQ ID NO: 41643 - DNA, 201 bp, Homo sapiens
catacaaaaatcaaatcaaaatgtattaaagacttaaatctaagacctcaaactaggaaactactaaaagaaacagttgaggaaactctctaggacatcgstctgggcaaagatttcttgagtaataccccacaagcacaggcaaccaaagcaaaaatggacaaatgggatcacatcaagtgaaaaagcttctgcacagca

SEQ ID NO: 41644 - DNA, 201 bp, Homo sapiens
agtacaaagtgctttatatgtgaggagttggggttgttttgaaaatgagcatgatgttgactggtgggtatgaaaagaattgcattgtagtcaaacaagcraaattttaaggtaggatatcatggacattttgcttgcctaggccagcaggttcttttaaagaagctgttggagagaaaccttcagagatcaataggagca

SEQ ID NO: 41645 - DNA, 201 bp, Homo sapiens
atcaaaactgggttaaggatgtaaacagacaattctcaaaagaagatatgcaaatggccaaccaatatatgaaaaaatgctcaacatcactaatgatcacraaaatgcaaatcaaaaccacaatgcaataccaccttactttcacaagaatgaccacaatcaaaaaatcatagatgttggcatggatgcagtgaacaagga

SEQ ID NO: 41646 - DNA, 201 bp, Homo sapiens
aaaagttttaaatatttgggtaaccattggctctgtgattttccctatttatatccaaatttgttattgctttacgtagataaaatatctagttttgtacrtttatcttgtatttggctacatttctgaactcttaagaattctaaaagtatttagttccttctggattcatgtatgttgctattactttgccaagcttca

SEQ ID NO: 41647 - DNA, 201 bp, Homo sapiens
tattcaagtgctgactaatttataaacccagagcagaggttttacttccagaattatttttacatataatatattcaatctaatagcattaaaatgctatycaagaatacacatagcattctaaaattttaagcttccgttttaatgaatactttaaagattttgagctagtcatatagaagattgggtttaaggttagaa

SEQ ID NO: 41648 - DNA, 201 bp, Homo sapiens
aaataccactttaagaattaaaagtctattcattggcataagaataatatttatgtgataagtttcttttcccctaaagtcaatgaaaatgactcctagawttttttcctaaaatttccttctagcatcaactagaactgccgaaatattcagaagagtgaaagaatatttctcatcccagagactcctaatatttccagg

SEQ ID NO: 41649 - DNA, 201 bp, Homo sapiens
taagaataatatttatgtgataagtttcttttcccctaaagtcaatgaaaatgactcctagatttttttcctaaaatttccttctagcatcaactagaackgccgaaatattcagaagagtgaaagaatatttctcatcccagagactcctaatatttccaggtgtttttgctatgtgggagggaaaaaaagccctctggt

SEQ ID NO: 41650 - DNA, 201 bp, Homo sapiens
catgatttttccaaattacctcctataggaagcctctctgaaatgatgtcctacttcctctataccgcaccacctgcatcgtagtgtgatgaagttgtatygagagtgtccctgtgtcccttttctttaagtctacaattctcatggatataatcaatctctctctctcattatcatatgctcaaagctaggataaaggtt

SEQ ID NO: 41651 - DNA, 201 bp, Homo sapiens
aaacatttgccatggaaacatattaaaggaaaaagcaagccttctccatctcccatcctacacacatgcaaacacacacacacacacacacacacacacayacacacatacacacaaattggaagaggattcccctgagtaaagaatgctaatagattaaattttgaacaccttgattttgatgtttctgtatactattct

SEQ ID NO: 41652 - DNA, 201 bp, Homo sapiens
tttataaaatacactgcatacagtttaatgcccaatcctttgaaaataaatatatatttttatttatcctaatggttaccttatattattttaaaaacatygtcagtattcattttatatcaaggtctcaaatttaatggtgtcatttgttcttcatctatttaaaatgaaagatatagcattttttcaattttcctccca

SEQ ID NO: 41653 - DNA, 201 bp, Homo sapiens
aaagaaaatcatatgacctttttgttttgtttagttgttttgtgttaaattctgctgagtctgaaatttaggctaccatgccgtttttctatatgcttgakaaatctttgacaaccctttacattttattcttcttcattcctttgagtcagatttgtcactttggggcagcatacactttgatttatgattttgttaatt

SEQ ID NO: 41654 - DNA, 201 bp, Homo sapiens
caaaggattaatttggcctcatcttggttcaatactgtcttttatggtaatatatcttcttatttagattttgaggctctgaaaaagagggccttataagkcttcacatagtctttttttctgtgtcttgtacttttgttttttttaacccagttaggagctaaatcagtatttgcttaatgaattaactaccaattaatt

SEQ ID NO: 41655 - DNA, 201 bp, Homo sapiens
atggtatggggatgcttgccagtacccaactaactgtgacttgacaaagaagaaaagtaaccaaatgtgcaagaattcacaagacatcatctgctctaatkcaggtaagaagtataccctgtgaaaattgttaagtggaataatcaaattttgtttttaatggaaatatgtgggcgtggagaaatgttgaatctcagagtg

SEQ ID NO: 41656 - DNA, 201 bp, Homo sapiens
atgtgacaattgaagaaggaagtacatcaaagaatttttttttttttgtacagttgggagacataacagtacactttatgctgaactggtggacaggcaaracatgataatgcaaagactggtaaataaagaaagcattgcccttgtggagaggagtgggataggatccagtggacaaaggagggctggcctgcactagaa

SEQ ID NO: 41657 - DNA, 201 bp, Homo sapiens
tctatttctttattgctgttgaatataaatttggagaagtcaaattgcctataggagaaaaataacctgatactgacaaatctataggctttggagtgtckgcagcgtctactagtgtgtatttagagggaatttttgataagactcaagattttgagtggcattttattaagcatttgaattactttgtaactgacatct

SEQ ID NO: 41658 - DNA, 201 bp, Homo sapiens
aggaatctaaacatgtaattcaccacattaacatatcttaaaggagaaaacatacagaagtgtttcagtagatgataaaacatatttgatacaatgtaaaygcatttctaggacatctgtactctctcattttttaagcatggatgcaatacctttgttcataacctgctttagtcaagggacccagtaatgtcctgtata

SEQ ID NO: 41659 - DNA, 201 bp, Homo sapiens
tttaagagatttgccaggttagatttatatagacattttaactaattctatttctttgtacttaacccaagatcacatacttaggtttgtcctttcaatawcatttatcagaatactccactattcagccactttgaggagacacattgtttacctgccacttgctgtgataagacattacatgcagcatgtgtttatttg

SEQ ID NO: 41660 - DNA, 201 bp, Homo sapiens
gtgcttcattgagggaatgcaagtgggaggcttttatagggtgaacagaaaaagaaagcaaagaaaaatagttggttggctaatgttatatggttgccttrtttagtctatcctgttggaaagtccctagttatataattataagtttgttggttgcttctgattggttaaacttaagttctgttcttctttaatgtagac

SEQ ID NO: 41661 - DNA, 201 bp, Homo sapiens
cagacagccaaaaagcaaacaggggatttagaggttcctgtttatttttgtttgtttgttttgttttaaataagtaaattgaaactcagagcaattatgcrgcttacttaaagtctcaaaattagctcatatttcagatgaaatttgccttcaagttctagatcacctgcagcactgaagttttggtgaccatttattctt

SEQ ID NO: 41662 - DNA, 201 bp, Homo sapiens
aagttcattctctttctaatagatcacatatagatttgctaatatctagtaattcaaaccaaattagcaacagcttccttggttccttcccatccttcacyctttacactcagtcaccaaatgccctctactctttctcctaaaaatatccccagatgtatttgttccattctaaactcatcgcatcatgtgtctagccac

SEQ ID NO: 41663 - DNA, 201 bp, Homo sapiens
gtgggatctgagctggccgttgtcgtagctgtgaacgaattcacatttgtttcccaggccccacacaggtaatgctctgtctgtattccacagacagacasacggtcaaccccacaagggtgcttttctgttcccttcctagagtcctctcatgaaaatgtgcttgttctcatctcatcccctcaaggtttggctttctac

SEQ ID NO: 41664 - DNA, 201 bp, Homo sapiens
aagttcataaataagatatatagatgatatattctgtactgattaaatcacttgacagcctttgcatttgcttaagtaaacaaatttaaaattcaaattcrttgtggaaatggtcattgatttttaggttaacaagtgattttctttgaatatcccaattataacttatttagacagagaacatggcattgggtccctgtc

SEQ ID NO: 41665 - DNA, 201 bp, Homo sapiens
ctctcacagaacttgcattgaaatgggggagtagtagattattcacaagtagataaagatatggaaacaataatattagatactcgtaagtactatcaatmaaatgggataaagcgtgcttggacaggggagtggctttagacagcacaatcagggatcagcctcctctttcagaaggtggcattcaaagagaagccactc

SEQ ID NO: 41666 - DNA, 201 bp, Homo sapiens
tgtttcccaggccccacacaggtaatgctctgtctgtattccacagacagacacacggtcaaccccacaagggtgcttttctgttcccttcctagagtccwctcatgaaaatgtgcttgttctcatctcatcccctcaaggtttggctttctacttcactgactccccggatttaatccatgtatgggtgcagctcctcaa

SEQ ID NO: 41667 - DNA, 201 bp, Homo sapiens
aggtaatgctctgtctgtattccacagacagacacacggtcaaccccacaagggtgcttttctgttcccttcctagagtcctctcatgaaaatgtgcttgktctcatctcatcccctcaaggtttggctttctacttcactgactccccggatttaatccatgtatgggtgcagctcctcaacagtgggattgctatttgt

SEQ ID NO: 41668 - DNA, 201 bp, Homo sapiens
atatccattataatttcaaccaatgagtaccacagagtgagttatggtgaatcatttccacagaagaaatttcctgagagatttcaatcctgttatatatraaaattgtcagaagtaaacagcactaggtcaaaaaagttttcaacttatgtcagctcttttagcgcatacatgagacgtattttgttcatttctgtatcc

SEQ ID NO: 41669 - DNA, 201 bp, Homo sapiens
taagtactatcaatcaaatgggataaagcgtgcttggacaggggagtggctttagacagcacaatcagggatcagcctcctctttcagaaggtggcattcraagagaagccactcagcatgtaacctgggggagagggatccttgcaaagggggcactgaggcaaagaacaagcttaggatgttctagaaacgtgagaaac

SEQ ID NO: 41670 - DNA, 201 bp, Homo sapiens
atacatttatacttaggtgatataactacaaagatgagagtataagaagtaaaatttgggataaatgccatctttggggaatttgcagaaggattgctagrtgtggatgaggaaagcaatggtgcgataattcactacagatggcttggaggcaagtgcagatgagcaggtaacaggttacagagaggtgggagctgaaag

SEQ ID NO: 41671 - DNA, 201 bp, Homo sapiens
tatctcaagacaggacaaataatactgtaattctaggtaaaagcaattcattgagagagaaactgatatatcttacattgtatatttcataatatagtgaracattttgaaagcttacttgtcttatattggttttcttaatattctttaattttcccaccagcttcaaattccacaatttatctacatgcagatacccac

SEQ ID NO: 41672 - DNA, 201 bp, Homo sapiens
acctggggatgtggaatgattggcagaaaccatattaaccagcttcatatccattataatttcaaccaatgagtaccacagagtgagttatggtgaatcayttccacagaagaaatttcctgagagatttcaatcctgttatatataaaaattgtcagaagtaaacagcactaggtcaaaaaagttttcaacttatgtcag

SEQ ID NO: 41673 - DNA, 201 bp, Homo sapiens
tggcattcaaagagaagccactcagcatgtaacctgggggagagggatccttgcaaagggggcactgaggcaaagaacaagcttaggatgttctagaaacrtgagaaacagaaagcctctgaatggttggagagtagtgagtaaggggaacagtaatgagagatgaggttagacaggctgacagagccacatcacacaagg

SEQ ID NO: 41674 - DNA, 201 bp, Homo sapiens
tttagttcactgctatattctctccctcaaaagagatcttgtatatgctgtgtgcaatagttactttttgaatatgtgatattatgaatattgacattgayattattgttgagtaaattaaattatacatatgattatgacatgaatatagccatagcttactcagcaagtcttttagtgagatggtcaatagaaacccat

SEQ ID NO: 41675 - DNA, 201 bp, Homo sapiens
actgaggcaaagaacaagcttaggatgttctagaaacgtgagaaacagaaagcctctgaatggttggagagtagtgagtaaggggaacagtaatgagagaygaggttagacaggctgacagagccacatcacacaaggctttgtaggatttgggaagtaagtaatcaacagaaatttatggagcaatgtaataatgggagg

SEQ ID NO: 41676 - DNA, 201 bp, Homo sapiens
acatcgcttgtagtttttggaaacacattcaggagttccccactagctcacccactgcatgtaagccatttttcgggagctctactttcttacattcatckgtgttcgataaatgcatattgtcttagcccaagtgacgtataaaagttaaatgttttctttctgaaagcaagtgccaaacatgcacagcaattttcctca

SEQ ID NO: 41677 - DNA, 201 bp, Homo sapiens
tgatgaccaaatggtttgtagggaagattttaactctgatgtggaggggctcttcaagcaaatattttgtctcttctcagtacagtaattaagctgataattttttttttttttaccttttcgggccactacaacattctctgctcttggattcaaagatgaatgttccttccacacagtttaatacgtctacagttccag

SEQ ID NO: 41678 - DNA, 201 bp, Homo sapiens
tttcctactaaaatcttgaggaaatttaccatcttatgcttgcatttcagcccctgaaatggaagcgtcatgggaatgctttctgcagtggggatgtttgmacaatgagtttattaattgatgcatgtagacaagagactgttgggtggtgctaggaagaagaaaccagcaccctcagagaagagataggggtagtgccct

SEQ ID NO: 41679 - DNA, 201 bp, Homo sapiens
aagggcatcctggtgggaagtagcattttacagcctttaagcagactgtttttctaaatataataacaatgaaaactatttggatacacatgtaagtcctytgtgaggcttgagtctagatgaaatatcagagtctactgcaacatccagtctgagggtgcctttgaaccatttcaggacaaaagcaaattaaacttggaa

SEQ ID NO: 41680 - DNA, 201 bp, Homo sapiens
cagtggggatgtttgaacaatgagtttattaattgatgcatgtagacaagagactgttgggtggtgctaggaagaagaaaccagcaccctcagagaagagrtaggggtagtgccctgccccgtgcagagtggactttactgaatagaacttcataccctaagaactggattgcccctcatcactctgtggccttggtatac

SEQ ID NO: 41681 - DNA, 201 bp, Homo sapiens
gatccatgcagagtttgttcatggttattagagattatgcctttagaagtgacactagtgggcacccctgaaatgacctccaacacaccccctaggggagyacaccctgagtttcccgaaaaatgaggaaccactgacaacagaaagaactggttttctttgtgtggaggggttagtccctgggagggaataatcttcctt

SEQ ID NO: 41682 - DNA, 201 bp, Homo sapiens
atacatatatatatgtatatatatgttgagttttctaaaaactaacaatttaattgatagcccctgagggaaataagactcgtataggccaagtaaggaarcagggtggattatcgctgttcagttggctcagtttcacttaattcctcttttctttcatactgccttctgctgtgtccagtattcctgagtctaaagcct

SEQ ID NO: 41683 - DNA, 201 bp, Homo sapiens
aattgggaaagaggtaacttcctatctgaaagatcacaggtgaaaatctgaggtcaaatttctcctgtaagagtatttatacaaatcttcttgttaacctsacacctcacacatcttgtcgctttcagtttttgaatctttgagtcttttctgcattgttgacagaagcacaatgatggagctgtccagctctacagtttc

SEQ ID NO: 41684 - DNA, 201 bp, Homo sapiens
tggcccgtacttgaaatctgtgaacaggacactttttttttttttaatgtcaaaataaaccatctgcttgtacaactgtttctaattacttccctgcctaractctccactgaggggtttggcaccagcaccccgcccagagcagtgccgctgcccaaatcctcgcaggcagctcatcaacgcaattgcaactccggctgg

SEQ ID NO: 41685 - DNA, 201 bp, Homo sapiens
gaattgcattgtagtcaaacaagcaaaattttaaggtaggatatcatggacattttgcttgcctaggccagcaggttcttttaaagaagctgttggagagraaccttcagagatcaataggagcagctcatagggagccttttaatgccaaaagatatgtgtgtgtgtgtgtgtgtgtgtatgtgtgtgtactcatatatg

SEQ ID NO: 41686 - DNA, 201 bp, Homo sapiens
agtagagacagggcttcaccatgttggccaggctggtctctaacttctgacctcaggtgatccacctgccttggcctcccaaagtgctgcgattacaagcrtgagccatggcacctggccttttccatatcatttctgataaagaacactaagtgtctttctaaagcatgaagagagggacttaagcccaacagttgcctg

SEQ ID NO: 41687 - DNA, 201 bp, Homo sapiens
gtgtgtatttagagggaatttttgataagactcaagattttgagtggcattttattaagcatttgaattactttgtaactgacatctttgttattgtctasaagaatggcatagcccttttcattgaagtctaatttgatagtttgcattatattgatgtattttctcttatatgggtttcatacatttcacgcagaagtc

SEQ ID NO: 41688 - DNA, 201 bp, Homo sapiens
caaaccaaattagcaacagcttccttggttccttcccatccttcaccctttacactcagtcaccaaatgccctctactctttctcctaaaaatatccccaratgtatttgttccattctaaactcatcgcatcatgtgtctagccactgtcttctttcctgcagacaaatataacagccttttaactcatttctttgcatc

SEQ ID NO: 41689 - DNA, 201 bp, Homo sapiens
caaatctcatagatcagtcatttaattttttagtctttatttgtatcagtgttttggctttcatttttaggaaacttctcctcatttatttttcaaccctyttagtgacttctttccagctaatttataattcacttttttggcactgcattcatttttgattgtcctatttttatggctgcacatttttgcaagcccgga

SEQ ID NO: 41690 - DNA, 201 bp, Homo sapiens
gctaatgacctgcacaagcattgaatgaaagatgcaaatgagcagcttaatggaaaaaatatgaggaacttggtgctaaatcattcacagtcaacctgttyctgggctggggtttcctaagcagcggagcacctccctcactaccgtctattgaaagtcagcttttaaacaataatagtaataaataataaaaaataataa

SEQ ID NO: 41691 - DNA, 201 bp, Homo sapiens
ttattagagattatgcctttagaagtgacactagtgggcacccctgaaatgacctccaacacaccccctaggggagtacaccctgagtttcccgaaaaatraggaaccactgacaacagaaagaactggttttctttgtgtggaggggttagtccctgggagggaataatcttccttcagtctcaatagctaaaactgtgg

SEQ ID NO: 41692 - DNA, 201 bp, Homo sapiens
tccctggggtccccagttctacagttctaggccttgactcctggatggcatttctggacccacactgggccagagggaagcccactgccctgaagggagasaccaaggcctggtagcattcaccacaagctgagccttgagtgaacattggtaccaagcctggggtggtaatggccatggatagacactctttctgactga

SEQ ID NO: 41693 - DNA, 201 bp, Homo sapiens
aatattttattcaacctcattgttttaagcttttctgaaacatattccctctttaatcaatgatgatatgctagctttaggtaaacggtctgatgttaacmcatatacagagagtataaaattccacttgactcctcaagtgcccatcaaacattttttttaaaactcttttgatacatcttagtcccattctgcatttta

SEQ ID NO: 41694 - DNA, 201 bp, Homo sapiens
gtttcccgaaaaatgaggaaccactgacaacagaaagaactggttttctttgtgtggaggggttagtccctgggagggaataatcttccttcagtctcaayagctaaaactgtggggaagtgatgaatggtagacttgagactttcctttgctgttaaggatgatggactagatgatggatgctgttaaagatgatgatgt

SEQ ID NO: 41695 - DNA, 201 bp, Homo sapiens
tgtaaaagataaaggcaattaaaaaatgaactgtaaatgaagacatatttttgctaaatgttggaataattgttaaaaataattattttgctttataaacrtatatttccaggagggctgtcaaaggcactgtggttaggatacatacacttattttttaaaaagttaaagatctgtttttcttataaaactgttcatccc

SEQ ID NO: 41696 - DNA, 201 bp, Homo sapiens
tttacataaaaatatttgtctacgtttctgatcatttccataagatagactggtaggagttattgaattggtaggtatggaacatcttatctcttatattygccaaactgctttataagaatatggttctatttactttcctgccagcaaagtgtgagcttccattttatcacatcatcactggaattgaatattttcata

SEQ ID NO: 41697 - DNA, 201 bp, Homo sapiens
ttttttctatcctcatttaagtcattttacttccaagctcagatggatatccctcttccacttgcctttgtgtttgatgatctgatctcttcttctgcatrttatttctactttgcctttgctgggttatttctgtatttcttcctcacttctcgcttatttctatttttattcccattctgggtccactcgtgcttctcc

SEQ ID NO: 41698 - DNA, 201 bp, Homo sapiens
ttcagaatatattataacagaataaattataaagattgcttgggtgtttcctgtaccaggacatagcagtggtttggtgtcctgcccatttgtgtggcagraaattcttttgtttgtgctggtgaatcgttttgtctggggcttctttctttgctaaaaatcttgcattctttcatttggcaagcattttgtcaacaactt

SEQ ID NO: 41699 - DNA, 201 bp, Homo sapiens
gtatatatttatgttgtgtgtataattatgttgttcaatcaacagttatttattaaggaactactatttataagatgctatatttgtagctgcagaggttrtaaagattaaaatgtgattcttgagagggaagtggaacaagatagccaactagaaccctccaatgatcatccaccccacagaaacaccaaactgaacaat

SEQ ID NO: 41700 - DNA, 201 bp, Homo sapiens
ttaataatttatcttcagaaaatgcaaatccctgttgtagttattttcctatttctacaaatgtaattaaagcattgataacacaggggaaccacagcatyggaattgagaacaacctggtgtgaaagaaaagaagtgttgaaaattttaagtttccctctcctatgctttctattatttctgtgtgtaaacccaattttc

SEQ ID NO: 41701 - DNA, 201 bp, Homo sapiens
tataaagattgcttgggtgtttcctgtaccaggacatagcagtggtttggtgtcctgcccatttgtgtggcaggaaattcttttgtttgtgctggtgaatygttttgtctggggcttctttctttgctaaaaatcttgcattctttcatttggcaagcattttgtcaacaactttaacttgcaagaactatgggtccacct

SEQ ID NO: 41702 - DNA, 201 bp, Homo sapiens
ttgatatataaattaagagttgtatatatttatgttgtgtgtataattatgttgttcaatcaacagttatttattaaggaactactatttataagatgctrtatttgtagctgcagaggttataaagattaaaatgtgattcttgagagggaagtggaacaagatagccaactagaaccctccaatgatcatccaccccac

SEQ ID NO: 41703 - DNA, 201 bp, Homo sapiens
tgcattaataatttatcttcagaaaatgcaaatccctgttgtagttattttcctatttctacaaatgtaattaaagcattgataacacaggggaaccacarcatcggaattgagaacaacctggtgtgaaagaaaagaagtgttgaaaattttaagtttccctctcctatgctttctattatttctgtgtgtaaacccaat

SEQ ID NO: 41704 - DNA, 201 bp, Homo sapiens
tactcctgatctcaaagaacaacttagtaatgtataattatttttatttttctgcaataactgagaatgaagtgcatatttaaataaatatttatatagtrtttgtttattcaatgtgaatttcatcatataaagttaatgccctaaatttaatatcttttgcattattgtggcaattgtgatagttaacacatctgtaaa

SEQ ID NO: 41705 - DNA, 201 bp, Homo sapiens
cctgatctcaaagaacaacttagtaatgtataattatttttatttttctgcaataactgagaatgaagtgcatatttaaataaatatttatatagtatttrtttattcaatgtgaatttcatcatataaagttaatgccctaaatttaatatcttttgcattattgtggcaattgtgatagttaacacatctgtaaacaca

SEQ ID NO: 41706 - DNA, 201 bp, Homo sapiens
agacacattctaaagtgagacaaaataactatatcctaaatattctatcctaaacgtccccatattcttgcattgtatgaagaagtgtgttggctggtgtrtgctaatttaatagttagatataatttggttgcttgatggaagataaagggaaacttgcagtttgaaagcagtcagaatgttaacatctgttaaaaattt

SEQ ID NO: 41707 - DNA, 201 bp, Homo sapiens
gcacacgcatcaacgggggacttgttaaaactgtgaattctcagtttcatactcacggcatcagagactctggctgtggagctcaacagcctgtgtattamcaagtcctccagcttccgatgcttccatagtcaagtttaagaaacactggtatagagctggatctatccctgggtgcaaatcaacttacggttcaaagga

SEQ ID NO: 41708 - DNA, 201 bp, Homo sapiens
aatttagttttatttatcctatcagtgattatgtatagcttttctacatggtttatttaattcttaaaaattctcagtgatttttctattccaacattgtsaattgacccaagttgagtttctggatatgaaaaccacaatatttgatatgaaaaatactatatgggattaacagcagattcacatcacagaagaaaaaac

SEQ ID NO: 41709 - DNA, 201 bp, Homo sapiens
cagctgcttgggaggctgaggcaggagaatggcgtgaacccgggaggcagagcttgcagtgagccaagatcacgccactgtactccagcctggtcaacagmgcgagactctgtctcaaaacaaaacaaaacaaaagaatggccataattaaaacatcaaaaaaacaatagatgttggtagggatgtggtgaaaagggcaca

SEQ ID NO: 41710 - DNA, 201 bp, Homo sapiens
gaggcaggagaatggcgtgaacccgggaggcagagcttgcagtgagccaagatcacgccactgtactccagcctggtcaacagagcgagactctgtctcaraacaaaacaaaacaaaagaatggccataattaaaacatcaaaaaaacaatagatgttggtagggatgtggtgaaaagggcacacttttacactgctggtg

SEQ ID NO: 41711 - DNA, 201 bp, Homo sapiens
aaacagtgtggagatttcttaaaaaactaaaagtagaactaccatcaatccagcaatcccactcctgggtatctacccaatggaaaagaaatcattagacraaaaagataaacgcacacatgtgtttacagcagcaccattgcaaagatgtggaaccaacctaagtgtccatcaaccaacgagtggataaaaaaaaaatgt

SEQ ID NO: 41712 - DNA, 201 bp, Homo sapiens
gtggcctcccaaattgtaacaacttttcctccatcacacattgtcattttcttatgccacacattcttctgatgatttttaagtggatttgtaagatgaaraattctgaatcacctggatgagcattgctttctttttctttatttttttttaaattatactttaagtgctgggatacatgagcagaatgtgcaggtttgt

SEQ ID NO: 41713 - DNA, 201 bp, Homo sapiens
ttagaactgataaattcagtaaagtttcaggatataaaatcaaaatataaaaatcaatagcacttctaaatgccaacagcaaacaatttgaaaaagaaatmaagaaagtaacctcatttacaacagctacaaataaaatgagttaaccaaagaagagaaagatctctacaatgaaaactataaacattgatgcaaaaaatt

SEQ ID NO: 41714 - DNA, 201 bp, Homo sapiens
catctatctcattttctttcttttgacacaagtccattagcttcatctgtcttgaggacaatcccggctaagagcctatctgatgtttcttctttggggamctttcagaatttcaaggttataggaaacttggctttgtgcaaagtatgttgccatctgttgctagtttctaatttcagatccatttaagagatttgccag

SEQ ID NO: 41715 - DNA, 201 bp, Homo sapiens
ttgaattcatggatacagagagtagaatgatggttactagaggctgggaagggcagtgagtggcagaggggtggaagtgggaatgagtaaagtgtacaaaratatagttagatacagtgtataagatctagtatttgatagctcaatgatgctattttttccatttgataacacaaatactagatgaatgtagggtgacta

SEQ ID NO: 41716 - DNA, 201 bp, Homo sapiens
ccaagactgttaaaataatcttccataatgatttgtcttagagtagaaatatgtggcatatttttaatcataaatacatatacacattataattgttcttytgtatttaagttagtacctgtgatttgtttatccaagacagatggtaaggggtgatacttttgtcagcttacatctagagatctatagtagggttaattt

SEQ ID NO: 41717 - DNA, 201 bp, Homo sapiens
gacttattcactaccactagaacagtatgggggaacctgcccccatgattcaattatctccctctcacaactcatgggaattaggggagctacaactgaaygtgacatttgggtggggacacagccaaaccatatcagtttctgaatgtcctcttcaggcacaattttgccttgtgttatctgtgctctaagttcatgctg

SEQ ID NO: 41718 - DNA, 201 bp, Homo sapiens
aattaactattaaaaattaaagaacataaaaattatacaaattaattatttactcagtgatgagaacttttttatcccaacaggctgagaccatatttaawacttttccttgtattttattcttccatgcaatacacttttgagttttcagaatatgttcctcttttcagtttgtccctatatgttggtcaacagattcct

SEQ ID NO: 41719 - DNA, 201 bp, Homo sapiens
tgcttcacaatgggtagagtttagtttgatgggtggttcaccttttggctcctgctatttggcttaattgatgattggcaggcaatctggcttaaatctgwtgacctttcttcaggaaaggaagggtgaaatgaagagatggtaagaattcctcccatatttcctgatctatctttggtggcccaggcttccagaattccc

SEQ ID NO: 41720 - DNA, 201 bp, Homo sapiens
gaggggtagggatattacttttccagataggctgtgtgaccactcttgcgtgtttgctgataaatgcctacgtgtttggctatttcaggtctgaggctcaytttccttgtgacaaatgcctgatagtttgtggggcagaaacttacagctctcctttctccctctgttgggaaccacctgatactgctgatgttgccaaaa

SEQ ID NO: 41721 - DNA, 201 bp, Homo sapiens
aaattgcctataggagaaaaataacctgatactgacaaatctataggctttggagtgtctgcagcgtctactagtgtgtatttagagggaatttttgatawgactcaagattttgagtggcattttattaagcatttgaattactttgtaactgacatctttgttattgtctacaagaatggcatagcccttttcattgaa

SEQ ID NO: 41722 - DNA, 201 bp, Homo sapiens
ttgtaactgacatctttgttattgtctacaagaatggcatagcccttttcattgaagtctaatttgatagtttgcattatattgatgtattttctcttatrtgggtttcatacatttcacgcagaagtcattcttaaagagttttgaataagactcttatccaaaattccctctaaaaacacgttagtagacattggtggt

SEQ ID NO: 41723 - DNA, 201 bp, Homo sapiens
tgaccaattagttctctctccccttggccatgtgctcagggcaagggccaatcaccaactcaaatgaacagccatgttaatgctgtttccgccttcagtarttgtgttaggcataggcatatgacataattttgttcaacaaggcttgtgaggtagagggatcagaccttctgagaaagatctttttcattcttaaaaagg

SEQ ID NO: 41724 - DNA, 201 bp, Homo sapiens
tcataggagtacaattttttatcacaagctagctatataaataatcctctattaaaaccccgggtatttttttttttagcccagcattttgatggtacacaaaactttagacaacaagatggtagggtttctttaagtgtgtgttggtagtaagaaatagttccattggagaaaaacaaagaattgcttcgttggtgagtc

SEQ ID NO: 41725 - DNA, 201 bp, Homo sapiens
gttggagaccatattagtacattgtaaacactgtcttgcttaatccaataatctcatggggatatttactattttatctccactttacagttgaggaaacwgctcaaatcacttttccaattactcagctagttaccacagttaggacttgcactatgtttttagctattatacttagacatacaagttgaaggcagttct

SEQ ID NO: 41726 - DNA, 201 bp, Homo sapiens
agtgatttattagtatggggtaactgctcatgtttgagcatgtcgacatgctttttgagtttagggttgaaatattagccttgtgttactagtaataaaaygaaaatccagtgagagggatttgctgcagatcacatagaatttgtactcaagttcctgtcttcttttccatctacttctctttctgtgttatcatagttc

SEQ ID NO: 41727 - DNA, 201 bp, Homo sapiens
caattttaaattgggttgccagggaaggcctgcaaatccaaaggacctcacttttgtatccagggaacaagacagagaccagtgtgcctggatctggaccsaagggaatgagaagggagggtgggaggagatgacgtcagaggagtgatgggtggggacagaagatgccatggagtctcattgaaccagctcgaagacctg

SEQ ID NO: 41728 - DNA, 201 bp, Homo sapiens
ttgaagaggtccttcacatcccttgtaagttggattgctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgg

SEQ ID NO: 41729 - DNA, 201 bp, Homo sapiens
gtgtgcctggatctggaccgaagggaatgagaagggagggtgggaggagatgacgtcagaggagtgatgggtggggacagaagatgccatggagtctcatygaaccagctcgaagacctggacagaagaggattgcttctccatcctggcagcatggagaaggccttgttccctgtgtgattcccacaggagtgccgaaga

SEQ ID NO: 41730 - DNA, 201 bp, Homo sapiens
tgaagaggtccttcacatcccttgtaagttggattgctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttggg

SEQ ID NO: 41731 - DNA, 201 bp, Homo sapiens
cactagaggagtttatgttgttcacatttaagatgatttatttttattcacttgacaacacttcgaacttcaaatggatgcacacaagccaattcttggagggttgtgactgcagaaaaaaaattaaatcttgtgctcatgtgttgctccatcatagtaatcctcagttttgtcccagaagtagcatgtgtcacttccagt

SEQ ID NO: 41732 - DNA, 201 bp, Homo sapiens
tgtctgttattggtgtataagaatgcttgtgatttttgcacattgattttgtatcctgagactttgctgaagttgcctatcagcttaaggagattttgggytgagacaatggggttttctagatatacaatcatgtcatctgcaaacagggacaatttgacttcctcttttcctaattgaataccctttatttccttctcc

SEQ ID NO: 41733 - DNA, 201 bp, Homo sapiens
taatcctcagttttgtcccagaagtagcatgtgtcacttccagtgattcaggaccagctggtagaaaggacggacatttcatgctgccatgagcaactgcygtgtggtccaggatgacttttccaaaagcttcactcactgctcctcagaccacgtctgtttttgtagaggcaaaatgagatggctgagagaattgtggac

SEQ ID NO: 41734 - DNA, 201 bp, Homo sapiens
ttttgcacattgattttgtatcctgagactttgctgaagttgcctatcagcttaaggagattttgggctgagacaatggggttttctagatatacaatcaygtcatctgcaaacagggacaatttgacttcctcttttcctaattgaataccctttatttccttctcctgcctgattgccctggccagaacttccaacact

SEQ ID NO: 41735 - DNA, 201 bp, Homo sapiens
acaatcatgtcatctgcaaacagggacaatttgacttcctcttttcctaattgaataccctttatttccttctcctgcctgattgccctggccagaacttscaacactatgttgaataggagtggtgagagaggacatccctgtcttgtgccagttttcaaagggaatgcttccatttttgcccattcagtatgatattgg

SEQ ID NO: 41736 - DNA, 201 bp, Homo sapiens
cggggatcttggcaaagaggagaattaattcatcaaagcaccctgcccttgaaatctcaccacactgctagattgaaactagattgatggcacagaatggrtgttttgttttatcttatctctctattttcttatgtgggaggagtggacatattgcaaaaagcagttgccagacatgcacatttaaatgtactgaaacgc

SEQ ID NO: 41737 - DNA, 201 bp, Homo sapiens
tgcaaacagggacaatttgacttcctcttttcctaattgaataccctttatttccttctcctgcctgattgccctggccagaacttccaacactatgttgwataggagtggtgagagaggacatccctgtcttgtgccagttttcaaagggaatgcttccatttttgcccattcagtatgatattggctgtgggtttgtca

SEQ ID NO: 41738 - DNA, 201 bp, Homo sapiens
ttcagttagagcaaaaagataaaagcaatgttcagagaagaaggtgtatgggtatagatgaccttggtgatgacagattaaatttcacagacattaggaarggagtgcagaggagaaggggccacgaggaatagatcagaatagtgacgcatttccttttggtggcgtgcaatctggagacagatttctgaagatgactga

SEQ ID NO: 41739 - DNA, 201 bp, Homo sapiens
gtcttgtgccagttttcaaagggaatgcttccatttttgcccattcagtatgatattggctgtgggtttgtcatagatagctcttattattttgagatacrtcccatcaatacctaatttattgagagtttttagcatgaagggttgttgaattttgtcaaaggccttttctgcatctattgagataatagatggtttttg

SEQ ID NO: 41740 - DNA, 201 bp, Homo sapiens
tgagatacatcccatcaatacctaatttattgagagtttttagcatgaagggttgttgaattttgtcaaaggccttttctgcatctattgagataatagayggtttttgtggttggttctgtttatatgctggattacatttattgatttttgtgtgttgaaccagccttgcatcccagggatgaagcccacttgatcacg

SEQ ID NO: 41741 - DNA, 201 bp, Homo sapiens
tgatttttgtgtgttgaaccagccttgcatcccagggatgaagcccacttgatcacggtggataagctttttggtgtgctgctggatttggtttgccagtwttttattgaggatttctgcgtcaatgttcatcagggatattagtcgaaaattctctttttgttgttgtgtctctgccaggctttggtatcaggatgatgc

SEQ ID NO: 41742 - DNA, 201 bp, Homo sapiens
cttggtgcctagtccttcatttatttattcacttattcaacaagcattatggtgtgcctggcatatgtcaaatcttttccatctgaaagattcagaatggyctcttaggtatatgagataacattctaaattaattttattctcctggcctgcaaatttattctcaaaaactgctagttatatggttgctctgtttacttg

SEQ ID NO: 41743 - DNA, 201 bp, Homo sapiens
tatatgcatgtgtctgtatgtatatatgtagttttttacattctggtttattatgtatatgtatacatagaagacccagagagggtctctctctctctctmtatatatatatatgcatatgtttatatatcctcctatatattatttatgcttgtatagccaatcaaaatacatatattttacccatttatatttggtata

SEQ ID NO: 41744 - DNA, 201 bp, Homo sapiens
gatgaagcccacttgatcacggtggataagctttttggtgtgctgctggatttggtttgccagtattttattgaggatttctgcgtcaatgttcatcaggsatattagtcgaaaattctctttttgttgttgtgtctctgccaggctttggtatcaggatgatgctggcctcataaaataagttagggaggattccctctt

SEQ ID NO: 41745 - DNA, 201 bp, Homo sapiens
tggccaaatagaataccattcactaataaagcaaatgttctgtacatttccttccatatctatatcaaattattcatcaagaacatcaaaatgctattatmcatccacaactaatatttacaaccaacattttagtaagttaattttaggtaaattaattgaaacacggcctgtatatatattttatgtgaaagtattaat

SEQ ID NO: 41746 - DNA, 201 bp, Homo sapiens
gcattcacacaatgaaaatgtatttgaatgagatttctctgctgttagatggatcgtcagtggcattgtctcaaaggatatttgtgcttctctccttgtcytttggctttgacaatcagaatgatgaagattcctgtagtagaagtgtgcatgtaaatggaatttttttaacctattttatgaacacttcctgagtcccta

SEQ ID NO: 41747 - DNA, 201 bp, Homo sapiens
atggtggtgggtgcctgtaatcccagctacttgggaggctgagacaggataattgcttgaaaccgggaggtggaggttgcagtgagctgagatcacaccaytgtactccagcctgggtgacaagagtgaaactccatctttccatctataaaaaaacaaaaacaaaaaacaccacaaaaacagatgttgtattttaagacc

SEQ ID NO: 41748 - DNA, 201 bp, Homo sapiens
tcttcccacataatatgtaaagtcaacccttttccttgcaacttcatgaaatcttcaggaagatagtggttcctcattcatctattgagaagtcagagctrtttattccctgcttttcctaccagaagttccatgagggcaggaggacagcctgctttgttctctgctttaccccggcaccaaggacagtgcttggtagag

SEQ ID NO: 41749 - DNA, 201 bp, Homo sapiens
gaagtccagcatacacacacactcacccacccacaacctgtcacacatccccagaaaagagaaagagtgaaagatgcttcacaaaatcggcctcagcctgktgttcaagttgcctcgctcaatatgcctgtgcagtcagacctgcaggaagaaacagctcatttttaaactactgtatatgaaagtttttgcctggagata

SEQ ID NO: 41750 - DNA, 201 bp, Homo sapiens
tggtgagagatagattgtaaaactcaatgtattcttattcttttttttttttgcaattattcctgaatacaaaacttaaaaaatgacaccagggctttatrtctagagtagactgtgaaaaaaatgaatacacatttatttgggaaagatattggtggtcattatgccaattgacatatagttgtcatcactgatgtaatt

SEQ ID NO: 41751 - DNA, 201 bp, Homo sapiens
agaagtccagcatacacacacactcacccacccacaacctgtcacacatccccagaaaagagaaagagtgaaagatgcttcacaaaatcggcctcagcctkgtgttcaagttgcctcgctcaatatgcctgtgcagtcagacctgcaggaagaaacagctcatttttaaactactgtatatgaaagtttttgcctggagat

SEQ ID NO: 41752 - DNA, 201 bp, Homo sapiens
acaaaaaagtaaacaattgtttacatgatatgttttcggggctctgatatttctgctgctgctccactgaattgcagtttaacttagctgtaacttaaagyttcagtttcagtttttgctaatcattaatattcattcacttattcagttcttaaatatttatccaggtcctgctacttttgtgggtgtgatattgtgctg

SEQ ID NO: 41753 - DNA, 201 bp, Homo sapiens
cattaactgtctccttaaactctcacagtgatacttcttgggtcccacatcttccaaagaagtccagcatacacacacactcacccacccacaacctgtcmcacatccccagaaaagagaaagagtgaaagatgcttcacaaaatcggcctcagcctggtgttcaagttgcctcgctcaatatgcctgtgcagtcagacct

SEQ ID NO: 41754 - DNA, 201 bp, Homo sapiens
ctgtgttgagtgctcagagaaatctggagaccatgattttcattccataaatctgcacataagtacaatttttttccagcagtaattattaatccaggtgkagaggagagattgtgaaattaacccagggtaaaataaaacagtgtaacataagatgttctggtggtgctacagcaaggagagatggagcatttgtcaaag

SEQ ID NO: 41755 - DNA, 201 bp, Homo sapiens
gccttttcctttgtggtttttccctttgtttttatgctattaacatgtatcaatatatttatatttataaatctatatctagctttgttccatttagaatttagttagagtttggtatcaactgaagacttaggtcattttattttgaaaaaaatagctgtccaaatatttcatcataaccattaatgtttactgtattta

SEQ ID NO: 41756 - DNA, 201 bp, Homo sapiens
ctggatttaccaagatttccagtcatttcctactaaaatcttgaggaaatttaccatcttatgcttgcatttcagcccctgaaatggaagcgtcatgggawtgctttctgcagtggggatgtttgaacaatgagtttattaattgatgcatgtagacaagagactgttgggtggtgctaggaagaagaaaccagcaccctc

SEQ ID NO: 41757 - DNA, 201 bp, Homo sapiens
gatgctgttgctcactgtggccttggaaaaggtcaaattaaaatgaaagtgtacattttaaatgacagtttgtttcacttagcatagagcagtatggtacsttcactaaacttcctagattcaaggttgattcaatcatcttaacaaaactaaattattaatttaaaaacacacatttttcatgtaaagcagagggttccc

SEQ ID NO: 41758 - DNA, 201 bp, Homo sapiens
ccaacacagtaaaaccctgtctctactaaaaatacaaaaattagctgggcgtggtggcacatgcctgtaatcccagctattcgggaggctgaggcaggagratggcttgaacccgggagtcggagggtgcagtgagtcaaaattgccactgcgctccagcctggtgacagagcaagactccatctcaaaaaaataaaataa

SEQ ID NO: 41759 - DNA, 201 bp, Homo sapiens
gacagtttgttgtaatttccgttcttttacatttgctgaggagtgctttacttccaactatatggtcaattttggaataagtgcggtgtggtgctgagaakaatgtatattctgttgatttggggtggagagttctgtagatgtctattaggtctgtttggtgcagagctgatttcaattcctggatatccttgttaactt

SEQ ID NO: 41760 - DNA, 201 bp, Homo sapiens
tatggtcaattttggaataagtgcggtgtggtgctgagaagaatgtatattctgttgatttggggtggagagttctgtagatgtctattaggtctgtttgrtgcagagctgatttcaattcctggatatccttgttaactttctgtctcgttgatctgtctaatgttgacagtggggtattaaaatctcccattattattg

SEQ ID NO: 41761 - DNA, 201 bp, Homo sapiens
caatggtgcaagtttaaaaaaaattaatacatgttctctgactccaaggttgttgttttggataacttacaggttcttgttacatgccaatttattggacratatatattaaacatatttcctgttacaaatataattctgcagaataattgaaatggctgcataatattccattatatagttgtagcaaaataattcaat

SEQ ID NO: 41762 - DNA, 201 bp, Homo sapiens
ctcagcctcccgagtagctgggactacaggcacgtgccaccacacctggctgaatttttgtatttttagtagagatggggtttcattgtgttagtcagaawggtctcgatctcctgatctcctgattcacccgccttggcctcccaaagtgctgggattacaggcgtgagccaccatgcaccatggaacaataattttaag

SEQ ID NO: 41763 - DNA, 201 bp, Homo sapiens
aaagtcagttggggtcaccttgtctattgcaactaaaatagaattgactcagagctacattttcgtcacctccttttcctacctctttcttggcccccttrttctggccttagattactctgcagaaacacaggcaccttgttttttttttttaatgtggaaaaaattaggtttctttttcttattcttccactattccag

SEQ ID NO: 41764 - DNA, 201 bp, Homo sapiens
ccgtgtctattttctaataaatgttaactattttgaagagaaatgcattactcccatagaaagaacaaatacttgcaatcagtgatgttttacacttactrtttctattttaatttgtatttattataaaaataggggatatgtgcacacttgaaaacattctcgttgtgtaacattagagtattacagttaaaactgaag

SEQ ID NO: 41765 - DNA, 201 bp, Homo sapiens
tcctctccaaaatacaaaagacaagttatagactattttcttttctttcctgggcaacaccattagttatatgagctctaagagctgtcttgacatggaartaattcacttgcttcaagaaagaaagtatttgatttgttaactatgtgctcgagagacttctctcagttgcctgtttggataattttaagccttgaaatt

SEQ ID NO: 41766 - DNA, 201 bp, Homo sapiens
ttgaggagctgactcgatggtggcatgggcaaatcagtggttctccttcggtcatgttacatttgaggtgcttatgatataaagtgagaagttcaatacasacgtctgaaagtaaaaagagaagtctgtgttagacatgtagatgtcatgtcttcagaatgcagatcggtgtaaagctctgggcctggatgcaaccaccca

SEQ ID NO: 41767 - DNA, 201 bp, Homo sapiens
atccttttcatttgctctcatatcctgccaatattgctaatgtttttacttaattttctgctgaatttagttctattgctagtgacttagcttagccttcrtttcccttgacaaggaatattagtaatagtaaagttcttatcacacctcatgcttcattcaggctgtcttcccttctgtctatcctgtataccaccactt

SEQ ID NO: 41768 - DNA, 201 bp, Homo sapiens
ttttttttggttggtaagctgttaattattgcctcaatttcagagcctattattggtctcttcagagattcaacttcttcctggtttagtcttgggaggahgtatgtgtcgaggaatttatccatttcttctagattttctagtatatttgtgtagaggtgtttatagtattctctgatggtagtttgtgtttctgtgggt

SEQ ID NO: 41769 - DNA, 201 bp, Homo sapiens
tgagtgaaagggaggaatcaaggtcatttttggtctgagttactgtctgaagagtcatgccattaacagagaaacagaaggcattgaggagctgactcgayggtggcatgggcaaatcagtggttctccttcggtcatgttacatttgaggtgcttatgatataaagtgagaagttcaatacacacgtctgaaagtaaaaa

SEQ ID NO: 41770 - DNA, 201 bp, Homo sapiens
gataccttctttgattctatgccaacaaaaattcagacaccctagttatgtctctttagtctcttttttaaaaaatcacatctattaagataaaatttgamttcaatgaatcgcacccatttaaagtatacactttagtgcatattgcccatacatgcatgtttgattctaacttcatgatcaagatacaaaacaatatca

SEQ ID NO: 41771 - DNA, 201 bp, Homo sapiens
tgcactgtggtctgagagacagtttgttgtaatttccgttcttttacatttgctgaggagtgctttacttccaactatatggtcaattttggaataagtgyggtgtggtgctgagaagaatgtatattctgttgatttggggtggagagttctgtagatgtctattaggtctgtttggtgcagagctgatttcaattcctg

SEQ ID NO: 41772 - DNA, 201 bp, Homo sapiens
agatgtctattaggtctgtttggtgcagagctgatttcaattcctggatatccttgttaactttctgtctcgttgatctgtctaatgttgacagtggggtrttaaaatctcccattattattgtgtgggagtctaagtttctttgtaggtctctaaggacttgctttatgaatctgggtgctcctgtattgggtgcatata

SEQ ID NO: 41773 - DNA, 201 bp, Homo sapiens
cttaggtctttgttgttattgcttcaagaatgcttcattacagaccaccacaacatttagtggcttacagaaaggcaacacaaatatatatgtgtgtgtgwgtgtgtgtgtatgtatgtgtgtgtgtgtgtgtgtgtgtatatatatttctcactcttgggtgtgcaaatgagctacaactcagctaggcaagcctggact

SEQ ID NO: 41774 - DNA, 201 bp, Homo sapiens
taatgttgacagtggggtattaaaatctcccattattattgtgtgggagtctaagtttctttgtaggtctctaaggacttgctttatgaatctgggtgctyctgtattgggtgcatatatatttaggatagttagctcttcttgttgaactgatccctttactattatgtaatggccttctttgtctcttttgatctttgt

SEQ ID NO: 41775 - DNA, 201 bp, Homo sapiens
taggtctttgttgttattgcttcaagaatgcttcattacagaccaccacaacatttagtggcttacagaaaggcaacacaaatatatatgtgtgtgtgtgwgtgtgtgtatgtatgtgtgtgtgtgtgtgtgtgtgtatatatatttctcactcttgggtgtgcaaatgagctacaactcagctaggcaagcctggacttc

SEQ ID NO: 41776 - DNA, 201 bp, Homo sapiens
gtctctaaggacttgctttatgaatctgggtgctcctgtattgggtgcatatatatttaggatagttagctcttcttgttgaactgatccctttactattrtgtaatggccttctttgtctcttttgatctttgttggtttaaagtctgttttatcagagactaggattgcaacccctgccttttttttgttttccgtttg

SEQ ID NO: 41777 - DNA, 201 bp, Homo sapiens
tgttgttattgcttcaagaatgcttcattacagaccaccacaacatttagtggcttacagaaaggcaacacaaatatatatgtgtgtgtgtgtgtgtgtgtatgtatgtgtgtgtgtgtgtgtgtgtgtatatatatttctcactcttgggtgtgcaaatgagctacaactcagctaggcaagcctggacttcaggctgaa

SEQ ID NO: 41778 - DNA, 201 bp, Homo sapiens
agagactaggattgcaacccctgccttttttttgttttccgtttgcttggtagatcttcttccatccttttattttgagcctgtgtgtgtctctacacgtsagatgggtttcctgaatacagcacactgatgggtcttgactctttatccaatttgccagtctgtgtcttttaattggagcatttagcctatttacattta

SEQ ID NO: 41779 - DNA, 201 bp, Homo sapiens
gccaaaagaccaagaagtcatgtcgcccaggctagagtgcagtggtgcattcatggctcactgcagcctcaaactcatggactcaagagatcctcctgcckcagcctccagaggatctgggcctgcaggtgcatgccaccacacctagttaattttttttacattttttcagcaacagggtggccatgtgaccttatgtaa

SEQ ID NO: 41780 - DNA, 201 bp, Homo sapiens
ccttttcctttgtggtttttccctttgtttttatgctattaacatgtatcaatatatttatatttataaatctatatctagctttgttccatttagaatttagttagagtttggtatcaactgaagacttaggtcattttattttgaaaaaaatagctgtccaaatatttcatcataaccattaatgtttactgtatttag

SEQ ID NO: 41781 - DNA, 201 bp, Homo sapiens
gttgttattgcttcaagaatgcttcattacagaccaccacaacatttagtggcttacagaaaggcaacacaaatatatatgtgtgtgtgtgtgtgtgtgtrtgtatgtgtgtgtgtgtgtgtgtgtgtatatatatttctcactcttgggtgtgcaaatgagctacaactcagctaggcaagcctggacttcaggctgaag

SEQ ID NO: 41782 - DNA, 201 bp, Homo sapiens
ctgccttttttttgttttccgtttgcttggtagatcttcttccatccttttattttgagcctgtgtgtgtctctacacgtcagatgggtttcctgaatacrgcacactgatgggtcttgactctttatccaatttgccagtctgtgtcttttaattggagcatttagcctatttacatttaaggttaatattgttatgtgt

SEQ ID NO: 41783 - DNA, 201 bp, Homo sapiens
cttttcctttgtggtttttccctttgtttttatgctattaacatgtatcaatatatttatatttataaatctatatctagctttgttccatttagaatttagttagagtttggtatcaactgaagacttaggtcattttattttgaaaaaaatagctgtccaaatatttcatcataaccattaatgtttactgtatttaga

SEQ ID NO: 41784 - DNA, 201 bp, Homo sapiens
ttattgcttcaagaatgcttcattacagaccaccacaacatttagtggcttacagaaaggcaacacaaatatatatgtgtgtgtgtgtgtgtgtgtatgtrtgtgtgtgtgtgtgtgtgtgtgtatatatatttctcactcttgggtgtgcaaatgagctacaactcagctaggcaagcctggacttcaggctgaaggctg

SEQ ID NO: 41785 - DNA, 201 bp, Homo sapiens
aatttgatcctgtcattatgattttagctggttattttgttcgttagttgatgcagtttcttcctagccttgatggtctttacaatttggcatttttttgyggtggctggtactggtttttcctttccatgtttagtgcttccttcaggagctcttttagggcaggcctggtggtgacaaaatctctcagcatttgcttgt

SEQ ID NO: 41786 - DNA, 201 bp, Homo sapiens
ttttcctttgtggtttttccctttgtttttatgctattaacatgtatcaatatatttatatttataaatctatatctagctttgttccatttagaatttagttagagtttggtatcaactgaagacttaggtcattttattttgaaaaaaatagctgtccaaatatttcatcataaccattaatgtttactgtatttagaa

SEQ ID NO: 41787 - DNA, 201 bp, Homo sapiens
gagagatgtgggcctcaggcgtcctgttcttggggttgtacgtctgcacctggaggggacactggggaggaaacgtgggttcggagcagggggcggcgtcygcgtctgacccggcctgccggttgcttgtcgcccgcgcaggagctggccgggcgccgcctgcaggctgtcccgggccgagtcggagcgacgctgccgcgc

SEQ ID NO: 41788 - DNA, 201 bp, Homo sapiens
tattgcttcaagaatgcttcattacagaccaccacaacatttagtggcttacagaaaggcaacacaaatatatatgtgtgtgtgtgtgtgtgtgtatgtatgtgtgtgtgtgtgtgtgtgtgtatatatatttctcactcttgggtgtgcaaatgagctacaactcagctaggcaagcctggacttcaggctgaaggctgg

SEQ ID NO: 41789 - DNA, 201 bp, Homo sapiens
tttctccttcacttataaagcttagtttggctggatatgaaattctgggttgaaaattcttttctttacgaatgttgaatattggcccccaccctcttctkgcttgtagagtttctgccgagagatcagctgttagtctgatgggcttccctttgtgggtaacctgacctttctctctggctgcccttaacattttttccc

SEQ ID NO: 41790 - DNA, 201 bp, Homo sapiens
ttattgtgtgggagtctaagtttctttgtaggtctctaaggacttgctttatgaatctgggtgctcctgtattgggtgcatatatatttaggatagttagstcttcttgttgaactgatccctttactattatgtaatggccttctttgtctcttttgatctttgttggtttaaagtctgttttatcagagactaggattg

SEQ ID NO: 41791 - DNA, 201 bp, Homo sapiens
attgcttcaagaatgcttcattacagaccaccacaacatttagtggcttacagaaaggcaacacaaatatatatgtgtgtgtgtgtgtgtgtgtatgtatgtgtgtgtgtgtgtgtgtgtgtatatatatttctcactcttgggtgtgcaaatgagctacaactcagctaggcaagcctggacttcaggctgaaggctggc

SEQ ID NO: 41792 - DNA, 201 bp, Homo sapiens
ttgtggcgttctctgtatttcctgagtttgaatgttggcctgcctggctagattggggaagttctgctggataatatcctgcagagtgttttccaacttgrttccattctccctgtcactttcaggtacaccaatcagacgcagatttgggcttttcacatagtcccatatttcttggaggatttgttcatttcttttaat

SEQ ID NO: 41793 - DNA, 201 bp, Homo sapiens
gaaaaagagtatatttatagcataatataataaactactgtctccttctggggcaaaggtcaggaatacttactgcccactgtgaaagagcagggaccccstatcctgagggttcctctcctggaacacaaccaactgcatgttcaaacaccacttggttctcattgtgttgccttttgggaagtaaaacttgataactat

SEQ ID NO: 41794 - DNA, 201 bp, Homo sapiens
ttgcttcaagaatgcttcattacagaccaccacaacatttagtggcttacagaaaggcaacacaaatatatatgtgtgtgtgtgtgtgtgtgtatgtatgtgtgtgtgtgtgtgtgtgtgtatatatatttctcactcttgggtgtgcaaatgagctacaactcagctaggcaagcctggacttcaggctgaaggctggct

SEQ ID NO: 41795 - DNA, 201 bp, Homo sapiens
ggctaaaaatttggaggaatcatgaaaagacattcaccaagaatttccttttctagaagtgaggatgattatgttttctgtttttcatgccattttgcaartcaaagtgatttttaactcagaagattaacatatgcttatgttattttatgcattataaacttggtaaagctattttccaaagtaaatattggtatgcca

SEQ ID NO: 41796 - DNA, 201 bp, Homo sapiens
tgcttcaagaatgcttcattacagaccaccacaacatttagtggcttacagaaaggcaacacaaatatatatgtgtgtgtgtgtgtgtgtgtatgtatgtgtgtgtgtgtgtgtgtgtgtatatatatttctcactcttgggtgtgcaaatgagctacaactcagctaggcaagcctggacttcaggctgaaggctggctg

SEQ ID NO: 41797 - DNA, 201 bp, Homo sapiens
taaagctttcatatctgtcatattagtccattttcatgctgctgataaagacatacccaagaccgggcaatttacaaaagaaagaggtttaatggacttayagttccgcatggctggggaggcctcacaatcatggtggaaggcaaggaggagcaagtcacatcttacgtggatggtggcaggcaaagagagttgttcatg

SEQ ID NO: 41798 - DNA, 201 bp, Homo sapiens
ttctttgatgttttcaatatttcaactctttgagaaactttttaaatcaaatttattgtaataaactgtattttaaggttttttaaaaaattctctccttycccaaacttgaaactggctcccgttagtaaagaacattggctcatattaatagaaaacattgactaaggaaccaaacataaatcacaaacaaaaaagaaa

SEQ ID NO: 41799 - DNA, 201 bp, Homo sapiens
tcaactagaagaatgtaggagaagctggattggactgtgggtgattgctagaaatattaagaaaccacgaaggagagcatcaggataaatagctaatgcamatgggacttaatacctaggtgatgggttgataggtgcagcaaaccaccatggcacacgttcacctaggtaacaaacctgcacgtcctgcacatgtatccc

SEQ ID NO: 41800 - DNA, 201 bp, Homo sapiens
gtcatatttttgaaataaaatttacattgttttattctatgttagaagtcttacatttatatgtagtcaaatcaattgattttttatttgtgatttctgtmattattaagaaagtttttgtccagagctcagatgaatattccatatttggttctttgatgttttcaatatttcaactctttgagaaactttttaaatcaa

SEQ ID NO: 41801 - DNA, 201 bp, Homo sapiens
gatttgtatctataaatcctactgagctctcacagaaaggactggaagatgcttttgaaaacagatccaggaagtggggaactcaaggaagagaggagcarctcctccaggatggtcatgaaactatccagacatttagtacctgtttcccctataaaacaaaatctttcactgtcggggaaagggtaatacatctccttg

SEQ ID NO: 41802 - DNA, 201 bp, Homo sapiens
tgcattgtggtttatcaccaaaaccattgaacctcattaacctcagtgataacgtacacaattggttttgagatgtttacagctggactctaccaaaacayaagactattagagagtaaaagatatgggaaatatattcattggctggatacattattctacattaatattttccaaaggattaatttggcctcatcttgg

SEQ ID NO: 41803 - DNA, 201 bp, Homo sapiens
tgcaaattctaagctaaaaaaattaaaaatatttttcatgataggatatatgaggctcattagtgtgctgatatatatcgtgacacattagaacagaagayagcagactcttttccatgtttattttaccctagaatcttctgtgaagagagtttcatgaaactgagcctccatgaactcacttcaggggataagcaactt

SEQ ID NO: 41804 - DNA, 201 bp, Homo sapiens
cgtgacacattagaacagaagatagcagactcttttccatgtttattttaccctagaatcttctgtgaagagagtttcatgaaactgagcctccatgaacycacttcaggggataagcaacttagaatattgcttctattgatgcgtcattgggtcaatttggaagggatggatctctccctatcctgtatacattttgtt

SEQ ID NO: 41805 - DNA, 201 bp, Homo sapiens
ctgctcaactttcaagggccagttaacagtcaaggaagtccagaaagtctctgctgttacgtctataggtcatagactttatcgctcagcttaactcaagrtgacaatcacttctggctgacaatcacatcagcttctttgtatattagccttgactttgaagtttgtacattctttgaggacaaggaccaagtactgcac

SEQ ID NO: 41806 - DNA, 201 bp, Homo sapiens
gtcatctcagggggatacctaaggccaaaatgtcatctgacaactgatccagaatccactatatcacctgcatcctttgttgactcataaatttattattyatgttgtacattatttttagttatttttgccataaatatatatcgagtatgtaatatgtattgggcactattttagatgatggcagaaaaaagtggtagc

SEQ ID NO: 41807 - DNA, 201 bp, Homo sapiens
tccaagaaaaattctatacaatgaaggaaacttggtcacaggtcaaagaattagggcacaagccatctgccaagtatgaaataaaggaatcttgtgccacrtacacttgtgaaagcaaaacgatttgtccaaatccttaaaattccttgacagggcttataggattatctgtcgctctccagagattaataagaaactgaa

SEQ ID NO: 41808 - DNA, 201 bp, Homo sapiens
ttgggcgtgcgacttcttctaagccagaaaagcctcaacatctgtgcagtgtggatctcatctctgtgcatatgggctgtgttatcccaagagaaaatagyccccaattatatgagttcatcctcatgaactcctgcaagaactcccatgggtatatcctggtgcctgacagtgcctgctggtaagatgtggctcctgtcc

SEQ ID NO: 41809 - DNA, 201 bp, Homo sapiens
aaagcaaaaaaaaaaaaaaaaacaacaacaacaaaaaaaaatagttttccaagaaaccctctccaggagacttctgcttacctctcagtgatcaaaaaccktttcaccacagttacttaccacgtcctaccgatccgcattctcgcaagtgtccttcactccatttactctactgcatttttcactgtatttctcatgcca

SEQ ID NO: 41810 - DNA, 201 bp, Homo sapiens
aaaaaaaattatttatttatttatttatttttagagacaggatctcactctgtagttcaggctacactttatcttagccaaaagaccaagaagtcatgtcrcccaggctagagtgcagtggtgcattcatggctcactgcagcctcaaactcatggactcaagagatcctcctgcctcagcctccagaggatctgggcctg

SEQ ID NO: 41811 - DNA, 201 bp, Homo sapiens
gtttgttagttttccttctaacagtcaggaccctcagctgcaggtctgttggagtttgctggaggtccactccagaccctgtttgcctgggtatcagcagyggcagctgcagaaccgcggatattggtgaacagcaaatgttgctgcctgatcgttcctctggaagttttgtctcagaggagtacctggccgtgtgaggtg

SEQ ID NO: 41812 - DNA, 201 bp, Homo sapiens
taagtaaggagttctttccccattgcttgttttcgtcaggtttgttgaagatcagatggttatagatgtgcagtcttatttctgagttctctattctgttscattggtctatgtgtctgttttgtaccagtaccatgctgttttggttaccatgtgactttttaaaaaaaattatttatttatttatttatttttagagac

SEQ ID NO: 41813 - DNA, 201 bp, Homo sapiens
gtgcctcccagctaggctcctcgggggtcagggacccacttgaggaggcagtctgtctgttctcagttgtccagctgcatgctgggagaaccactactctbttcaaagctatcagacagggacatttaagtctgcagaggattctgctgccttttgtttggctatgccccgcccccagaggtggagtctacagagacaggc

SEQ ID NO: 41814 - DNA, 201 bp, Homo sapiens
agtctgcagaggattctgctgccttttgtttggctatgccccgcccccagaggtggagtctacagagacaggcaggcctccttgagctgcggtgggctccmcccagttcaagcttcctggccgctttgtttaccttctcaagcctcggcaatggcgggcacccctccccgagccttgctgctgccttgcagtttgatctca

SEQ ID NO: 41815 - DNA, 201 bp, Homo sapiens
gcactcatgctctaagatatctgcagggaccctagagtcatccctgcgtctcaggaaggaagaaagtaaaatgccaagggaaaacaaaacgacattgcttrttctttaagtaaagaacttgacacctttaaagccaccttttcaggagcccactcagtggcttctgtttctttttcatacaattatatttcattgactttg

SEQ ID NO: 41816 - DNA, 201 bp, Homo sapiens
gttcaagcttcctggccgctttgtttaccttctcaagcctcggcaatggcgggcacccctccccgagccttgctgctgccttgcagtttgatctcagactrctgtgctagcaatgagcaaggctccatggtcataggaccctccaagtcaggcgcgagatataatctcctggtgtgccgtttgctaagaccattggaaaag

SEQ ID NO: 41817 - DNA, 201 bp, Homo sapiens
gtgatcacagtacccggtttcaataccatatcaaagaaagaggcaatgaagaggtaggaaagacagtcttgaatcaccacaccatgcctaccccatccgcyggcagcagccatgtagtgtggagagatcatctctgtgctgttgagggagagggaacagtgattgtggaactttggattggaactcagttttgccctgtac

SEQ ID NO: 41818 - DNA, 201 bp, Homo sapiens
gtccaaaatcgaagtaagaaaataacagaataaacctaaaaaagtaaagaaagataatgaaaacaaacaaaaatgatagaaataatttaaaaagtcaaatrttaagtctttgtatagtcttcctgcaaacttaattttaaaaactaacaaactcataacagaacaaacaaaggtgaaaagcaacagacaaacctaacagaa

SEQ ID NO: 41819 - DNA, 201 bp, Homo sapiens
gtatgcctgtatcaaaatatctcaggcaccctataaatacatacacctattatgcacccacaacaatgaaaaagaaaaattgctttcttacattaaatatrtgtatatatctctgtgtgtgtgtatatatatatatgtgtatatatatacacacatgtatatacacatacacacacacacaaaaagagataaagcaaactc

SEQ ID NO: 41820 - DNA, 201 bp, Homo sapiens
ctggctaacaaggtgaaaccccgtctctactaaaaatacaaaaaattagccgggcgcggtggcgggcgcctgtagtcccagctactcgggaggctgaggcrggagaatggcgtgaacccgggaagcggagcttgcagtgagccgagattgcgccactgcagtccgcagtccggcctgggtgacagagcgagactccgtctc

SEQ ID NO: 41821 - DNA, 201 bp, Homo sapiens
tggctcagtttgcaacctgctgactgaagagcccctgggccttgaacaaaattggcagtagccaggcagtgtggttgctatgagccttgggtgagacctartaccatgctggctttgggactgacccagagtagtcccagtagtagttgcaacaggggtgcttgtgttacccctcccccagttccaggcagatcagtgtga

SEQ ID NO: 41822 - DNA, 201 bp, Homo sapiens
aggcaccctataaatacatacacctattatgcacccacaacaatgaaaaagaaaaattgctttcttacattaaatatgtgtatatatctctgtgtgtgtgtatatatatatatgtgtatatatatacacacatgtatatacacatacacacacacacaaaaagagataaagcaaactctaaaaaggtttattaaccatagt

SEQ ID NO: 41823 - DNA, 201 bp, Homo sapiens
ggcaccctataaatacatacacctattatgcacccacaacaatgaaaaagaaaaattgctttcttacattaaatatgtgtatatatctctgtgtgtgtgtatatatatatatgtgtatatatatacacacatgtatatacacatacacacacacacaaaaagagataaagcaaactctaaaaaggtttattaaccatagtt

SEQ ID NO: 41824 - DNA, 201 bp, Homo sapiens
tgatgctcacacagtgatgaaattgcctagtgatgcacttctcagggaagaccctgttgttaagcaatgtagaactgtaatagggagatatgacaaaaaawatacttctaaataagcctaaaatatctctttcaataaatataaaattaaaatctaactgataagagcctgtgtcatagtttagtttgccacatttttttc

SEQ ID NO: 41825 - DNA, 201 bp, Homo sapiens
aagagagactacatttgtttggaggaaagtaagggaagagaacatgagtctgcctggtaattcaaggaattctcctggatcttatccaggaccaccaaggrgatacctttacaagtctgtaagaatcacggcattactgggcttggggtgccccctaatgcagacacagctgcaatgaccaaagatttagataacaacact

SEQ ID NO: 41826 - DNA, 201 bp, Homo sapiens
acccacaacaatgaaaaagaaaaattgctttcttacattaaatatgtgtatatatctctgtgtgtgtgtatatatatatatgtgtatatatatacacacaygtatatacacatacacacacacacaaaaagagataaagcaaactctaaaaaggtttattaaccatagttaccattttagatgtttaaaagtcttgttacc

SEQ ID NO: 41827 - DNA, 201 bp, Homo sapiens
aacaggcaattgaactaagcagtgaaaagcatattagtttatcttagagaaatgtcagtaggatggtgggaataaaatctgattgtaaataaaaggtgagwcttggaatgaaacctaccttcgcctaatgtagtactgattatattttgtaaagaacaggagacacttgctcagttgtatggtttaaggggaggtatcgaa

SEQ ID NO: 41828 - DNA, 201 bp, Homo sapiens
gtatcagtataagttaatgctgaggaggagaaattatcaggggcacatatgatttttatttatgcatttgataataaattatttccacaaatatttattayataaatagtatgttcaaacatagtgcaaaacattgaataaatactggtgaggaagataagcaaggttgcttccctcacaaagcttagaatttgctgcttt

SEQ ID NO: 41829 - DNA, 201 bp, Homo sapiens
tctagaggcatcacattacctgatttcaaactctactataaggccatagtcaccaaaacagcatggtactgttataaaaataggcacacagaccaatggamcagaatagaaataaacccaaatacttacagccaactgatcttcgacaaagcaaacaaaaacgtaaagcaagaaaggataccctattcaacaaatggtgct

SEQ ID NO: 41830 - DNA, 201 bp, Homo sapiens
tattcaaagggatagccgagaaatttccaaacctagagaaatatgtcaatactcaagtacaagaaggttatagaacaccaaatagatttaacccaaataaractacctcaaggaattcaatagtcaaattcccaaaggtccaggataaagaaaagattcttaaattagcaagagaaaagaaacaagtaacattcaaaggaa

SEQ ID NO: 41831 - DNA, 201 bp, Homo sapiens
taaactaaagagcttttgcatggtaaaagaaacagcagagtaaacagacaacccacagagtgggagaaaaatcttcacaatctatacatctgacaaaggayacatattcagaatctacaaggctctcaaacaaatcagcaagaaaaaaacaatcccatcaaaactgggttaaggatgtaaacagacaattctcaaaagaag

SEQ ID NO: 41832 - DNA, 201 bp, Homo sapiens
ccatatttatggggcaaaaacctaatttattacttagtgattgctaggtagtccatatgtgtgtaccattactgcgctaattccccattgaacaatatttyggtcactagtaatttttcaaaaacataaatacaactatattttatatttctgaacatacacttgtgtgtactttttctttctgttgggtacattaattaa

SEQ ID NO: 41833 - DNA, 201 bp, Homo sapiens
atagtttattgtacattgatgaaaagtttcctggcctagtaaagcccaggactcaatggtttcactgctcaattttacaaaacatttaaagaaataatacygatcctactttaactatttcaaaaaatggaggaggagggaatacttccaaactaattctgtgaggctaatattaccctgataccaaaaccagacaaaaac

SEQ ID NO: 41834 - DNA, 201 bp, Homo sapiens
agataaaagaactgtcccatttaattatgagtgtgcaacttcaaaggcttctccagactgactggggaaagcctgctgctaaatcttcccattgcagaagrgtttccctcttctgataatctcttgtgctccagaggatttcctaaacattttgtgaacactattctcttgagggtatttttttctattattaattataca

SEQ ID NO: 41835 - DNA, 201 bp, Homo sapiens
ccagccagcccatcagttacaccagctttgaggtacatgaggtctggaggccatgggttctggttctattcactaaagaccttgaccacaagagatttgcsaatcctgtgggtggtaaaaatgccactgaatatgcttcagaagattcagagggaagcttctatacaaagcttaggttggtatatcagaagacagaggggt

SEQ ID NO: 41836 - DNA, 201 bp, Homo sapiens
actactcatgtaacttaatctccaggtgatgcaaatacaattctccagttttactttatttttctgaggaagaactgtcctctgggtactcagattttttwaaaataaaactaagcttctctgaacatcattacaatctggagcagacatcaacctctgcagtatttcatcattcttacagaatctgtagaattctatata

SEQ ID NO: 41837 - DNA, 201 bp, Homo sapiens
tctgaggaagaactgtcctctgggtactcagatttttttaaaataaaactaagcttctctgaacatcattacaatctggagcagacatcaacctctgcagkatttcatcattcttacagaatctgtagaattctatatactgtatggtattatgcttattagtctttaaatttttcctaattaacagtctaagttgcagtg

SEQ ID NO: 41838 - DNA, 201 bp, Homo sapiens
aaatgattccttctttggcataacttttaaaattggaattgagaaactggtaaattcacaagaaaagttgcaattttgttttataattttctgtcttatcygaaaagcccaatacctgcctgagaatctggtaccaacacctgatatttctaagtgatttttaaactctaccagttaaatatcacaaaggattttgtagga

SEQ ID NO: 41839 - DNA, 201 bp, Homo sapiens
acttttaaaattggaattgagaaactggtaaattcacaagaaaagttgcaattttgttttataattttctgtcttatctgaaaagcccaatacctgcctgrgaatctggtaccaacacctgatatttctaagtgatttttaaactctaccagttaaatatcacaaaggattttgtaggacatgtacagtttcacttaaagt

SEQ ID NO: 41840 - DNA, 201 bp, Homo sapiens
gcatttccataagttcccaaatgatgctgatgttgctgcaggtccatggaccacgctttaagaacaactgacttagtaattcccattctgtctcttttagrcaggcccttcccccacaggctgcagttcatgtgacttagggaacctgccaactcagaacctgtgtccttttttcctaagccgcactttggttatccaaga

SEQ ID NO: 41841 - DNA, 201 bp, Homo sapiens
ggagtcacagttccacatggctggagaggcctcacaatcatggtggaaggtgaaaggcacatctcacatggcgggagacaagagagaatgagaatcaagcraaagggatttccctttataaaaccatcagatctcataagatttattcactaccatgagagcaatatgggggaaaccacccccatgattcaattatctccc

SEQ ID NO: 41842 - DNA, 201 bp, Homo sapiens
aggttgaaatagagaagagagaggaattcgggacccaaagaaccagaaggcaaagaagtcaaggctccttgaaaggaatggacctagacatggccttgggkgctggagaaaagggagcaagatggatcaggaaggaagttcaggaagggaggggatttctgtcttgctcctcagctccagggtacctgagctgggtaagtg

SEQ ID NO: 41843 - DNA, 201 bp, Homo sapiens
cactataaaatatattaccagatattaatttgatggtagaacaaaggaaggatctgctataaaatatatcaagtaaggttttacatgtcattatacacaaytgcagagttttttgagaggctctaatgaaagggtacttctcatgctttggaagctcaagtcttcctcctcaaagagagtcaatgacattattttacagag

SEQ ID NO: 41844 - DNA, 201 bp, Homo sapiens
tataaagtaaagtaatactctacttgaaaggaatattcctgttacactataaaatatattaccagatattaatttgatggtagaacaaaggaaggatctgytataaaatatatcaagtaaggttttacatgtcattatacacaattgcagagttttttgagaggctctaatgaaagggtacttctcatgctttggaagctc

SEQ ID NO: 41845 - DNA, 201 bp, Homo sapiens
ttttttgagacagagtttctctcattgcccaggcagaagtccaatggcacgatctcggctcaccgcaacatctgccttccaggttcaagcaattcaactgyctcaacctcccaagtagctgggattacaggcatgcaccaccacactcagctaattttgtatttttagtagagacgggttttctccatgttggtcaggctg

SEQ ID NO: 41846 - DNA, 201 bp, Homo sapiens
gactcaatggtttcactgctcaattttacaaaacatttaaagaaataataccgatcctactttaactatttcaaaaaatggaggaggagggaatacttccraactaattctgtgaggctaatattaccctgataccaaaaccagacaaaaacacatcaaagtaagaaaactataggccaatatccctgataagcattggtg

SEQ ID NO: 41847 - DNA, 201 bp, Homo sapiens
taaaataatacacagacaacgcacacaagaaaatatatatgcatgtatttaagtatctacatatatgtatgtgtatatatatgcatgtatttaagtgttttgtgtgtgtgtgtgtatgttttatatagataaaacattggttagcactttaaagtctttaaattcttatctggctccaattggttttgaattcatctgtta

SEQ ID NO: 41848 - DNA, 201 bp, Homo sapiens
aaaataatacacagacaacgcacacaagaaaatatatatgcatgtatttaagtatctacatatatgtatgtgtatatatatgcatgtatttaagtgttttgtgtgtgtgtgtgtatgttttatatagataaaacattggttagcactttaaagtctttaaattcttatctggctccaattggttttgaattcatctgttag

SEQ ID NO: 41849 - DNA, 201 bp, Homo sapiens
gtctgacacagtgttagtctaagcatgtgcctaagatgctaatacaggttatgagaaaaggggcctcgtagccaaagttttgcaaattctaagctaaaaamattaaaaatatttttcatgataggatatatgaggctcattagtgtgctgatatatatcgtgacacattagaacagaagatagcagactcttttccatgtt

SEQ ID NO: 41850 - DNA, 201 bp, Homo sapiens
caataagaaaatctaccaaggatgaatgaaatgatttcattgtggacacttgtgatttataatagcatgtttaaatttggcacattttgatcataatcatratacctatatgtattttattgcagggaatggaatatgtagctgtggaaactgtgaatgctgggatggatggaatggaaatgcatgtgaaatctggcttgg

SEQ ID NO: 41851 - DNA, 201 bp, Homo sapiens
ttaaccactgcaagaatttggcttaatgcttttataaataggctaggtggttgacaggtgagatcacttatgcttaaaaatgataccaagttgggcaagaytgacaatattttgtagggccaggcaggaatgcaaaatgatgcagtcaatttgagggagtaatgtgtgctgaatagaatgaattcctaataaaatacttgc

SEQ ID NO: 41852 - DNA, 201 bp, Homo sapiens
atgcaaatcaaagctacaatgagatatcgtttcaccccagttaaagtggctttaatccaaaaggcaggcagtaacattcccaccaacagtgtatgagagtkggagaaaaaggaaccctcttacagtgttggtgggaatgaaaattagcatagccactgtgaagaacaatttggaagttcctcaaaaaactaaaaatagagc

SEQ ID NO: 41853 - DNA, 201 bp, Homo sapiens
aactggtaaattcacaagaaaagttgcaattttgttttataattttctgtcttatctgaaaagcccaatacctgcctgagaatctggtaccaacacctgayatttctaagtgatttttaaactctaccagttaaatatcacaaaggattttgtaggacatgtacagtttcacttaaagtggtatctctaatattctaaaat

SEQ ID NO: 41854 - DNA, 201 bp, Homo sapiens
cctcaaaaaactaaaaatagagctatcatatgatcaagcaatcccactgctggatacataccgaaaagaaaagaaatcagggtatggaagagatatctgcmctgttatgtttattgcagcactattcactatcacaaaagacttggaagcaacctaagtggccataaacagatgaacagttaaagaaaatgtggtatctat

SEQ ID NO: 41855 - DNA, 201 bp, Homo sapiens
cttcctgaagctcacattgttggtagggcccatctctaaccagagctgagaattccccacagtctgattgcaacagattgtgtgttttagactgagctcarttaaaggtgttttgctgataggaatcagaccatatccaaagcgaggtgtgagtggatccgtcaggggtcatgacaaatggtcttagcagttaggtccctt

SEQ ID NO: 41856 - DNA, 201 bp, Homo sapiens
cacgtcactgcttgtgaattcaggtgggccttagtggcagatgacattctcttgggcagttagggacttcctgggtcccgcatcggctagatgtattgttstaaccttcacagccattaaactttcaagagtggagaaactttttctccctcttcaatctggttttcaatgttattgttaaagtgtcaacaagcaatgtta

SEQ ID NO: 41857 - DNA, 201 bp, Homo sapiens
caggggtcatgacaaatggtcttagcagttaggtccctttctgtgttcatgatgttctcatcatatttctctagcacttcagtctttctttcttcttagtmggatttctctacgtccaattcataacacccacccctccaaacacacacacacacacacacacacacacacacactcttctctacttccaattcataacac

SEQ ID NO: 41858 - DNA, 201 bp, Homo sapiens
ttattgttaaagtgtcaacaagcaatgttattgttccagtgtcaacaagtctctcgcaaatgtcagcatgttctgtactttgcccagtttcctcacaacaratctgtcgctgaaataaaaccacttgtctccaagaatttcaaagccattggctcctgtgaaacaacagaattgactgtactttaaatgtgaaatatttat

SEQ ID NO: 41859 - DNA, 201 bp, Homo sapiens
tatatgtgtaactatatacacacacatgcatatatatacacacacacgcatatatatatatacacacacgtgcatgtatatacacacatatatatacacawgtgcatatatatatgtatatatatatatgagagagagcatatatatacatatgagagagagagagagactgtgaacgcccttggcagtcaatgtgagcag

SEQ ID NO: 41860 - DNA, 201 bp, Homo sapiens
ataaatccaatttccatgaatgaaagtacatggagaaatatgattctctttctctctttatatatatcttttgcacacagacactctcactcactgtcagsctactttagccttaaggtatgttcaatttcagttcagttcagttcaatgttacattaaaaaacacagtttagacgtttgcttaaagttttctgaatgaga

SEQ ID NO: 41861 - DNA, 201 bp, Homo sapiens
tacacacacatgcatatatatacacacacacgcatatatatatatacacacacgtgcatgtatatacacacatatatatacacatgtgcatatatatatgwatatatatatatgagagagagcatatatatacatatgagagagagagagagactgtgaacgcccttggcagtcaatgtgagcagagaattggcttttcca

SEQ ID NO: 41862 - DNA, 201 bp, Homo sapiens
atatatatacacacacgtgcatgtatatacacacatatatatacacatgtgcatatatatatgtatatatatatatgagagagagcatatatatacatatragagagagagagagactgtgaacgcccttggcagtcaatgtgagcagagaattggcttttccagaaaggagtttctgggacatcactcttgggataaata

SEQ ID NO: 41863 - DNA, 201 bp, Homo sapiens
taaatccaatttccatgaatgaaagtacatggagaaatatgattctctttctctctttatatatatcttttgcacacagacactctcactcactgtcaggytactttagccttaaggtatgttcaatttcagttcagttcagttcaatgttacattaaaaaacacagtttagacgtttgcttaaagttttctgaatgagac

SEQ ID NO: 41864 - DNA, 201 bp, Homo sapiens
aatatatgttaatagagatataattcacataccacaaaattcacataccactcagtattttgatatattaacataattatgcagccatcaccactgtccarttccaaaaaaaaagtttatcatcataaaataccctgttaccctatagcagccactccccattctcttgtcccagaacccctggaaaccaccaatctactt

SEQ ID NO: 41865 - DNA, 201 bp, Homo sapiens
aataaagttttattagatcattgccatgctcatttgtttacgtatagctactttcttgctgtaatggcaaagttgagtagtggccacagagagcacagggyccacaaagcctgaaatatttctcatgcagccccttacagaaaaaacctgctacccctgagctaagcatttgtgataattgtgacaaatatgtcgggagaa

SEQ ID NO: 41866 - DNA, 201 bp, Homo sapiens
tgctgtaatggcaaagttgagtagtggccacagagagcacagggcccacaaagcctgaaatatttctcatgcagccccttacagaaaaaacctgctacccytgagctaagcatttgtgataattgtgacaaatatgtcgggagaagggattgagtgtcttgagaatcagaggaagatgacatttgctcaatttgtgtgcaa

SEQ ID NO: 41867 - DNA, 201 bp, Homo sapiens
cataagaaaatatggagtatgtagtgcctggtaaagtctctcctactgcttcctttaatttgctggaagtctgggtatggttaatgatactgttgaattayagttgcaatggtgagagagaattgtaaaactcaccctcttgagtgtagcttaatgtaattataaaaaaaaaggtggtagcaaaatccaagtgacataatt

SEQ ID NO: 41868 - DNA, 201 bp, Homo sapiens
cctcacaaatctagaatatgatgtaattataattttacacatctgttgtaagtggctctgtatatttcaaaacttgttcattctcaacttcttaaatgtgrgctgagcattataggatgcatacaattttattatttgatctctcgtcttaaattgtcatgacccaagagggctacagcagtatttctagaaggcatttct

SEQ ID NO: 41869 - DNA, 201 bp, Homo sapiens
gagagggaagggtgggaagaactttgttttgcagcttgggtgccaactcaagtcacagcagaacagtgcactaagtagattattaagtttcctgactccaygcactggctcatggacagcatttctgggccagccttgagccagggagtagcttgctgccctaaagggaggaacacaatcctggctcagtttgcaacctgc

SEQ ID NO: 41870 - DNA, 201 bp, Homo sapiens
cacttcagtctttctttcttcttagtaggatttctctacgtccaattcataacacccacccctccaaacacacacacacacacacacacacacacacacactcttctctacttccaattcataacacccacccctccatacacacacacacacgcgcacgcgcgcgcatgccccatagcgtctttcatcttgaaaaaatta

SEQ ID NO: 41871 - DNA, 201 bp, Homo sapiens
acttcagtctttctttcttcttagtaggatttctctacgtccaattcataacacccacccctccaaacacacacacacacacacacacacacacacacacwcttctctacttccaattcataacacccacccctccatacacacacacacacgcgcacgcgcgcgcatgccccatagcgtctttcatcttgaaaaaattat

SEQ ID NO: 41872 - DNA, 201 bp, Homo sapiens
tggtttctttttattatttattattattattatactttaagttctagggtgcattgcacaacgtgcatgtttgttacatatgtatacatgtgccatgttgstgtgctgcacccattaacttatcatttacattaggtatatctcctaatgcttcccctccccactacccccacatcacaacaggccccagtgtgtgatgtt

SEQ ID NO: 41873 - DNA, 201 bp, Homo sapiens
ttgggagaccgaggtgggctgatcacgaggtcaggagatcgagaccacagtgaaaccccgtctctactaaaaatacaaaaaattacctgggcgtggtggcrggcgcccgtagtcccagctgcttgggaggctgaggcaggagaatggcgtgaacccgggaggcagagcttgcagtgagccaagatcacgccactgtactcc

SEQ ID NO: 41874 - DNA, 201 bp, Homo sapiens
atagcaagtactacctagatctaagttattccccaaagcttttctctattgatggtcttcatgttactttgtaaacatgttaacagacgattcaaattcasaggcattttttgatcctttaaaaagaaagaagtatcctctaaagcagagaagtgtttgtctggaatagatgcaactgcacttgtgctgaaacacctgcac

SEQ ID NO: 41875 - DNA, 201 bp, Homo sapiens
gctgcttgggaggctgaggcaggagaatggcgtgaacccgggaggcagagcttgcagtgagccaagatcacgccactgtactccagcctggtcaacagagygagactctgtctcaaaacaaaacaaaacaaaagaatggccataattaaaacatcaaaaaaacaatagatgttggtagggatgtggtgaaaagggcacact

SEQ ID NO: 41876 - DNA, 201 bp, Homo sapiens
tagcaagtactacctagatctaagttattccccaaagcttttctctattgatggtcttcatgttactttgtaaacatgttaacagacgattcaaattcacrggcattttttgatcctttaaaaagaaagaagtatcctctaaagcagagaagtgtttgtctggaatagatgcaactgcacttgtgctgaaacacctgcacc

SEQ ID NO: 41877 - DNA, 201 bp, Homo sapiens
attgaaataaaaataaaaattagaaaagatcagagggaaagaatatgggggaaataagacccccatcaaaaaataagtgatgaaagatactggggaaaaayacaggagagcaggttactggggaaataaagactatttgagaaatgggcaaaaatgataaataatgcaaatccacaatgtaagtttcatattttaaaagtc

SEQ ID NO: 41878 - DNA, 201 bp, Homo sapiens
gagtttggatagcataactccaaagaacacaatagttacaaataaacaagaaaaagtttagttaacaccctttcctataatggcctgagaaccttaataaytcctgccttcccagcatggcctttggaccactcaatggctgctcttgctgcaaatcttccttttcgtatgggtattttgggctgcagtcatttttatggt

SEQ ID NO: 41879 - DNA, 201 bp, Homo sapiens
accctttcctataatggcctgagaaccttaataattcctgccttcccagcatggcctttggaccactcaatggctgctcttgctgcaaatcttccttttcrtatgggtattttgggctgcagtcatttttatggtaggtagattataccaacaccaagcactgtattcttccattgtgtgtgtgtgtgtgtgcatgtgtgt

SEQ ID NO: 41880 - DNA, 201 bp, Homo sapiens
gctcagtcccaaatcaatgtcactgttaagagtatgtgttacagtagtggttatctttggaaaacaatttgagtctgactagatgttgttcaatccccagrccatggtaagtgtgactgtggcaagtgcaagtgtgaccagggatggtatggggatgcttgccagtacccaactaactgtgacttgacaaagaagaaaagt

SEQ ID NO: 41881 - DNA, 201 bp, Homo sapiens
ggatgtttctttctacatcagtcattcccttggagacaagagagaatgaggcaagatgtattggattgttccttagtgtttttccattatgcctctccatytacagattgtgccctccaacaatttcctccctctaattcaaacgcagtgctcttgggaacttattttatgtgtacccaataaaatggcattaatctgata

SEQ ID NO: 41882 - DNA, 201 bp, Homo sapiens
atatgatcaagatcactaattgtcagggaaatgcaaatcaactccacagtgagatacctcttcactccagttagaatcggttttattatagaattataataaaaaaagacaaaagaaaacaaatgttggcaagggaggtagagaagagaacactgacacactgtgggtgaaaatgtaaattagtatagtcactatggaaaa

SEQ ID NO: 41883 - DNA, 201 bp, Homo sapiens
tcacattgagacctggttttaggtacaaaatgtatacttcaatggtttcttcaacgtcacatctggtactgttgcacttgatttttcttagagaagacccrtaactcctagattggatagttctacatctatcatcatcttccagtgattttcccttattcatttcctatgcatttttgaaatacttttcagtttgtattc

SEQ ID NO: 41884 - DNA, 201 bp, Homo sapiens
ttataatttatcggttgactattgaaataaaattttcatattccattgcattttatataatagcattacccctcagccactgcgatatacatgagtttcartttattatagctcagtcccaaatcaatgtcactgttaagagtatgtgttacagtagtggttatctttggaaaacaatttgagtctgactagatgttgttc

SEQ ID NO: 41885 - DNA, 201 bp, Homo sapiens
ttatgaacacttcctgagtccctactgtggactggatgtgcatgttcttgaagaactcataatctagcagaagatgtaaataaataaatctatagagtagratgtgatgaaatgttggagagaagggtgtttatttgccctggggaccctaaacaggttgtggctaactccgcctggaggatttaggggagtaataatgaa

SEQ ID NO: 41886 - DNA, 201 bp, Homo sapiens
tatgatcaagatcactaattgtcagggaaatgcaaatcaactccacagtgagatacctcttcactccagttagaatcggttttattatagaattataataaaaaaagacaaaagaaaacaaatgttggcaagggaggtagagaagagaacactgacacactgtgggtgaaaatgtaaattagtatagtcactatggaaaac

SEQ ID NO: 41887 - DNA, 201 bp, Homo sapiens
gacctgaggagaagcaatagtgaaatgatgaactagattaagaagggtatgcatattgttttgtatcttctaattgacctggcgttgacaatttcaaaaartgtatgagttcttaagccatctcgttgatttactgaaataggttgaatgctgtggtggcttcatgactgtgcccagttcttccatccatgcatgttgccc

SEQ ID NO: 41888 - DNA, 201 bp, Homo sapiens
actgtataaaattcattttgggtaaaggccatgggaagtgttactgtggaaactgctactgcaaggctggttggcatggagataaatgtgaattccagtgygatatcaccccctgggaaagcaagcgaagatgcacgtctccagatggcaaaatctgcagtaacagaggtgtgtcattcatacatgttactacataatggg

SEQ ID NO: 41889 - DNA, 201 bp, Homo sapiens
atgatcaagatcactaattgtcagggaaatgcaaatcaactccacagtgagatacctcttcactccagttagaatcggttttattatagaattataataaaaaaagacaaaagaaaacaaatgttggcaagggaggtagagaagagaacactgacacactgtgggtgaaaatgtaaattagtatagtcactatggaaaact

SEQ ID NO: 41890 - DNA, 201 bp, Homo sapiens
gtgtttttcctttttagaatatttttgtctgaatatatgtgtttttttcaaacacaaagtaaacagaaaataataagcgatatgtgaaatgctttctttcrtggtttttcttgactggattcttataaaattcttcttcccacctagggacttgtgtatgtggtgaatgtacctgtcacgatgttgatccgactggggact

SEQ ID NO: 41891 - DNA, 201 bp, Homo sapiens
ttcatatctgtcatattagtccattttcatgctgctgataaagacatacccaagaccgggcaatttacaaaagaaagaggtttaatggacttatagttcckcatggctggggaggcctcacaatcatggtggaaggcaaggaggagcaagtcacatcttacgtggatggtggcaggcaaagagagttgttcatggaaactc

SEQ ID NO: 41892 - DNA, 201 bp, Homo sapiens
cagatttgaaactgatcatagtgacttcccaaagcaaaaatgaatggggaaattttggttttagtgatgcacaaagccagtcatcctccgtgtctgattcyagagtgaacagaaatgacttcccatagtccctttaaagttttaacctatcaaataaagtcctttagtctaatctccttgaaaaacaccatttttcaagtt

SEQ ID NO: 41893 - DNA, 201 bp, Homo sapiens
ccttgaaaaacaccatttttcaagtttcctgttattaacttcatgtcagaattcaaatccccaatgttttaaagaatgtcattggttactataacaattaacttacttaattcaacagagtgccttcctagacatgaattatgcagtgatcttgaaagaacaaaagatagtacaaaaaagaaatccaatttctcttttttt

SEQ ID NO: 41894 - DNA, 201 bp, Homo sapiens
tgcaaaaattttctcccattttgtaggttgcctgttcactctgatgttagtgtcttttgctgtgcagaagctctgtagtttaattagatgccatttgtcarttttggcttttgttgccattgcttttggtgttttagacatgaagtccttgcccatgcctatgtcctgaatggtaatgcctaggttttcttccagggtttt

SEQ ID NO: 41895 - DNA, 201 bp, Homo sapiens
gataaaatgatttattaatattttattcaacctcattgttttaagcttttctgaaacatattccctctttaatcaatgatgatatgctagctttaggtaarcggtctgatgttaacacatatacagagagtataaaattccacttgactcctcaagtgcccatcaaacattttttttaaaactcttttgatacatcttagt

SEQ ID NO: 41896 - DNA, 201 bp, Homo sapiens
ttttgtcaaacccttacaaaaaaaagtggggaatatgaagggagggttcttatgcacaattgcctaataacaagaactatcataagagactgccaaaaccrcagcgttgcacaaagaccaccacagtcttacacacacaaaaatatatatacttatgtgaggatctgcccagcaactgcctgcctaaccttggacggacac

SEQ ID NO: 41897 - DNA, 201 bp, Homo sapiens
actgtagagagaaaaattatgtttctaaagaaaaactctaatatacttgttagatgttggccctgtgcatagtttcttagtttttattatctatctgtagwctagactggatcttgaattcttctgatataggagttaagaagaaattacttaggcagatagtgagaatatgggagtcctcagtaaggttttccttttaat

SEQ ID NO: 41898 - DNA, 201 bp, Homo sapiens
gttcttgaatttttaaagctgttcagacactgtaccacaacctcatatcacagtggtacccagaaaatccaaatagtagtacttgtgtaaatagatttctrtttcagcctctttaaaggcagttatgtagatactcttaattttgaatttttggaaatagggaggatcattatttcctaaaattatagcacttataagtgg

SEQ ID NO: 41899 - DNA, 201 bp, Homo sapiens
ttaatgaatactttaaatattttgagatagttatatagaaaattgggcttaaggttagaatgagataatgttctagtaaattttagctgtctatatattcyattaaacaattattacatatattgtgaccttttagttttatactagtagcacttttttattatgaagttagtaatgctggtcaaaatgtttagggtttaa

SEQ ID NO: 41900 - DNA, 201 bp, Homo sapiens
tgcctagaaatgtgaaagaaagtcttcaaaattaggataaagaaatctctaaaatcaggaaattcctcaccttgatgagaccacaagggaaccagcatccyttgcagactgacctgggagcagcagctcactgggtcctgagaaaccacagggctgtcagtcaattattaaaactgagaagacgtgtatatttcctcaaga

SEQ ID NO: 41901 - DNA, 201 bp, Homo sapiens
aaacaggagagcaaccaatcatgcaagtcagttgtagaagagagtgtaccttgcactggaagaagaaagcataaacagtacaaagcatattatttcagagsatttgttctctactcccatagttttactttttaaaatttaaaatatatgctctttgagagtagggatttctgtcagtttagttcactgctatattctctc

SEQ ID NO: 41902 - DNA, 201 bp, Homo sapiens
tcaaatatttatttagtttttgaaatgctatttgattttttatgtggctagctgtttttttatttcctacagatatttttaggttgctctttattgacttrtgctctaaacataatacagttattttatattatatgtctggcaatttcaaagtctaaatattttctggatctgtttttgcagtctaattttttctgaaga

SEQ ID NO: 41903 - DNA, 201 bp, Homo sapiens
ttttttgtttttttttgtttttttttgagacggagtctcgctctgtcgcccgggctggagtgcagtggcgcgatctcggctcactgcaagctccgcctccygggttcacgccattctcctgcctcagcctcccgagtagctgggactacaggcgcccgccaccacgcctggctaattttttgtatttttagtagaggcggg

SEQ ID NO: 41904 - DNA, 201 bp, Homo sapiens
tgatcaagatcactaattgtcagggaaatgcaaatcaactccacagtgagatacctcttcactccagttagaatcggttttattatagaattataataaaaaaagacaaaagaaaacaaatgttggcaagggaggtagagaagagaacactgacacactgtgggtgaaaatgtaaattagtatagtcactatggaaaactg

SEQ ID NO: 41905 - DNA, 201 bp, Homo sapiens
aggaattgttaataatttttttcataaattttataaatatttctcccatttagtataggttttactttttttgtgatgtatcaaaagttcagtaaactctrttagccttttcctttgtggtttttccctttgtttttatgctattaacatgtatcaatatatttatatttataaatctatatctagctttgttccatttag

SEQ ID NO: 41906 - DNA, 201 bp, Homo sapiens
ttaatgtcaacttttctatatccatactgattttaatttcactaattgcattaattactgagaaaggagcgtttatatattaaaaagtagtctaaaaagcaaaaaaaaaaaaaaaaaaaatcctgcttcaaaaatacagttagtccttccctgtgactcccctccatgcaaattaattgccaaatccaccaaatactcctt

SEQ ID NO: 41907 - DNA, 201 bp, Homo sapiens
cttgaaaaacaccatttttcaagtttcctgttattaacttcatgtcagaattcaaatccccaatgttttaaagaatgtcattggttactataacaattaacttacttaattcaacagagtgccttcctagacatgaattatgcagtgatcttgaaagaacaaaagatagtacaaaaaagaaatccaatttctctttttttt

SEQ ID NO: 41908 - DNA, 201 bp, Homo sapiens
taatgtcaacttttctatatccatactgattttaatttcactaattgcattaattactgagaaaggagcgtttatatattaaaaagtagtctaaaaagcaaaaaaaaaaaaaaaaaaaatcctgcttcaaaaatacagttagtccttccctgtgactcccctccatgcaaattaattgccaaatccaccaaatactccttt

SEQ ID NO: 41909 - DNA, 201 bp, Homo sapiens
ttgaaaaacaccatttttcaagtttcctgttattaacttcatgtcagaattcaaatccccaatgttttaaagaatgtcattggttactataacaattaacttacttaattcaacagagtgccttcctagacatgaattatgcagtgatcttgaaagaacaaaagatagtacaaaaaagaaatccaatttctcttttttttc

SEQ ID NO: 41910 - DNA, 201 bp, Homo sapiens
aatgtcaacttttctatatccatactgattttaatttcactaattgcattaattactgagaaaggagcgtttatatattaaaaagtagtctaaaaagcaaaaaaaaaaaaaaaaaaaatcctgcttcaaaaatacagttagtccttccctgtgactcccctccatgcaaattaattgccaaatccaccaaatactcctttc

SEQ ID NO: 41911 - DNA, 201 bp, Homo sapiens
tgaaaaacaccatttttcaagtttcctgttattaacttcatgtcagaattcaaatccccaatgttttaaagaatgtcattggttactataacaattaacttacttaattcaacagagtgccttcctagacatgaattatgcagtgatcttgaaagaacaaaagatagtacaaaaaagaaatccaatttctcttttttttct

SEQ ID NO: 41912 - DNA, 201 bp, Homo sapiens
tccccagtgtgtgatgttccccttcctgtgaccatgtgttctcattgttcaattcccacctatgagtgagaatatgccgtgtttggttttttgtccttgcratagtttgctgagaatgatggtttccagtttcatccatgtccctacaaaggacatgaactcatccttttttatggctgcacagtattccatgctgtatat

SEQ ID NO: 41913 - DNA, 201 bp, Homo sapiens
atgagcattttttcatatgtttgttgatcacatatatatcttcttttgagaagtgtctgttcatgtcttttgcccactttttaatggggttatttgttttwtgcttgttaatttgtttaagtttcctatagattctcgatatgagacctttgttggacacataatttgtgaatattttctcccattctgtatgttgtctgt

SEQ ID NO: 41914 - DNA, 201 bp, Homo sapiens
ttaaagtagttttttccaattctgtgaagaaagtcattggtagattgatggcgatggcattgaatctgtaaagtaccttgggcagtatggccattttcacratattgattcttcctatccatgagcatggaatgttctttcatttgtttgtatgctcttttatttccttgagcagtggtttgtagttctccttgaagaggt

SEQ ID NO: 41915 - DNA, 201 bp, Homo sapiens
aatctggcatagttggccagaaatcctttaaggaattcttttcaagttggcttagagataagatatgcaaatgacacttaaaagtgtaaaaaaaaaaaaamcccaaatgccttttagctcatgggattcatatgaatctttgataaataaattggttttaaatttgttggtaaaataaaaatttgtttcagaattgttagc

SEQ ID NO: 41916 - DNA, 201 bp, Homo sapiens
gggtgaaagagaggtgacagaaccatttttactgcagtgcagtgtgattaatctgtgtcttcttaatgagattaaggggaaaaacaaactttttttttaatttttttttttttttaactagctctcctctatactgcaagttaaacaacttattctggcagaaggttgaaagaagggaacaattgctcctttgctagaaat

SEQ ID NO: 41917 - DNA, 201 bp, Homo sapiens
tagtttgtatttctgtgggattggtggtgatatcccctttgtcattttttattgagtctatttgattcttctctcttttcttctttattagtcttgctagyggtctatcaattttgttgaacttttcaaaaaaccagctcctggattcattgattttttgaagggttttttgtgtctctatttccttcagttctgctctga

SEQ ID NO: 41918 - DNA, 201 bp, Homo sapiens
ggttagaatgagataatgttctagtaaattttagctgtctatatattctattaaacaattattacatatattgtgaccttttagttttatactagtagcayttttttattatgaagttagtaatgctggtcaaaatgtttagggtttaattttggtgatataatcattcctccacattttttggtagtcaatatgcagtaa

SEQ ID NO: 41919 - DNA, 201 bp, Homo sapiens
caagcattgttcacaaaactggattagttgttaattacaaatggcctaaactattttaagaaagaattttattatggaaaaataagagtactataaaaaargtcagttggggtcaccttgtctattgcaactaaaatagaattgactcagagctacattttcgtcacctccttttcctacctctttcttggcccccttatt

SEQ ID NO: 41920 - DNA, 201 bp, Homo sapiens
cagtattcattcaggagcaggttgttctgtttccatgtagttgagtggttttgagtgagtttcttaatcctgagttctagtttgattgcactgtggtctgmgagacagtttgatataatttctgttcttttacatttgctgaggagtgctttacttccaagtatgtggtcaattttggaataggtgtggtctggaatgcac

SEQ ID NO: 41921 - DNA, 201 bp, Homo sapiens
gctacattttcgtcacctccttttcctacctctttcttggcccccttattctggccttagattactctgcagaaacacaggcaccttgttttttttttttwatgtggaaaaaattaggtttctttttcttattcttccactattccagatgaattccgtgtctattttctaataaatgttaactattttgaagagaaatgc

SEQ ID NO: 41922 - DNA, 201 bp, Homo sapiens
gagtttccagtttgtccacatccttgccatttcttggtattgtctgtctttttgattctttagagtattctttataaagaaaactccataaagtgtctcargttgtttgcagcacagatattttctcatatccattattttcccctaagggttgtaagtagaagagtggaggagtaggatatgggtataataatcttttta

SEQ ID NO: 41923 - DNA, 201 bp, Homo sapiens
agtttttatatttctgtctttcagtgaatttatccatttaatctaagttttcaatttattggcatagagctatttataatattgtcttattgcctttataatattcaaggaatctctagttgtgctcactctaatttagaatattgtaatttgtttattacttgtgtttttaacataaatgtttgtgtacattgttgttta

SEQ ID NO: 41924 - DNA, 201 bp, Homo sapiens
gtttttatatttctgtctttcagtgaatttatccatttaatctaagttttcaatttattggcatagagctatttataatattgtcttattgcctttataatattcaaggaatctctagttgtgctcactctaatttagaatattgtaatttgtttattacttgtgtttttaacataaatgtttgtgtacattgttgtttat

SEQ ID NO: 41925 - DNA, 201 bp, Homo sapiens
aatatatagagagaaatggaaaccacaaaataaaaatcacccattaattgatcatcctagaataatatctgatgacactatgttgtatttcttcctaggtwttgtttctgaggagtaaaattattttcaaaatataaattcataaatcttctttgggtattttgatattttgtctagagaaagtccacattgtatggtatc

SEQ ID NO: 41926 - DNA, 201 bp, Homo sapiens
ttttatatttctgtctttcagtgaatttatccatttaatctaagttttcaatttattggcatagagctatttataatattgtcttattgcctttataatattcaaggaatctctagttgtgctcactctaatttagaatattgtaatttgtttattacttgtgtttttaacataaatgtttgtgtacattgttgtttataa

SEQ ID NO: 41927 - DNA, 201 bp, Homo sapiens
ccaccagacactaaaccataagatctgtggcctttcatatggagaatataaaacctatatatccaacatgtggccagagagtaaaatatggtacttgactscaaaatcagggactgtcttagcattttagcaaacaagcaaataagtaagataaaaaacatgtataaacttaactgatcagcagatgcatgagcactaaga

SEQ ID NO: 41928 - DNA, 201 bp, Homo sapiens
aaatgttgtcacttgaaataccaaaacaacatttctgagcgttgttgagggactggcaaagcaatcagctactataacaaatcagtagaaataaccctccyacaccagatatgcatgcagaaggaatggagtattatagagacttgatacaatggacatatgcacatggaggtacaaaacacacagtctaaatacaaatga

SEQ ID NO: 41929 - DNA, 201 bp, Homo sapiens
aacaaacttcaacacaataaaagccacatatgacagacctatggctagtatcatactgattggggaaaaactgaaaggctttccttgaagatcaagaacaygatacggatgcccacttttaccagtgttattcaacacagtactggaagtcctagtcagacaatcagataagaaaaagaaataatgttcatccacatggga

SEQ ID NO: 41930 - DNA, 201 bp, Homo sapiens
cgctcatcagttacagcaagtgtacttctctggtgggaattgttgataatggagaaggctatgcacgtgagggagaaggaggtatatggaatatctccgcrtctctctcagttttgctgtgcacctaaaactgctctaaaaagaaaacagtcttaaaagaatatgtactctctctgatattgtttgttagcgtgctctata

SEQ ID NO: 41931 - DNA, 201 bp, Homo sapiens
agatcacagagggttttcagggcagtgaaattactgtgtatgagtagtgaattcatgtcactatatgtttactcacactcatacaatgtacactaagagtrgaccctaatgtcaactattcactttgggtaatagtgatgtgtcaatgtacgctcatcagttacagcaagtgtacttctctggtgggaattgttgataatg

SEQ ID NO: 41932 - DNA, 201 bp, Homo sapiens
tttttttttgtttttttttgtttttttttgagacggagtctcgctctgtcgcccgggctggagtgcagtggcgcgatctcggctcactgcaagctccgccycccgggttcacgccattctcctgcctcagcctcccgagtagctgggactacaggcgcccgccaccacgcctggctaattttttgtatttttagtagaggc

SEQ ID NO: 41933 - DNA, 201 bp, Homo sapiens
tggaggacattctgctaagtaaaataagccagacatagacaaaaaaacactgcacgatctcactcatatgtggaatctaaaaacgttgaactcttagaaayagagtagaagggtggttacccagggccaaggggtaggagaaatggggagactttgcatacaaactttcaaagttataagatgaatacgttctggagatct

SEQ ID NO: 41934 - DNA, 201 bp, Homo sapiens
tctattcgagatggaaacctttagttataaggtgatggtgagtaatagcctttgtaatttcaggttcttgtcattgtgggaagtgcatttgttctgctgargagtggtatatttctggggagttctgtgactgtgatgacagagactgcgacaaacatgatggtctcatttgtacaggtgcagtattaaccttttctaatt

SEQ ID NO: 41935 - DNA, 201 bp, Homo sapiens
acccagtggaatagtattcgtcctttaagaaggaaatcctttcatttgccacaacatggatgaacctggaggacattctgctaagtaaaataagccagacrtagacaaaaaaacactgcacgatctcactcatatgtggaatctaaaaacgttgaactcttagaaatagagtagaagggtggttacccagggccaaggggt

SEQ ID NO: 41936 - DNA, 201 bp, Homo sapiens
acaagcgtatagtggtatttcatcgttttaatttgcatttgcctgatgacaatatataatatgaaacatctttttatgtacttgtttgccatctgtatgtyttctttaataaggcatctgttaagatctttgggccatttttaaattgtttttctcttattgttgagttttaggagttatttgtatattttaagtaacaga

SEQ ID NO: 41937 - DNA, 201 bp, Homo sapiens
gtgtatatatacgcatatacatatgtatgtgtgtatatgtgtatatatacacatatatagacatgtatgcgtgcatgtgtatatatacacatatatagacatatgtatgcgtgtatgtgtatatatacacatatacacatatatatgcatatatgtgtatatatatgtgtatatatacacatatatatgtatatatgttat

SEQ ID NO: 41938 - DNA, 201 bp, Homo sapiens
tgtatatatacgcatatacatatgtatgtgtgtatatgtgtatatatacacatatatagacatgtatgcgtgcatgtgtatatatacacatatatagacatatgtatgcgtgtatgtgtatatatacacatatacacatatatatgcatatatgtgtatatatatgtgtatatatacacatatatatgtatatatgttata

SEQ ID NO: 41939 - DNA, 201 bp, Homo sapiens
tatatgtgtatatatacacatatatagacatgtatgcgtgcatgtgtatatatacacatatatagacatatgtatgcgtgtatgtgtatatatacacatayacacatatatatgcatatatgtgtatatatatgtgtatatatacacatatatatgtatatatgttatatagcatatatatgatataaggctatccttgta

SEQ ID NO: 41940 - DNA, 201 bp, Homo sapiens
gtttgccttaatatgttatattatgttcatcaagatcctgactcatttgtgacatttgctgttagaatgaaaactaattccaacttcattatctttatgtrcatttttattttttgccactctcactgtgaaggtcatggacagtgtaattgcggaagatgtgactgcaaagcaggctggtatgggaagaagtgtgagcac

SEQ ID NO: 41941 - DNA, 201 bp, Homo sapiens
atatatatgtgtatatatacacatatatatgtatatatgttatatagcatatatatgatataaggctatccttgtatatatatgtgatatatatatatgctatatatatatatatgctctctctctctctatatatatatatagccttcacgtggtccctgatatacttcagtatattctattaggatttttatatatata

SEQ ID NO: 41942 - DNA, 201 bp, Homo sapiens
tttactttatttcttaagtagtttaggtattttattagtgattttgatttttcttgaaggttttattttttttattttgttatttattttgttatttatttatttatttatttatttatttatgttttttagacggagtctcgctctgtggctcaggctggggtgcagtggtgcgatcttgactcactgcaagctccgcct

SEQ ID NO: 41943 - DNA, 201 bp, Homo sapiens
tgtgttggatgggaaatgagatcctatggtttacacatttctttcttaaaactctctgcttcagctggttatttcctcatcctctcactcctttcctgtgrttgcttcacaggccacggcacatgttcctgtggtcgctgtgtttgtgagagaggatggtttggaaagctctgccaacatccgcggaagtgtaacatgacg

SEQ ID NO: 41944 - DNA, 201 bp, Homo sapiens
tatatatgtgtatatatacacatatatatgtatatatgttatatagcatatatatgatataaggctatccttgtatatatatgtgatatatatatatgctatatatatatatatgctctctctctctctatatatatatatagccttcacgtggtccctgatatacttcagtatattctattaggatttttatatatatat

SEQ ID NO: 41945 - DNA, 201 bp, Homo sapiens
acttctattatttccctatggttgtctcactagtaaataatacctttcaatacagaagatgatttctggtcaaattaatttactataatctcatattaatwattatttccagaaaatatctggagcagatgtcactggagcatatttaagaaatgaatggcatttaaaggtttaatttaaactgatcacatttaataaact

SEQ ID NO: 41946 - DNA, 201 bp, Homo sapiens
ctctcactcctttcctgtggttgcttcacaggccacggcacatgttcctgtggtcgctgtgtttgtgagagaggatggtttggaaagctctgccaacatcygcggaagtgtaacatgacggaagaacaaagcaagaatctgtgtgaatcagcagatggcatattgtgctcggggaagggtgagtatctctgctggtgcctg

SEQ ID NO: 41947 - DNA, 201 bp, Homo sapiens
tatatacacatatatatgtatatatgttatatagcatatatatgatataaggctatccttgtatatatatgtgatatatatatatgctatatatatatatrtgctctctctctctctatatatatatatagccttcacgtggtccctgatatacttcagtatattctattaggatttttatatatatatatatatatagcc

SEQ ID NO: 41948 - DNA, 201 bp, Homo sapiens
ctgagacatgtgaaattcatcatattctaatcaacttgtatattatcagccctgaaacacaaatattatatcagctctgactgcctcaaaccacatcttarcagtcagagactggctctccaggctattccatctcatttgagaagaaaaccaagaaccaaaacaaattttggtcaagtaacttaggaaatatttaaaatg

SEQ ID NO: 41949 - DNA, 201 bp, Homo sapiens
atatacacatatatatgtatatatgttatatagcatatatatgatataaggctatccttgtatatatatgtgatatatatatatgctatatatatatataygctctctctctctctatatatatatatagccttcacgtggtccctgatatacttcagtatattctattaggatttttatatatatatatatatatagcct

SEQ ID NO: 41950 - DNA, 201 bp, Homo sapiens
aaaattacatgagagcagagataagttcttttttaaaaggatttaagaaatacttacatagtgtttattatgtgacaaacactcttaagcagtttatagtyattattttacatagaaattctgtaatgcaaatactaccattttctcattttacagatgaatattctgtgatatataaagaggttaaataacttgctcaag

SEQ ID NO: 41951 - DNA, 201 bp, Homo sapiens
tatacacatatatatgtatatatgttatatagcatatatatgatataaggctatccttgtatatatatgtgatatatatatatgctatatatatatatatkctctctctctctctatatatatatatagccttcacgtggtccctgatatacttcagtatattctattaggatttttatatatatatatatatatagcctt

SEQ ID NO: 41952 - DNA, 201 bp, Homo sapiens
aacttgctcaagttcacacagcaaatccatgtagtggagctttaccatcagtggtacggttgcggagtgtgtgactttgagatttatgctgtgctgcttcttttttttttttttttttttttttttaagttttagggtacatgtgcacaacgtgcaggttagttacatatgtatacatctgctgtgttggtgtgctgcacc

SEQ ID NO: 41953 - DNA, 201 bp, Homo sapiens
atacacatatatatgtatatatgttatatagcatatatatgatataaggctatccttgtatatatatgtgatatatatatatgctatatatatatatatgctctctctctctctatatatatatatagccttcacgtggtccctgatatacttcagtatattctattaggatttttatatatatatatatatatagcctta

SEQ ID NO: 41954 - DNA, 201 bp, Homo sapiens
acttgctcaagttcacacagcaaatccatgtagtggagctttaccatcagtggtacggttgcggagtgtgtgactttgagatttatgctgtgctgcttcttttttttttttttttttttttttttaagttttagggtacatgtgcacaacgtgcaggttagttacatatgtatacatctgctgtgttggtgtgctgcaccc

SEQ ID NO: 41955 - DNA, 201 bp, Homo sapiens
tacacatatatatgtatatatgttatatagcatatatatgatataaggctatccttgtatatatatgtgatatatatatatgctatatatatatatatgctctctctctctctatatatatatatagccttcacgtggtccctgatatacttcagtatattctattaggatttttatatatatatatatatatagccttat

SEQ ID NO: 41956 - DNA, 201 bp, Homo sapiens
cggttgcggagtgtgtgactttgagatttatgctgtgctgcttcttttttttttttttttttttttttttaagttttagggtacatgtgcacaacgtgcargttagttacatatgtatacatctgctgtgttggtgtgctgcacccattaactcgtcatttagcattaggtatatctcctgatgctatccctcccccctcc

SEQ ID NO: 41957 - DNA, 201 bp, Homo sapiens
agatatgcggcattatttctgagggctctgttctgttccattggtctatatctctgttttggtaccagtaccatgctgttttggttactatagccttgtartatagtttgaagtcaggtagtgtgatgcctccagttttgctcttttgacttaggattgacttggcaatgtgggctcttttttggttccatatgaacttta

SEQ ID NO: 41958 - DNA, 201 bp, Homo sapiens
ccttgaagaggtccttcacatcccttgtaagttggattgctaggtattttattctctttgaagcaattgtgaatgggagttcactcatgatttggctctcygtttgtctgttattggtgtataagaatgcttgtgatttttgcacattgattttgtatcctgagactttgctgaagttgcctatcagcttaaggagatttt

SEQ ID NO: 41959 - DNA, 201 bp, Homo sapiens
cttgaagaggtccttcacatcccttgtaagttggattgctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttg

SEQ ID NO: 41960 - DNA, 201 bp, Homo sapiens
atggaagggaggtgaggactcaggatacagattgacctggggttgctcatgaattgagaccaaaagaaaaacagaggtagaataaaatgaaagggagaagwgctcagtgaacatctgtgctttctctttgccgagtcctgacacagcgctcactacccctctgcattttatccctgtcaccatttggagaatcaggcagga

SEQ ID NO: 41961 - DNA, 201 bp, Homo sapiens
ccctccaaaccactcctctccagataaacatttatgttttatgccccagtaactacacttccttttattttccctgctctgagccttgaagtgttcacctraaagcattttaaaatagtctgtaattccaaaggaaatgaagtaattgtccatggaagggaggtgaggactcaggatacagattgacctggggttgctcat

SEQ ID NO: 41962 - DNA, 201 bp, Homo sapiens
atggataaaacatttattgtcttattcaatctttattgattgcttcagtgtatgccatgcactgtatttggtgctaggaacacatgggtgacaagacagcrttgtgaagaactgcaaaagatctgaggtttctaccctccttgccagccaatgagcttaaggctttctctccgtctgagaaaccatcaatagtcgatgttc

SEQ ID NO: 41963 - DNA, 201 bp, Homo sapiens
ttctatccacctttgctcctgaggtcccaggctaggggaatttgggttgtactaataagcactttaatattggccaccagagggctcccatattccttccrtctaagtatgaaaatacaaagtgcaactaacataaagttcaccatcaaatagaaaatattataggaatttatgatatagttctctctagagtgaaagtgt

SEQ ID NO: 41964 - DNA, 201 bp, Homo sapiens
ttttccttcttaaatgcaaacagtaaataacaacacctacttatatcattatttttaggactaatgagacaataacagatcctgattatggtaattttttwgagctaattagataatatatgtaaagcatcaagtagacttcctgctataaatgatgatccattggtgatgataatgattatgatgatggtgatactgaca

SEQ ID NO: 41965 - DNA, 201 bp, Homo sapiens
catagtcaaaacacctcccaccaggccccatctctagttttggggattgcatttccacgtgagatttggagaggacaaacgttgaaactatatctaactcrtacaactcaatagcaaaaaaaatcaaacaaccagattaaaaaaatgggcaaatgacctgaatagacatttttccaaagaagatatgcaaatggccagtgg

SEQ ID NO: 41966 - DNA, 201 bp, Homo sapiens
aagaaattagagtcttatctcatactgtatataaaaatcaactcaaaatgaattaaagacttatatgtaaaacctgaaattttaaaactactcgaagaaaygtaggagaaaagctccatgccattggtcttagcaatgatttttttttggatataacaccagaacacagacaacaaaaacaaaaataaatgagtgggactg

SEQ ID NO: 41967 - DNA, 201 bp, Homo sapiens
gccaccatgcccagctaatttttgtatttttagtagagatggggtttcaccatgttggccaggctggtcttgaactcctgaactcaggttatctacctgcyttggccttccaaagtgctgggattatgggcgtgagtcaccacgtccgatgggaacttcttaaactgagatgaatgaatggcaaaagccatagaacccaac

SEQ ID NO: 41968 - DNA, 201 bp, Homo sapiens
gaaaactattgctttagcgaaagcaaacaccgttacttcctgaatcacagctccctccaaaccactcctctccagataaacatttatgttttatgccccartaactacacttccttttattttccctgctctgagccttgaagtgttcacctgaaagcattttaaaatagtctgtaattccaaaggaaatgaagtaattgt

SEQ ID NO: 41969 - DNA, 201 bp, Homo sapiens
gtcctcttataactttttccaaagcacaactttatagcttactcgttgcacctatttgaagtcttacaatttattccatgttgtaatataatcttggtatrttgtttttaatgattacacattaacatattttaaccaagcataatatgcattatattccgtcgtttaatcaatttttctatttaaatggcccatgaacat

SEQ ID NO: 41970 - DNA, 201 bp, Homo sapiens
tgtatatatgttatatagcatatatatgatataaggctatccttgtatatatatgtgatatatatatatgctatatatatatatatgctctctctctctctatatatatatatagccttcacgtggtccctgatatacttcagtatattctattaggatttttatatatatatatatatatagccttatatcatatatata

SEQ ID NO: 41971 - DNA, 201 bp, Homo sapiens
gtatatatgttatatagcatatatatgatataaggctatccttgtatatatatgtgatatatatatatgctatatatatatatatgctctctctctctctmtatatatatatagccttcacgtggtccctgatatacttcagtatattctattaggatttttatatatatatatatatatagccttatatcatatatatat

SEQ ID NO: 41972 - DNA, 201 bp, Homo sapiens
tctcgtcttaaattgtcatgacccaagagggctacagcagtatttctagaaggcatttctataccctgaaaagccacagaagtgatggtaccccactaatmgcaaaatgaatgtgtcctcaacccaccttctctttggctgaatctcagaagtacctggagtctttccagagccactggacatgagaggaaatgtggatga

SEQ ID NO: 41973 - DNA, 201 bp, Homo sapiens
acaactgcacctggggctgtacccaaagtggagaacagtgagtttctgtgtcgtgactgtcattgaccttccacctttcctctccaaaagaataagaagcraatcaattgtgaagatggagcaggtgctgtgattcagcctttctttatatcaccagacaaggtgaagccttcctgggtttatcatggtctcccaaaggac

SEQ ID NO: 41974 - DNA, 201 bp, Homo sapiens
tgttgcttctcacctgaaccccttgcagacattccagcaaaatgaaaacatgaccttgagccttagtttcacagtccatgaaaagctcaacttttattatrgaaattcagggttagagcccttcttttttttctcccacttaaaaagggataaagaaactaacccacccagattgctgctaagcctaacatgagctttgca

SEQ ID NO: 41975 - DNA, 201 bp, Homo sapiens
tctcactcctttcctgtggttgcttcacaggccacggcacatgttcctgtggtcgctgtgtttgtgagagaggatggtttggaaagctctgccaacatccrcggaagtgtaacatgacggaagaacaaagcaagaatctgtgtgaatcagcagatggcatattgtgctcggggaagggtgagtatctctgctggtgcctgg

SEQ ID NO: 41976 - DNA, 201 bp, Homo sapiens
gaaccccttgcagacattccagcaaaatgaaaacatgaccttgagccttagtttcacagtccatgaaaagctcaacttttattatagaaattcagggttasagcccttcttttttttctcccacttaaaaagggataaagaaactaacccacccagattgctgctaagcctaacatgagctttgcatagccattgaaaaag

SEQ ID NO: 41977 - DNA, 201 bp, Homo sapiens
gtgagattgaaaatattatttaatattgcattttgagtacaaataaattttggcttttaatcgtgaacagtcataatgttgaatgttttacttaactgtayttattattaattttttgaaatggtaaaaagtaacaactaacaaactaagaaaaaagagaaaggaaatgaacagtgttataggcaagtagatgctgtggct

SEQ ID NO: 41978 - DNA, 201 bp, Homo sapiens
ccatgaaagttaaatactatttttatccattcagctgggttttaaatacagcatgtggacccatcattctgtcatgggcagaagctctggaaattcttgayaacttataatcttccctgcccatattcacaagtgaaaatgattatacttacaagaaagaactttacacactaatttttgaatcaactttcagaaagacaa

SEQ ID NO: 41979 - DNA, 201 bp, Homo sapiens
gcaataaacatacgtgtgcatgtgtctttatagcagcatgatttatagtcctttgggtatatacccagtaatgggatggctgggtcaaatggtatttctarttctagatccctgaggaatcgccacactgacttccacaatggttgaactagtttacagtcccaccaacagtgtaaaagtgttcctatttctccacatcct

SEQ ID NO: 41980 - DNA, 201 bp, Homo sapiens
gtgttaaagaagacatggttgatgcctactatagatcaaagacttagcaacaaaaagctatggtgttgctggtaccagatcacactttgcagcaatctccrgtttgggacatataaagagttgttcttcgttttctatgtcctgaaagaattctagcttcctttattacgttttaaaatcctttgtcattagttatagtgc

SEQ ID NO: 41981 - DNA, 201 bp, Homo sapiens
tcttagatcagaatgccgactgagagacaggattttgacagaaataaaataataaagggttaccaagtgaaagagtgataaaaagtgctggaatggaaaamtatgtagtacatttacaaactctgggtcgattcgaaagaacagaactttgctaatgtaagagctgtgtttggggcatagattctgagataatattggaaa

SEQ ID NO: 41982 - DNA, 201 bp, Homo sapiens
cgcctccaagttggattagaagatgtcctggagcgtgcagttcaccacccactatattgtaagctgaaagtgtttttgctaactgaatgtcaaattaatgmggttttgctatctacatggcatgttttgacaaaaatactgtgtacctttattgacagtgaaccttctgctctggagtaatgctaatccaagactgctggt

SEQ ID NO: 41983 - DNA, 201 bp, Homo sapiens
tttttgctaactgaatgtcaaattaatgaggttttgctatctacatggcatgttttgacaaaaatactgtgtacctttattgacagtgaaccttctgctcyggagtaatgctaatccaagactgctggtttttcatgttaaaacccataaacttgttattagagcagatgacttccaaaacgtcaaaactaaagatgttgc

SEQ ID NO: 41984 - DNA, 201 bp, Homo sapiens
caatgatacaatctcttaaattcatcccaatgtgcaagcaattggctgcaggtgtgttattgagaagattattgaggagtcatcacacacatgccaaagtwaggacacatatatattcttcccagctttgcttatagttggcaatgcctggaggtgaagcacgcatttagaagcatgatcctggagaatgttcatgatgtt

SEQ ID NO: 41985 - DNA, 201 bp, Homo sapiens
acccttgctgagttcttttataaacctcattccattttatgtacacactaactcagagagggaggcattattgtctatagtttagcagaagagaaaatacrttcagagaaattaagtaacttgataaagttcacactgccataaaagtgtcatctgaaaacacatatagcctgactactcatgtaacttaatctccaggtg

SEQ ID NO: 41986 - DNA, 201 bp, Homo sapiens
ttagtgagaatatttgctattatttgttcaacataggcaatagattaggaaagtgttaaagaagacatggttgatgcctactatagatcaaagacttagcracaaaaagctatggtgttgctggtaccagatcacactttgcagcaatctccagtttgggacatataaagagttgttcttcgttttctatgtcctgaaaga

SEQ ID NO: 41987 - DNA, 201 bp, Homo sapiens
ggaggatttcttgagcccaagagtttgaagctgcagtgagccatgatggcaccactgcaattcagccgggaagacagagaccatgtctctaaaagtaattrtaataataataaaataataaataaataacaaaagagaccccagaaagctagcttgacaattccaccatgtgaggacacagtgagaaggtgccatctatgt

SEQ ID NO: 41988 - DNA, 201 bp, Homo sapiens
aaacaaatgaccacatatttgatggctgaaaacaacagaaatttattcccacagctctggagatcagaaatttgaaattgaaaaatgtcaggatccctccmaaggatctaggagagaatccttccttgctgtttctaacttgtggcttttggcgttccttggcttgtgactgcatcactccctgctctgcctctctcttca

SEQ ID NO: 41989 - DNA, 201 bp, Homo sapiens
caaattaatgaggttttgctatctacatggcatgttttgacaaaaatactgtgtacctttattgacagtgaaccttctgctctggagtaatgctaatccargactgctggtttttcatgttaaaacccataaacttgttattagagcagatgacttccaaaacgtcaaaactaaagatgttgcttattcactagaggagtt

SEQ ID NO: 41990 - DNA, 201 bp, Homo sapiens
cagtaccatgctgttttggttactgtagccttgtagtatagtttgaagtcaggtagcgtgatgcctccagctttgttcttttggcttaggattgacttggygatgtgggctcttttttggttccatatgaactttaaagtagttttttccaattctgtgaagaaagtcattggtagcttgatggggatggcattggatcta

SEQ ID NO: 41991 - DNA, 201 bp, Homo sapiens
aaagtcattggtagcttgatggggatggcattggatctataaattaccttgggcagtatggccattttcatgatattgattcttcctacccatgagcatgraatgttcttccatttgtttgtatcctcttttatttccttgagcagtggtttgtagttctccttgaagaggtccttcacgtcccttgtaagttggattcct

SEQ ID NO: 41992 - DNA, 201 bp, Homo sapiens
ggacctgcggatgatatttctcatggaaatctatacttgtttagatattttttttccagtccaatgaggtaatgtctgatcgcctagatgcttctgtcacaaccttagcaaggatcatgatttctcaattgtattgctcaagagcctttggctgctcttactgaccagcctattactcatcttgtacactttgatttatgt

SEQ ID NO: 41993 - DNA, 201 bp, Homo sapiens
attatttgtctgctctgcccaataaagtgtaagacacctgagaaggatttagagtaagaataaaagcaagagagagagagactgagagagataattagcgtttttttctgaaaatgcattgtcctcttaatgctcatggtactgttgggtctcagctttctcatcagattctaaaatgctcaaaaactttttgattaaagt

SEQ ID NO: 41994 - DNA, 201 bp, Homo sapiens
tccagcatctgttgtttcttgactttttaataaaggctattctgactggtacgagatggtatctcattgtagttttgatttacgtttctctaatgatcagkgatgttgacctctaatgatcagtgatgttgaccttttttcgtatatttgttggtcgcatgaatgtcttattttgagaagtttctgttcatgtcctttgcc

SEQ ID NO: 41995 - DNA, 201 bp, Homo sapiens
aagaaacttgagcggccgggtgtggtggctcgtgcctgtaatcccagcactttgggaggccgaggcgggcagatcactggaggtcgagagtttgagaccakcctgaccaacatggagaaaccctgtctctactaaaaatacaaaattagccaggcatggtggtacatgcctgtaatccagctactcgggaggctgaagcag

SEQ ID NO: 41996 - DNA, 201 bp, Homo sapiens
tggtggtacatgcctgtaatccagctactcgggaggctgaagcaggagaattgctcgaacccgggaggcggaggttgcagtgagccgagatcacgccaccrcactccagcctgggcaacaagagtgaaactgagaaagaaacaaagaaagaaaaagaaggaaggaaggaaggaaacaagggggagggggaggaggaggagg

SEQ ID NO: 41997 - DNA, 201 bp, Homo sapiens
gcaggagaattgctcgaacccgggaggcggaggttgcagtgagccgagatcacgccaccgcactccagcctgggcaacaagagtgaaactgagaaagaaayaaagaaagaaaaagaaggaaggaaggaaggaaacaagggggagggggaggaggaggaggagaaacaaagaagagaagaagaggaggaggaggaggagggg

SEQ ID NO: 41998 - DNA, 201 bp, Homo sapiens
actgcaacctctgcctcctgggtttaagtgattctcctgcctcagactcccgagtagctgggactacaggtgcgcaccaccatgcccagctactttttttkttttttgtttttttttttttgtatttttagtagagacagggtttcaccatgttggccaggatggtctcgatctcttgacttcgtgatctgcccacctccg

SEQ ID NO: 41999 - DNA, 201 bp, Homo sapiens
agtggacatattgcaaaaagcagttgccagacatgcacatttaaatgtactgaaacgcaaggtgatagacaagaaaaatttagtcaaatttatgcattaataatttatcttcagaaaatgcaaatccctgttgtagttattttcctatttctacaaatgtaattaaagcattgataacacaggggaaccacagcatcggaa

SEQ ID NO: 42000 - DNA, 201 bp, Homo sapiens
caaaactaaagatgttgcttattcactagaggagtttatgttgttcacatttaagatgatttatttttattcacttgacaacacttcgaacttcaaatggwtgcacacaagccaattcttggagggttgtgactgcagaaaaaaaattaaatcttgtgctcatgtgttgctccatcatagtaatcctcagttttgtcccag

SEQ ID NO: 42001 - DNA, 201 bp, Homo sapiens
caactttcactgatatcaaatttcagttaaattttactagtatcaaatttcactgataagtatgttttgaatattttcatatggttattggccatttatayacattcatttggaaagtgaatgttcaaattttatcgtatttatttaggaatttgtcttctcattactcagaagaacatttatatattcttgataggaatc

SEQ ID NO: 42002 - DNA, 201 bp, Homo sapiens
caattggctgtagtttgaacaagaaaacatcaatctattattgtgattttatgattcgctggttgaagtgaattgaacatggccagctttccacagcttgrctcccacacttagaatgaggaattgaggaaagaggaagaaactcatatttacagagactctactctattggacccttgctgagttcttttataaacctca

SEQ ID NO: 42003 - DNA, 201 bp, Homo sapiens
gcgtctgtgttccaaagagatgatgagaatagtggggaagaggcctgttggagattttaattaggatgatgtggctcttcacagtggtggtgatgtagggmtcatgaattgcaggaggctattggatcacagtgcatgtgggttttatcctaaaaaaaataggcttgcaggtaaagaaagatgagaggggcattccaagca

SEQ ID NO: 42004 - DNA, 201 bp, Homo sapiens
gagggtatttttttctattattaattatacatgctcatgttcttcattatcattgctgtcaacacagtggtaataaaagagctcatgactagtgagtggcktctgtgttccaaagagatgatgagaatagtggggaagaggcctgttggagattttaattaggatgatgtggctcttcacagtggtggtgatgtagggctc

SEQ ID NO: 42005 - DNA, 201 bp, Homo sapiens
aaaatggaaagaccctggaaagggtcagtgcagaggttggacagtcacaactgacaggaccagtgagaagaaatcttagttcatgatggcctccatcttcytgatgaagcagaaaaaaaggcagcctgttagcactgaaaaggctgaagcttaggaagagggtgttaaatgttcataaaggtcaaaaagttgaaagaaggt

SEQ ID NO: 42006 - DNA, 201 bp, Homo sapiens
ataataatttagaacaaaaataaaaggacatcccaggtaggaggaagagcagggacagaaactctgagttatgatgggaataatgtgtaaagaacaggaarcatactcacttgtgatgatttagaaaaaataagaaaatggtgggagacagcctggggggaaatatgtctctccctcccacctaacttcttcttgtgtgat

SEQ ID NO: 42007 - DNA, 201 bp, Homo sapiens
taatacatagatattctttgcttatctctactttgagaaggatgcttttgtctgtgatgaaaacttatctacattttaaaataaaccatttcctaaacctrttctagcacccagtgtttctattccccattgtgataaaacgtatgtaagcatatagaggtgacaaggttaaagtcgtaccttctctaacattcaataatc

SEQ ID NO: 42008 - DNA, 201 bp, Homo sapiens
tttagcagttatttacctgatttcattcaatataaacaggcaaaccagatacttttatgggaaacaatttgctctggttatcagccataatcttcatagamtcagcctcaacagatgttctttctaatagaaaaccaatgaggcacagtgttatccctttgtgtagcctgtagagtcacatagctgatcagaacctgcgat

SEQ ID NO: 42009 - DNA, 201 bp, Homo sapiens
gcccatgggtcaagagcagggagggcagccttgatgggggtggtgagttttgaactgatcatattttcatgggaagatattcctttttgtcgaagtgattkccaccactgttttcatgctctttcctcaatctccaagctccttggttttaaatggcttcaaaacagctgtgcatactggccactctagcaacctttcctt

SEQ ID NO: 42010 - DNA, 201 bp, Homo sapiens
cacatataattttcaataaatgaggttcagtttggtctcaatgaactcttctgagaagaaaacattgaattttattaggtgtacacagagttaacaaatawattcccaaacagtttagtatgaaacattttgaacccctttagatccaatattgaacattttgcatggaatcttcattgtgtagtcaactgttcctggcct

SEQ ID NO: 42011 - DNA, 201 bp, Homo sapiens
tcttcccatgctacaggtgagaccagacacaaagtaaatgacctaactcaattacaaataacaaggacccctctgcaatatgtctaaacatatattagaakaaagtatttgacatccttcatagggataaatgcccttatagacaccccatatataaaacacaacagagatacacatttacataaatctcagtcatttaca

SEQ ID NO: 42012 - DNA, 201 bp, Homo sapiens
tgccttcatataaatattttattcaatatgttgtatttgtgaatttaacaaatgatattaaacacaaactacaatgcagacagacaaactctttgtatgcraattagcaatacataccaacagttcttgatacacaggtacctactacatgcagctcatcattgctgtcctcttcccatgctacaggtgagaccagacaca

SEQ ID NO: 42013 - DNA, 201 bp, Homo sapiens; identical to SEQ ID NO: 9318

SEQ ID NO: 42014 - DNA, 201 bp, Homo sapiens
gtggacatattgcaaaaagcagttgccagacatgcacatttaaatgtactgaaacgcaaggtgatagacaagaaaaatttagtcaaatttatgcattaataatttatcttcagaaaatgcaaatccctgttgtagttattttcctatttctacaaatgtaattaaagcattgataacacaggggaaccacagcatcggaat

SEQ ID NO: 42015 - DNA, 201 bp, Homo sapiens
ctcagccgtgtcatagccactgctatcctaatttattgagtcctcataattggttataaattcatttgtttagccaagttacgaggaaacagagacatgtrtacttctcctcagctctagctgaaggtaaaagatgactctttgtgtgtcattaagttagacctttgctttctgcccatccttactacgtaagactctctt

SEQ ID NO: 42016 - DNA, 201 bp, Homo sapiens
tggacatattgcaaaaagcagttgccagacatgcacatttaaatgtactgaaacgcaaggtgatagacaagaaaaatttagtcaaatttatgcattaataatttatcttcagaaaatgcaaatccctgttgtagttattttcctatttctacaaatgtaattaaagcattgataacacaggggaaccacagcatcggaatt

SEQ ID NO: 42017 - DNA, 201 bp, Homo sapiens
ggacatattgcaaaaagcagttgccagacatgcacatttaaatgtactgaaacgcaaggtgatagacaagaaaaatttagtcaaatttatgcattaataatttatcttcagaaaatgcaaatccctgttgtagttattttcctatttctacaaatgtaattaaagcattgataacacaggggaaccacagcatcggaattg

SEQ ID NO: 42018 - DNA, 201 bp, Homo sapiens
tttcaatatattttgaacttaccaattctgcagttttgttaaatatgtcaaaatactcttttcaactgcacattttttcaacgtgattttgactcaaaaaraatacagccatcttttagtaaatggaagtcatgtttggaaagaacaaccaacccaaggaaacagaaggaaaagaaagtcctttttatttgtttctttttc

SEQ ID NO: 42019 - DNA, 201 bp, Homo sapiens
tcttaaatatatagtcaggctcctctttagctcaaatagtgttgttttgtttaattagactgtgttcccagtattgcttctatttttttttctttttttctttttttttttaattatactttaagttttagggtacatgtgcacattgtgcaggttagttacatatgtatacatgtgccatgctggtgcgctgcacccact

SEQ ID NO: 42020 - DNA, 201 bp, Homo sapiens
caaagccaaagagtccctctagctaatgcctttgcaaattgtttgctttgggaggtggcgatatattcagagatcaatgaagggttgaaagcatatttgtstaaactatttgtttatccttcaatgggtagggagtttgggagtccttaaacttaaaagggaatatgaaagctgcctcaaggctgcacattttgacattca

SEQ ID NO: 42021 - DNA, 201 bp, Homo sapiens
attcaacctcattgttttaagcttttctgaaacatattccctctttaatcaatgatgatatgctagctttaggtaaacggtctgatgttaacacatatacagagagtataaaattccacttgactcctcaagtgcccatcaaacattttttttaaaactcttttgatacatcttagtcccattctgcattttatatgggtc

SEQ ID NO: 42022 - DNA, 201 bp, Homo sapiens
cagataagtcactatttataaaaagcatgacttgtccagtgatagttcgtaagatttatttattttattggtatatcattttaagattacacaagtgaaayatattcacatactggcacatgtgtgtttaattgtttagcctaatataagttaaatcagagacttccctcctgtgtgccatatacctagggtgagaataag

SEQ ID NO: 42023 - DNA, 201 bp, Homo sapiens
cctaagcagcggagcacctccctcactaccgtctattgaaagtcagcttttaaacaataatagtaataaataataaaaaataataaaaatatacatatatmaaactttgacaccatggtgtacattttagataaatcaatatttgttagactacagcactaacaagtttctatcttaaacattatagtgacccctaatcag

SEQ ID NO: 42024 - DNA, 201 bp, Homo sapiens
cctgagagcttagttgaaacttagagctccctccccagagtacaagcatatttaaggaaattcatgattgcacaatatgaggggcagggtaggatcaaggwtgacaccaggtttctgttttgagcaactgaatggtggaggagactatgcttgtcttgaccagttgtctccatttcttgaaaaattggtttcttcacagag

SEQ ID NO: 42025 - DNA, 201 bp, Homo sapiens
gactaaggaaacaacaacagacagtagtagcagatgcataaatgaccagttattaggaattaacggatatacatatttaaataactataacaaacatagtaaaaaaaaaaaatggcaaggtgggtaattggacaatatccagtctaaagtacagataactcaaagaatattgtttttcctgactttggttcatggtggttt

SEQ ID NO: 42026 - DNA, 201 bp, Homo sapiens
atcctcatgaactcctgcaagaactcccatgggtatatcctggtgcctgacagtgcctgctggtaagatgtggctcctgtcccacagccttcaaaggagaytggtggcaagtgtcagcctgagagcttagttgaaacttagagctccctccccagagtacaagcatatttaaggaaattcatgattgcacaatatgagggg

SEQ ID NO: 42027 - DNA, 201 bp, Homo sapiens
ttcagtttcgagcttatcctaaactccggaatatcttgaaacctaagttcaggacacgtttttcaataagttttgtccatttttgagatgaatattactgwtcttgcacctcttcagtcctcatttcatgacacctactccccggcttactcaggtagtcttgggtctatcttttccacctttatggcctgaagtaccaat

SEQ ID NO: 42028 - DNA, 201 bp, Homo sapiens
ttacttaaaacgtttcagttgcagatttaaggaaactttccctcttaagctaattataatttacagctatttgacaaaagtatacctttgttttttttttktttttttttgtttttttttgagacggagtctcgctctgtcgcccgggctggagtgcagtggcgcgatctcggctcactgcaagctccgcctcccgggttc

SEQ ID NO: 42029 - DNA, 201 bp, Homo sapiens
cgtttcagttgcagatttaaggaaactttccctcttaagctaattataatttacagctatttgacaaaagtatacctttgttttttttttgtttttttttktttttttttgagacggagtctcgctctgtcgcccgggctggagtgcagtggcgcgatctcggctcactgcaagctccgcctcccgggttcacgccattct

SEQ ID NO: 42030 - DNA, 201 bp, Homo sapiens
tttgccaaatagattgcaagcttcttgggggaaaggattatatcttatataaattgttttagtgttatctttgaaggaaactaacataatactaatgacayattccaccaactcacataattatagaatagataataacttttgtttattaaggaatctctattatcaatattagatggtgtttttcctttttagaatatt

SEQ ID NO: 42031 - DNA, 201 bp, Homo sapiens
agctatttgacaaaagtatacctttgttttttttttgtttttttttgtttttttttgagacggagtctcgctctgtcgcccgggctggagtgcagtggcgygatctcggctcactgcaagctccgcctcccgggttcacgccattctcctgcctcagcctcccgagtagctgggactacaggcgcccgccaccacgcctgg

SEQ ID NO: 42032 - DNA, 201 bp, Homo sapiens
tgtcatatgcactgaataggaaattatcctgttctcacagatgtcttacatttcagtgggggatataaacaagaaacaaaggaattcctttttaaaatcakaagtgcaatgaagaaaatgataaaagaagagtgtggctatttgcaaggggcagggatagtatttgcaagaggaaggggtgaatgaaaagggagctgataa

SEQ ID NO: 42033 - DNA, 201 bp, Homo sapiens
cagaaagttgtaccatttcgtactccccttcagggcaagaaagtacccattgtcccacacctttaccgagtctggatccaacaatattttccacctctgaygatctgacttctaaaataattgccaatcacgattattttgaagatctgccactgctacccacttagtagtggttgattgagtgataaacatttttcatct

SEQ ID NO: 42034 - DNA, 201 bp, Homo sapiens
gtggcgcgatctcggctcactgcaagctccgcctcccgggttcacgccattctcctgcctcagcctcccgagtagctgggactacaggcgcccgccaccaygcctggctaattttttgtatttttagtagaggcggggtttcactgtgttagccaggatggtctcgatctcctgacctcatgatccgcccacctctgcctc

SEQ ID NO: 42035 - DNA, 201 bp, Homo sapiens
agagaggtggaaaatggaattggttgggctgtggattaaggtcaggttctgcagcagagttacattggctgtgagagacgatgtccttcagaaacataagstaagccacctgcatcccacttcgctgtgcttggagcattctgacctggagctatggcagaggcagaatgggaagcagcttgcctgagcgaggctcacagc

SEQ ID NO: 42036 - DNA, 201 bp, Homo sapiens
cgcgatctcggctcactgcaagctccgcctcccgggttcacgccattctcctgcctcagcctcccgagtagctgggactacaggcgcccgccaccacgccyggctaattttttgtatttttagtagaggcggggtttcactgtgttagccaggatggtctcgatctcctgacctcatgatccgcccacctctgcctcccaa

SEQ ID NO: 42037 - DNA, 201 bp, Homo sapiens
caaatcattttcttttcttacgaagagcagcctattgctggcagttgtgccaataggaagaaactacctgggaataggcaggctcaaaatggcagctccaycctctctttgccagccacacgtacagtaaggagcagacaagatggttctggccaagtggaaagcccatttgcataataagattagggtggggcgaccagc

SEQ ID NO: 42038 - DNA, 201 bp, Homo sapiens
gcaagcttaaaataaatgtgacagttatgaaaattttgttactatgattatatatttatttctattaaaatactaaaattatagtgcagattgtagtggaragctttagcagttatttacctgatttcattcaatataaacaggcaaaccagatacttttatgggaaacaatttgctctggttatcagccataatcttcat

SEQ ID NO: 42039 - DNA, 201 bp, Homo sapiens
gtataggaccagactcagtttgaaattaccagaatgcagaattaaggaagcatgtggtaaaaggtaaagttggttgagaaacaagaactggggggcttttyaccttcctgcagacccaggttttattctaaaggcaatgaggagctaatgatggttttaggcaatagagtgctgtcatcaccagatttctagtctgagtgt

SEQ ID NO: 42040 - DNA, 201 bp, Homo sapiens
tgtccatgaattgctttgtaaatcttgtgagctacttcacgagttatgaagtttttaagaataaatagcaatgaactcactttagtctccatgccaaatgyagatgtttttgtgatagctgatcttgttttgtaggaaaactcttgccttcaagtccttctattggctttcaagagaataatttccttgttttaagtcaga

SEQ ID NO: 42041 - DNA, 201 bp, Homo sapiens
tacctgggaataggcaggctcaaaatggcagctccatcctctctttgccagccacacgtacagtaaggagcagacaagatggttctggccaagtggaaagyccatttgcataataagattagggtggggcgaccagccttcccacacacaatgtaaatgtcacacctgatccaatcaatctgtgggccctacataaatcag

SEQ ID NO: 42042 - DNA, 201 bp, Homo sapiens
gtaggaggacacaacttagcccataacagctctcagtccactgatgacagaatgttattaaattccatttaggttgctctcaatcaatgtggattttcccyggagtcaagacaataatccttgggagtaaactgttcacagttcacagggctttgccactgtcacctggtccctgcttatgtctcatttctctagctgctg

SEQ ID NO: 42043 - DNA, 201 bp, Homo sapiens
actgtatttttaaattcagaatttccactttatttgttttttacagataattgtctagtgagtttctccacacagtaatattttttgaacattttaaaagtaatagatattttagtcaatgactgatgatttaagtttgttacctgcatcattttttaatctctttctattgtctgtttttttctcttttatttttagtga

SEQ ID NO: 42044 - DNA, 201 bp, Homo sapiens
aaaaaagtccaatttataatctctaaaataaattatacaggtgtgctctcctgccgggggcttaagaaaagtcttcttcccccaccactagtgacaatttraattatcagttagctcttctcaatgtattttgctgttggtgttacaaacttttgccatttatcaaacttctttcattgacttctataatcatcaaaacga

SEQ ID NO: 42045 - DNA, 201 bp, Homo sapiens
tgcatatattttataaatgatgtgtttatgctcttctgtcaacagcatttatgtgcactttgtcaacaggtaaaatgataagaacattgaatacatttttwaaaatttcctaaaaacacaatgaggtaggaagacgtataattattattctttttacagaagaagaaattagatatctgaacagtttgccattttacataa

SEQ ID NO: 42046 - DNA, 201 bp, Homo sapiens
gctgctgtcttacacgatgacatctgtatttgccatgtggtcaatggtgggcagtccttgtgggcccatctacttgttctcaccataggtcctcttcagayagcaaccttcctttgaagcaattatggttgttctcatgagccatgctgcgtctgtggaacatttggtggcctgtgtcaggcatgtgtggccttaacagcc

SEQ ID NO: 42047 - DNA, 201 bp, Homo sapiens
ttaatagcattgaactacttaaaaatagctgcatcttgtgctttgcagaagtgggaaggagaagctaaagaaaataattattcctcacactgtgtaatacwctggtcctggtgattttcaatattgaaatacgttctatcatctctaaagtttctaatattgatcctgctgtatcttattctgaatatattatttcatatt

SEQ ID NO: 42048 - DNA, 201 bp, Homo sapiens
ctgtatttttaaattcagaatttccactttatttgttttttacagataattgtctagtgagtttctccacacagtaatattttttgaacattttaaaagtaatagatattttagtcaatgactgatgatttaagtttgttacctgcatcattttttaatctctttctattgtctgtttttttctcttttatttttagtgaa

SEQ ID NO: 42049 - DNA, 201 bp, Homo sapiens
aaaaagtctcccatgtcaagatcaactgttacggacaggcaaggtcaccttcaggaacccagtcggttccaagaaaaattctatacaatgaaggaaacttkgtcacaggtcaaagaattagggcacaagccatctgccaagtatgaaataaaggaatcttgtgccacgtacacttgtgaaagcaaaacgatttgtccaaat

SEQ ID NO: 42050 - DNA, 201 bp, Homo sapiens
tgtatttttaaattcagaatttccactttatttgttttttacagataattgtctagtgagtttctccacacagtaatattttttgaacattttaaaagtaatagatattttagtcaatgactgatgatttaagtttgttacctgcatcattttttaatctctttctattgtctgtttttttctcttttatttttagtgaat

SEQ ID NO: 42051 - DNA, 201 bp, Homo sapiens
cttcagcttaccttagggaggttggaaatgtgtatttgtgtaactattatcaggcacagactggaactattctaggagatttgggtttaatagtgtgctcrcctccttgaaagccttagtgattccgggactctcctcataagtgtgcactttctttatactttccaggtaaatgtgaatgtggcaaatgcacctgctatc

SEQ ID NO: 42052 - DNA, 201 bp, Homo sapiens
gtttcagaattacttttgtatatgagtatgatattactacctaatttatagcgtttttgttagaaaaaggtgaatcttgaatagtttttggtgttgttgtrgaagccatctcaaggttcaaataatgagataatctgttagaatcctaaatgacctcctctgtgatgttttgctctatggtttggaaaacctttagagatg

SEQ ID NO: 42053 - DNA, 201 bp, Homo sapiens
tctattaaataaattgaaggaagtcatggatccttctgacattttaccaaaaaaaatgtgtattggtatatttttccagggatagatctgtgttctgccarttatggttcttgattacaaacaacaaaaccaacttcattaaaagggataaaaaaatattttattagaaggctttaggctcagaatgcaactttgaacaat

SEQ ID NO: 42054 - DNA, 201 bp, Homo sapiens
agttagtattcttcagcggaacactttaaatgtgaccatatagggaagaaacgtatgtgtatgtgtgtgtgtgtgcctgtgtgcatatgtgtgtgcgtgtwgcatattcagtcatggtttctgaaggtgattacaatttttaacactagcagttcaagtccaggcatctaccctgtggcttctgagtttacagattttcac

SEQ ID NO: 42055 - DNA, 201 bp, Homo sapiens
cctccttcttgttcataagtattttcgttattggtgctttccatttctgtataaatgtcataattggcttttaagctttaaaaaatcctgataagattttsgttgtaattacatcgaatctatagatcaattaggggatatttggtattttaacaatattgaataataagcatacagtatttcttcacatttaaatctcaa

SEQ ID NO: 42056 - DNA, 201 bp, Homo sapiens
acccaggctggagtgcagtggcgcgatctcagctcactgcatcctccacctcccggattcaagcaattctcgtgcctcaggctcccaagtagctggaacamaggcgtgggccaccatgcctggctaatttttgtatctttagtagagatgggatttcactatgttggccaggctggtcttgaactcctgatctcaggtgtt

SEQ ID NO: 42057 - DNA, 201 bp, Homo sapiens
gcgaaactccatctctgctaaaaatataaaaattagctgggcgtggtggcacatgcctgtaatcctagctacttgggatgctgaggcacgagaattgcttraacctgggaggtggaggttgcaatgggctgagatcacaccactgcactccagcctgggcgacagagcgagactctctttctaaatatataaatacataaa

SEQ ID NO: 42058 - DNA, 201 bp, Homo sapiens
atatttctcatggaaatctatacttgtttagatattttttttccagtccaatgaggtaatgtctgatcgcctagatgcttctgtcacaaccttagcaaggwtcatgatttctcaattgtattgctcaagagcctttggctgctcttactgaccagcctattactcatcttgtacactttgatttatgtattcaccacacta

SEQ ID NO: 42059 - DNA, 201 bp, Homo sapiens
aaggaatatattaaatatttccttttctactgtggatttctgtctttctcaattagactataaggtcaatgtaagaagggttcctaaataaatgattaaaraaattaaagtgtgaatagcagagctacattttgaattagagatttttaaaaatattgtcaaggtaagggacctgcggatgatatttctcatggaaatcta

SEQ ID NO: 42060 - DNA, 201 bp, Homo sapiens
tgtatataatccgttaacaagaaataatagaaattaaatgggccaaaaatctaaaagtaatggaccctgagtggtacaattatgtattactcttgttttcwtctctttttttattttcccattttagacagtgaatctatatttgttcagtcattaaaatgtgttaaatatcttagttagcatgatgtttgttattcactg

SEQ ID NO: 42061 - DNA, 201 bp, Homo sapiens
aatatcaaaagctaaatcctggagttttataacatatattgtatataatccgttaacaagaaataatagaaattaaatgggccaaaaatctaaaagtaatrgaccctgagtggtacaattatgtattactcttgttttcttctctttttttattttcccattttagacagtgaatctatatttgttcagtcattaaaatgt

SEQ ID NO: 42062 - DNA, 201 bp, Homo sapiens
taaccatacttgaaatgtcaagtatggtttgaagttaaatcggtgctggggacaacaaagtcaaaatgattggaacagtattttttttttttttttttttragacagagtctcactctgtcacccaggctagagtgcagtggtgcgatctgggctcactgcaaccaccgcctcctgggttcaagccattctcctgcctcag

SEQ ID NO: 42063 - DNA, 201 bp, Homo sapiens
agcaacctaaaaatctaataagagaattaaatggttaaatagaatgctgaaccacactaaaacaaaacaaaacaaaaaggaaaaaacttttcaaaggacaktgaaagacatgagatgttactgatgtcatatgtaaaataagtaagattcaaagatgcaagagaggttcagttggagaaagaaattcaaatatcaaaagct

SEQ ID NO: 42064 - DNA, 201 bp, Homo sapiens
tcagggttgataagaattcaccgtggagtaactggccagtgtgaataaagagccttaaacatctatacccctttcccaagtagttttattttacagagtcyacctcagtaaatgctacaaaatgcaaaggtttatatatatgtattaatacaatctttgaaatttaatttctaatattggaaaaaagaaagcaacctaaaa

SEQ ID NO: 42065 - DNA, 201 bp, Homo sapiens
tcaaattgcctataggagaaaaataacctgatactgacaaatctataggctttggagtgtctgcagcgtctactagtgtgtatttagagggaatttttgakaagactcaagattttgagtggcattttattaagcatttgaattactttgtaactgacatctttgttattgtctacaagaatggcatagcccttttcattg

SEQ ID NO: 42066 - DNA, 201 bp, Homo sapiens
tattgtctacaagaatggcatagcccttttcattgaagtctaatttgatagtttgcattatattgatgtattttctcttatatgggtttcatacatttcaygcagaagtcattcttaaagagttttgaataagactcttatccaaaattccctctaaaaacacgttagtagacattggtggttgtctgaccaattagttct

SEQ ID NO: 42067 - DNA, 201 bp, Homo sapiens
tgcagtggcatgatctcagctcactgcgagctccacctcccaggttcacaccattctcctgcctcagcctcccgagcagctggggctacaggtgcccaccrccacgcccggcttatttttttgtatttttagtagagaagggtttcactgtgttagccaggatggtctcaatctcctgaccttgtgatccgccagcctcgg

SEQ ID NO: 42068 - DNA, 201 bp, Homo sapiens
ggtgtgagccacctcccccggcggcaatgtcattttaagattgcttttgagataaacatgatttgacacaatttaaaataagaaaataagggaggcatatraaaggcagtattttaaaattgtaagtgtgtgacttgctgatatggagcccctttttcctatgggtattcactctcttgtgaaatccataattctgatgtt

SEQ ID NO: 42069 - DNA, 201 bp, Homo sapiens
acttcttagttataaatgggtggattctccatatagctgctcaaattctaaattcattatattcctgccagttaagccttcgtatgtctttgctttgccartgaaaactcagccggccaggaacaaatcatatacagacttaatttgaattcaagggatgatattgcttcttctgtaggttaagggttgcagtggtagctc

SEQ ID NO: 42070 - DNA, 201 bp, Homo sapiens
aaattatacaggtgtgctctcctgccgggggcttaagaaaagtcttcttcccccaccactagtgacaatttaaattatcagttagctcttctcaatgtatwttgctgttggtgttacaaacttttgccatttatcaaacttctttcattgacttctataatcatcaaaacgaatgatttatctgcaggcattattattcag

SEQ ID NO: 42071 - DNA, 201 bp, Homo sapiens
atgtcttacattctgtatcctgtgattccttgatttctataccatattggctgtagatatattttcatgtaactagatgtagctcatatagccattatagrtataaagacattcgtcctaatttcggttcctgggagtaaaggtgggaaaacactttctctagtctcctagtgttgtgctcaaaaactataatggcttatg

SEQ ID NO: 42072 - DNA, 201 bp, Homo sapiens
gtggaataaggtgagcaagggagagaggagcaggagatggggcgcagagataagcaggtgaggtacaggtcatggaatggctgtaggtcattcaaaaaacttttttttttttatatttccccaagaaatgaaaagattttcagcaaaagagcacagtggtctaataatggcttaagaatcattctggctaagttgtctaag

SEQ ID NO: 42073 - DNA, 201 bp, Homo sapiens
ttcaccagtaaccccagacaggaaccattgttctatctgcattggaatattgtcattatagtgctgcataagccatcatgcttttaaagtaacaaagattraaattcatatccctcagactgcttagttaccaacacttgtaatctacagcaaaaaataattttacattattattttacatttacacaaagctttatctgt

SEQ ID NO: 42074 - DNA, 201 bp, Homo sapiens
ttgttctcaccataggtcctcttcagatagcaaccttcctttgaagcaattatggttgttctcatgagccatgctgcgtctgtggaacatttggtggcctrtgtcaggcatgtgtggccttaacagccacaagtgccttattctgttgaaattgttctgagatgattcagagaaaatttgcaactctccagggatatgcag

SEQ ID NO: 42075 - DNA, 201 bp, Homo sapiens
agagaattgcttgaacccaggagacagaggttgcagtgacccaagattgcaacactgcactgccagcactcaagcctggggacagagcaagactctgcctaaaaaaaaaaaaaaaaaaaaaaaaaaaaaaaaaaaaaaaaattatgaggacacataagaagcatacttaattttattgtatttgtgaaattgtgtgagtag

SEQ ID NO: 42076 - DNA, 201 bp, Homo sapiens
ttcaatgcacacacatctttttgtttgtttgtttgttttttgttttctgctttttggtttttttgttttttatttttttattttattttttattattataytttaagttttagtgtacatgtgcgcaatgtgcaggtttgttacatatgtatacatgtgccatgatgatgtgctgcatgcattaactggtcatttagcatt

SEQ ID NO: 42077 - DNA, 201 bp, Homo sapiens
tctagatgtgacttagtttccttcctctacagtgagggaggaaataagagtgatttgtgaagatgcatattttttttcagtaaaactggggaggtttcacytatctcgggtctcctattctggatacaacatttcaagagtcttggattcctgtttgattatcaagttcacttccactgaccaataaatattggtagatgt

SEQ ID NO: 42078 - DNA, 201 bp, Homo sapiens
ccctttattgggggaaagaaacagaatgtgtgtcttttctaacttttattttaagttcagggatgcataggtaggcttgttacatatgtcttattggaggrtggagggtgggttgagggagaggatcaggaaaaataactaatgggtagtagagtgtgtgtcttaatggaaggctgaggcaccatccatccatcctatctg

SEQ ID NO: 42079 - DNA, 201 bp, Homo sapiens
cagcagcaaaggaaacaacagaaatgaaaaggcaacttctggaatgagagaaaatatttgcaaaccatatatccaataaggggttaatattcaaaatataygagttctagtccatttttgcattgctacaaagaaatacctgaggctgggtaatttataaagaaaataaatttattttgggccaggcacatggtggctcat

SEQ ID NO: 42080 - DNA, 201 bp, Homo sapiens
agggtggagggtgggttgagggagaggatcaggaaaaataactaatgggtagtagagtgtgtgtcttaatggaaggctgaggcaccatccatccatcctabctgtctgtctgtctatctatctatctatctatctatctatctatctatctatctatcatctattatctgtgtatctattatctatctatatcaatcatct

SEQ ID NO: 42081 - DNA, 201 bp, Homo sapiens
tgtatagaattatgatttttaaaattgtttataattcatttcagcctcttgaagtactttaaaactaaataagcttcatcagtttccttacatgagcaaartaattttgcagggaatcatgacagtatgtaagatttttgaaaacgaaaaccaagaatttatgacagccagttgagtgcctttggtcaaggtcacggaccc

SEQ ID NO: 42082 - DNA, 201 bp, Homo sapiens
aaaacgtttctacagcagcaaaggaaacaacagaaatgaaaaggcaacttctggaatgagagaaaatatttgcaaaccatatatccaataaggggttaatrttcaaaatatatgagttctagtccatttttgcattgctacaaagaaatacctgaggctgggtaatttataaagaaaataaatttattttgggccaggcac

SEQ ID NO: 42083 - DNA, 201 bp, Homo sapiens
tgggttgagggagaggatcaggaaaaataactaatgggtagtagagtgtgtgtcttaatggaaggctgaggcaccatccatccatcctatctgtctgtctrtctatctatctatctatctatctatctatctatctatctatctatcatctattatctgtgtatctattatctatctatatcaatcatctatatgcctgtt

SEQ ID NO: 42084 - DNA, 201 bp, Homo sapiens
tatggacttgtctattctgagtattccatacaaatggaatcataaaatatgtgatcttctcgcatctggcttttttcacttagcataagtgtttgcaaggkttatcaaagttgtagcatatgtcagtccttcattgctttttatggctgaataatatcctgttgtatggatacaccaccgttatttaacccttcatcagtt

SEQ ID NO: 42085 - DNA, 201 bp, Homo sapiens
atgcatttttgcagcaattatagaaatctactttgttctgtatctgcggtgatgagtagcttcatgtttattaggaattatggaaagctcagttgaaactrtgctttcctctacttgcttataatgtgggaactgatgaatacaaaaaccagtagctcctttttatgtagcttttaaactatttaatgtacttccgaagaa

SEQ ID NO: 42086 - DNA, 201 bp, Homo sapiens
ttgagggagaggatcaggaaaaataactaatgggtagtagagtgtgtgtcttaatggaaggctgaggcaccatccatccatcctatctgtctgtctgtctrtctatctatctatctatctatctatctatctatctatctatcatctattatctgtgtatctattatctatctatatcaatcatctatatgcctgttctct

SEQ ID NO: 42087 - DNA, 201 bp, Homo sapiens
atttaattttatgttgcgtttttcttttttaaaaaatatatgttaatagagatataattcacataccacaaaattcacataccactcagtattttgatatrttaacataattatgcagccatcaccactgtccagttccaaaaaaaaagtttatcatcataaaataccctgttaccctatagcagccactccccattctct

SEQ ID NO: 42088 - DNA, 201 bp, Homo sapiens
tttcatccattagcatttctatgtacttttaaaaagtgtaattccacttttaaaattcttcatgcatttttgcagcaattatagaaatctactttgttctrtatctgcggtgatgagtagcttcatgtttattaggaattatggaaagctcagttgaaactatgctttcctctacttgcttataatgtgggaactgatgaa

SEQ ID NO: 42089 - DNA, 201 bp, Homo sapiens
tactggttagaagtaatgaaactaaaacctgcaggcttaacatacacataaatttgacaaaccagcatggaagcattgcatttcagatccatgtggcaaaytgatctttttttagttctgtcatttgaaagataaagcaatttgagataaggcccagaaaagatagtggcacatcagatgaaggacacaagtctcctgatt

SEQ ID NO: 42090 - DNA, 201 bp, Homo sapiens
aggataccttacttactggaaacctggggtcatgcaaagaagtcaagacgagaaatactgtgataaaatggcaccaatctcagaagctcacaaaagaccaaaaaaaaaaaaaaaatctagaaatggcttaaatagaaattacaaatattcactcagtgataggaacaaaatgtttattttcttaatggtgaaactttgctt

SEQ ID NO: 42091 - DNA, 201 bp, Homo sapiens; identical to SEQ ID NO: 9309

SEQ ID NO: 42092 - DNA, 201 bp, Homo sapiens
taggcttatttaatatgttgggttgtctggtaagcattgtctaataatagagtgatgccaaatctttttcaagttatatttatatgaatatgttattgatrtgaatgttccaaagattatgtaaaatttatagaagtctgatggctctggttggatgctgtcaaccataattctggttgttatcttaaaatgttacatgcg

SEQ ID NO: 42093 - DNA, 201 bp, Homo sapiens
attggcagtagccaggcagtgtggttgctatgagccttgggtgagacctagtaccatgctggctttgggactgacccagagtagtcccagtagtagttgcwacaggggtgcttgtgttacccctcccccagttccaggcagatcagtgtgaaaagagagactacatttgtttggaggaaagtaagggaagagaacatgagt

SEQ ID NO: 42094 - DNA, 201 bp, Homo sapiens
gaatggagacactctgcataaacaactccttaaaggagttttgctgtaaatggaaagatagaaatgatgtgacaattgaagaaggaagtacatcaaagaatttttttttttttgtacagttgggagacataacagtacactttatgctgaactggtggacaggcaagacatgataatgcaaagactggtaaataaagaaag

SEQ ID NO: 42095 - DNA, 201 bp, Homo sapiens
catacagagagatctttagagagcatttctcttatttgaattcttctgatgttcgatatcaagacaaacagcaccatgccgaatctttcatctctatttcrttgatcttctgcctacacagtttaaaggaatactggttagaagtaatgaaactaaaacctgcaggcttaacatacacataaatttgacaaaccagcatgg

SEQ ID NO: 42096 - DNA, 201 bp, Homo sapiens
ttgggctgcagtcatttttatggtaggtagattataccaacaccaagcactgtattcttccattgtgtgtgtgtgtgtgtgcatgtgtgtgtacatacagrgagatctttagagagcatttctcttatttgaattcttctgatgttcgatatcaagacaaacagcaccatgccgaatctttcatctctatttcattgatct

SEQ ID NO: 42097 - DNA, 201 bp, Homo sapiens
gtgagtcagggtcagggttaaaccaagagaatttcaagttgtaagcatagagttggtggttaaaactatgctggcattcaggaaatgccatttgacaataycattttcttttttgagatggagtctccctctgttgcccaggctggagtgcagtggcatgatctcagctcactgcgagctccacctcccaggttcacacca

SEQ ID NO: 42098 - DNA, 201 bp, Homo sapiens
ttcatttcatgccacttttcatgctgttctgtatacctcaatcccatgtggtgtttttccttcacttccccttttattgcagagcctgtgctattgtctcrtgctggaagtaagcctcttcaccatctcacttctcttagctatgctttttctcttggcttttagttctcagctacttcctcagggactctgactttgacc

SEQ ID NO: 42099 - DNA, 201 bp, Homo sapiens
agattgtgagaaatattcctcgggtctgtgctgcttgtatttctcatcgtcttgcaaacctggtgtcagtcttgatagtacttaatagatgtacactgaattttttttttgaataactgaatgagtctaggcacgtacttgttgctatgggaagggtatggggatgatccagtgttccagctgaatcaaagaaaaccgagt

SEQ ID NO: 42100 - DNA, 201 bp, Homo sapiens
ttttttaatatgccttcatataaatattttattcaatatgttgtatttgtgaatttaacaaatgatattaaacacaaactacaatgcagacagacaaactmtttgtatgcaaattagcaatacataccaacagttcttgatacacaggtacctactacatgcagctcatcattgctgtcctcttcccatgctacaggtgag

SEQ ID NO: 42101 - DNA, 201 bp, Homo sapiens
actcggaattcagctacagctctaccttactcacaagttcattctctttctaatagatcacatatagatttgctaatatctagtaattcaaaccaaattakcaacagcttccttggttccttcccatccttcaccctttacactcagtcaccaaatgccctctactctttctcctaaaaatatccccagatgtatttgttc

SEQ ID NO: 42102 - DNA, 201 bp, Homo sapiens
tcatcctcccacatagaaagaataacaagaggccagtacattgatcccacatataattttcaataaatgaggttcagtttggtctcaatgaactcttctgagaagaaaacattgaattttattaggtgtacacagagttaacaaatatattcccaaacagtttagtatgaaacattttgaacccctttagatccaatattg

SEQ ID NO: 42103 - DNA, 201 bp, Homo sapiens
caatgcctttaaaaatgcatagctcatgaggattaaaactcggaattcagctacagctctaccttactcacaagttcattctctttctaatagatcacatrtagatttgctaatatctagtaattcaaaccaaattagcaacagcttccttggttccttcccatccttcaccctttacactcagtcaccaaatgccctcta

SEQ ID NO: 42104 - DNA, 201 bp, Homo sapiens
tttcaaatcatccttggaattttcaagattttactcaaggagctgatatttagagcttagatacacctctactattttataaataaagggccagctgaacygtatgagtttcttacttagcagaattggagctcttgcttttttgtctttcatcctctatcccaaagatttgttgaaggatgatgaactgaatgaaggctg

SEQ ID NO: 42105 - DNA, 201 bp, Homo sapiens
catcctcccacatagaaagaataacaagaggccagtacattgatcccacatataattttcaataaatgaggttcagtttggtctcaatgaactcttctgagaagaaaacattgaattttattaggtgtacacagagttaacaaatatattcccaaacagtttagtatgaaacattttgaacccctttagatccaatattga

SEQ ID NO: 42106 - DNA, 201 bp, Homo sapiens
ctggtgtacatgtctggtcagtcatcctagagagagtcagttctattgggcactatgaaaaatgagagctaaaaatcatcaagtgtaaggcagaagaccartcctagaggctgagttaactggcaaccacgagagagaagctgtgtgtgtcatagcatgagcacaggagtctggagcttttgcctgggcgtccatatgcca

SEQ ID NO: 42107 - DNA, 201 bp, Homo sapiens
acaggtataacatgtgctccctaaccagcttcctgaagtggctcatggttgaatttttgggaatcctttatcacaaagatggagaaattggggaccagaasgttgaatgtaagccagttccttttccccagaggcttccctctcacctgaaagggcatttttgggtgagcctcatcgttgaaagaaagtgggatacaaaca

SEQ ID NO: 42108 - DNA, 201 bp, Homo sapiens
gtatatggaatatctccgcatctctctcagttttgctgtgcacctaaaactgctctaaaaagaaaacagtcttaaaagaatatgtactctctctgatattktttgttagcgtgctctataaatgttaattatgtctactgggctgttaatgtcaacttttctatatccatactgattttaatttcactaattgcattaatt

SEQ ID NO: 42109 - DNA, 201 bp, Homo sapiens
gaaatgttaccagtaagaatgccagaggcccttttcccctaaattctcatgtgcctcgttccaggaagaaaaaaagaaagatttaggatgtttctttctayatcagtcattcccttggagacaagagagaatgaggcaagatgtattggattgttccttagtgtttttccattatgcctctccatctacagattgtgccct

SEQ ID NO: 42110 - DNA, 201 bp, Homo sapiens
ttttgggtgttcgtgttgtgctttaagctgttaccatctctcaagcctccctacttatttattataaacatttaaagctgagacctttacaaaaggccaamattaacagtgagtgcattcacacaatgaaaatgtatttgaatgagatttctctgctgttagatggatcgtcagtggcattgtctcaaaggatatttgtgc

SEQ ID NO: 42111 - DNA, 201 bp, Homo sapiens
tttttttaacctattttatgaacacttcctgagtccctactgtggactggatgtgcatgttcttgaagaactcataatctagcagaagatgtaaataaatmaatctatagagtaggatgtgatgaaatgttggagagaagggtgtttatttgccctggggaccctaaacaggttgtggctaactccgcctggaggatttag

SEQ ID NO: 42112 - DNA, 201 bp, Homo sapiens
tacaagtaactcaaattatcctttttttgtatttacaatctctgagctataattgtttatttccaatatacatgtaaatgcagggctgtgtagcatcacargttttggggatgggagctatagttattctttacccttgatgaacttatttgcaaagtgtctgtaagattttggtttccacttagggatgtagaaagttac

SEQ ID NO: 42113 - DNA, 201 bp, Homo sapiens
tctaaattttttaatatgtagaacaagtaaaatgaaattattggggacttaatatattgatcttttataaactccactaggtttttcctcaaacatgcatrtttcctgtctttctggagattcactaacttatttagctaccattttttaagcaatagagtatgtttaaactttattttattaaaaaggtgttgagtaaat

SEQ ID NO: 42114 - DNA, 201 bp, Homo sapiens
aaaaccctcaaaaaactgggtatagaaggaacaaacttcaacacaataaaagccacatatgacagacctatggctagtatcatactgattggggaaaaacygaaaggctttccttgaagatcaagaacacgatacggatgcccacttttaccagtgttattcaacacagtactggaagtcctagtcagacaatcagataag

SEQ ID NO: 42115 - DNA, 201 bp, Homo sapiens
ttaatttctttggggtctgtatctgtgagtggaattgctgggtcatagagtgactctgttttaccttttgaggtagcacaggaccgtcttcaaaatgacartaccattttacattccaccagcagcgtgtggagtttccagtttgtccacatccttgccatttcttggtattgtctgtctttttgattctttagagtattc

SEQ ID NO: 42116 - DNA, 201 bp, Homo sapiens
cagcagcgtgtggagtttccagtttgtccacatccttgccatttcttggtattgtctgtctttttgattctttagagtattctttataaagaaaactccakaaagtgtctcaggttgtttgcagcacagatattttctcatatccattattttcccctaagggttgtaagtagaagagtggaggagtaggatatgggtata

SEQ ID NO: 42117 - DNA, 201 bp, Homo sapiens
gtacatcatattttcataaacgatgttgcttatcataatcaatctaatatttattgatcttaccaccatgtatctctgggctaagctagtggtcagaaaastagggttaggcctacattctctttttgtaaataaagttttattagatcattgccatgctcatttgtttacgtatagctactttcttgctgtaatggcaaa

SEQ ID NO: 42118 - DNA, 201 bp, Homo sapiens
aaccagtttgtgttggtcaactaagtcagtgtccaaaaaaaagcaaacaagtgaacaacagggcttggtatgattatttaagatcttctagccctggggakatctttatccacacccacattttgatggacaataagaactgctgtcatgtttgttcacatttacatttctgcagtctcagaccagtccttggagaagctt

SEQ ID NO: 42119 - DNA, 201 bp, Homo sapiens
atgttcagagattacctcttaaggcccacagtaataaaactatctacacttttctctaaaagtcataaaaatgtttgtgaaataaaatcaagtttcatatytttgtgtactgaaattagtttcttattcctacccaattatctaacatacaattgtcattttgttatgagatacatacacttctcattacacatggagaag

SEQ ID NO: 42120 - DNA, 201 bp, Homo sapiens
tctccccccacccagtttacaatgtatacaatctcttatattcatgtggcttagtgatttgtacaggatgacctaaagccaccaggattcctggagatatkcttagatgtttactaggttgctttggagagtgagaagaaatctgggcttgttgagctttacctaccctacctactgctttctctgggcaaattcacttac

SEQ ID NO: 42121 - DNA, 201 bp, Homo sapiens
ggttagccatttctcattaggactgggaaagatgagtgagaaataaaattatagattgcatgttaaaaagaaaaacactggttgtgacactgagtataggtttttttttttactatatctgaagtaaaatgatacttatctgccttgttaattatatttatttgtaaaaatagtttccatttaaatttgtcaataataaaa

SEQ ID NO: 42122 - DNA, 201 bp, Homo sapiens
gatacacctgattgtgacattatttggggtccgtataatagaaaacccaagccaagggtgtgtaaggaaaaaaattgcaatttactggaccacttaactgwagtagttaggactgtgatttccaaagtgtgattcttgaatcagcagcacacgcatcaacgggggacttgttaaaactgtgaattctcagtttcatactca

SEQ ID NO: 42123 - DNA, 201 bp, Homo sapiens
cgccattctcctgcctcagcctcccgagtagctgggactacaggcgcccgccaccacgcctggctaattttttgtatttttagtagaggcggggtttcacygtgttagccaggatggtctcgatctcctgacctcatgatccgcccacctctgcctcccaaagtgctgggattacaggcgtgagccaccgcgcccggccaa

SEQ ID NO: 42124 - DNA, 201 bp, Homo sapiens
cccctaattttgatgactgccagacaataggataaattatttcaggagaattattacaccgttcagagcttctacagtgtcctacattcaataaaaatatrtccaaacaaacaaaacaaataagcagacaacaacaaactaggactgttaggaaatacagatgatagaaagagaaaggtgagacagatattggaattatca

SEQ ID NO: 42125 - DNA, 201 bp, Homo sapiens
acatctgtttctctgattcatatttttatggtcaactctgaaatgagacagttgtgaactgagaaattattcaaaacacaagggatgtgtcttcctattayttgtgaggaggaagtacaataaagtcctgaaatcagcaacttgcattggtggcttgtttacataaggaatatattaaatatttccttttctactgtggat

SEQ ID NO: 42126 - DNA, 201 bp, Homo sapiens
tcaaacagtggacaaggaatatttagtataatgccaggaaactagttgactggtcatagtcacacagatgcttcagggcaggcctatttcttgcatacctrtgatttcaggacattttcagaagtcccagacctagaacccataggtggagaatccaaattttttgtctgaggacaatgaaggtgtcagtgaatatctact

SEQ ID NO: 42127 - DNA, 201 bp, Homo sapiens
tggtcatagtcacacagatgcttcagggcaggcctatttcttgcatacctgtgatttcaggacattttcagaagtcccagacctagaacccataggtggaraatccaaattttttgtctgaggacaatgaaggtgtcagtgaatatctactcccttacaagagctttgttacaattgttcaaacctatcaacttctagatg

SEQ ID NO: 42128 - DNA, 201 bp, Homo sapiens
gtctctactaaaaatacaaaattagccaggcatggtggtacatgcctgtaatccagctactcgggaggctgaagcaggagaattgctcgaacccgggaggyggaggttgcagtgagccgagatcacgccaccgcactccagcctgggcaacaagagtgaaactgagaaagaaacaaagaaagaaaaagaaggaaggaagga

SEQ ID NO: 42129 - DNA, 201 bp, Homo sapiens
ttgtttacatttcggtagcttcaattcctgtgagtcatccaaatacacttattttaggcctgattggccctccctccttgatctcctggctgtacaaactrcctggataaaacaaacaaacacaaaaaccttattttcatttttccgagccaatgacctaagcaagatgctgctcagacaattctttcttaaagggctcag

SEQ ID NO: 42130 - DNA, 201 bp, Homo sapiens
tttaattagtaagaagagggctccaaaaacatgtaaataggcagcaagacaatacatgcttttggcaagtgctattatgaactatgaccacacagtaagaratgaatatgggtggtagagaaggcttctttttttttgagacagagtctcactctgtcgccaggctggagtgcagtggcacaatctcggctcactgcaacc

SEQ ID NO: 42131 - DNA, 201 bp, Homo sapiens
ttttttgagacagagtctcactctgtcgccaggctggagtgcagtggcacaatctcggctcactgcaacctctgcctcctgggtttaagtgattctcctgyctcagactcccgagtagctgggactacaggtgcgcaccaccatgcccagctactttttttgttttttgtttttttttttttgtatttttagtagagacag

SEQ ID NO: 42132 - DNA, 201 bp, Homo sapiens
gagcagggggcggcgtccgcgtctgacccggcctgccggttgcttgtcgcccgcgcaggagctggccgggcgccgcctgcaggctgtcccgggccgagtcsgagcgacgctgccgcgcacctgggcagcccccgggggccgcgctgtgccacggccggggccgctgcgactgcggcgtctgcatctgccacgtgactgagc

SEQ ID NO: 42133 - DNA, 201 bp, Homo sapiens
tttaagtgattctcctgcctcagactcccgagtagctgggactacaggtgcgcaccaccatgcccagctactttttttgttttttgtttttttttttttgkatttttagtagagacagggtttcaccatgttggccaggatggtctcgatctcttgacttcgtgatctgcccacctccgcctcctaaagtgctgggattac

SEQ ID NO: 42134 - DNA, 201 bp, Homo sapiens
ttaaaaggaagcttagccttaatcagaaatcctctattcacacagcagggcctcagatatggcagatattcctgaaatggaaaaacagtacttcaaagttkaggctctgtggaacttcgtcatgatttttcttcatcaatctctattcttttttgtagacggcatatttggttttttttttccctgctttttgtctaacta

SEQ ID NO: 42135 - DNA, 201 bp, Homo sapiens
tgaaagatgcaaatgagcagcttaatggaaaaaatatgaggaacttggtgctaaatcattcacagtcaacctgtttctgggctggggtttcctaagcagcrgagcacctccctcactaccgtctattgaaagtcagcttttaaacaataatagtaataaataataaaaaataataaaaatatacatatatcaaactttgac

SEQ ID NO: 42136 - DNA, 201 bp, Homo sapiens
tccttttcgtatgggtattttgggctgcagtcatttttatggtaggtagattataccaacaccaagcactgtattcttccattgtgtgtgtgtgtgtgtgyatgtgtgtgtacatacagagagatctttagagagcatttctcttatttgaattcttctgatgttcgatatcaagacaaacagcaccatgccgaatctttc

SEQ ID NO: 42137 - DNA, 201 bp, Homo sapiens
aaaaacagtacttcaaagttgaggctctgtggaacttcgtcatgatttttcttcatcaatctctattcttttttgtagacggcatatttggtttttttttyccctgctttttgtctaactagttatatattgcttattgtagatacttttgcaaataccaaaaaaaatgaaactcccagaagcaacattttagctaatttt

SEQ ID NO: 42138 - DNA, 201 bp, Homo sapiens
gaagttttccttggaccttgaagaatgattggaaatttacctgataggtatatgataatgactgaaacaaaattggtagtgatttgtggtagtggctaaayagaagttgtgaagtgaggcagcaaaataataaacttacaaaaattagccaggcacgtgcctgtagtcccaactgctcaggaggctgaggcaggagaattg

SEQ ID NO: 42139 - DNA, 201 bp, Homo sapiens
ctggctgtacaaactacctggataaaacaaacaaacacaaaaaccttattttcatttttccgagccaatgacctaagcaagatgctgctcagacaattctytcttaaagggctcagtccaaaataattagatcaattagacaaatccatccacaaatatatgtgtttgtcctcttgatgtttagtttccaattattataga

SEQ ID NO: 42140 - DNA, 201 bp, Homo sapiens
ctctttaatgcttagacatcagtgaatatccacaagcatcaaggccatccaggaaaacatgacctcaccaaacaaactgaataaggcaccagggaccaatyctggagtgacagagttatgtgacctgtcaaagataatttaaaatacctgttttggggaagatcagtgaaattcaggataacacagagaaggaattcagaa

SEQ ID NO: 42141 - DNA, 201 bp, Homo sapiens
ctaatgttaatttttatgcaataatagagagacaccattacttccacttgtatctgttgttatttgtaagcagagaggtatacagataaactaatatagtrccaaatgccatttgtatgaaagttacccttttgttttattagtaagcaataggagaacaatcaataaatactgccaccagtggtaatgtgactagccttg

SEQ ID NO: 42142 - DNA, 201 bp, Homo sapiens
gaagacaacaataaatacctaactctttaatgcttagacatcagtgaatatccacaagcatcaaggccatccaggaaaacatgacctcaccaaacaaactraataaggcaccagggaccaatcctggagtgacagagttatgtgacctgtcaaagataatttaaaatacctgttttggggaagatcagtgaaattcaggat

SEQ ID NO: 42143 - DNA, 201 bp, Homo sapiens
cttttctcttcactgattctgggtatgagaagaaaagaatgacttgaggatatgccaacctcaccttgcttctgtctgcccctagctatattttatatttrcatttcaggcaagagaccaaaaaactgaattcccaacacagagagacagtggcgagcgagaggacctgcatcacccagctcttaaatcctacatcagtac

SEQ ID NO: 42144 - DNA, 201 bp, Homo sapiens
cttcaacacaataaaagccacatatgacagacctatggctagtatcatactgattggggaaaaactgaaaggctttccttgaagatcaagaacacgatacrgatgcccacttttaccagtgttattcaacacagtactggaagtcctagtcagacaatcagataagaaaaagaaataatgttcatccacatgggaaaggaa

SEQ ID NO: 42145 - DNA, 201 bp, Homo sapiens
gagagagatcagcatagaaaatttattcaaagggatagccgagaaatttccaaacctagagaaatatgtcaatactcaagtacaagaaggttatagaacaycaaatagatttaacccaaataagactacctcaaggaattcaatagtcaaattcccaaaggtccaggataaagaaaagattcttaaattagcaagagaaaa

SEQ ID NO: 42146 - DNA, 201 bp, Homo sapiens
acttcatgataaaaaccctcaaaaaactgggtatagaaggaacaaacttcaacacaataaaagccacatatgacagacctatggctagtatcatactgatyggggaaaaactgaaaggctttccttgaagatcaagaacacgatacggatgcccacttttaccagtgttattcaacacagtactggaagtcctagtcagac

SEQ ID NO: 42147 - DNA, 201 bp, Homo sapiens
ttttaaatcatatcaggtctgttgctgggagatgtttgaggaacacaggaaattatatggagcctgttgataacagcctgtccttatcctgtgacctaaartaataccaaacttgccacattaccaaccctcttgtttaaatgtaaaacccatattggaggtttacaccaatgtcattaaaaaaagaaagttaggattcaa

SEQ ID NO: 42148 - DNA, 201 bp, Homo sapiens
agcagaagtaagacttggagactgagtgtgttcccgaatcatgggggtggatgagctagcataatctccctgtgtttttataatgatcactgatgaaactsccttgaagactgttttagatgaaaaggcaaaaatgggttttgtgctgacagatgtgcattttttctgtcttcagaaaagtcaggagaggagaaggtcatc

SEQ ID NO: 42149 - DNA, 201 bp, Homo sapiens
gtaattacatccaatgaatgaaggctgaaattctggaagtgcgctatttggaggctgtagtcccctctgcaccagcaacacacatctttctctgctttttytctccagagctaagtgaagcccaacagaagctgctggtgaaatccatggagaaaaagatcctacccgtgcagctaaagctggtgagggaaaaacagcaga

SEQ ID NO: 42150 - DNA, 201 bp, Homo sapiens
ttaggaactagaagtactggagttgagccagggtggtacattgtgactggaagccaagagaagccagcgttgcacggagggtttccacagcaggatcgagwattgcacagagttaggcgaggtcattgagactgataggtaagagatcattgtaatttcagctgagtagtggaaatacaaggcaaattataaagaatttag

SEQ ID NO: 42151 - DNA, 201 bp, Homo sapiens
tctgacaggactgacagggaaatagcagagcgaatctcagcaaataattgtccccgaaacatggcagaaattccaatagcttgggaaaaagcagtggaaaggggggagtctttgcccaggtggtctgacgcctgagacctttgtcctcaacagccttactagcagccaggcacagtgattcacacctataatcccagcact

SEQ ID NO: 42152 - DNA, 201 bp, Homo sapiens
gagccagggtggtacattgtgactggaagccaagagaagccagcgttgcacggagggtttccacagcaggatcgagtattgcacagagttaggcgaggtcrttgagactgataggtaagagatcattgtaatttcagctgagtagtggaaatacaaggcaaattataaagaatttaggtggaccgggcatggtggctcaca

SEQ ID NO: 42153 - DNA, 201 bp, Homo sapiens
ctgacctcaggtgatcctcccaccttggcctcccaaagtgctgggatcacaggtgtgagccactgagcctggcctagaaaaaaaaaaaaaaaattaagagwcttagtagctataacctgctacacacacatctgcaactcggccgcccagcaactggggccagagccactgagtcacagtaatgccaggaacaaggtagct

SEQ ID NO: 42154 - DNA, 201 bp, Homo sapiens
atttttttgatatatttgccaatgaaatgaaggaaaaaaatagggtagtaatttgagggagtggcatgatcaaagcaaacaaatttgttaggattagggacacgtttatatatggaagcagacagaaggagcaagtggagaggaggaactggtgttaacagcaagagagagcataagatgtggagagaaaggatcccagag

SEQ ID NO: 42155 - DNA, 201 bp, Homo sapiens
tttttttgatatatttgccaatgaaatgaaggaaaaaaatagggtagtaatttgagggagtggcatgatcaaagcaaacaaatttgttaggattagggacacgtttatatatggaagcagacagaaggagcaagtggagaggaggaactggtgttaacagcaagagagagcataagatgtggagagaaaggatcccagaga

SEQ ID NO: 42156 - DNA, 201 bp, Homo sapiens
ctgccaaaatcctccaccctctcctagcttatactataatcccccaaggagcctctgcttttgtttcccaagtccctaagaatacctagcctcaactttaggaaagacagatagaggcatataaatactgtcccagagagatatagaaactgacagacagagaccggaaggcacagtcagaagcagaagtaagacttggag

SEQ ID NO: 42157 - DNA, 201 bp, Homo sapiens
ttttttgatatatttgccaatgaaatgaaggaaaaaaatagggtagtaatttgagggagtggcatgatcaaagcaaacaaatttgttaggattagggacacgtttatatatggaagcagacagaaggagcaagtggagaggaggaactggtgttaacagcaagagagagcataagatgtggagagaaaggatcccagagag

SEQ ID NO: 42158 - DNA, 201 bp, Homo sapiens
ggaggaactggtgttaacagcaagagagagcataagatgtggagagaaaggatcccagagagatgaatggggaggaaagagggggggagcatctacccccrggatcccagagagatgaatggggaggaaagagggggggagcatctacccccgaactggaggaaaagggggtaagaagcacccaagaggccctgttcccgg

SEQ ID NO: 42159 - DNA, 201 bp, Homo sapiens
gaatggggaggaaagagggggggagcatctacccccgaactggaggaaaagggggtaagaagcacccaagaggccctgttcccggccaggtgctggcccarttaccgagtttatctctgagcaacccaggaggtcagcatcattatactcatttcatagatgaggcaattaagactcagagaagctgccctgccagtaagc

SEQ ID NO: 42160 - DNA, 201 bp, Homo sapiens
aagtccttcctcagagtccagaccagggacaccactgaaggcttccagcttcttatctccctgaaggctctcagccctgaccctgcacctcccccaactcrcgctcccaatatctcatacttaagatgtccagagattcacaaattctcattgtctaattctagggatccataaatcacaaggaggctgtaaccatcccca

SEQ ID NO: 42161 - DNA, 201 bp, Homo sapiens
ttcccaagtccctaagaatacctagcctcaactttaggaaagacagatagaggcatataaatactgtcccagagagatatagaaactgacagacagagacyggaaggcacagtcagaagcagaagtaagacttggagactgagtgtgttcccgaatcatgggggtggatgagctagcataatctccctgtgtttttataat

SEQ ID NO: 42162 - DNA, 201 bp, Homo sapiens
gcacgctcctacctatcggcactcccagcctgcagaaattgtatgccttatgttcagcactaaactcaaatctaaccaaggaagtccggatcccatagggktcttcctactctccagttcggtttattttaaggccaacagccctagcttcacgtccctccttcacagccttctttccttccctcctgccggatgcgcccg

SEQ ID NO: 42163 - DNA, 201 bp, Homo sapiens
ccaccgccgccggccccccaggatgtggagatgaaagaggaggcagcgacgggtggcgggtcgacgggggaggcagacggcaagacggcggcggcagcggytgagcactcccagcgagagctggacacagtcaccttggagggtacggcagcccaggccgggaacgtgccgcgatcgcgggtgacagcgacccctgtgatt

SEQ ID NO: 42164 - DNA, 201 bp, Homo sapiens
acctgacaccacttgacagcctcatcgacttcaagcgcttccatcccttctgcctggtgctgaggaagaggaagagcacgctcttctggggggcccggtaygtccgcaccgactacacgctgctggatgtgcttgagcccggcagctcaccttcaggtcagcctcaagcggggctgggaactgagggatactgagggacag

SEQ ID NO: 42165 - DNA, 201 bp, Homo sapiens
gcctcatcgacttcaagcgcttccatcccttctgcctggtgctgaggaagaggaagagcacgctcttctggggggcccggtacgtccgcaccgactacacrctgctggatgtgcttgagcccggcagctcaccttcaggtcagcctcaagcggggctgggaactgagggatactgagggacaggggctgggcacctggcct

SEQ ID NO: 42166 - DNA, 201 bp, Homo sapiens
aggaagagcacgctcttctggggggcccggtacgtccgcaccgactacacgctgctggatgtgcttgagcccggcagctcaccttcaggtcagcctcaagyggggctgggaactgagggatactgagggacaggggctgggcacctggcctgcaaggaggacctcaaagctccctctggccagaggtgattagatgtcatc

SEQ ID NO: 42167 - DNA, 201 bp, Homo sapiens
gggtggccaggggagtccaccttagataccttccccaaggctggccacgtgccccaaggctgccaggccactgctcctccctttgtcccctggaaaagggyaaacagtgggttcccccaaggcacatgctccctctgatggccagaagggacttctgctggaggggctggaaccttctctttccagagtccaaaactcagg

SEQ ID NO: 42168 - DNA, 201 bp, Homo sapiens
tgtaccaaagacggtgaaggtgaagggaacggcagggctctcgcagaacagcactctggaggtccagacactcagtgtggctcccaaggccctggagaccktgcagaagaggtgagagtgggcgggaccgagggtctcccgggatgtgggtggggcagtgcatggaaatggtgcttggggccttgagctgaaaggtaggac

SEQ ID NO: 42169 - DNA, 201 bp, Homo sapiens
aaagacggtgaaggtgaagggaacggcagggctctcgcagaacagcactctggaggtccagacactcagtgtggctcccaaggccctggagaccttgcagragaggtgagagtgggcgggaccgagggtctcccgggatgtgggtggggcagtgcatggaaatggtgcttggggccttgagctgaaaggtaggacccttgc

SEQ ID NO: 42170 - DNA, 201 bp, Homo sapiens
acggcagggctctcgcagaacagcactctggaggtccagacactcagtgtggctcccaaggccctggagaccttgcagaagaggtgagagtgggcgggacygagggtctcccgggatgtgggtggggcagtgcatggaaatggtgcttggggccttgagctgaaaggtaggacccttgcactgacctttgccaatgtggtc

SEQ ID NO: 42171 - DNA, 201 bp, Homo sapiens
aggcgaaaccgccgcccggcggaggagaacaagaacccccaccgccgccggccccccaggatgtggagatgaaagaggaggcagcgacgggtggcgggtcracgggggaggcagacggcaagacggcggcggcagcggctgagcactcccagcgagagctggacacagtcaccttggagggtacggcagcccaggccggga

SEQ ID NO: 42172 - DNA, 201 bp, Homo sapiens
gctaaggcaggagaatcgcttgaacccaggagggggagggtgcagtgagccgagatcactccattgcactccagcctgggcaacagagcgagactccatcaaaaaaaaaaaaaattggtttcattcctaaggatttgcttggtcacattgggtagtctgagaagacagcctagtcttgctaatagaggttgaataacccta

SEQ ID NO: 42173 - DNA, 201 bp, Homo sapiens
ggatctcaggaagattaactgttgggttagatgatacatgcatcctggcccaccttctcgccccaaccctcaggttagggttggtggatagttctgtcacygcattccttggtaaagaaaaatggggccaggctcaaactggggggtagagcatgggtacctaaagggggctgagtgtaggagccctgcagggggaatgct

SEQ ID NO: 42174 - DNA, 201 bp, Homo sapiens
ccgggatcccagagagatgaatggggaggaaagagggggggagcatctacccccgaactggaggaaaagggggtaagaagcacccaagaggccctgttccyggccaggtgctggcccaattaccgagtttatctctgagcaacccaggaggtcagcatcattatactcatttcatagatgaggcaattaagactcagagaa

SEQ ID NO: 42175 - DNA, 201 bp, Homo sapiens
aagatgtggagagaaaggatcccagagagatgaatggggaggaaagagggggggagcatctacccccgggatcccagagagatgaatggggaggaaagagrgggggagcatctacccccgaactggaggaaaagggggtaagaagcacccaagaggccctgttcccggccaggtgctggcccaattaccgagtttatctct

SEQ ID NO: 42176 - DNA, 201 bp, Homo sapiens
aagcctcctgcctgaccccaatacacactaagcacgccctcgggaatgctgccccacagcacaaagggtgtggcaggtgccacattgatgctgggcaccaccggatgtttggcttgacacgggaactgacttttaagtagttaagtagtggttgaaagaaggaggtaaggactgtgaaggccagaaggaaaggctggggta

SEQ ID NO: 42177 - DNA, 201 bp, Homo sapiens
ccccacgaacccataaaggctcctccccgctccttcctcgaagctcctccttcatcctgcacctcggctgtggatttatttcccctttgttgactcggccrtcggcctgccgggcctggcgtttcccagaaggcccagcgccgggaaggggtttgcagctgctccgtcatcgtgcggcccgacgctatctcgcgctcgtgt

SEQ ID NO: 42178 - DNA, 201 bp, Homo sapiens
cagaaggagcaagtggagaggaggaactggtgttaacagcaagagagagcataagatgtggagagaaaggatcccagagagatgaatggggaggaaagagsgggggagcatctacccccgggatcccagagagatgaatggggaggaaagagggggggagcatctacccccgaactggaggaaaagggggtaagaagcacc

SEQ ID NO: 42179 - DNA, 201 bp, Homo sapiens
ggtggagacggtgcaggaggtcacactggagcgagccggcaaggcagaggcctgcttctccctccccttcttcgccccattggggctacaggtttgattcaaacacacacacacacacacactctcacactcacactcacacatacacatttacattcagcccctccttggaggcttcattagctttgcctgatcagcgcc

SEQ ID NO: 42180 - DNA, 201 bp, Homo sapiens
ttggcagccaccttgacactctcctgtctccccacctccacagagacaatgaccatgtttgaaaatgtcacccgggccctggccagacagctaaaccctcraggggacctgacaccacttgacagcctcatcgacttcaagcgcttccatcccttctgcctggtgctgaggaagaggaagagcacgctcttctggggggcc

SEQ ID NO: 42181 - DNA, 201 bp, Homo sapiens
aagtgctccagctgggctccgtggcagtgaagaaaatgagcgtggagtgagaaaaatgcccttgacaaagaaaagggaggtgtggctttgctggccatctrtgggactttggggcaactctttcaactctccagccctaggttcctcatcataaaatgcagactcccttgattctttccagctgtgacatgagacaatcca

SEQ ID NO: 42182 - DNA, 201 bp, Homo sapiens
ataagggcctggagctcaggaaagaggtcaaagtgaagatacacacaaggtaatcagcactataaagattaaaactgtaggagccaggggaggagtctcastcccgtaagcccagcactttgggaagccaaggcaggattgcttgagcccaggagttcaaaccagcctgggcaagagagtgaaacccccatctccacaaaa

SEQ ID NO: 42183 - DNA, 201 bp, Homo sapiens
gggtacctaaagggggctgagtgtaggagccctgcagggggaatgctgactggagaggaaggtgcccgatggagggctgtgtgtcccattattgtccccayaggggacgtacacgaaggcttcaggacactaaaagaagaagttcagagagagacccaacaagtggagaagctgagccgagtagggcaaagctccctgctc

SEQ ID NO: 42184 - DNA, 201 bp, Homo sapiens
tgggtacctaaagggggctgagtgtaggagccctgcagggggaatgctgactggagaggaaggtgcccgatggagggctgtgtgtcccattattgtccccmtaggggacgtacacgaaggcttcaggacactaaaagaagaagttcagagagagacccaacaagtggagaagctgagccgagtagggcaaagctccctgct

SEQ ID NO: 42185 - DNA, 201 bp, Homo sapiens
gtccgcaccgactacacgctgctggatgtgcttgagcccggcagctcaccttcaggtcagcctcaagcggggctgggaactgagggatactgagggacagrggctgggcacctggcctgcaaggaggacctcaaagctccctctggccagaggtgattagatgtcatctagcccaaagtcatcatcaggagctgaggaggc

SEQ ID NO: 42186 - DNA, 201 bp, Homo sapiens
tcccaatatctcatacttaagatgtccagagattcacaaattctcattgtctaattctagggatccataaatcacaaggaggctgtaaccatccccaaggrctgcgtcctggcctttcgagtgagacagctgatggtcaaaggcaaagatgagtggggtgagcagagacccgcatgttctccccacaagatgagaattacc

SEQ ID NO: 42187 - DNA, 201 bp, Homo sapiens
cagacccaacagacactgggaattttggctttaagaatatgctggacacccgagtggagggagatgtggatgtaccaaagacggtgaaggtgaagggaacrgcagggctctcgcagaacagcactctggaggtccagacactcagtgtggctcccaaggccctggagaccttgcagaagaggtgagagtgggcgggaccga

SEQ ID NO: 42188 - DNA, 201 bp, Homo sapiens
tcccagagagatatagaaactgacagacagagaccggaaggcacagtcagaagcagaagtaagacttggagactgagtgtgttcccgaatcatgggggtgratgagctagcataatctccctgtgtttttataatgatcactgatgaaactgccttgaagactgttttagatgaaaaggcaaaaatgggttttgtgctgac

SEQ ID NO: 42189 - DNA, 201 bp, Homo sapiens
atctgggtttcaacctcagccctagtccagagtcctcactccttccctgccaccacaatgtctagttcctgggaatgacagaaggaaagaggagggtgtgktacaggcaggaaggagctctgaacggttcccttatgtttctcctgcaacaggaagctggcagcagaccacccattcctgaaggagatgcaagatcaaggg

SEQ ID NO: 42190 - DNA, 201 bp, Homo sapiens
gtacattgtgactggaagccaagagaagccagcgttgcacggagggtttccacagcaggatcgagtattgcacagagttaggcgaggtcattgagactgayaggtaagagatcattgtaatttcagctgagtagtggaaatacaaggcaaattataaagaatttaggtggaccgggcatggtggctcacatctgtaatccc

SEQ ID NO: 42191 - DNA, 201 bp, Homo sapiens
agtagagatggggtttcaccatgttggtcaggcaggtcttgaactcctgacctcaggtgatccacccacctcagcctcccaaagtattgggattacaggcrtgagccacggcgcctggccttttttttttttcttgagacagagtctcattctgttgcccagactggagtgcaaaggtgagatctccactcactgcaaact

SEQ ID NO: 42192 - DNA, 201 bp, Homo sapiens
cccaacaagtggagaagctgagccgagtagggcaaagctccctgctcagctccctcagcaaacttctagggaagaaaaaggagctacaagaccttgagctygcagtgaggacctagtggaagtggggaagggtgggagaaggcatgttttggtgaagatttggtgggggcgggtattgcagcaggtagggagatctgacgg

SEQ ID NO: 42193 - DNA, 201 bp, Homo sapiens
tgtgctgggccctgggttgggccctttcctatgttatcttcaatagtcgcccaccttcccccacagcttgaaggggctctagacaagggacatgaagtgamcctggaggcactcccaaaagatgtcctgctatcaaaggaggccgtgggcgccatcctctatttcgttggagccctaacaggtaagtggggaataaggtct

SEQ ID NO: 42194 - DNA, 201 bp, Homo sapiens
acactggagcgagccggcaaggcagaggcctgcttctccctccccttcttcgccccattggggctacaggtttgattcaaacacacacacacacacacacwctcacactcacactcacacatacacatttacattcagcccctccttggaggcttcattagctttgcctgatcagcgcccaccgaggatgctgaaaagggc

SEQ ID NO: 42195 - DNA, 201 bp, Homo sapiens
ggctggaaccttctctttccagagtccaaaactcaggaaacaaggaacccaggagtccagtactcttcaggacatgaggcctcgaaaaagaaatcaggaartggagagagtttccgcatgtcaaggggttattatgtgctgggccctgggttgggccctttcctatgttatcttcaatagtcgcccaccttcccccacagc

SEQ ID NO: 42196 - DNA, 201 bp, Homo sapiens
ggggccaggctcaaactggggggtagagcatgggtacctaaagggggctgagtgtaggagccctgcagggggaatgctgactggagaggaaggtgcccgayggagggctgtgtgtcccattattgtccccataggggacgtacacgaaggcttcaggacactaaaagaagaagttcagagagagacccaacaagtggagaa

SEQ ID NO: 42197 - DNA, 201 bp, Homo sapiens
cagcactttgggaggctgaggcaggaggatcccttgagctcaggagttcaagaccagcctgggcaacatagtgagacaatgtctctatttaaaaaaaaaawtttttttttggatggagtttcactcttgttgcccaggctggagtgtagtggcgcaatctcagtccactgcaacctccacctccccggttcaagtgattct

SEQ ID NO: 42198 - DNA, 201 bp, Homo sapiens
acatggcagaaattccaatagcttgggaaaaagcagtggaaaggggggagtctttgcccaggtggtctgacgcctgagacctttgtcctcaacagccttastagcagccaggcacagtgattcacacctataatcccagcactttgggaggctgaggcaggaggatcccttgagctcaggagttcaagaccagcctgggca

SEQ ID NO: 42199 - DNA, 201 bp, Homo sapiens
cgacaaagggaggcggaggttgcagtgagctgagattgtgccactgcactccaacctgggcgacagagagagactacatctcaaggaaaaaaaaaaaaaaagcaaaactgtggccggatgcggtggctcatgcctgtaatcccagcactttgggagtccaaggtggatggatcacttgaggtcaggagttcgagactcgcc

SEQ ID NO: 42200 - DNA, 201 bp, Homo sapiens
tgctgagaagctggactgcataccttggattcctgcagacagcacagcagaagaagctgctcctcactccatggccgcaggcatccttcttggagacgtcygggaaatgttggatatgttgcagatttagtgagtggaactctctccctctcctcagccctcagtctctccgtaggaataatgtgtgtgtgtgttgggggg

SEQ ID NO: 42201 - DNA, 201 bp, Homo sapiens
ttgctgagaagctggactgcataccttggattcctgcagacagcacagcagaagaagctgctcctcactccatggccgcaggcatccttcttggagacgtyagggaaatgttggatatgttgcagatttagtgagtggaactctctccctctcctcagccctcagtctctccgtaggaataatgtgtgtgtgtgttggggg

SEQ ID NO: 42202 - DNA, 201 bp, Homo sapiens
aaaatcaagtggctatttattacttttctatggttctctagtgggagcagtggctgctatggacagtgagattgacaccattctcccaacccgttgctgasaagctggactgcataccttggattcctgcagacagcacagcagaagaagctgctcctcactccatggccgcaggcatccttcttggagacgtcagggaaa

SEQ ID NO: 42203 - DNA, 201 bp, Homo sapiens
tttctagtagagacgggctttctccatgttggtcaggctggtctcgaattcccgacctcaggtgatccacccgcctccgcctccctaagtgctgggattamaggcgtgagccactgcgcctggcccaatcagcattttctaagtaccccccatgttccctgtgcggtgccagaccaaggctgaggatgatacagagatgac

SEQ ID NO: 42204 - DNA, 201 bp, Homo sapiens
ttttttgagtggagtttcactcttgttgcccaggctggagtgcaatagcatgatctcagctcactgcaacctccgtctcccgggttcaagggattctcctkcctcagcctcccaagtagctgagattacaggcatgcgccaacatgcccagttgatttttgtatttctagtagagacgggctttctccatgttggtcaggc

SEQ ID NO: 42205 - DNA, 201 bp, Homo sapiens
ttttttctttttttttttttgagtggagtttcactcttgttgcccaggctggagtgcaatagcatgatctcagctcactgcaacctccgtctcccgggttyaagggattctcctgcctcagcctcccaagtagctgagattacaggcatgcgccaacatgcccagttgatttttgtatttctagtagagacgggctttctc

SEQ ID NO: 42206 - DNA, 201 bp, Homo sapiens
cgatctcctgacctcatgatccgcccgcctcggcctcccaaagtgctgggattacaggcgtgagccactgcgcccggccacttttttctttttttttttttgagtggagtttcactcttgttgcccaggctggagtgcaatagcatgatctcagctcactgcaacctccgtctcccgggttcaagggattctcctgcctca

SEQ ID NO: 42207 - DNA, 201 bp, Homo sapiens
tgggttcccgggctcctctgtagtccggaggagcgattgggcacgctgcttggaccttcctagtactgcggctcctcggtctggcattcaaatcctgcacsgtacaggcaaccctagctcccactgctttcctccatcttcccgggggccctgccaaacccagctccaggcctgccaagtgtcccaaactgcctccctgct

SEQ ID NO: 42208 - DNA, 201 bp, Homo sapiens
ggtgtttcatggtgttagccaggatggtctcgatctcctgacctcatgatccgcccgcctcggcctcccaaagtgctgggattacaggcgtgagccactgygcccggccacttttttctttttttttttttgagtggagtttcactcttgttgcccaggctggagtgcaatagcatgatctcagctcactgcaacctccgt

SEQ ID NO: 42209 - DNA, 201 bp, Homo sapiens
agccgggattacaggcgtgagccaccacgcccggttaatttttttttttgtatttttagtagagacggtgtttcatggtgttagccaggatggtctcgatytcctgacctcatgatccgcccgcctcggcctcccaaagtgctgggattacaggcgtgagccactgcgcccggccacttttttctttttttttttttgagt

SEQ ID NO: 42210 - DNA, 201 bp, Homo sapiens
atccgtgcctagactctcccccaaatgtccactgactggcttgagaaaaggactgtccccaggaccgccccaggtccagggatgtacagatgaacagactrgatctccatcttgtctcctgggcttttccaaccccagggtcgctcctccccttctctcaaaccaaaagccagtttgaggaacagacagaggagaaggctg

SEQ ID NO: 42211 - DNA, 201 bp, Homo sapiens
cctgcacctgtccggcccgggaagtgccatgggacagctgatcgccaagttaatgagcatcttcgggaaccagggtaaggggcgcacagggcatccaagckagcgctttgatctcgccctcttctgggactcctctgatctgtggtcggacgcacggggggacctcgggctccgagggtcgtatatgggcgctcctcgact

SEQ ID NO: 42212 - DNA, 201 bp, Homo sapiens
ctactcaccagctgtgtggtcaagagcaagatacatagcctcactgagcctcagtctcttcatttgtaaaatggggatactaacagtaccaagtccacagsgttgtggtaaggcctaaatggagtcatgaacacccaatgcttatgtagcacagcctctgccacacagtcagaggtgtgctattcccatgtctggatagaa

SEQ ID NO: 42213 - DNA, 201 bp, Homo sapiens
aaggccaaagagggggcacccggatttgaaccggggacctcttgatctgcagtcaaatgctctaccactgagctataccccctctgccggcaaaccgacckcacgtagtcgcttagtggtattgctgcgcaggcgctgtgtggcgttcccgaagggaagtggaagtggggtaagacgtttacaagagatggaaaaaataca

SEQ ID NO: 42214 - DNA, 201 bp, Homo sapiens
gactgagctcttggtgcccactcctacctccccagcttgaccagtgaggtggtccatatgtgtcccaccattggcagcaacgtggaggagatcattctgcygaagacccacttcttcctgtgggacatagtgagacctgaggctctgagctttatctggaacacatactactccaacactgaggtgaggagggcaccaggg

SEQ ID NO: 42215 - DNA, 201 bp, Homo sapiens
ctgcctgaaattgcatttgcagcccggacacggtggctcatacctgtaatcccagcactttgggaggtcgaggtgggtggatcacttgcggtcaggagttygcaaccagcctggccaacatggtgaaaccccatctctactaaaaatacaaaaattagccaggcgtggtggtgggtgcctgtaataccagctacttgggag

SEQ ID NO: 42216 - DNA, 201 bp, Homo sapiens
ggagatcattctgccgaagacccacttcttcctgtgggacatagtgagacctgaggctctgagctttatctggaacacatactactccaacactgaggtgrggagggcaccagggctgaagggtctccaaggcaggcgtgtgatatcagactgtcatgtaacctttctgagccttggttccccaacttgtgaaatagagat

SEQ ID NO: 42217 - DNA, 201 bp, Homo sapiens
agctgagacctgagtgaagagtaggagacagccatggggagacctggggaacaagccttccaggcagaaatcattgactcactctgacttcagtttcttawctgtaaggaagaggatcattatacctcctagagtttctgtagagtaaatgacaccattcagtacacaaatctttcttgagcacctcctttgtgccaggta

SEQ ID NO: 42218 - DNA, 201 bp, Homo sapiens
ccactcctacctccccagcttgaccagtgaggtggtccatatgtgtcccaccattggcagcaacgtggaggagatcattctgccgaagacccacttcttcmtgtgggacatagtgagacctgaggctctgagctttatctggaacacatactactccaacactgaggtgaggagggcaccagggctgaagggtctccaagg

SEQ ID NO: 42219 - DNA, 201 bp, Homo sapiens
agctcaaatgatcttcctgccttggcctccccaagtgttgggattacatgagtgagctaccacgcctggcgcagatgtgttttttgaagaaggggagactktaggcaagtcagtccaagggaccacacgtttctagcagtgtccttgccacccgctgggtcaggagaaccctcttccacaacccacagtcagttcaatcag

SEQ ID NO: 42220 - DNA, 201 bp, Homo sapiens
agctggagagggagccagagagcgcctgtgaggcagtaggaaggaaggctgggcactagcaggctgactggggctgggctcctctgtccacaggctctacrggatgcttcagtcctgatatttgccaataagcaggacgtgaaggactccatgaggatggtggagatctcccatttccttactctcagcaccatcaaagac

SEQ ID NO: 42221 - DNA, 201 bp, Homo sapiens
tagattcagactgctttgggagtagagcatttgggggccagagttgggagtaggctggactgagctcttggtgcccactcctacctccccagcttgaccartgaggtggtccatatgtgtcccaccattggcagcaacgtggaggagatcattctgccgaagacccacttcttcctgtgggacatagtgagacctgaggct

SEQ ID NO: 42222 - DNA, 201 bp, Homo sapiens
ctattaaatatcctacattgcgggtatttttattctgtcctggaagaaaaaataaaaagattatctatccccagagcctgtcagaaggtggtgacaggtgrggtgagccatttcctcgtctggggctggctctgaagattgattgggtctggccctgagtaggcctggaggccccagagaggcaggaggcctgggttacct

SEQ ID NO: 42223 - DNA, 201 bp, Homo sapiens
cccagtttctgagagcctctataccagcagcatgaggagggctggtttgtgcctgatgaagggcatcagtaccctcagtgcaattgactatagaagccagrgttgctggttcaagttctaactccatctttcattcactgtaggactttggacaagtgacttcacctctctaatcctcagtttccccaagtataaaatgag

SEQ ID NO: 42224 - DNA, 201 bp, Homo sapiens
aaagacaattataatggaagcagggtggtgaaatcttgaggctgcatgctttcatttctctggggctgacatctgggcagtgcagagaccagtggggaaasaaagagggcaggaaacacatttaccaaagagaaagcctgtctctcacggctcccctctgctgcccagtttatcatccttgtgattgacagcacggaccgg

SEQ ID NO: 42225 - DNA, 201 bp, Homo sapiens
gctagaatctcctttgcccaaagggaatgggacaaaaatggctgaggggctaaaaagcctgagggtggaaggaggtttgaggaaatgaagagcaattccaggggtttttttttttgtttttgtttttgttttgagtcggagtctctctctgtcgcccaggctggagtacagtgacccgatctcaactcactgcaacctccg

SEQ ID NO: 42226 - DNA, 201 bp, Homo sapiens
tgctggcagctttctgtttgatgcactggatgggtaggccccttctctctaggggccttactttcttactccagcaggagtagaattcagtggtataattyctggaccgagacagagctgggttccatttccagcactgctactcaccagctgtgtggtcaagagcaagatacatagcctcactgagcctcagtctcttca

SEQ ID NO: 42227 - DNA, 201 bp, Homo sapiens
tcctctaagatgtttcccttctctggggtccaagccagggcagggcttagtctcactcctgtcttcattccccagggcccagcacggggcctggctccgarcaggtgtttggtgaacctgggtggacttgttctgagttagattcagactgctttgggagtagagcatttgggggccagagttgggagtaggctggactga

SEQ ID NO: 42228 - DNA, 201 bp, Homo sapiens
tgcttctaggggttctctcagcccgaggggctcccgccctgtcccctactctgcaccccttgccttgggagcggctgcagagctctaggggagcgctccgktagggctgagggcaggcgccgggagagcccccaacgacgccgcgccccccgccccgccccctgccccagctcccccccacccccaccgacccagcggccc

SEQ ID NO: 42229 - DNA, 201 bp, Homo sapiens
aagccccctgcagttgggagagggcccagtggtactagctgtgtgccctcaggctggtcacttagcttctctgagattcgttcctgctgtcccagtttctsagagcctctataccagcagcatgaggagggctggtttgtgcctgatgaagggcatcagtaccctcagtgcaattgactatagaagccagagttgctggtt

SEQ ID NO: 42230 - DNA, 201 bp, Homo sapiens
cagagttgggagtaggctggactgagctcttggtgcccactcctacctccccagcttgaccagtgaggtggtccatatgtgtcccaccattggcagcaacrtggaggagatcattctgccgaagacccacttcttcctgtgggacatagtgagacctgaggctctgagctttatctggaacacatactactccaacactga

SEQ ID NO: 42231 - DNA, 201 bp, Homo sapiens
ccgaagcgccccgggcctttcagacacttttctagaatgtgaagggaggtgggggctcagctgtcttttccaccgtcccggagtggggcaggtgtcggagytgggtgggaagcagacgcggtacggtgggcagaggtccccagcctgcggggagcgctatctccttcctgggaggtctggtgggggcacacagtcccttgg

SEQ ID NO: 42232 - DNA, 201 bp, Homo sapiens
ctgcgagtttcctgcgattgtgacttcgcgttatgctctttctctaaacaccgtctcttggcaagccccgaagcgccccgggcctttcagacacttttctrgaatgtgaagggaggtgggggctcagctgtcttttccaccgtcccggagtggggcaggtgtcggagttgggtgggaagcagacgcggtacggtgggcaga

SEQ ID NO: 42233 - DNA, 201 bp, Homo sapiens
tcctgaggccgctgagccctcctgcacctgtccggcccgggaagtgccatgggacagctgatcgccaagttaatgagcatcttcgggaaccagggtaaggrgcgcacagggcatccaagcgagcgctttgatctcgccctcttctgggactcctctgatctgtggtcggacgcacggggggacctcgggctccgagggtcg

SEQ ID NO: 42234 - DNA, 201 bp, Homo sapiens
acaggagttcgagaccagcctggccaacatggcgaaaccccatctctactaaaaaaatataaaaattagctgggcgtggtggcacatgcctgtaatcccasctactctggaggctgaggaaggagaatcacttgaacccgggaggcagaggttgcagtgagctgagactgcgccactgtactccagcctgggcgacaaagg

SEQ ID NO: 42235 - DNA, 201 bp, Homo sapiens
aggaggaaatgcagaagcaaaggcaccatcagaaagagccaggcatgtataggcaggaaccagtagatacagagcctgggagataaacctgtgaaggcagstgggggctgttcgtggaagctcttgaatgtcaagtggagactgatctgaatccagtgagcaatagggagccattgaagatctatgagctgggggagttac

SEQ ID NO: 42236 - DNA, 201 bp, Homo sapiens
agtccctaggccccagcccactagaagccaggatgccccctcaccccgtctcccactctccagcgccccagctccttgccgtcacaagaacgaagtaggtyaggggagggaagaggcatcttcgtgtcctgacctgattccttgccgtctattaaatatcctacattgcgggtatttttattctgtcctggaagaaaaaat

SEQ ID NO: 42237 - DNA, 201 bp, Homo sapiens
catttaccaaagagaaagcctgtctctcacggctcccctctgctgcccagtttatcatccttgtgattgacagcacggaccgggatcggctgctgaccacycgggaggagctatataaaatgctggcccatgaggtaagccccctgcagttgggagagggcccagtggtactagctgtgtgccctcaggctggtcacttag

SEQ ID NO: 42238 - DNA, 201 bp, Homo sapiens
ggatttgaactcagatatatagatgtcaagttctgtggtgcctttgacccccaagttcagtgctaattcccttgtcccaggatgcatcagcttctgcaagsgggggctgggggtttgagaaggaggaagcaggtgtctgagtgtatttgtgccccatgtgccttctgcctgaaattgcatttgcagcccggacacggtggc

SEQ ID NO: 42239 - DNA, 201 bp, Homo sapiens
agtcccttggtcttcgggtttggccctgacgctgcccttcctccgacgcttccagagcacacggtcatcatcgtgggactggacaatgaaggaaagaccaycattctctaccggttgtaagtgactctcgggcggggagggtagagagctgggcctcccaccagactgacaggcagggggaccaatcactggagctcttcc

SEQ ID NO: 42240 - DNA, 201 bp, Homo sapiens
gaacctctttctggcacagatcaccgtgaagaatccttgcccagagacacagctaaggggcccagcaaggtgagtctccaggctccttcctcagagaagcmctccctgactctcaggcatccagaggcctctgtatatttcctttatcacagtatgtaattacagaattatgtgtctgaccatttatttagtatccatctc

SEQ ID NO: 42241 - DNA, 201 bp, Homo sapiens
aatcattgactcactctgacttcagtttcttatctgtaaggaagaggatcattatacctcctagagtttctgtagagtaaatgacaccattcagtacacawatctttcttgagcacctcctttgtgccaggtactgttctaggcactggagaaacagcagcgagcaaaacagacaaaaatccctgccctcacggagcttac

SEQ ID NO: 42242 - DNA, 201 bp, Homo sapiens
ccatttccttactctcagcaccatcaaagaccactcgtggcatatacaaggctgctgtgccctcaccagggaagggttagtggctgccctacctggatctytagggcctggctgaaccaatggatgactgaccatcagaacccttctcctgcctctctcctgtgagaatctggttcacagttggctcctgggccaagccaa

SEQ ID NO: 42243 - DNA, 201 bp, Homo sapiens
agtgagaccctgtttctataaaaagaaaaaaagagataaagtttgaggagcctcctctaagatgtttcccttctctggggtccaagccagggcagggcttrgtctcactcctgtcttcattccccagggcccagcacggggcctggctccgagcaggtgtttggtgaacctgggtggacttgttctgagttagattcagac

SEQ ID NO: 42244 - DNA, 201 bp, Homo sapiens
atcctcagtttccccaagtataaaatgaggaggatcatcaattcccacctatgggattgtcataaagaggctttccttgagctgctgatgttatttgatayggttgctaccattgtggcagggcccccatctctgccccatccaggcatgggcctctcttcctgggacagctggagagggagccagagagcgcctgtgagg

SEQ ID NO: 42245 - DNA, 201 bp, Homo sapiens
tttcattcactgtaggactttggacaagtgacttcacctctctaatcctcagtttccccaagtataaaatgaggaggatcatcaattcccacctatgggaytgtcataaagaggctttccttgagctgctgatgttatttgatacggttgctaccattgtggcagggcccccatctctgccccatccaggcatgggcctct

SEQ ID NO: 42246 - DNA, 201 bp, Homo sapiens
tgagaggctgaagtgggtggatctacctgaggacaggagttcgagaccagcctggccaacatggcgaaaccccatctctactaaaaaaatataaaaattarctgggcgtggtggcacatgcctgtaatcccagctactctggaggctgaggaaggagaatcacttgaacccgggaggcagaggttgcagtgagctgagact

SEQ ID NO: 42247 - DNA, 201 bp, Homo sapiens
ctaactccatctttcattcactgtaggactttggacaagtgacttcacctctctaatcctcagtttccccaagtataaaatgaggaggatcatcaattccyacctatgggattgtcataaagaggctttccttgagctgctgatgttatttgatacggttgctaccattgtggcagggcccccatctctgccccatccagg

SEQ ID NO: 42248 - DNA, 201 bp, Homo sapiens
agaatctcctttgcccaaagggaatgggacaaaaatggctgaggggctaaaaagcctgagggtggaaggaggtttgaggaaatgaagagcaattccagggktttttttttttgtttttgtttttgttttgagtcggagtctctctctgtcgcccaggctggagtacagtgacccgatctcaactcactgcaacctccgcct

SEQ ID NO: 42249 - DNA, 201 bp, Homo sapiens
gtggctcacgcctgtaatcccagcactttgagaggctgaagtgggtggatctacctgaggacaggagttcgagaccagcctggccaacatggcgaaacccyatctctactaaaaaaatataaaaattagctgggcgtggtggcacatgcctgtaatcccagctactctggaggctgaggaaggagaatcacttgaacccgg

SEQ ID NO: 42250 - DNA, 201 bp, Homo sapiens
aatgctggcccatgaggtaagccccctgcagttgggagagggcccagtggtactagctgtgtgccctcaggctggtcacttagcttctctgagattcgttyctgctgtcccagtttctgagagcctctataccagcagcatgaggagggctggtttgtgcctgatgaagggcatcagtaccctcagtgcaattgactatag

SEQ ID NO: 42251 - DNA, 201 bp, Homo sapiens
gggcaggaaacacatttaccaaagagaaagcctgtctctcacggctcccctctgctgcccagtttatcatccttgtgattgacagcacggaccgggatcgkctgctgaccactcgggaggagctatataaaatgctggcccatgaggtaagccccctgcagttgggagagggcccagtggtactagctgtgtgccctcagg

SEQ ID NO: 42252 - DNA, 201 bp, Homo sapiens
ggacgcaaagctgggcgaccctcctttctccccgctaaacggagccagcggcggggatggggggctgctgcgagtttcctgcgattgtgacttcgcgttakgctctttctctaaacaccgtctcttggcaagccccgaagcgccccgggcctttcagacacttttctagaatgtgaagggaggtgggggctcagctgtctt

SEQ ID NO: 42253 - DNA, 201 bp, Homo sapiens
tgaggctgcatgctttcatttctctggggctgacatctgggcagtgcagagaccagtggggaaacaaagagggcaggaaacacatttaccaaagagaaagsctgtctctcacggctcccctctgctgcccagtttatcatccttgtgattgacagcacggaccgggatcggctgctgaccactcgggaggagctatataaa

SEQ ID NO: 42254 - DNA, 201 bp, Homo sapiens
agcgtcccagagggttcccaggtcaggttggtgacgtgtggggcttccctaacttcgtaggcaaaatctgccagaccctcccgggggagcggagctccgartaccagggccgactccgctcctgaggccgctgagccctcctgcacctgtccggcccgggaagtgccatgggacagctgatcgccaagttaatgagcatct

SEQ ID NO: 42255 - DNA, 201 bp, Homo sapiens
aaagtttgaggagcctcctctaagatgtttcccttctctggggtccaagccagggcagggcttagtctcactcctgtcttcattccccagggcccagcacrgggcctggctccgagcaggtgtttggtgaacctgggtggacttgttctgagttagattcagactgctttgggagtagagcatttgggggccagagttggg

SEQ ID NO: 42256 - DNA, 201 bp, Homo sapiens
ggcagatcgcttgagctcaggagtttgagaccatcctgggcaacatgaaaacccatgtctacaagaaatacaaaaattagtagggtgtggttatgtgagcytgtagtcccagctacttgagaggctgaggtgggaggatggcttgagcccaggaagcggaggttgcggtgagccaagttcatactactgcactccagcttg

SEQ ID NO: 42257 - DNA, 201 bp, Homo sapiens
acagcatgacatgtctctgaattttcaggtttaatgtctgtattggcagaaataagaccaaagaatgacttggggcatcctttttgtaataatttgagatstggagattggatgattgactatgtcagtaaccggcttatttcacgatcaggaactattgctgaagtaagtagagctatattatcgtcccaaaaaatcaag

SEQ ID NO: 42258 - DNA, 201 bp, Homo sapiens
agataagaaagcagcatagctgttgcctttattgtgcatgtctttttcctcactgtgactgagcaagttgcatttctgtgagcaattttgcaatctttacwtgtctttttctagaatagtgctgtccaaaataatgtgaaccacatacataattttaaattttatagtacccacattttaaaaagtaaaaagaagcaggtg

SEQ ID NO: 42259 - DNA, 201 bp, Homo sapiens
tgtgcctctaatacgtattcaccccaaatcactagaatagagactagcagaatagggactagaggatataggaacaaattgatgctaccaataatacagcrtgacatgtctctgaattttcaggtttaatgtctgtattggcagaaataagaccaaagaatgacttggggcatcctttttgtaataatttgagatctggag

SEQ ID NO: 42260 - DNA, 201 bp, Homo sapiens
ctgatctgcctttatgttaatagtttgttatatatgattgggggggctgggaggggatagtagctttgtaagctactccagggttagcatatatttgtgtyctcatgatatttatttatatcatgaagtactcaacatttgtccaaaatttttttatttgtcctctgttatcaactgacatttctgttacaatgaatatag

SEQ ID NO: 42261 - DNA, 201 bp, Homo sapiens
gtagtcctagctactcaggaggctaaggcaggagtatcacttgagcccaggagatcaaggctgtagtgagctatgatggcaccactgcactccagcctgcytgacagaatgagacactgtattaaaacacacacacacacacgcacacacacaccaaaactcacaattaaagctgactcttgtgaccagctctccaaaaaa

SEQ ID NO: 42262 - DNA, 201 bp, Homo sapiens
atctcataccactttagatataatttaaccaatatatcatttatggcagaaatgatcaaagcaatttaaaaaccagtgtttccttgaagtaattgttttcrttttatttcttgaaccattgaaagcaatctcttttctgaacaggttcagaagtttacctaaggagagaacttatttgctggggagacagtgttaaattac

SEQ ID NO: 42263 - DNA, 201 bp, Homo sapiens
ccctttgcccttcacggcgcccggccctccttgggctgcggcttctgtgcgaggctgggcagccagcccttccccttctgtttctccccgtcccctccccscgaccgtagcaccagagtcgcgggtcctgcagtgccccagaagccgcacgtataactccctcggcgtaagtgctaggaatgccgctggcctcgcggggaa

SEQ ID NO: 42264 - DNA, 201 bp, Homo sapiens
taacacatgattaaagtcctgtgaactcagtatgtactaatttaaggttagatggatgatgtactaatgccgagcttattctgtagaagacaaaataattrattatttctcttacctttgttattgaaatttttctaatgctttttacataatatctgatcatcttttatttaacttaaatttcaatcattttgcagtgat

SEQ ID NO: 42265 - DNA, 201 bp, Homo sapiens
attttaaataagtatatgtatatatgtattttttaactattgacatttttcagtccatccgaaaaataatttgggaggatatttttccaaagcttaaactytgggaatttttccaagtagatgtcaacaaagcggttgagcaatttagaagacttcttacacaaggtaaaggatacatactagaatgttcctatcgatttt

SEQ ID NO: 42266 - DNA, 201 bp, Homo sapiens
attaatgaagtatatttttacaccttgattagctatttatatttcttccattaattgcctgttaatgtttcttctcatttttctattgagttgtctctttktttatatcgacattattgattattacacaggcctcaaatatatcccctagtatgctcttgatcttttaactcttgtttatggtgacattttttttcaatg

SEQ ID NO: 42267 - DNA, 201 bp, Homo sapiens
tttcatagatattcactcataaaaataataaccatgcttactgtttaattataactgtgcaccaggcatttatgtgtgttttttatggctagctgattctycatgtttctattttttccaactcttgacattctgtgtttttttaaatcaaatttattttactattctcttttctatattttcccccaattttaaaaaata

SEQ ID NO: 42268 - DNA, 201 bp, Homo sapiens
caatagttattttcgatattttaactcctttttgtttcataggggtaactcattcgactgtggagttcttttaattcttatgaaagatttcaaatcctctrgaagccaaaatgggacacagtaaacagattcgaattttacttctgaacgaaatggagaaactggaaaagaccctcttcagacttgaacaaggtcagtagc

SEQ ID NO: 42269 - DNA, 201 bp, Homo sapiens
gaaaaataccttgaatttcagtgattgtgttgatgaatctcggaggaactacttaatgcaagttttgagaattaccaatttaacttttattacaacttctytgctccttacatagcctttcttcatctgagtgcttattatgggtatgaataaatactaagtaaataaatgacttactaaataaatgactgaaactggaaa

SEQ ID NO: 42270 - DNA, 201 bp, Homo sapiens
taattataaaattatgcaaatgtataaaaagcattttttctgtgttttttttttaattaggattatactatctaaacaattttgtaacctgcctttttccygtttgtagtagtattatggtgtatgtactctacctccctgcctactgccatgtttcagccatacttttttccagaagatattttaaaagctctacataaa

SEQ ID NO: 42271 - DNA, 201 bp, Homo sapiens
gattctaaaattatataagggtgctcagctgagtaaatgaagcacaaacaattcatttcagcagcagagcaatgtggttaagattgcatattctgaagagrgacttggccaagttaattcctgactgtatgacttgggctgagttacttaactctctgtgcttcagtttctcttttgttaagggaacataacagtatgtcc

SEQ ID NO: 42272 - DNA, 201 bp, Homo sapiens
aatgtttatttgaatgctgagttcctaaaacatacactgctaagacattttatgattgtaattcagattttcttcttttgtttctattgacaacaagcgawacttcaatatatggttatctttattttccaattcttagtcttgcctccagattaactttggctgagctaaatcagatcctttaccgatgtgaatcagaag

SEQ ID NO: 42273 - DNA, 201 bp, Homo sapiens
ctgcactcctgcactcctgggtgatggagaaagacctttctcaaaaataaatggatgaatgagagcagcattggtatttactcttttttttttttttttttgagacagggtctcattctgtcacccaggctgtagtgcagtggcacaatctcagttcattgcaacctccacttattggggtcaagcagccctcccacctta

SEQ ID NO: 42274 - DNA, 201 bp, Homo sapiens
ccaccacacccagctaatttttgtatttttagtagagacggggtttcaccatgttggccaggatggtctcgatctcttgacctcgtgatctgcctgcctcrgcctcccaaagtactgggattacaggcgtgagccaccgcgcccagccttttaagttacatttctttgcttattaatgaagtatatttttacaccttgatt

SEQ ID NO: 42275 - DNA, 201 bp, Homo sapiens
tgatcaaacacctctcaccaggcccctcctccaacatcggggattacaattcgaatgagatttgggcagggacacaaatccaaaccatatctttttgcctstatgtttaattttgtttcttattatttagtaatataagtagatagaaccatattaaaaaaaaattttttttttttgagacggagtatcaccctgtcacgt

SEQ ID NO: 42276 - DNA, 201 bp, Homo sapiens
cttcaggaagcaaactttgaaagcaatcttgaaaaagaactcctgaggttagaatatttggtagcaccggggaggaaaacgggttccactaaagtccttamagtgtttaaaaaaaaaaaaggtacatgtatacatgtataacaaacctgcaagttgtgcacatgtaccctagaacttaaagtataataaaatatatatata

SEQ ID NO: 42277 - DNA, 201 bp, Homo sapiens
tacaccttccttagccaagattgtatctcattctccatcattaatgtcatagatctttacagttgcccaagtcattcctgttaattcccttctcagcaggytttctcatgcctgtccttatacccgtactcccatcagattcctttatatctgttaaatctcatttactgtcagtctatgtgttgcctaagtttcaacttt

SEQ ID NO: 42278 - DNA, 201 bp, Homo sapiens
tggctgagctaaatcagatcctttaccgatgtgaatcagaagaaaaggaagatggtggagggtgctatgacataccaaactggtcagcccttaaatatgcmggtcttcaaggtaagcaaatagaaggatagctgagctttgtgtttttcttttagggtcatctggtgtcttctttacagacatagatataggctcagagta

SEQ ID NO: 42279 - DNA, 201 bp, Homo sapiens
ctgttgacaatgcagatcctatattaaaaattccttttgcttcgtaagtatgccttgtttggtagagatttgccaccttaataagtaagttaccactagaytgaattaagcagttttaagggtcctctatatccttgctactcaaagtacggtccaaggaccagcagtgtcagcatcacctgttgttaacattttacccta

SEQ ID NO: 42280 - DNA, 201 bp, Homo sapiens
atatgaggacacatatcttgaaagatttaaataaacttgcttaaagtctcttgtggtacagttaggatttgaacccaagtgtttgacctcttttccagtakcatgcttgccttgctatttataattacttaagaaagtttaaatttatattttcttcattttaggctggttttgtttgtttgtttttacagtggtctttcc

SEQ ID NO: 42281 - DNA, 201 bp, Homo sapiens
ggatttgaacccaagtgtttgacctcttttccagtagcatgcttgccttgctatttataattacttaagaaagtttaaatttatattttcttcattttagsctggttttgtttgtttgtttttacagtggtctttcctttatttgctttgcaggctacaacatgattcattttaccccattgcagactcttggactatcta

SEQ ID NO: 42282 - DNA, 201 bp, Homo sapiens
tatatctgcatttctccatctgctctagcaaggggccagcagcaattgaagaatgctgtaattggtttcataaaagaatggaggaattaaattcagagaakcatcgactcattaactatcatcaggaacaggttttacttatttttgaactgctgcttttccttgcatcttactactatttttttgttgtcttgaggatgg

SEQ ID NO: 42283 - DNA, 201 bp, Homo sapiens
ctaataaaacatattgataagaatattgttttatattgtttctatgtattcactgacttattgagttaattgataaagtttctgaaatctacatgtacaawttttctaatttttcatcaattaggagaaaaaattccactattactatgaatgaaatttgcctttaatgatgaatttccctaaaatgaaaccacaaattta

SEQ ID NO: 42284 - DNA, 201 bp, Homo sapiens
gatttcagtggtttctgaagaacggttttacactaagtggaatcctgaagcattgccttcaaacacaggtgaagttaatttccaaagcggcattattgcakccaggtgtgctatcagtaaacttcatcaggagcttggagccaagggttttattcaggcaagaaataattaaatttgtttcttcaggttcaatttcagagt

SEQ ID NO: 42285 - DNA, 201 bp, Homo sapiens
ccagcagggaatttatgaataattatttagtcaaccacctggaaattaagtctgattaaagttttaaaaataagcaagcaggcccaggcacggtggctcaygcctgtaatcccaacacttttaggctcaggcaggcagatcagctgaggttgggagtttgcaaccagcctgaccaacatggagaaaccccatctctactaa

SEQ ID NO: 42286 - DNA, 201 bp, Homo sapiens
ctagtgatattgaagccagatattgacgagataacaaaaggtaacgaagtgagtcttctattaaggacataactaatcaagcagttaatgtgccccccccccaacaaaatagggtaggaaaaaataggtgaaatgagaaagtagggtttgtaggagacaaattagaaaggattattaagagtctatctgcatttcatatag

SEQ ID NO: 42287 - DNA, 201 bp, Homo sapiens
cttctaagattgttacatggcagaaaagaatgttcaaacttaatttacttaattttaaattacaaaatctaggattctacttgttagctaatagagtttcragtattttattaatctttgtgcaaatgttgtgtttaacagtttggaaccaatctgattttttattataaaccagtgtttataataaacagctagatagat

SEQ ID NO: 42288 - DNA, 201 bp, Homo sapiens
gctgtctccagctcctggactcaggtgatactccctcctcagcctcccaaagtgctgagattacaggcgtgagccactgcacctagccccaatatttattytttatacgtgaaaatcctatttggacataagttattactacattttgtcattttgaaaaataccttgaatttcagtgattgtgttgatgaatctcggagg

SEQ ID NO: 42289 - DNA, 201 bp, Homo sapiens
gcaccactgcactcctgcactcctgggtgatggagaaagacctttctcaaaaataaatggatgaatgagagcagcattggtatttactctttttttttttkttttttgagacagggtctcattctgtcacccaggctgtagtgcagtggcacaatctcagttcattgcaacctccacttattggggtcaagcagccctccc

SEQ ID NO: 42290 - DNA, 201 bp, Homo sapiens
aagtaacatcaatgcctcaattatgtatttattttttttctttgagatggagtcttgttctgtcacccaggctggagtgcagtggcacgatctcagctcaytgcaacctccgcctccagggttcaagcgattctcctgcctcagcctcccaagtagccaggactacagaggtgcaccaccatgcccagctaatttttgtag

SEQ ID NO: 42291 - DNA, 201 bp, Homo sapiens
atcctcttcgaaactttgctgaaccgggtatgtaatttttaacttctctgtggatggggaaagaatagttcatggcaaggtcaaaataaaatctgctttaytgattttcttccccattagtctattggtttttaaatatttcaccataaaggtaccagagatacatacaatttgagaaagaaaacatggagccaacaaaaa

SEQ ID NO: 42292 - DNA, 201 bp, Homo sapiens
acattgacataagagatattttcactcattggccagaggtattaagaatttcagtggcaattaaaccagaacctaatggttttaggtcccccctcactctyagtgtcttgtgtttctatagctatttcattaccaggaagaatgttgcaggagcccattgatatatttattttttaacatttcgaaactaggagtctatat

SEQ ID NO: 42293 - DNA, 201 bp, Homo sapiens
gtggcaattaaaccagaacctaatggttttaggtcccccctcactcttagtgtcttgtgtttctatagctatttcattaccaggaagaatgttgcaggagyccattgatatatttattttttaacatttcgaaactaggagtctatattagtgacattaaaatttattcagaaatcttaatgcttttttttaagagtataa

SEQ ID NO: 42294 - DNA, 201 bp, Homo sapiens
atcatactggtatgagcttcattgactgccttcattaattttgatgagaatttatgcacacacacatatacacacaaataagagaaaggaagaaagaaagrgaaaggaaaggggctaacataaattttaaaaacacaaatgatgattaggtgtccttccgtttaaaaaattaatatttttcctttcaaagaaaacattctt

SEQ ID NO: 42295 - DNA, 201 bp, Homo sapiens
aggtcccccctcactcttagtgtcttgtgtttctatagctatttcattaccaggaagaatgttgcaggagcccattgatatatttattttttaacatttcraaactaggagtctatattagtgacattaaaatttattcagaaatcttaatgcttttttttaagagtataaatttgggtgtaagtatctctgccctctttt

SEQ ID NO: 42296 - DNA, 201 bp, Homo sapiens
cacacacatatacacacaaataagagaaaggaagaaagaaagagaaaggaaaggggctaacataaattttaaaaacacaaatgatgattaggtgtccttcygtttaaaaaattaatatttttcctttcaaagaaaacattcttaattgaggattaagtcaatatataagtatcttgcatctgttgcttataaatacaggag

SEQ ID NO: 42297 - DNA, 201 bp, Homo sapiens
gatgttttattttcttagcctttgtaatttttcaacattgaagaagtgtaatatatgaaaaatccagtcccccttattaatgtaccaaatggatgttgctrgtcataaacatttcaaaggaatttttaaatttcgctaatgttttaagaattaaatttttgaaaaaaatttcacacatacaatgtgatatcttcatgccaa

SEQ ID NO: 42298 - DNA, 201 bp, Homo sapiens
ggagtctatattagtgacattaaaatttattcagaaatcttaatgcttttttttaagagtataaatttgggtgtaagtatctctgccctcttttttctagycattctaaacgaaatcaagccattctgctgtatgccatggatctaatacaacctgttgccgaaaataagtaggagggtggagatggagttttaaatgttt

SEQ ID NO: 42299 - DNA, 201 bp, Homo sapiens
taaatttgggtgtaagtatctctgccctcttttttctagccattctaaacgaaatcaagccattctgctgtatgccatggatctaatacaacctgttgccraaaataagtaggagggtggagatggagttttaaatgtttttggtagaactatggttttaaaaggcctatgatattaacatttctgttttcccttatgatg

SEQ ID NO: 42300 - DNA, 201 bp, Homo sapiens
tgtcacccaggctgtagtgcagtggcacaatctcagttcattgcaacctccacttattggggtcaagcagccctcccaccttagcctcctgagtagctggsactttaggcacatgccaccatgctcagctaattttttaaaaattttgtagagatgaggtctcactatgttgcccaggctgtctccagctcctggactcag

SEQ ID NO: 42301 - DNA, 201 bp, Homo sapiens
aatttttagaagagactgtaagctagagttttttcagaatagctatgagaaataaataattattaattttttaaaacattatctcataccactttagatawaatttaaccaatatatcatttatggcagaaatgatcaaagcaatttaaaaaccagtgtttccttgaagtaattgttttcattttatttcttgaaccattg

SEQ ID NO: 42302 - DNA, 201 bp, Homo sapiens
tcgtttattttaaattaaaacaaattatctgtttttaaataggtagatataaggtttcactgtgttgcccaagctggtcttgaactcctgcaggctatccwacctccactcccacaaagtgctggggttgagctaccgtgcctggccaaaacaaattatcttcaatgttgtaaatatttggaatactgtgccaaactcctg

SEQ ID NO: 42303 - DNA, 201 bp, Homo sapiens
accagtgtcacttaggtgttctttggaaatgtgtgcttacctaaaaaatgtctatttctataatattaaagcagtattataatatatatttcaagtcctakgatgaaaaattgatttgatttggagggatttagtgaatattagttaagctggtagaacattgtttagttccaaaaaatgacggctttattttattgtgct

SEQ ID NO: 42304 - DNA, 201 bp, Homo sapiens
ctcttttcttctaatttgtatttttacatttgaatatttaatatacctgaaatttatttttgtgtattatataaagaagatatttaacttgatttgtattyttaaaattatattgagttgaaaatccatccttttatactgatttgaagtaccaccataatacttcatagtgtatggtaatatacaaaatatacatctgtt

SEQ ID NO: 42305 - DNA, 201 bp, Homo sapiens
tatttcacctctaaacttaacatagatacagtttcaatttaattatgagatactcctttgtgtctcctttttccttcagctgctaatagtaaatggatccrggaacatccagaatgtgcctataatcttgtgaattctccacacttaaaacctgcctgggtcttagacagagcactttggcgtttctcctgtgatgttgca

SEQ ID NO: 42306 - DNA, 201 bp, Homo sapiens
aaggaatggaatgttatttgtattactgatgttgtctacaatcatactggtatgagcttcattgactgccttcattaattttgatgagaatttatgcacayacacatatacacacaaataagagaaaggaagaaagaaagagaaaggaaaggggctaacataaattttaaaaacacaaatgatgattaggtgtccttccgt

SEQ ID NO: 42307 - DNA, 201 bp, Homo sapiens
aataaatatttgttttattttcagtgaaaaaattataggccaaaaattagaaaatagtgacagttataatctctttgtagatatttgcatttaaggtatcrtcttttctttcttttagaaaataggcgagtaaccaagtctgatccaaaccaacaccttacgattattcaagatcctgaatacagacggtttggctgtact

SEQ ID NO: 42308 - DNA, 201 bp, Homo sapiens
agataccagaatattttacattttttatattaaccagtatttgttaatcatttttaacacatgattaaagtcctgtgaactcagtatgtactaatttaagkttagatggatgatgtactaatgccgagcttattctgtagaagacaaaataattgattatttctcttacctttgttattgaaatttttctaatgcttttta

SEQ ID NO: 42309 - DNA, 201 bp, Homo sapiens
gtttaacccagtttaccttacaaatgttatcttgtgtgtatgctacaatgtagaaaagtttggaaaccactgatttgcatatgtaaagaacaagaattctrgttggtacaaacatttaaaagatacaatctgctgtttcataaaacagttctccaagtaaccatagaaactatgaagatatttaaaagctcatagatctgg

SEQ ID NO: 42310 - DNA, 201 bp, Homo sapiens
ccgtactgtcttccacagtggctgtgccattttacactcttactaatagtaaacaggcttccattcatctatatcctcaccaatacttgtttttttctgtktttgtttttttggattttgtttttgttgttttggtttttgtttttgttcgtttgtttttgttttttgttttttttgctagtagccatcctaaatggctat

SEQ ID NO: 42311 - DNA, 201 bp, Homo sapiens
gtctaagaattttatagttttaactcttgtgtttaggtctttgatccatattgagttaatttttgcatatgatattaagtccaagtccattttttttttttgcatgtgaatatccagtttactcagctccatttgccaaaaaaaatataaactgtcccttccccaatgaatggtcttggcacccttgtcaaaaaaaatttg

SEQ ID NO: 42312 - DNA, 201 bp, Homo sapiens
tattttctcccatattgtgggttgtctattcactatcttaaaagtatcctttgataaacaaaagtttctgattttgattaagtccaatttatctacttttrttacctgtgcctattgtatcatatgcaaaaaagcctcatcaaattcaatgtcatgaagcttttgccatacatttttgtctaagaattttatagttttaac

SEQ ID NO: 42313 - DNA, 201 bp, Homo sapiens
tctcactgtgttgcccaagctggtcttgaactcctgggctcaagtagtcctcttgccttggcctcccaaagtgctgggattacaggtgcaaaccactgcayctgatctcaatattaattttctgcttttaagttggataatacatgaagaaaggaatgagaagttcactgacataactaaaacagaatacaagtactatgg

SEQ ID NO: 42314 - DNA, 201 bp, Homo sapiens
ctctgtcacccagactggagtgcagtggcctgatctattttttgtagagacaaaagtctcactgtgttgcccaagctggtcttgaactcctgggctcaagyagtcctcttgccttggcctcccaaagtgctgggattacaggtgcaaaccactgcacctgatctcaatattaattttctgcttttaagttggataatacat

SEQ ID NO: 42315 - DNA, 201 bp, Homo sapiens; identical to SEQ ID NO: 9374

SEQ ID NO: 42316 - DNA, 201 bp, Homo sapiens
aggctgcaatggtgcgatctcagctcactacaacctccacctcccgggttcaaacgattttcctgcctcagcctcctgagtagctgggattataggcaccygccaccatgcctcactaatttttgtatttttagtagagacggggtttcaccatgttggccaggctggtctcaaacttctgacctcgtgatctgcccacct

SEQ ID NO: 42317 - DNA, 201 bp, Homo sapiens
caaagataattgggaaaacatgagactggtcatattgatgaatattgtaacatgtgaattgtgatccatttctgatatgtcttgaactactgtgtctagtrggcaaatgtcattgttacctctgtgtgttaagaaaataaaaatattttctaaaggtctgtattttgctttcattcatagtcattgcacccagctaatttt

SEQ ID NO: 42318 - DNA, 201 bp, Homo sapiens
attttgtttcttattatttagtaatataagtagatagaaccatattaaaaaaaaattttttttttttgagacggagtatcaccctgtcacgtaggctgcartggtgcgatctcagctcactacaacctccacctcccgggttcaaacgattttcctgcctcagcctcctgagtagctgggattataggcacctgccaccat

SEQ ID NO: 42319 - DNA, 201 bp, Homo sapiens
acatgtgaattgtgatccatttctgatatgtcttgaactactgtgtctagtgggcaaatgtcattgttacctctgtgtgttaagaaaataaaaatattttytaaaggtctgtattttgctttcattcatagtcattgcacccagctaattttttattttttacttattttttattttgtagagacaggattctacactatg

SEQ ID NO: 42320 - DNA, 201 bp, Homo sapiens
tctatgtttaattttgtttcttattatttagtaatataagtagatagaaccatattaaaaaaaaattttttttttttgagacggagtatcaccctgtcacrtaggctgcaatggtgcgatctcagctcactacaacctccacctcccgggttcaaacgattttcctgcctcagcctcctgagtagctgggattataggcac

SEQ ID NO: 42321 - DNA, 201 bp, Homo sapiens
tagtctatcccttcataattgtagctctaattttaaaatgttttccctaattataaaattatgcaaatgtataaaaagcattttttctgtgttttttttttaattaggattatactatctaaacaattttgtaacctgcctttttcccgtttgtagtagtattatggtgtatgtactctacctccctgcctactgccatgt

SEQ ID NO: 42322 - DNA, 201 bp, Homo sapiens
tttctaacagaggtaacacccattatgtctcaaacaggatcagccattgtttgaagtcatacaggaagcaatgcaaaaacacatgcagggcatacagttcygagaaaggaatgctggtccccagatagatcgaaacatgaaggacgaaggtacagaactttaactaaaatagtacaaatttatcaaggtgatgaaattaaa

SEQ ID NO: 42323 - DNA, 201 bp, Homo sapiens
tggatggggaaagaatagttcatggcaaggtcaaaataaaatctgctttactgattttcttccccattagtctattggtttttaaatatttcaccataaakgtaccagagatacatacaatttgagaaagaaaacatggagccaacaaaaaaagaagttcatcttctgtcctctcctttgccttcctaccttttatcttct

SEQ ID NO: 42324 - DNA, 201 bp, Homo sapiens
gcccaactttacagggaaaagcagttaccgtgtatacaaattacccatttcctggagaaacatttaatagagaaaaattccgttctctggattgggaaaayccaacagaaagagaagatgattctgataaatactgtaaacttaatctgcaacaatctggttcatttcagtattatttccttcaagggtaagtcaggtgtt

SEQ ID NO: 42325 - DNA, 201 bp, Homo sapiens
ttttattaatctttgtgcaaatgttgtgtttaacagtttggaaccaatctgattttttattataaaccagtgtttataataaacagctagatagatagcamcagtgttaaacgtaaatcacacaagtggaaattgtaaggtgtaagagtttttaagagttatttatcatcatctgtaggagaaactggcttcagtctggtc

SEQ ID NO: 42326 - DNA, 201 bp, Homo sapiens
ttggatattttgtgtattatacatgtaattatgtagattgtgaaagggtaaaagtagcttttccattaagttttgttgcaacttttaaaatgattttatgygcttagaaataaatacattttatttgggacaattaaccttttagttagagtcagactatattatatgaggattttttttctatcactgactgaaaagttt

SEQ ID NO: 42327 - DNA, 201 bp, Homo sapiens
gattcattacaattgtttaccgaatgccctttaaatagtacttaaaggacgccaacttaaagaataaaaatacgttttttaattttagagatgggtctgcygtggaaattgtgggcctgagtaaatctgctgttcgctggttgctggaattatccaaaaaaaatattttcccttatcatgaagtcacagtaaaaagacatg

SEQ ID NO: 42328 - DNA, 201 bp, Homo sapiens
agtaaacaggcttccattcatctatatcctcaccaatacttgtttttttctgtgtttgtttttttggattttgtttttgttgttttggtttttgtttttgktcgtttgtttttgttttttgttttttttgctagtagccatcctaaatggctatgaggtggtatctaatggttttgatttgcatttccttaatgatttctt

SEQ ID NO: 42329 - DNA, 201 bp, Homo sapiens
tgtggacgtacttgagaaaaagaatttaaactttttggtaacttggccaggtatgatggctcacaccagtaatcccaacacctcaggaggctgaggcaggmagatcacttgagctcaggagttcaagaccagtctcagcattatggtaacaccctgtctctatcaaaaaaaaagtacaaaaaattagatgggcatggtggc

SEQ ID NO: 42330 - DNA, 201 bp, Homo sapiens
aggcctcaagaaacttacagtcatggcagaaggcaaaggggaagcaggcatgtcttacatggccagagaaggaggaagagaacaaagtgggaggtgctacrtgcttttaaacaaccagatcttgtgaaaactcactcactatcatgagaacaagggggaaatccacctctgtgatcaaacacctctcaccaggcccctcct

SEQ ID NO: 42331 - DNA, 201 bp, Homo sapiens
atattcactatccttatctgatctttgctaatatacgtattcagttttataggacaacaatcactgtgtacaatattatctcaggttttgttttggtcacrgatcattcttaaaacatttccacttcagtccgcaaaattgtgatttttattttgttaaatgttcgtacgttctgttattatgcccttttaaatattctat

SEQ ID NO: 42332 - DNA, 201 bp, Homo sapiens
ttggtgcatataccactcttctggatacagcatggaagcagatgtcaaggtatatccaacaaagcttgaataaatgggcatatctgtgttgaaactatatrcagagtcacttcatacatgttcttaaaaaaccaaaccataaagaattgtcatagaactgaaaaggcttgtaggtggatagtaaatttattagcatccttt

SEQ ID NO: 42333 - DNA, 201 bp, Homo sapiens
tccaagagtttccatcattagcaatactgagtatatattattataacgtagtgtttaagggcatggagtatagaaccagactaactggatttgaattccawtgcagactcttattagctataagaagtaagacctggctgagtgcagtggctcactcctataatctcagcactttggtaggccaaggtgggaggattgctt

SEQ ID NO: 42334 - DNA, 201 bp, Homo sapiens
tattcttaataaagtagttgcattcttaaccaaaaaatctgtgatgaagcagctttgtgtttggatggactgcttgtaaaatgcatgttcctcctcagacmtgctcagattattttggagcaaggccaagaaatttgcagttttataagatccccaggtaatttttaggcaaggagtccactggctattgaaaaatattgt

SEQ ID NO: 42335 - DNA, 201 bp, Homo sapiens
ggtttttgattttttggttattgacttgtagaagtttcttatatattctggatattaaccccttatcatacatatgagaatttcatttctttttaaggctraataatattccattgtatgtatataccacattttgtgtttccattcatttgtcaatggacatttgggttttttccaccttttggctattgggaataatgc

SEQ ID NO: 42336 - DNA, 201 bp, Homo sapiens
tcctttttgtttcataggggtaactcattcgactgtggagttcttttaattcttatgaaagatttcaaatcctctagaagccaaaatgggacacagtaaayagattcgaattttacttctgaacgaaatggagaaactggaaaagaccctcttcagacttgaacaaggtcagtagcaagttgttttgatttgctcatttgc

SEQ ID NO: 42337 - DNA, 201 bp, Homo sapiens
ttcttctcttgataaattctcttgtttctatgtgttttggtatgtttgatatcttgctgcatatttttctatgtcaaatcatgcctccttttgtctctttscttcctcctatcttgcttttctctttctgttacatttatttgttacatttgtcactgtgctttttacagtacatgttggatgctgctaggaatttgcaac

SEQ ID NO: 42338 - DNA, 201 bp, Homo sapiens
tgtgattttgactactttagatacttcatatgagtgaaatcatgcagtatttgttcttttgtgactgattttttccacttagcataatgccaaggttcatycatctcatagcatgtgacaggattcccttctttttcaaggctgcataatattccattgtatgcatacattttctttattcattcattgtcagtgggcatt

SEQ ID NO: 42339 - DNA, 201 bp, Homo sapiens
aataaaccagaggactgtccttatctctgggcacacatgaaaaaatacactgaaataactgcaacttatttccagggagtacgtcttgataactgccactsaacacctcttcacgtagctgaggtacagaaaaacaatttatctacattaagaaaagaaattcagtgttccttcctagctttccttaagtaaactatgcag

SEQ ID NO: 42340 - DNA, 201 bp, Homo sapiens
gcgtatgatgctcttccaagtactacaattgtttctatggcatgttgtgctagtggaagtacaagaggctatgatgaattagtgcctcatcaggtttgttyatatgttgtttcttaaaacctacatggccaacaactttgggcatttttattaaaaaaaattcattgtaattaagatgtatccatgctaaattttaccttt

SEQ ID NO: 42341 - DNA, 201 bp, Homo sapiens
atttcaatcattttgcagtgatatggtttactgtggaatttatgacaatgcattagacaatgacaactacaatcttgctaaaggtttcaattatcaccaasgacctgtaagaatttcatttatcttctgagtttcagtttaaattatttttcaagtaatttttaggtatttatggttttttttgtcttttaaataatcttt

SEQ ID NO: 42342 - DNA, 201 bp, Homo sapiens
acagaggctttattgtatttgtaaagtttaagtgaggaagtagaacttgggtttttaatttttttttgtatccgaaatattccaagttttaaaaaaatgtmagcctttcaagtgatttgcttttctctgctcaaaattaggaagttgttccctagagctaagctattattttgatacgtttctacttcaaaaaaagctttg

SEQ ID NO: 42343 - DNA, 201 bp, Homo sapiens
gatttgccaccttaataagtaagttaccactagactgaattaagcagttttaagggtcctctatatccttgctactcaaagtacggtccaaggaccagcartgtcagcatcacctgttgttaacattttaccctattgttttataatttgtgtgtgtacctgcatgtgtattctctctatagatatagatacacacatgcc

SEQ ID NO: 42344 - DNA, 201 bp, Homo sapiens
catcattttttaaaaatgtcaacatattattctactttatggctttaccataatttatttaaacaatttccatttttggacatctagattgcttctaattrttccctattatttatgtctttgtacattcatctttacatgaatccttagttattccctttctagatgtttctgcatactacagaagaatataggttttga

SEQ ID NO: 42345 - DNA, 201 bp, Homo sapiens
tatccatatatttgaggctgttaatacatactgccaaattttctccagaaagattataataattaatactttcagctctatccaagagtttccatcattascaatactgagtatatattattataacgtagtgtttaagggcatggagtatagaaccagactaactggatttgaattccattgcagactcttattagctat

SEQ ID NO: 42346 - DNA, 201 bp, Homo sapiens
tctatatcctcaccaatacttgtttttttctgtgtttgtttttttggattttgtttttgttgttttggtttttgtttttgttcgtttgtttttgttttttkttttttttgctagtagccatcctaaatggctatgaggtggtatctaatggttttgatttgcatttccttaatgatttcttagtgatgttgagcatctctt

SEQ ID NO: 42347 - DNA, 201 bp, Homo sapiens
tgttaatacatactgccaaattttctccagaaagattataataattaatactttcagctctatccaagagtttccatcattagcaatactgagtatatatyattataacgtagtgtttaagggcatggagtatagaaccagactaactggatttgaattccattgcagactcttattagctataagaagtaagacctggct

SEQ ID NO: 42348 - DNA, 201 bp, Homo sapiens
aaatactgttttggagattttagatgagttttaacctttgctctgcaagttctctgaatacttgtgtaattataaaaacagtatttgtataaacttaacaggggacaggttgtacacatatacccagacagctaatctctgctgtttgtacttgttcaaaatgacactatttctcctaaagataaatttagtcattcttgt

SEQ ID NO: 42349 - DNA, 201 bp, Homo sapiens
tcaagtgcccagtttccagaatgtatcctacagatgattctgctcctttgcctgctggcacactggtaaagatatttcttaaaatgtttttttgttttttkttttttttctgaaaaatgacttttagtttctaatgtaaaaataagggtaattaagaatccaaatcttacgaattattcaaatgtcagtattgatttggca

SEQ ID NO: 42350 - DNA, 201 bp, Homo sapiens
ctttcagctctatccaagagtttccatcattagcaatactgagtatatattattataacgtagtgtttaagggcatggagtatagaaccagactaactggrtttgaattccattgcagactcttattagctataagaagtaagacctggctgagtgcagtggctcactcctataatctcagcactttggtaggccaaggtg

SEQ ID NO: 42351 - DNA, 201 bp, Homo sapiens
caaatactgttttggagattttagatgagttttaacctttgctctgcaagttctctgaatacttgtgtaattataaaaacagtatttgtataaacttaacaggggacaggttgtacacatatacccagacagctaatctctgctgtttgtacttgttcaaaatgacactatttctcctaaagataaatttagtcattcttg

SEQ ID NO: 42352 - DNA, 201 bp, Homo sapiens
tttaccgatgtgaatcagaagaaaaggaagatggtggagggtgctatgacataccaaactggtcagcccttaaatatgcaggtcttcaaggtaagcaaatrgaaggatagctgagctttgtgtttttcttttagggtcatctggtgtcttctttacagacatagatataggctcagagtatgcctacttgggttgcaatta

SEQ ID NO: 42353 - DNA, 201 bp, Homo sapiens
tcttcacttcccagtaggggcggccgggcagaggcgcccctcacctcccggacggggtcgcagccgggcagaggcgctcctcacatcccagacggggcggygggacaaaggcgctccccacatctcagacgatgggcggccgggcagagacgctcctcacttcctagatgggatggcggccgggaagaggtgctcctcact

SEQ ID NO: 42354 - DNA, 201 bp, Homo sapiens
atttttaaaagatgtatgtatgttatcagatttgagtaattatctacttcattttcactctgagttgttaaactacttctagttcactacaaagaccaaayttgtgtgtgctctttttctagcctttgtctttcttatagttaagtttggttctttgctaattctccttatctttctaatgaaatgattcttcttatcttt

SEQ ID NO: 42355 - DNA, 201 bp, Homo sapiens
tatgcctttgtaacttggctcaagccagtattgtcatacttatctccaactgtattaagcagtgttgtggactgggtagcccttgtgtgtgcctctaataygtattcaccccaaatcactagaatagagactagcagaatagggactagaggatataggaacaaattgatgctaccaataatacagcatgacatgtctctg

SEQ ID NO: 42356 - DNA, 201 bp, Homo sapiens
acattttaatatttgttttttatttcagtcatcaaatatttataggtatatattatatacagttacaattttcaatgaatacatacttgttggtgaacaargtagatgaggtttctactcataggtcttatttcctactgggaagatatatgcattcaacagatagcaaacaagataattttcagatagcgttaagtgctt

SEQ ID NO: 42357 - DNA, 201 bp, Homo sapiens
cctccttccttctttccttccttcttccctttcttttcttttcttgtatttatttatttatttatttatttttattgatcattcttgggtgtttctcgcaragggggatttggcagggtcataagacaatagtggagggaaggtcagcagataaacaagtgaacagaggtctctggttttcctaggcaaaggaccctgcgg

SEQ ID NO: 42358 - DNA, 201 bp, Homo sapiens
accggtaaatgtatccaaatgttataaatgagaatgtgccacctttttttgcagtaatggtgtgatcattttgttttagaagataatttgaagccgggtgyggtggctcacgcctgtaatcctagcactttgggaggccgaggcgggcggatcacgaggtcaggagatcgagactatcctggctaacatagtgaaaccccg

SEQ ID NO: 42359 - DNA, 201 bp, Homo sapiens
ctttattttattgtgcttttagcaatagcaaaaagaaatatgcttctaagattgttacatggcagaaaagaatgttcaaacttaatttacttaattttaarttacaaaatctaggattctacttgttagctaatagagtttcaagtattttattaatctttgtgcaaatgttgtgtttaacagtttggaaccaatctgatt

SEQ ID NO: 42360 - DNA, 201 bp, Homo sapiens
gctcacacacttggcggactgaggcaggaggatcacttcagcccaggagtttgagaccagcctggatatcataatgaagccccaccaccatatttgaaaaraaaagaaaagaaaatgatatttgtatagcacaataggttacatggagtaggctgcttgtgctagatccaactacttcagttagccccaggccccacccag

SEQ ID NO: 42361 - DNA, 201 bp, Homo sapiens
tcctaccttttccaactgccatcttcttttattccacaattcccattctacatcatagaattttttaaaattatgtgaggatgatagacaatggcaaaacygtgagaggaaaaaatctttacatgatatagtacacattcctatagagtaaggattttttaatagttttcataatatgttatatgattcattacaattgtt

SEQ ID NO: 42362 - DNA, 201 bp, Homo sapiens
atggaatctgacctactgtaggctctctgatgtttcatttactgtatataaaaattttagtttcagtgatttgcattagaggtctacagagtggctatgtrtcccttggggtatgcgctgatatatctattgggctacagaaagaaaatataacatcccttccttccttcctccctccctccctccctccctccctccctc

SEQ ID NO: 42363 - DNA, 201 bp, Homo sapiens
tccagcaggctgctaataagagcctcagattaaatcagatttaactactttgttgacctgtctttcccttaaacaaaatgtatttccctccttataatacrgtatatctagtcatgttggaatccaggaatccattttggatctgctcctttcatcctcagtatccaatcagtcattatgatttgtggattcttttccatg

SEQ ID NO: 42364 - DNA, 201 bp, Homo sapiens
catcagatctgtttctaaaacactgttttccttatgtccttccattattcaacagtgagaccaacatttaccgagcattatctgctgtccatgaaaatgcyagggcatatgtagaatattattttatagtcttgtttcccaacatctttatgttttaagctttcttccccagagaagattgtgagccccttgagggaaaga

SEQ ID NO: 42365 - DNA, 201 bp, Homo sapiens
aaatcaaggacataataataaatattaccatgttatatataatatttacattgttttctaacctgaaccattttcctccttccttcatcatctttcagttrtaataaatggaaatcgggtttatagattactagataaagttgcacatttagatttacctctaaaaacacacctagtctgtacacataccaaattaacttt

SEQ ID NO: 42366 - DNA, 201 bp, Homo sapiens
tattttatagtcttgtttcccaacatctttatgttttaagctttcttccccagagaagattgtgagccccttgagggaaagaactttatcttaaatttatrtagtttttagtttctcaaaacatgctacatacctagtaaaattcatgcaattctaaatagataaataaatttagtctaaatgaagtcagtgatgccaata

SEQ ID NO: 42367 - DNA, 201 bp, Homo sapiens
ataataaatggaaatcgggtttatagattactagataaagttgcacatttagatttacctctaaaaacacacctagtctgtacacataccaaattaacttwcaaatttattttaattacaggttggtaaatggttgcaggctatgttcttctacctgaagcagatcccacgttaccttatcccatgttactttgatgctat

SEQ ID NO: 42368 - DNA, 201 bp, Homo sapiens
tgatgccaatataatttttaaggtagcatcattgaaataataaaatctgggaaattctaatgcttctaattgaagactagaaggattaagaaaaaaaaaawatatatatatatacctcattttgatacttcacttagttctaagtacctcctgttaaattttaacaattccttccaaagcatgctttattcttattatctc

SEQ ID NO: 42369 - DNA, 201 bp, Homo sapiens
gcttgactcacaaactagctctggggagggaggctgatatggagagaacaaagcacagatgacaatgattttctaaattgagccagaactaaatgggaaaraaagatacacattcaagaggatatgtgttcacataaaatggcagtcatgtaaaatgaaattacctgagcatctattatagaagcacaagaaaatacagtt

SEQ ID NO: 42370 - DNA, 201 bp, Homo sapiens
ggagagaacaaagcacagatgacaatgattttctaaattgagccagaactaaatgggaaagaaagatacacattcaagaggatatgtgttcacataaaatrgcagtcatgtaaaatgaaattacctgagcatctattatagaagcacaagaaaatacagtttcagctgtattcaggtgtggtcagttatacagtcttactg

SEQ ID NO: 42371 - DNA, 201 bp, Homo sapiens
attaatgccaaattgtattatagaaaaagtacatttagttgcttagagaagaaattcttagtttcactatagagcattctcttagtgtcttttactgaaawcttttgttcacagaaaatatccctgttagtatatcctcttttattactttgttggatgtttaataagtcaaggattataaattataaataatatatatta

SEQ ID NO: 42372 - DNA, 201 bp, Homo sapiens
ttgtaacttggctcaagccagtattgtcatacttatctccaactgtattaagcagtgttgtggactgggtagcccttgtgtgtgcctctaatacgtattcmccccaaatcactagaatagagactagcagaatagggactagaggatataggaacaaattgatgctaccaataatacagcatgacatgtctctgaattttc

SEQ ID NO: 42373 - DNA, 201 bp, Homo sapiens
ttcagacttgaacaaggtcagtagcaagttgttttgatttgctcatttgcgtcttttaaacttttaattcattggcagtcctgttaaatgttttaaagctytaagataaatattatttccaagggtctaaaacttgatttgtgcaaagatggtgctgtgttctccatatatcactaattaatgttgatttgaattaaaaat

SEQ ID NO: 42374 - DNA, 201 bp, Homo sapiens
ttaagaaacaggctttaaaaccagatttcctgggttacattgactagttttataacctgaagtaaatgctctatggcttacttttcccctgcaaaatggtrcctaccacagggattatggttaggattaatgaattaatacatgtgaacagctcattagacgacacctaattcatactaagtaattggaaattgttagcct

SEQ ID NO: 42375 - DNA, 201 bp, Homo sapiens
catgaaaactttagatccagagtaagttggaatataagtattaagaatgttatcatatttaatccaaatacattgacatcaaccataatttttttttttttgccagggcaacaaaaggagatgccatctctacaaaaataaaagttaaaaaaaaaattagttgggagagattgtgtacacctgtagtcctagctactcagg

SEQ ID NO: 42376 - DNA, 201 bp, Homo sapiens; identical to SEQ ID NO: 9381

SEQ ID NO: 42377 - DNA, 201 bp, Homo sapiens; identical to SEQ ID NO: 9385

SEQ ID NO: 42378 - DNA, 201 bp, Homo sapiens; identical to SEQ ID NO: 9386

SEQ ID NO: 42379 - DNA, 201 bp, Homo sapiens
tgtgttttttttgttaggcttacctcatttttcttctggtattttccgctgctggggaagggatacttttattgcacttagaggtatactgctgattactrgacgctatgtagaagccaggtaggagagcctctaaagtgttgtactgcgagtttatgtctgaatgtcttttacatgctcttcaaactttccttcttgtcc

SEQ ID NO: 42380 - DNA, 201 bp, Homo sapiens; identical to SEQ ID NO: 9388

SEQ ID NO: 42381 - DNA, 201 bp, Homo sapiens
tcttcaatgttgtaaatatttggaatactgtgccaaactcctgattctgattctgaactataagctacattcgtattccttgagcgtatttattttagcaytttctcaacctcgcttttatccaacttatcaaaacaacgtatttcattaacactttaggatgagccatacaaaagtgttacctatgagagagttgctttt

SEQ ID NO: 42382 - DNA, 201 bp, Homo sapiens
ccagaactttgtcatcattcctaattgaagcaggaactcctcattatctccttccccagcccctggaaccactatcctactttctgcctctataaattcarttatcctagggacctcatataagcggaatcatacagtctttgcccttttgtacctggcttatttcacttagcataattattttttatcaatacataagag

SEQ ID NO: 42383 - DNA, 201 bp, Homo sapiens
agccgggcatggtggtgggcgcctgtaatcccagctactccagaggctgaggcaggagaatcacttgaacccaggaggtggaggttacagtgagccgagaytgtgccactgtactccagcctgggtgacaaagcaagactctgtctcaaaaaaagggaaaaatttaaattagctgtgtgtgttggcatacacttgtcgtcc

SEQ ID NO: 42384 - DNA, 201 bp, Homo sapiens
aaaatacaaaaattagccgggcatggtggtgggcgcctgtaatcccagctactccagaggctgaggcaggagaatcacttgaacccaggaggtggaggttrcagtgagccgagactgtgccactgtactccagcctgggtgacaaagcaagactctgtctcaaaaaaagggaaaaatttaaattagctgtgtgtgttggca

SEQ ID NO: 42385 - DNA, 201 bp, Homo sapiens
gtgagatgtaaatgtttatgcttctcagtcactaagtattttacttcatgttttaattctttctgtaattatttcttagtctatcccttcataattgtagstctaattttaaaatgttttccctaattataaaattatgcaaatgtataaaaagcattttttctgtgttttttttttaattaggattatactatctaaaca

SEQ ID NO: 42386 - DNA, 201 bp, Homo sapiens
acaatggttgaactagttaacagtccccccaacagtgtaaaagtgttcctatttctccacatcctctccagcacctgttgtttcctgactttttaatgatygccattctaactggtgtgagatggtatctcattgtggttttgatttgcatttctctgatggccagtgatgatgagcattttttcatgtgtctgttggctg

SEQ ID NO: 42387 - DNA, 201 bp, Homo sapiens; identical to SEQ ID NO: 9489

SEQ ID NO: 42388 - DNA, 201 bp, Homo sapiens
cacctcctttgtgaagtctttccctaatttttcactgtctgcttcctttgatttccaattacacaatgagcacagaactattaagtgctgaataatgaagyagtgtctaaaggcttgttagtcttacagtgtcagactagggtttaaaatctgtgagaattgatgagggcaggtgactcacacttgtaatctcagtgcttt

SEQ ID NO: 42389 - DNA, 201 bp, Homo sapiens
tctttttcaaacatttcttggcagtgttcttttttttttttttttttgagacagagtttcactcttgtcgcctaggctaaagtgcagtggtgtaatctccrctcaccacaacctccgcttcctgggttcaagcgattctcctgcctcagcctcccgagtagctgggattacaggcatgtgccaccacacccagctaattct

SEQ ID NO: 42390 - DNA, 201 bp, Homo sapiens
gtatttttaaaattatattgagttgaaaatccatccttttatactgatttgaagtaccaccataatacttcatagtgtatggtaatatacaaaatatacakctgttatctgtgctcttccactgatccgtctcttttattctatcaatactaaagattattagtttatactgatggcatagctttttctctttttcaaaca

SEQ ID NO: 42391 - DNA, 201 bp, Homo sapiens
attttgtttttttgttcgtgtttttataagtcatttcaaagtctctttagaataagccagacacaaattaattagttaatataaaatcaagttcaatggargcaatcctgtaccagttcttaattttattacaaacaagttccagaaaaagagtgaaaatttccccaaaaaccatttatttcctttttaatttttaagtta

SEQ ID NO: 42392 - DNA, 201 bp, Homo sapiens
aaacaagttccagaaaaagagtgaaaatttccccaaaaaccatttatttcctttttaatttttaagttattatctaaggaatatggttgatgaaaagggaraaaaagtattaaacctgtgtgcttcttttagagaattcaaagaaagtcaggttgttaataagacttcaggaagcaaactttgaaagcaatcttgaaaaag

SEQ ID NO: 42393 - DNA, 201 bp, Homo sapiens
agagtgaaaatttccccaaaaaccatttatttcctttttaatttttaagttattatctaaggaatatggttgatgaaaagggaaaaaaagtattaaacctktgtgcttcttttagagaattcaaagaaagtcaggttgttaataagacttcaggaagcaaactttgaaagcaatcttgaaaaagaactcctgaggttagaa

SEQ ID NO: 42394 - DNA, 201 bp, Homo sapiens
tattatctaaggaatatggttgatgaaaagggaaaaaaagtattaaacctgtgtgcttcttttagagaattcaaagaaagtcaggttgttaataagacttyaggaagcaaactttgaaagcaatcttgaaaaagaactcctgaggttagaatatttggtagcaccggggaggaaaacgggttccactaaagtccttaaagt

SEQ ID NO: 42395 - DNA, 201 bp, Homo sapiens; identical to SEQ ID NO: 9377

SEQ ID NO: 42396 - DNA, 201 bp, Homo sapiens
ccatgttttggccaggctggacattgtggttttaatttgcatttccctaatggctaatggtatggaatatcttttcatgtgctcattggccatccatcttycctctttgctgaaatgtcggttcacgtattttgcacattgtctctttctttattattttttagagacagggtcccactctgtcactgagactggatggca

SEQ ID NO: 42397 - DNA, 201 bp, Homo sapiens
ttacaccagttccaagctatttctcagtgtttaattctatttttctccctttctatatttgtaattcccttttccaacaatgaataacctacttcccacaytgggccatcaccaccacatagagtctgctcacccagcttgggcctgctaccccacagtaagccacctctatgtgtggagccctcctggcaccacttggat

SEQ ID NO: 42398 - DNA, 201 bp, Homo sapiens
agatgaggcttcgccatgttttggccaggctggacattgtggttttaatttgcatttccctaatggctaatggtatggaatatcttttcatgtgctcattkgccatccatcttccctctttgctgaaatgtcggttcacgtattttgcacattgtctctttctttattattttttagagacagggtcccactctgtcactg

SEQ ID NO: 42399 - DNA, 201 bp, Homo sapiens
acagtttgatcctttctggtcttgattttaagcttgttagacctgaccagaatagcatttggtctaggaataattattctccattagtgaatcaagacccrtctgtgttccctaccctgtatttcgaaaattatgacgttttcaaatctggctggtgggaacaagcaagtgttcctgacgctgtatgagtgccacatactg

SEQ ID NO: 42400 - DNA, 201 bp, Homo sapiens
tagaccactacaaactgtgtgtggtgggggggtgggtctgagatggagtcttgctctgtcccccagctggagtgcagtggcgcaatctcagctcactgcamtctctgcctcctgggttcaaacgattcttgtacctcagcctcccaagtagctggactacaggtgcatgccaccacaactagctaattttttgtatttgtt

SEQ ID NO: 42401 - DNA, 201 bp, Homo sapiens
agctgctcaagaggctaaggcaggatgatcgcttgagcccaggagattgaggctgcactgagctctgatctcgccactgcaccccagcctggtgacagagygagaccctgtctccaaaggggttaaaataaaagtgtgttctgccttcagtgtagctgtggcaacttccttttggagctgagtaactttcttgaggtgaca

SEQ ID NO: 42402 - DNA, 201 bp, Homo sapiens
aagaactttatcttaaatttatatagtttttagtttctcaaaacatgctacatacctagtaaaattcatgcaattctaaatagataaataaatttagtctwaatgaagtcagtgatgccaatataatttttaaggtagcatcattgaaataataaaatctgggaaattctaatgcttctaattgaagactagaaggattaa

SEQ ID NO: 42403 - DNA, 201 bp, Homo sapiens
cattaaaattaatgcatattcttggtcaacaatgcttttctcttctttctctgtatctctgataaatttactcatgctattggagtaaaagttctgtgttwatttatggccccagaagcaaacaatgggtatcagatgtacttaaagaaagctattatgaatctgctgaagaatgagttacataaatttaagtgtgtgctg

SEQ ID NO: 42404 - DNA, 201 bp, Homo sapiens
tttatcattgtgattaagaaacaggctttaaaaccagatttcctgggttacattgactagttttataacctgaagtaaatgctctatggcttacttttccmctgcaaaatggtacctaccacagggattatggttaggattaatgaattaatacatgtgaacagctcattagacgacacctaattcatactaagtaattgg

SEQ ID NO: 42405 - DNA, 201 bp, Homo sapiens
tggggtattttccaaagtcattatggatcctcaaatttgagagtttccctttagctcataatttacccccattacctgtgtatgcagatgagtaaaaatarcaatgccaatttaaaattcagatgctggataacaagctaggttcgtttattagctgaagagatcactctgatagaaactgtagaagctcactagatttgt

SEQ ID NO: 42406 - DNA, 201 bp, Homo sapiens; identical to SEQ ID NO: 9501

SEQ ID NO: 42407 - DNA, 201 bp, Homo sapiens
catttctgatccacttaattctgttgttttaggaatattattttagcatttgcgggtaccctgaggcatggtctcattcctaatctactgggtgaaggaawttatgccagatacaattgtcgggatgctgtgtggtggtggctgcagtgtatccaggattactgtaaaatggttccaaatggtctagacattctcaagtgc

SEQ ID NO: 42408 - DNA, 201 bp, Homo sapiens
tgtccggcaaagaattttagactctctgctgttttaaatctatactttagtctaaaaataaactacaaggaagtaaaatagagaaggtatgtgttcttctrtgcctggctagctgttttcacgttgtcaaaaagagtaccaaacctactactataaattatagtagaatgaaaagtgtaaaagtacacaaaggtagctttg

SEQ ID NO: 42409 - DNA, 201 bp, Homo sapiens
tcttaatctgagaaaaatcctggtttcttgaataaacaagctgaggggcagtgcaaccttagagaagagaaaggaagggacttggagagaaatatgaaggyagagagcatgtgatttcctaggcaattaactttgactttttattcctttagtcatcctctgataagtatttttagtatacaataactagcataaaaagtt

SEQ ID NO: 42410 - DNA, 201 bp, Homo sapiens
gggagaaagtgacagagctagaaacagaggaatcccagccacaccaaggtagtgtaaatgttataatgctgtgtaattatacccttctttaagaaagcacwtacttgtggaatcttttattctgttaactatgaactctttacattaagtcaatcaaaatttccctgccttcttcccttcatctccccattatacatttac

SEQ ID NO: 42411 - DNA, 201 bp, Homo sapiens
atttgcaggtgcctgccttgtaccccaggtttagagtaactgttctatagtaatggagttcataggtttgtgtgtattattatgattaacatattactttrttgtgttttttttgttaggcttacctcatttttcttctggtattttccgctgctggggaagggatacttttattgcacttagaggtatactgctgattac

SEQ ID NO: 42412 - DNA, 201 bp, Homo sapiens
catactatgactactttctacatgaaaatataaagaaatagggcaagagagaaaacgcattcaaaatatagtcaccaaaagtgactggtttttgtcttcartttttaagtgtttgttttcatttctgatccacttaattctgttgttttaggaatattattttagcatttgcgggtaccctgaggcatggtctcattccta

SEQ ID NO: 42413 - DNA, 201 bp, Homo sapiens
gataaaatgggagaaagtgacagagctagaaacagaggaatcccagccacaccaaggtagtgtaaatgttataatgctgtgtaattatacccttctttaaraaagcacttacttgtggaatcttttattctgttaactatgaactctttacattaagtcaatcaaaatttccctgccttcttcccttcatctccccattat

SEQ ID NO: 42414 - DNA, 201 bp, Homo sapiens
tcagttgagcccaggaggtctaggctgcaatgagccatgattgtgccactgctctccagcctgggcaacagagcaagaccctgtctctagaaaaaaaaaaagagatctttgagaatttataatagacataattatagcacctttcttacagattacttgagtaaaacacaatagtttttgacacatagtgattgataagtg

SEQ ID NO: 42415 - DNA, 201 bp, Homo sapiens
tgccataaattataaacacttaaaatcttaatggcttttcacaaataaaatttatttcttgcttgtagtcgtagacgcatgctcagtaagcagccttctayatactgattcagggaagcaggtttcttccagcttgaggatctgtcagtttccatggcttctggggcctctccaggaggcaagcagagagggaaagagagc

SEQ ID NO: 42416 - DNA, 201 bp, Homo sapiens
tattcagtgtactataatatatactataatcaataatttatgttttgagattatacacagatattagatataccagtattatctatgattaaacttttacraaaaagttatcttactatatatgtccttttgcaacttgttttattcaatcattttgttttggagatttatcttttttatataaatttaaggggtacaagg

SEQ ID NO: 42417 - DNA, 201 bp, Homo sapiens
accccaaggccacctactactgccaggttgggtgtggaagttcatactccccagattcccctcgtggtgcccgcaggtaccacgctgctgaggaaggggarcactgccttaagccatctgctacccccaggtaggggataggagtccaggcttccactcagtctccactgacattccagggagaaaggacatccatggtgt

SEQ ID NO: 42418 - DNA, 201 bp, Homo sapiens
tacttctcaggtacgatataaaacaaataaaaactaaaaaattaagttgataaacaaatacaaatagaagtgtgatatttgctcctagcatcccaagggartgttttgcctattccatacttgtaaaaaataggactgtattcagatttgcagataggttttttggggttcattttaaactgattggggatgtcttccttt

SEQ ID NO: 42419 - DNA, 201 bp, Homo sapiens
accaggcatttatgtgtgttttttatggctagctgattcttcatgtttctattttttccaactcttgacattctgtgtttttttaaatcaaatttattttrctattctcttttctatattttcccccaattttaaaaaataaacccaatcttgtaattatcaagaggtcatgtaagggtccctataaattataaaacaaaa

SEQ ID NO: 42420 - DNA, 201 bp, Homo sapiens
gttaaatttgaataaattactcctaaaaattaaccactttttaattaacattttcagagttagtcttgatccacatgcacaagtcgctgttggaattcttygaaatcatctgacacaattcagtcctcactttaaatctggcagcctagctgttgacaatgcagatcctatattaaaaattccttttgcttcgtaagtatg

SEQ ID NO: 42421 - DNA, 201 bp, Homo sapiens
ccagtttccagaatgtatcctacagatgattctgctcctttgcctgctggcacactggtaaagatatttcttaaaatgtttttttgtttttttttttttttctgaaaaatgacttttagtttctaatgtaaaaataagggtaattaagaatccaaatcttacgaattattcaaatgtcagtattgatttggcacctgctgg

SEQ ID NO: 42422 - DNA, 201 bp, Homo sapiens
cccagtttccagaatgtatcctacagatgattctgctcctttgcctgctggcacactggtaaagatatttcttaaaatgtttttttgtttttttttttttttctgaaaaatgacttttagtttctaatgtaaaaataagggtaattaagaatccaaatcttacgaattattcaaatgtcagtattgatttggcacctgctg

SEQ ID NO: 42423 - DNA, 201 bp, Homo sapiens
cttaattctgttgttttaggaatattattttagcatttgcgggtaccctgaggcatggtctcattcctaatctactgggtgaaggaatttatgccagatasaattgtcgggatgctgtgtggtggtggctgcagtgtatccaggattactgtaaaatggttccaaatggtctagacattctcaagtgcccagtttccagaa

SEQ ID NO: 42424 - DNA, 201 bp, Homo sapiens
gctggtctcaaactcctgacctcaggtgttccgcccgcctcggcctcccaaaatgctgagattacaggtgtgagccactatgcccagccagtttgttttcytatatgtttgttttactcttggtttctgctatttaaaataattaagttcttgtttaatagttacttcgattttgaaataccatagacttcaaaagtagaa

SEQ ID NO: 42425 - DNA, 201 bp, Homo sapiens
tctctctctctctctttctctctctctttctctctctctctctttccctccctccctccctccctctctccttccttccttcctttctttctttccttctttctttcttttctttcttttttttgagactgagtctcgctctgccatccaggctggagtgccgtggcgcaatctccgctcactgcaagctccgcctccctg

SEQ ID NO: 42426 - DNA, 201 bp, Homo sapiens
aaaaatctctaatcataatggcaaagttaggtaaagaaataggtacattctaaaatttggtgtttctgcatgtacctagaaaccaagcctccagttctacrgtgaaaacttcataatacctaagaactcagtattcttcatttgaaaatttgacattattaagccaggtgctgtggcttgcacctgtaatcccagctgctt

SEQ ID NO: 42427 - DNA, 201 bp, Homo sapiens
ctctctctctctctctttctctctctctttctctctctctctctttccctccctccctccctccctctctccttccttccttcctttctttctttccttctttctttcttttctttcttttttttgagactgagtctcgctctgccatccaggctggagtgccgtggcgcaatctccgctcactgcaagctccgcctccct

SEQ ID NO: 42428 - DNA, 201 bp, Homo sapiens
ttcttacaaaagattagataggcattcctggactaggatggtagttcagtggtgatagggaactagtttctctcatgttgctctgcagtctccaacacttwgcttcaaattcttagtcagatatggctattccagctcctgctaccacattctccccagtggaaatgaggaaagggcaggcatgtctttttgggtatgata

SEQ ID NO: 42429 - DNA, 201 bp, Homo sapiens
tctctctctctctctctttctctctctctttctctctctctctctttccctccctccctccctccctctctccttccttccttcctttctttctttccttctttctttcttttctttcttttttttgagactgagtctcgctctgccatccaggctggagtgccgtggcgcaatctccgctcactgcaagctccgcctccc

SEQ ID NO: 42430 - DNA, 201 bp, Homo sapiens
ttctctctctctctctctctttctctctctctttctctctctctctctttccctccctccctccctccctctctccttccttccttcctttctttctttccttctttctttcttttctttcttttttttgagactgagtctcgctctgccatccaggctggagtgccgtggcgcaatctccgctcactgcaagctccgcct

SEQ ID NO: 42431 - DNA, 201 bp, Homo sapiens
cttccttgagatgcaaatagaatattctttgatttctaggaggtaattttatggtccattgcagagctaaagtatcaagtaaatgtattttaagtaacatmttaaaatgtagtaatttcatgcaacctgattataggttgctgtttatttgcgtgcccttgttattactgataggttttagtatacttatatttcattaaa

SEQ ID NO: 42432 - DNA, 201 bp, Homo sapiens
tgcatataccagtatttatttaaccattcatccaaaccattcatccattgaaggacatttgggttgttttcatgttttggctaatacgagtaaagctactrtgaacattcatgtacaagtttttgtgtgacacataagttttcattttttctgggataaatgtccaagaatgggattggttcatatagtaagtatatgttt

SEQ ID NO: 42433 - DNA, 201 bp, Homo sapiens
atcaaaaaaaaagtacaaaaaattagatgggcatggtggcacatgcctgtagtcttggctactcctgaagctgaggtgggaggatcgcttgagcccagcasgcagtggttacactgagtccagatcccaccactgcactctactgggtgatagagtgagaccctatctcaaaaaaaaagaaatttttggcaacttatattt

SEQ ID NO: 42434 - DNA, 201 bp, Homo sapiens
agtttgaaagataattttggtggtttcatttataactataataatcgccatgaactgcatgcttactattgctaggcattgtggtaactactttacctatrttattaccatttaacactccccaaaacattgagaatgagtgatattgtttccattttttttaattattatactttaaattctagggtacaggtgcacaac

SEQ ID NO: 42435 - DNA, 201 bp, Homo sapiens
tgtcggatttgggggaaaataagaaaaatgtaatttctaacagaggtaacacccattatgtctcaaacaggatcagccattgtttgaagtcatacaggaarcaatgcaaaaacacatgcagggcatacagttccgagaaaggaatgctggtccccagatagatcgaaacatgaaggacgaaggtacagaactttaactaaa

SEQ ID NO: 42436 - DNA, 201 bp, Homo sapiens
gttgttgtcagtttatttcatttcaataaatgaggctgtgataaatatccttatacataatctctgtttacatcactgatacttttctcaaaaaatctatrtaaaattcctagatcaaaaaatataaacattcttaatatattaatgccaaattgtattatagaaaaagtacatttagttgcttagagaagaaattcttag

SEQ ID NO: 42437 - DNA, 201 bp, Homo sapiens
atgctgagattacaggtgtgagccactatgcccagccagtttgttttcctatatgtttgttttactcttggtttctgctatttaaaataattaagttcttrtttaatagttacttcgattttgaaataccatagacttcaaaagtagaatctggagctatgagggaccttaaaaatcacccagtccaatctcaaatgaaaa

SEQ ID NO: 42438 - DNA, 201 bp, Homo sapiens
ctcatcagttattattgcccattattaattgaaagttatattcgtgtttaaaatttatatgtattatatttctaatagacttgaccatagtcagtattttygtattctaataattataaagaaggtttaaagtctgctttaaaccaaccaaaatgtttctttcacagtacagttttaactgtaatgtgcttatttgttttc

SEQ ID NO: 42439 - DNA, 201 bp, Homo sapiens
tgaagtttgaaagcactgctctaaaagataaaactttcagcaaaagggcatttatacgataccttgttttgatgccatcaggaaaataactgaagtttgcrtctttacatgccaaaattttatttttgatacttttaaaactgaagtttttaggtgggcatctgaaatgaattgcatttttgttaatccgatatatagtaa

SEQ ID NO: 42440 - DNA, 201 bp, Homo sapiens
agtcaaattctttcacttttcgatctacattttaatatttgttttttatttcagtcatcaaatatttataggtatatattatatacagttacaattttcartgaatacatacttgttggtgaacaaggtagatgaggtttctactcataggtcttatttcctactgggaagatatatgcattcaacagatagcaaacaaga

SEQ ID NO: 42441 - DNA, 201 bp, Homo sapiens
cctgttctaataattgacaaattagaaatcacttagaagatatggaatctattagttgtgtactcttagaggtcaaaaagttaatacaaacatttccatayatagtgctagagattttatagttttgactttttcacaaagacagaccgcatatatttttggatataccgattcagactcacctttgaatctacctgtatt

SEQ ID NO: 42442 - DNA, 201 bp, Homo sapiens
catctggctccttactttgtaagtgacataaagcataggttgggcaactagagtgcagtaaaagcctttgcatatctttacttagagtcttttttaaaaatatctttgcaaagtaacatcaatgcctcaattatgtatttattttttttctttgagatggagtcttgttctgtcacccaggctggagtgcagtggcacgat

SEQ ID NO: 42443 - DNA, 201 bp, Homo sapiens
gtaccttataggttaaatgagatcacaaaagaaaaggagcaatgttgtgtttctctagctgcaggtaaggaattatgtacaaggttaaaatatgtaaatcratagtattcgcggaagaaaagttataggaaaatgattattttttaaaagcttgtaatgctactcaagattttattttaccacttagtacatttcatagat

SEQ ID NO: 42444 - DNA, 201 bp, Homo sapiens
ttttgttttgttttttcccttagaaatgagaaaagtggtggaggttacatagttgtggaccccattttacgtgttggtgctgataatcatgtgctaccctwggactgtgttactcttcagacatttttagctaagtgtttgggaccttttgatgaatgggaaagcagacttagggttgcaaaagaatcaggtaatgtcagc

SEQ ID NO: 42445 - DNA, 201 bp, Homo sapiens
tttgtatgttcacttaataggatcataaaatttcaaaggggtgaaaatctttgaagtcactaagttctagtccttcatattacaagtcaggttatctttarcattagctaatttatttcaacaaaactaaaaatgttataacctttttatgccttccatagtgaaggcattgctagttctttgtctgagtcttgtagaagt

SEQ ID NO: 42446 - DNA, 201 bp, Homo sapiens
aaagcaatcttgaaaaagaactcctgaggttagaatatttggtagcaccggggaggaaaacgggttccactaaagtccttaaagtgtttaaaaaaaaaaaaggtacatgtatacatgtataacaaacctgcaagttgtgcacatgtaccctagaacttaaagtataataaaatatatatataaaaaaataaaaaaagaata

SEQ ID NO: 42447 - DNA, 201 bp, Homo sapiens
ctgcatttctccatctgctctagcaaggggccagcagcaattgaagaatgctgtaattggtttcataaaagaatggaggaattaaattcagagaagcatcractcattaactatcatcaggaacaggttttacttatttttgaactgctgcttttccttgcatcttactactatttttttgttgtcttgaggatggtgatg

SEQ ID NO: 42448 - DNA, 201 bp, Homo sapiens
ctgtcttcaaccagtttttaaactggttgaattatgtttttcaaggtcagcttctaccagtttgttttctttctctctctctctctctctttctctctctytttctctctctctctctttccctccctccctccctccctctctccttccttccttcctttctttctttccttctttctttcttttctttcttttttttga

SEQ ID NO: 42449 - DNA, 201 bp, Homo sapiens
tatatatttcaagtcctatgatgaaaaattgatttgatttggagggatttagtgaatattagttaagctggtagaacattgtttagttccaaaaaatgacrgctttattttattgtgcttttagcaatagcaaaaagaaatatgcttctaagattgttacatggcagaaaagaatgttcaaacttaatttacttaatttta

SEQ ID NO: 42450 - DNA, 201 bp, Homo sapiens
acatgcagggcatacagttccgagaaaggaatgctggtccccagatagatcgaaacatgaaggacgaaggtacagaactttaactaaaatagtacaaattyatcaaggtgatgaaattaaaccttgcaattgttcacttagtaaatatttgtgtgccaaacctcacgatataatgattaaaaagattaacatagttcctga

SEQ ID NO: 42451 - DNA, 201 bp, Homo sapiens
tctagacttaaaatggttttttttgtttttgttttttgttttttgtttttgagacagagtctcgcactgtcgtccgggctggagtgcagcggcacagtctyggctcactgcaacctccgactccgcctcccgggttgaagccattctgctgcctcagcctcctgagtagctgagattacaggcgcccgccaccacgcccag

SEQ ID NO: 42452 - DNA, 201 bp, Homo sapiens
tttagcaaactgagtcatggaatctgacctactgtaggctctctgatgtttcatttactgtatataaaaattttagtttcagtgatttgcattagaggtcwacagagtggctatgtatcccttggggtatgcgctgatatatctattgggctacagaaagaaaatataacatcccttccttccttcctccctccctccctc

SEQ ID NO: 42453 - DNA, 201 bp, Homo sapiens
ataccataaccaaagaaaaaacttttcctgtaacagtatcatcgtaaaattgatgtccaatatagaaaaaaatgagtggtagatctttatattttatttcrcctctaaacttaacatagatacagtttcaatttaattatgagatactcctttgtgtctcctttttccttcagctgctaatagtaaatggatccaggaaca

SEQ ID NO: 42454 - DNA, 201 bp, Homo sapiens
gtttttatcatttcaaatgctaaatacatcatcataagctattaaaatcacttttaatattactatcacccaaataacgtactttgtacccattaagtaatgtctattaaaatagcttctgatactgtattaagctgagaagttattttcttattctaatttttttttttgaaagagagagcctcactctgttgcccagcc

SEQ ID NO: 42455 - DNA, 201 bp, Homo sapiens
ctaaggtatgtttttttaaaaataacctaacttgggcaaaagtagaaatgcattggctctcaggattacaagacagctttagtaactaaaccatgaagcayagggatataggcagtagtgtgttggaggtgcttttgctggctcacaagagctgattgtgcacatcccttcccacttccacgttcaatgttgtcgtgttgg

SEQ ID NO: 42456 - DNA, 201 bp, Homo sapiens
agtttttatcatttcaaatgctaaatacatcatcataagctattaaaatcacttttaatattactatcacccaaataacgtactttgtacccattaagtaatgtctattaaaatagcttctgatactgtattaagctgagaagttattttcttattctaatttttttttttgaaagagagagcctcactctgttgcccagc

SEQ ID NO: 42457 - DNA, 201 bp, Homo sapiens
agaaatgcattggctctcaggattacaagacagctttagtaactaaaccatgaagcacagggatataggcagtagtgtgttggaggtgcttttgctggctyacaagagctgattgtgcacatcccttcccacttccacgttcaatgttgtcgtgttggtagcttaagattgcccatgtcgggattatttccaccagaaagt

SEQ ID NO: 42458 - DNA, 201 bp, Homo sapiens
tttaagtaacatgacaaactctcatgccatcctgctctatcccacctggaatgtgactcatccttttgtccagtgcatccatgctgtaaatactacctgtmcaccagttacttaatagcctgctcagttatcagataaaaaaacacaaaatatcaaaatatatatatatatagggtttcatactatctatagttttacaca

SEQ ID NO: 42459 - DNA, 201 bp, Homo sapiens
ttcaacctttgtgaaacacctttcattgggttcagttcaactgtgtggagtaggaaaattcccttccctgccaattctttcacctgccctaatggatgtaycttataggttaaatgagatcacaaaagaaaaggagcaatgttgtgtttctctagctgcaggtaaggaattatgtacaaggttaaaatatgtaaatcgata

SEQ ID NO: 42460 - DNA, 201 bp, Homo sapiens
ggaagcagatgtcaaggtatatccaacaaagcttgaataaatgggcatatctgtgttgaaactatatacagagtcacttcatacatgttcttaaaaaaccmaaccataaagaattgtcatagaactgaaaaggcttgtaggtggatagtaaatttattagcatcctttagtctgtgtagcatacaaaaacaaacttgaata

SEQ ID NO: 42461 - DNA, 201 bp, Homo sapiens
ttgggtatgatatgatatatattactgtgttcatattgcatcacaggaatttgtctcttgccatacctaccttaaaggagacctgcagcgtagtcttgagwttgtcagctatgtgtaaagttgaaccttgggaattttattactaaagaaagaaagggaggataaaactgagtacagcagcagtctctaccacagactgta

SEQ ID NO: 42462 - DNA, 201 bp, Homo sapiens
aaagttgaaccttgggaattttattactaaagaaagaaagggaggataaaactgagtacagcagcagtctctaccacagactgtatttctgagacatttgrgagattctgtgcaatgtaaaagaagtaaaccttgccacagccttacttgaaaagtgttgcaaatcgtaatatcctttctgtgaaacaagttttcttttat

SEQ ID NO: 42463 - DNA, 201 bp, Homo sapiens
cttggtgattgaaccaagacctgctccattatcttacacaaatgcctctgttatggaagctgtatcacaggtgctccactcctggtaggtgtggccaagarggagacattctctcctcccaactcccagcctggggttatagtttcatgctaagaggcacagtctatgagtgtttttaattctccctgccggccctgtctt

SEQ ID NO: 42464 - DNA, 201 bp, Homo sapiens
gggaggaggagcgagcgttgggtgcggtggccgctgcgttggcagccctgtccctgagcggaacgcaggtcgtctctgggaggaggagcgagggttggackcagtggccgctgcggtggcagccctgtccccaggcgtggactctgccctcagcttcacagtcaccgaagaaatgaagttacaggaggggcacaccgtcct

SEQ ID NO: 42465 - DNA, 201 bp, Homo sapiens
ccttatcttgttttctgctaaatcatggaggtttggggagttccttctccacttgtttgtggaggcctggggagttttttcagacccccagtaaaacttgyttaatcctaaacgggtcctggtctcgtcatgcttcaaggcccaagaaagccctgggcaaaactcttgatgggcttttgttacgtcccagccctcgtgtga

SEQ ID NO: 42466 - DNA, 201 bp, Homo sapiens
tttccagagcttacacaccttctaagctctgtgtctccgtgtcagtgtgcattcgtctaaagacgtacgtgattcaattcttctcatctctaactgaggtytggtcctgaagatcttcctctgaagactcagtaaatttacttgatctaaatgggcccaggtgtttacccttatcttgttttctgctaaatcatggaggtt

SEQ ID NO: 42467 - DNA, 201 bp, Homo sapiens
gttgccttggagaccgtgttgggtgtggtgccagagggcagctgtgggtacccctctttgtcattcacagggagggacagagcctccctgcctggcaggaygtgatccctggctgccaggggctcagcgggtaaagggggtgcactcgccgggaccagccgatgcctggggcacccaggaaacgcagctactctgcagcat

SEQ ID NO: 42468 - DNA, 201 bp, Homo sapiens
ttgctcattcccgaggcccgatagcgagatgcagatgaactggggaagaagagggattttatttctgtaactggttacagggagaaggcctggaaatgatygccagaccaactccagattacagtttttccagagcttacacaccttctaagctctgtgtctccgtgtcagtgtgcattcgtctaaagacgtacgtgattc

SEQ ID NO: 42469 - DNA, 201 bp, Homo sapiens
gccgggggctccgtgcgggtgagtgagtggccgggggctctgtgtgggtgtagtggccggatctgctggggctgcacaccccgggatggggcgggggtggyggcggcaggcagatgcccgaggtagagatgagcaaaccaggctcagcgatcctgggtgccctgcggggggctgtgcccaggtccctggacgtcctggtca

SEQ ID NO: 42470 - DNA, 201 bp, Homo sapiens
aacccccaaaatctgagacaggtctcggttaatttagaaagcttactttgccaagggtgaggacgcgcacccatgacccagcctcaggaggtcctgatgaygtgtgcccaaggtggtcagggcacagtctggctttatacattgtagggagacatgagacatcagtccgcatatgcaggacgaacattggttcggtctgga

SEQ ID NO: 42471 - DNA, 201 bp, Homo sapiens
aagggaaagtggcccgggaggagcccacgtgccaacaacaggagtcccagaagacagaaaagaccacagatgagaaagcagttcacgcagagaacaaaacrttcccggaccaaacccagggtcgggttgctcattcccgaggcccgatagcgagatgcagatgaactggggaagaagagggattttatttctgtaactggt

SEQ ID NO: 42472 - DNA, 201 bp, Homo sapiens
acgagggtggggagtgggggatgctggaccacagggcagcacctgcccggcaggatgcgcgtgcctgtgagccccgggactccccagggtcctgggcactkgggctgtggatcctcggaggaactcagagtggttcccctgaatttcccggccctggcgacgaggtgctggtcccagagacaggtgcaggcacaggcagtg

SEQ ID NO: 42473 - DNA, 201 bp, Homo sapiens
cctcaagaacatcccgttcctgggggcgtagaggggccgggccggggacgaggcctcctgcggacaccagctcctctctccgccgtcaccggggaggccgrggatccttgcagggcttctggggcgttgggaaacccaggcccgccggccacggctctaaaatgaagagggcggagaccccagtgaagagcaccccccgca

SEQ ID NO: 42474 - DNA, 201 bp, Homo sapiens
tccttgagcgggtgtggccagggcgcgcctcctccccgcgggtgggccaccctggcctgggcccgcggtccgcagcccgcctctctgtcgccacacaggtkcagaaagtcatgcccaacgacaccttctacttctccatcctgaggaaccccgtgttccagctggagtcctccttcatctactacaaaacctacgcccccg

SEQ ID NO: 42475 - DNA, 201 bp, Homo sapiens
aagtcttcaaaataatgtttgcaatttttttcatttgtttgccccaccccccatttttctgttttcttttcttttctttctttcttttttttttttttctsagatggagttttgctcttgtcgcccaggctggagtgcagtggcatgatctcggctcactgcaacctctgcctcctgggttcaagcaattctcctccctca

SEQ ID NO: 42476 - DNA, 201 bp, Homo sapiens
ccggcacccagtgggtttgaggacaagacgttacagaggtgaggggaggcccagacctgtgtggcccaaggcctggacttggctgcaggatgggaggtggrggtggggctggcacgacccggactgggcactcatggcctgccctttccacagatacttccgggtcatcctcctcctcctcctggccctgactctgctcct

SEQ ID NO: 42477 - DNA, 201 bp, Homo sapiens
tttctacagagagatggcacaactgctcacaagaccagggttctagccggagcccaggtcgagctcagctccacgacccctgctggtcagcccctgatgcytcgtgaaggagaggagtctcacttgccaaaggaggctggagtggttgggggtacacacacccttggttgccttggagaccgtgttgggtgtggtgccaga

SEQ ID NO: 42478 - DNA, 201 bp, Homo sapiens; identical to SEQ ID NO: 9598

SEQ ID NO: 42479 - DNA, 201 bp, Homo sapiens
tttcgctgcaggaggtttggttctgatggaaggatgttttctacagagagatggcacaactgctcacaagaccagggttctagccggagcccaggtcgagytcagctccacgacccctgctggtcagcccctgatgcctcgtgaaggagaggagtctcacttgccaaaggaggctggagtggttgggggtacacacaccct

SEQ ID NO: 42480 - DNA, 201 bp, Homo sapiens; identical to SEQ ID NO: 9600

SEQ ID NO: 42481 - DNA, 201 bp, Homo sapiens
cttctcatctctaactgaggtctggtcctgaagatcttcctctgaagactcagtaaatttacttgatctaaatgggcccaggtgtttacccttatcttgtyttctgctaaatcatggaggtttggggagttccttctccacttgtttgtggaggcctggggagttttttcagacccccagtaaaacttgtttaatcctaaa

SEQ ID NO: 42482 - DNA, 201 bp, Homo sapiens
gggcaggcacaggtgttttagggtcaccctgagcgctctgtggagaatggccagcagaggctaggtgaccaggcggggccagagggaggccgggtggggaraggtgatgggcagagagcggggcagcgggggtgtgctgtggggtgggggctgcggggcagagggaggaggaggggccgggaggaggggaaaggaagaggg

SEQ ID NO: 42483 - DNA, 201 bp, Homo sapiens; identical to SEQ ID NO: 9605

SEQ ID NO: 42484 - DNA, 201 bp, Homo sapiens
cctctgggaggtcaactgcggcctcacagctgggcctgtcccagcacagcccttgttggagggcgcacccccgtctcctcagcaccccagtgttgagtgcmttgacctgcagaggggagcctgtgctggtcccgggcgtctgtgtggctcctgggtgcccatctgcacccctggccctgctctgggcttcagtggagccgt

SEQ ID NO: 42485 - DNA, 201 bp, Homo sapiens
tgccacggtagtttactgcacctattagcccgtcatctaggtttcaagccccgcatgcattaggtatttgtcctaatgctttccttccccttacaccccayccccgacaggccctgggatgcgctgttcccctctctgtgtccacgtgttctcattgttcaagtcccacttatgagtgagaacatgcggtgtttggttttc

SEQ ID NO: 42486 - DNA, 201 bp, Homo sapiens
ggggccgaggcggtgggacctcgggggagctcaagcctcgactgtcccctcgctggaggccagaggccaagatgatgtccatgctgggcggcttgcagagrtaaggggggcagttggaccccccaggtggacaaagcgcttcatctgtggctattctgagagacggacaggagtgggttttgtttgtctttcgaaggaagt

SEQ ID NO: 42487 - DNA, 201 bp, Homo sapiens
cacttctgctggccctgttctggggcagggagggcgcctgctactccagccccactgggtgggtgtcatgatgggattctaggagtgggcccagccctacrtctggccgctggtctcggctttggggtccttccttttcctggtgtgaagggacaagaagcactgcacgtgtggctgaggtcacaaagccagctgcatgtg

SEQ ID NO: 42488 - DNA, 201 bp, Homo sapiens
cgtgtatgtatgtactgtgtatgcgtgtgtatgtgtatgcatgtgtattatatgtacatattgtgtatgtgtgtgtatatgtatgtgtgtattgtgtttatatgtatgtgtgtatatgtatgtatgtgtatatgtgtgcgtatatgtgtatgtatgtatatgtgtatatgtgtgtgtattgtgtgtgtacatattgtgttt

SEQ ID NO: 42489 - DNA, 201 bp, Homo sapiens
gctgtcacaacagacaccacagacaggctggccccagcagcagacatgtgcttctcaccgttctggaggccggaaggcatgcgatctcgagccagcatggsgggttcctggggagggccctcctcctggcctgcagatgccactttctctctgtgcccctatatggggagcgagggtggggagtggaagctgcactctggt

SEQ ID NO: 42490 - DNA, 201 bp, Homo sapiens
gtgtatgtatgtactgtgtatgcgtgtgtatgtgtatgcatgtgtattatatgtacatattgtgtatgtgtgtgtatatgtatgtgtgtattgtgtttatatgtatgtgtgtatatgtatgtatgtgtatatgtgtgcgtatatgtgtatgtatgtatatgtgtatatgtgtgtgtattgtgtgtgtacatattgtgtttg

SEQ ID NO: 42491 - DNA, 201 bp, Homo sapiens
cactggcttgttgtgctcctatgtaccctgtaaagccccatgcaaaggccccagtccaagcaggaagctcaccccttgtgtcctctccagatgctgagctygccgagtgcaggtgtggtgtctggttccctcgtagcctgtgcctgacctgcactgagacgctacggcccacgtggcaaccccccatcactgaggggacac

SEQ ID NO: 42492 - DNA, 201 bp, Homo sapiens
tgtatgtatgtactgtgtatgcgtgtgtatgtgtatgcatgtgtattatatgtacatattgtgtatgtgtgtgtatatgtatgtgtgtattgtgtttatatgtatgtgtgtatatgtatgtatgtgtatatgtgtgcgtatatgtgtatgtatgtatatgtgtatatgtgtgtgtattgtgtgtgtacatattgtgtttgt

SEQ ID NO: 42493 - DNA, 201 bp, Homo sapiens
gagggctgccccgtttgctgttagcatgcacctggccgccctggcgcagccatccttgaaacactctgacagcaatgttttaagaatgtagagatggggtytcactgtattgcccaggctggcctcaaactcctaggctcaagcaattctcccacttccgcctcccaaaatgttagggtcacaggcgtgagctgccgcgcc

SEQ ID NO: 42494 - DNA, 201 bp, Homo sapiens
gtatgtatgtactgtgtatgcgtgtgtatgtgtatgcatgtgtattatatgtacatattgtgtatgtgtgtgtatatgtatgtgtgtattgtgtttatatgtatgtgtgtatatgtatgtatgtgtatatgtgtgcgtatatgtgtatgtatgtatatgtgtatatgtgtgtgtattgtgtgtgtacatattgtgtttgtg

SEQ ID NO: 42495 - DNA, 201 bp, Homo sapiens
ctgcctgatcaggaaccatcagccccaccaacctgcccagagctggaaagccagaccttctgggcgctcccagtgaggcagcaggtcagtggcctccaagycccgaggctccaacagcaggaagtttgaggctctttgggaacgactgagctactctggcaacccccagagcaaaggcagcagggcctggccgcagtcccc

SEQ ID NO: 42496 - DNA, 201 bp, Homo sapiens
tgtaacaaattagcttcgtatggtggtgggtgcctgtaatcctagctacttcgaggctgaggcagaagaatcgcttgaacccgggaggcagaggttgcagtgagccgagattgtgccactgcactccagcctgggcaacaaaagtgaaactccatctccaaaaaaaaaaacccacacaaaaaaagtttaatctcaattttt

SEQ ID NO: 42497 - DNA, 201 bp, Homo sapiens
tagctatggatcattaaacaaatattaatgtcttcttttttttttttttttgagatggagtcttgctctcttgcccaggctggagtgcagtggtgcaatckcagctcactgcaacctccgtctcccgggttcatgccattctccagcctcagcctcccgagtagctgggactacaggtgctcaccaccacgcccggttaat

SEQ ID NO: 42498 - DNA, 201 bp, Homo sapiens
ctctaaaatgaagagggcggagaccccagtgaagagcaccccccgcaatccgcgcagatccctcccagagaaggccctgagcccaggcggcagccacccgccccccttccgaggctgtgtctctgtttagaactgaacacgagggtggggagtgggggatgctggaccacagggcagcacctgcccggcaggatgcgcgtg

SEQ ID NO: 42499 - DNA, 201 bp, Homo sapiens
aactgcggcctcacagctgggcctgtcccagcacagcccttgttggagggcgcacccccgtctcctcagcaccccagtgttgagtgcattgacctgcagasgggagcctgtgctggtcccgggcgtctgtgtggctcctgggtgcccatctgcacccctggccctgctctgggcttcagtggagccgtgccaccgtgggag

SEQ ID NO: 42500 - DNA, 201 bp, Homo sapiens
ctgcttcccgcttgggcacaattgccctttgagagcagagccaggggcttcttggggacggaagctgctctcagaagccgcgcactggtggtgggggagcrgcaggaaggggccggccagctgtcctagccaagagcctttcaggaaccggtggcccagggcagaggtggctggaggtggagctgtctgtttgggcctcag

SEQ ID NO: 42501 - DNA, 201 bp, Homo sapiens
tggggagcccagagccggcaggggccgaggcggtgggacctcgggggagctcaagcctcgactgtcccctcgctggaggccagaggccaagatgatgtccwtgctgggcggcttgcagaggtaaggggggcagttggaccccccaggtggacaaagcgcttcatctgtggctattctgagagacggacaggagtgggtttt

SEQ ID NO: 42502 - DNA, 201 bp, Homo sapiens; identical to SEQ ID NO: 9604

SEQ ID NO: 42503 - DNA, 201 bp, Homo sapiens
tacccctggctcttcctggcgcgctacgtggaaggcgtggggtcgcagcagcgcttcaacatcatgtgcaaccacctgaggttcaacctgcctcaggtacygcgggcctgctggggaggagggcgggctgcagccgtgcctgtggctgtgggtctgggtggtgtagcctggaggctggagagaaggagtgtaaggcttggg

SEQ ID NO: 42504 - DNA, 201 bp, Homo sapiens
gtgagccaggtatgtaattttaatttttttctttttcttttttttttttcagagacaggatctcgctctatcacccaggctggagtacagtggcacaaatmgtagctcactgtaacctcaagcttaggctcaagcaatcctcctgtcttggcctcctaaagtgctgggactacgggtgtgagccaccatacctagcctact

SEQ ID NO: 42505 - DNA, 201 bp, Homo sapiens
caaactgaaggtgaattttttaatctaagttttgatagtccattgatctgaattcttaaaattatttgcagagacaggaaaatatatagaaagagccaagytcaagctaggagttaaaagtcttgggctctactcctatctttgccacttgcccttcattcattaaacaatttttgagcatactgccaggccccacccagg

SEQ ID NO: 42506 - DNA, 201 bp, Homo sapiens
ttttccgttatccagtaaaacattgtaattcctgcagtaaaacattgtaattcctgcagtaaaacattgtaattcctgcagtcttcactcattccactcamtcaccagtttccattgcaagcaacacacattctgtccatataggtaaagctagcaacacacaatcaggatgttacctttctgcctccatgtaacaaaagt

SEQ ID NO: 42507 - DNA, 201 bp, Homo sapiens
tccagtataaatagttttcacatttaaaaatctaatctacaacataagttacctggagcactcttggcaaccattttgaactaagagtacatcaaattctmatacttaacagctagttttctattatagtttttttccgttatccagtaaaacattgtaattcctgcagtaaaacattgtaattcctgcagtaaaacattg

SEQ ID NO: 42508 - DNA, 201 bp, Homo sapiens
gacaaagtacttagtacattatgggttagttaacagtctctcaataaatagtgacaaaaataattttttataaacttttgcaaaattttaacaatgttttrtgtgtgtttattcaatttaggcttcttagtgttgaagaaaagaagaaaatagggcatctttgtaaattgctgattgaccaaggtcgaatccagtatttgc

SEQ ID NO: 42509 - DNA, 201 bp, Homo sapiens
catgagtagctgggactatagtcccacgccaccatgcccaggtaattttttaaaattttttgtggagacagggtctcactttgtcgcccaggctggtgtcraactcctgagcttaagccatcctcccaccttacccttccaaagtgctggaattacaagtgtgagccactgtgcccagccactttattacttatatttaga

SEQ ID NO: 42510 - DNA, 201 bp, Homo sapiens
ctaattcttccaccatgctctgaattttttgagtatatggtatatacttagtacgatgcttgctatataacaggaacacagtgaatatttgaatgaatgartaatcttggctaccaatttgctgtgtttccttgtccctttctgcatatgtggctttgtcttttaagttctttataaaagatgaattgagataaattgcta

SEQ ID NO: 42511 - DNA, 201 bp, Homo sapiens
gggactagttggtggaacagcacttggctcatgttggctcgctgcctcggctggtgtgcagaaaagcccaacaggcccggccctcgggattagcctgagasgtccgggtcctgataaagtttgagtttggcgctcggcttctgcggaggaggcggggagggagaaacgaggggaaggcgtaagagacttggccctcgccag

SEQ ID NO: 42512 - DNA, 201 bp, Homo sapiens
caaagtgctaggattacaggcctgagccactgtgcctggcttcattacgttaatttaaatagtgtgacaggacatttatattttcaagttttaattaataktttaaaatagaagaaatcagacttattgttataatatctttgtcttatctgtttttggtcatgctgcatgtctgataagcagcattgtgtagttagtact

SEQ ID NO: 42513 - DNA, 201 bp, Homo sapiens
tatatgaagatcaactagcaaagcatttgaaaaaatgtaactcaagagagaaaccaaaacctgtaagtgtttgatcagtaaaattgaatggtgaaatgtgrtatgtaatgccttggtagatgctgcacatggaatgtacttgtttcatagctgaggaacccaagctcaggaaatataatttttttttaaagagatagggtc

SEQ ID NO: 42514 - DNA, 201 bp, Homo sapiens
taattctgaaataacttaattcttttttttttttcttcgagacggagtctcgctctgtcgcccagactggagtgcagtggcgcaatctcggctcactgcawcctccgcctcccggcttcaagcgattctcctgcctcagcctcccgaattgctgggactacagactcgtgccaccacgcccggctaatttttgtattttta

SEQ ID NO: 42515 - DNA, 201 bp, Homo sapiens
gtgaacaatttttttaaattttgtatactaaataaaagttagttggttataaatttctccagtataaatagttttcacatttaaaaatctaatctacaacrtaagttacctggagcactcttggcaaccattttgaactaagagtacatcaaattctcatacttaacagctagttttctattatagtttttttccgttatc

SEQ ID NO: 42516 - DNA, 201 bp, Homo sapiens
gctgagggtagatgcggttactatgtggaaaagaagaaacggttctgcaggatggtggtggccgcagggaaaagattttgtggtgaacacgctggagccayggaggtgtggtatcgccctactctctcaagagtcggaaataagtatcctggtcctgtcggtgctggaacccggcccctcccctctttgacagctttctgc

SEQ ID NO: 42517 - DNA, 201 bp, Homo sapiens; identical to SEQ ID NO: 9617

SEQ ID NO: 42518 - DNA, 201 bp, Homo sapiens
agctgagggtagatgcggttactatgtggaaaagaagaaacggttctgcaggatggtggtggccgcagggaaaagattttgtggtgaacacgctggagccrtggaggtgtggtatcgccctactctctcaagagtcggaaataagtatcctggtcctgtcggtgctggaacccggcccctcccctctttgacagctttctg

SEQ ID NO: 42519 - DNA, 201 bp, Homo sapiens
gagactctaattagttctttcttttggaaggccacattaatatgtactttatttcactagacagttaattctcatttccatttcagacaagattcctgtgytaagagaagaaaaactacctgtggtaggaattggaaagcatctgtgtggtatggcaacaggtacgtaaacatactgataatgtttacattaatgcattaa

SEQ ID NO: 42520 - DNA, 201 bp, Homo sapiens
gagaagaaaaactacctgtggtaggaattggaaagcatctgtgtggtatggcaacaggtacgtaaacatactgataatgtttacattaatgcattaagttktggcctaacctggccccaaccatttcagtggtctcttttgaatagatatcttatgtttacaactcaataatctttatagagcactggccctgtgctttat

SEQ ID NO: 42521 - DNA, 201 bp, Homo sapiens
taaggatttctatattcaagatattaatgcaggcttaagagatgaaacagaaatacctgaacaattagtaagtacattgacttaatatttaattttaaaakatatttataagctctcttcatgatgtgaataaggcatgttctaatttttgtctcaagtctgtttttaatttagaatgcattttcctgtagacttaatatt

SEQ ID NO: 42522 - DNA, 201 bp, Homo sapiens
ttgtgatatcttagggtaataaaattttaaaatatgtatatgtttttgattgaacagacacaacatgacaatctaatgattaagaagatatgggtcctacrttttgggtctttccagtattgtcaacagtgtaggagttttcgatgggaaatagccatagtcatcaaaaatccatttatttagttttaaaatatactaaaa

SEQ ID NO: 42523 - DNA, 201 bp, Homo sapiens
gaaccctaaacaagttcttatgttatatgttgggttccataaagtgataatttttgtttgagtctctttcaggctaaaattcagagactctaattagttcyttcttttggaaggccacattaatatgtactttatttcactagacagttaattctcatttccatttcagacaagattcctgtgctaagagaagaaaaacta

SEQ ID NO: 42524 - DNA, 201 bp, Homo sapiens
actcgacacctaggtgcaaggtggatcccacgggccagaaccgccatctttccccattggcctgaccccaaccgccacccgcgggcactggatgacgcggrccttacctctcctcacagtctttgcatttcacctgcaacgggactagttggtggaacagcacttggctcatgttggctcgctgcctcggctggtgtgcag

SEQ ID NO: 42525 - DNA, 201 bp, Homo sapiens
tgagccaggtatgtaattttaatttttttctttttcttttttttttttcagagacaggatctcgctctatcacccaggctggagtacagtggcacaaatartagctcactgtaacctcaagcttaggctcaagcaatcctcctgtcttggcctcctaaagtgctgggactacgggtgtgagccaccatacctagcctactt

SEQ ID NO: 42526 - DNA, 201 bp, Homo sapiens
tggcaagtaagttatgctgtaggccgggcgcggtggctcacgcctgtaatcccagcactttaggaggccgaggcaggcggatcacgaggtcaggaaatcgmgaccatcctggctaacacggtgaaaccccgtctctactaaaaatacaaaaaattacctgggcgcggtggcgggcgcctgtagtcccagctaccgggaggc

SEQ ID NO: 42527 - DNA, 201 bp, Homo sapiens
aagtagaaggactttgaataggcattatttttcaagatcttataaatagttatgcctgatagttttataatgtctgtagcgtattttgcagtccacagaaygcactcacatacattatcagctgatccgtcgcaaagaagcctcatgtgattctttctattctcagctttgtccatgaactaaaattagaactaggctgac

SEQ ID NO: 42528 - DNA, 201 bp, Homo sapiens
catactcaagactgggtaactaataaagaaaaagaggtttaatggactcagtttcacgtggctggggagacctcacaatcatggcagaaggcaaaaggcaygtcttacatggtgggaagagagaatgagaaccaagtgcaaagggaaaccccttataaaaccatcagatctcatgaggcttattcactaccatgagaacag

SEQ ID NO: 42529 - DNA, 201 bp, Homo sapiens
aaaaagagcattctaaatgccttgttattgaatttgatatagaattttatttactgaaaactcaaaatatacttaaagaaaacagctgactcaattaaatktgtctatgcgataggagtcacaaaaaatacaaatgtgaaaatggtagctatcttataccctcataggactctgtttaacattcatcaaagtttgattagt

SEQ ID NO: 42530 - DNA, 201 bp, Homo sapiens
tcccagcactttaggaggctgagggggagaatagcctgagctcaggagtttgagaccatcctggacaacatgataagacccctacctcttaaaattatttkttaaaactccaaaaccaatattttcatattatatgtaattaattgtagaaaccttaatttttcagaatgcaaaatctacatacgttatggctgcaacgaa

SEQ ID NO: 42531 - DNA, 201 bp, Homo sapiens
ccttcagtttatgcacacatacatacaagagtcacggagaagagcaggtataagatttgtatataacacagattaaatgttttttggtagagtaatgtgtrtatcactaactgctgccttttgattaattcctttatatatttctcattccatcttaagttttctgtcaaattctgttctcttagtcaatattgtgggaag

SEQ ID NO: 42532 - DNA, 201 bp, Homo sapiens; identical to SEQ ID NO: 9624

SEQ ID NO: 42533 - DNA, 201 bp, Homo sapiens
acttcctcccagtgaaggcacagatgaagaagaggaacgggaattatttggccttcagtttatgcacacatacatacaagagtcacggagaagagcaggtrtaagatttgtatataacacagattaaatgttttttggtagagtaatgtgtatatcactaactgctgccttttgattaattcctttatatatttctcattc

SEQ ID NO: 42534 - DNA, 201 bp, Homo sapiens
ctgaaaactcaaaatatacttaaagaaaacagctgactcaattaaatttgtctatgcgataggagtcacaaaaaatacaaatgtgaaaatggtagctatcwtataccctcataggactctgtttaacattcatcaaagtttgattagtatcatatagtctaattttcaggattgtatgttcagcattatatgccctaggac

SEQ ID NO: 42535 - DNA, 201 bp, Homo sapiens
ctggggctgtcaatgctgtaaaggaagtttgggaaaaaagaataaagaaactcaatgaagacctgaagcgagagaaggaatttcaacacaagtatgctaawacatatttattattttgaattagtgaaaattcatattatcatcaccataaaaaagagcattctaaatgccttgttattgaatttgatatagaattttatt

SEQ ID NO: 42536 - DNA, 201 bp, Homo sapiens
ctatgattcagctattcaaaacctaatgaagttggtgactatgacaatgtggagaaatcatgacagaaaatgtggtttgtactggggctgtcaatgctgtwaaggaagtttgggaaaaaagaataaagaaactcaatgaagacctgaagcgagagaaggaatttcaacacaagtatgctaaaacatatttattattttgaa

SEQ ID NO: 42537 - DNA, 201 bp, Homo sapiens
gatggaagagtcattttgaagatagaaaaagaggaatggaaggtaagcttttatagaatatttgattttccacattttgcattttgtgagtcagttgagasaatgattctgagactgtgtaattaagactagaatagttagaaactaattttaataatacaccaaatgaatttgagcaacatgtgcaactgaaaagaaaca

SEQ ID NO: 42538 - DNA, 201 bp, Homo sapiens; identical to SEQ ID NO: 9625

SEQ ID NO: 42539 - DNA, 201 bp, Homo sapiens
gtttgaccatgaactgaccttccctgtcattccataaatagaaaaaaaaatttacctagggatgaaaaatattgagaacacagttttttgtttgtttgttkgtttgtttgttttaaagagatgaggtcttactatgttgcccaggctggagtgcagtggctattcaaaggcacaatcatagctcactgtagccttgaactc

SEQ ID NO: 42540 - DNA, 201 bp, Homo sapiens
tgattaattcctttatatatttctcattccatcttaagttttctgtcaaattctgttctcttagtcaatattgtgggaagaaaaaaagtgaaatagagagrgaggttttaaagatattcaaagtctttcaagtgggggaaggaaataaatcctttggctaagcatctgaagtaaaaccaagtgagtgaagacatgattctt

SEQ ID NO: 42541 - DNA, 201 bp, Homo sapiens
tgcagtggctattcaaaggcacaatcatagctcactgtagccttgaactcctgggctcaagagatcatccgacctcagcctctgaagtaactggggctatyagtgcatgccaccacgtctggctgagaacacagattttaatgaacaaagtgtgaggttttgatatagagatttcaatcacttagtctctgataattaatt

SEQ ID NO: 42542 - DNA, 201 bp, Homo sapiens
ttaatgcattaatgtaaacattatcagtatgtttacgtacctgttgccataccacacagatgctttccaattcctaccacaggtagtttttcttctcttarcacaggaatcttgtctgaaatggaaatgagaattaactgtctagtgaaataaagtacatattaatgtggccttccaaaagaaagaactaattagagtctc

SEQ ID NO: 42543 - DNA, 201 bp, Homo sapiens
atggcaacttcatagaactggtttgctgaaaattcctgaattcattggaagattccagaacctcattgtgttagatttatctcgaaacacaatttcagagwtaccaccagggattggtaagaaagattacttttattcctgtgctattttatccacctgcagatgtgctttttattaagatttttttggatacatggaata

SEQ ID NO: 42544 - DNA, 201 bp, Homo sapiens
ctgcagatgtgctttttattaagatttttttggatacatggaataaagacctctttatacagccctcaaccttgagaattttaaacatttaatctaaattraagcttctaggggattcaagtttgtggatttactgaggtgattcaagatgagatttcaatgaaagaaaagcctctttggaaaatatcctgtgattctcgg

SEQ ID NO: 42545 - DNA, 201 bp, Homo sapiens
ttatatttatttttaatttgttgcggactaatatgactaaataaagcccaagtaaaatgtgaatattcctggatgtgaaatatctcctttaccaatgtgartcttttagtagtttacattgtggacatttattttgaaaaaccttgctttcttcttcagctcagcaatctgctaaaacttactcaccttgatctgagtatg

SEQ ID NO: 42546 - DNA, 201 bp, Homo sapiens
attatgaaagataaattttcttcaaatagatgaactttctatgagagttttccacttccctggaggtcatttagctttatatttatttttaatttgttgcrgactaatatgactaaataaagcccaagtaaaatgtgaatattcctggatgtgaaatatctcctttaccaatgtgagtcttttagtagtttacattgtgga

SEQ ID NO: 42547 - DNA, 201 bp, Homo sapiens
acaatgttctgcagtgcctatgtgtatatgagtctgtttctggggttccttattcaggtacactggtatgtttttctattgcaccaataacattatctagyaccatagctttaaaagagatcttgatgaatgcaaaataaatcctcccactctagttttctttggcaagagtgtctgggctattttgtatccttagaattg

SEQ ID NO: 42548 - DNA, 201 bp, Homo sapiens
ggttttagaagagttataaaatttcgattagagacctgaaagaatatcaagattaaaataagcagcttcacacctgtaatcccagtgctttgggaggctgrggcaggaggattgcttgagcttaggagttcgagaccagactgggcaacatggagacagcctttctcaatttttttttttttttttttagaaaaagctgta

SEQ ID NO: 42549 - DNA, 201 bp, Homo sapiens
cagtatcaatgtcatattcattgtactaaagaagaatgttaaaatagattctcctttcctgcacttcaataaatgctaaaaaatcatgccacattttgttsgctctatatatggactgtggctttcttgtacagtgtcttcctcaacacaatttctgactgcctttctttttgcttattgggagaagaaatttcatctttt

SEQ ID NO: 42550 - DNA, 201 bp, Homo sapiens
gatgtcaccaaaaagtattctactaatcctgcaaaaatagtccctttcctcatagatgcatatagttccatacaattctcattcattgtctctttctatcattattattattattattattattattattattattattattattatttttgaaatggagactcactctgtcgcccaggctggagtgcaatggcatgatct

SEQ ID NO: 42551 - DNA, 201 bp, Homo sapiens
atgtcaccaaaaagtattctactaatcctgcaaaaatagtccctttcctcatagatgcatatagttccatacaattctcattcattgtctctttctatcattattattattattattattattattattattattattattattatttttgaaatggagactcactctgtcgcccaggctggagtgcaatggcatgatctc

SEQ ID NO: 42552 - DNA, 201 bp, Homo sapiens
agaatatgttgatttgatttcatttctattgccatatgacatgagagttgtactgtagagataaacttcctgatgtggtttctctaataaccaggtaatgygatgtcagttaactcaataagtatactggttaaagatgttgtaaaagacatttgatttttaacataagaaccaaaggctgggtgcagtggctcacgcctg

SEQ ID NO: 42553 - DNA, 201 bp, Homo sapiens
tgtcaccaaaaagtattctactaatcctgcaaaaatagtccctttcctcatagatgcatatagttccatacaattctcattcattgtctctttctatcattattattattattattattattattattattattattattattatttttgaaatggagactcactctgtcgcccaggctggagtgcaatggcatgatctca

SEQ ID NO: 42554 - DNA, 201 bp, Homo sapiens
agaatttgcaggagaactcccctttataaaaccatcggatttcatgagacttattcactatcacaagaacagcatgagaaagagccattttcatgattcarttacctcccaccaggtcctccccatgacacataggaattatggcagctacaatttgagctcccctgtggggacacagccaaaccatatcaccttcctaat

SEQ ID NO: 42555 - DNA, 201 bp, Homo sapiens
aagctgttaagaatcttgtttcagttcacacatctaatatgggatagatctgggattctgatctaaatgacttcaattatccattgactaatatttattartcacttcctgtgtaccaggcactggtaaacaccagaagtaaaacagtagataaaatgggatgccagcttcgaggagcttatagtctaaagacgaatacaa

SEQ ID NO: 42556 - DNA, 201 bp, Homo sapiens
gcgctcattgcaagtcctaaactttaggagaagggattttgttttctcttcacattgcctacaaccctttaccaattgaaaagatgatttggggccaggcrtgatgactcatacctgcaatcccagcactttggggggccgaggcaggtggatggcttaaggtcaggaatttgagaccagcctgggcaacacggtgaaacc

SEQ ID NO: 42557 - DNA, 201 bp, Homo sapiens
tttggggccaggcgtgatgactcatacctgcaatcccagcactttggggggccgaggcaggtggatggcttaaggtcaggaatttgagaccagcctgggcaacacggtgaaaccccttctctatgaaaaataacaaaacattttaaataatttaaaaaaaaagattattttattcctttttacagccctttacgaagcagg

SEQ ID NO: 42558 - DNA, 201 bp, Homo sapiens
gaggcaggtggatggcttaaggtcaggaatttgagaccagcctgggcaacacggtgaaaccccttctctatgaaaaataacaaaacattttaaataatttaaaaaaaaagattattttattcctttttacagccctttacgaagcaggatctgcaacaaatttctcaggaaacgggctgagcaacacatgagggatatcac

SEQ ID NO: 42559 - DNA, 201 bp, Homo sapiens
agcaggatctgcaacaaatttctcaggaaacgggctgagcaacacatgagggatatcacccacaaacagtgatgagtagttattgttgcaaaccataattkagttgcccgagtctagtgtgcctttcttctttcttttgccacttgggtaattctcaccttctcagggaacatcttccactttcccccaaattgatggcag

SEQ ID NO: 42560 - DNA, 201 bp, Homo sapiens
gcaggatctgcaacaaatttctcaggaaacgggctgagcaacacatgagggatatcacccacaaacagtgatgagtagttattgttgcaaaccataattgwgttgcccgagtctagtgtgcctttcttctttcttttgccacttgggtaattctcaccttctcagggaacatcttccactttcccccaaattgatggcagc

SEQ ID NO: 42561 - DNA, 201 bp, Homo sapiens
tttgtaggtcttaaggacttgctttatgaatctgggtgctcctgtattgggtgcatatatatttaggatagttagctcttcttgttgaattgatccctttrccataatgtaatgatcttttttgtctcttttgatctttgttggtttaaagtctgttttatcagagactaggattgcaaccccttgcagaagaaatttcta

SEQ ID NO: 42562 - DNA, 201 bp, Homo sapiens
tctcaggaaacgggctgagcaacacatgagggatatcacccacaaacagtgatgagtagttattgttgcaaaccataattgagttgcccgagtctagtgtrcctttcttctttcttttgccacttgggtaattctcaccttctcagggaacatcttccactttcccccaaattgatggcagcttttttttccccccagttt

SEQ ID NO: 42563 - DNA, 201 bp, Homo sapiens
gatagttagctcttcttgttgaattgatccctttgccataatgtaatgatcttttttgtctcttttgatctttgttggtttaaagtctgttttatcagagrctaggattgcaaccccttgcagaagaaatttctaagcagcaaagcattcaagaggtgacttgggtgctgttaaaggcattcagttttataaagaaagcag

SEQ ID NO: 42564 - DNA, 201 bp, Homo sapiens
tctttgttggtttaaagtctgttttatcagagactaggattgcaaccccttgcagaagaaatttctaagcagcaaagcattcaagaggtgacttgggtgcygttaaaggcattcagttttataaagaaagcagagcataaaagttcagaaaatttgcagcctaacagtgcgacagaaaagaaaatcccatttgctgaggag

SEQ ID NO: 42565 - DNA, 201 bp, Homo sapiens
gggactgtcagggaggcatgactagttttgaaatgtgaggacataatagttgggtggaggcaggggtggaatgacatggtttggttttgtctcctctctcaaaaaaaaaaaaaaaaaaatttccaggcatggtggctcacccctgtaatcccagcactttgggaggctgaggcgggcaaatcacttgagggtcaggagttc

SEQ ID NO: 42566 - DNA, 201 bp, Homo sapiens
cgctataaacagatctgttgtcctttaggctttgtttttccatttatagagcacaggcagagtagatgtaacataaattttaaggccttaggattttttgratgataaatgagcattggcttcaacttaaagataccagctgcactggcctctaataagagagccaacctgtcctgagaagctttgatgccagacattgac

SEQ ID NO: 42567 - DNA, 201 bp, Homo sapiens
cttcaacttaaagataccagctgcactggcctctaataagagagccaacctgtcctgagaagctttgatgccagacattgacatctcttctctagctaggraagtcctagatggcatcttttttcaatagaagactgttttatctacattgaaaatctgttatttggtgtagccacctttatcaatgatcttagctagatt

SEQ ID NO: 42568 - DNA, 201 bp, Homo sapiens
agttttcctgaaattgattttgttttccttttaattaagtaatatttatcacctcctggtttttgtacattgattgtggtgtatggggttacaggagagcracagacgattcccaggtaagaagggaggaacagttattgtctttctaagctctgttagtctcttttttatataaattcatatatgcatgctttaatgcaa

SEQ ID NO: 42569 - DNA, 201 bp, Homo sapiens
tcaatgatcttagctagattttctgagtaacttgctacagcttctccattagcatttgctgtttcaccttgtacttttatgttacggagatggctttttcyttaaatgacatgaaccaacctctgctagttttgaacttttctgcagttttcttacctctctcaaccttcatagaattgaagagagttagggccatgttct

SEQ ID NO: 42570 - DNA, 201 bp, Homo sapiens
ctgttcgtagaaatgtagtgtgtgtcacctggggttatagtgcatgtgagtggggagtcacttaatgtctgttcctttttgtctcctttctccagctatayctgcaggcccgcttcacttggcgaggagcccgcctgctccggcccctcctgcagttcaccttgatcatgatggccttctacacgggactgtctcgcgtat

SEQ ID NO: 42571 - DNA, 201 bp, Homo sapiens
gcatgcaaaaggagcaacagccatggtctttacgctcacatggtggagctctattaagagctacagtttttgaactctgaaaacagggatgactcaacacratccatgcccttgagtagctagctcagtctagaaggggaaatatgacacagcatttaaagcgtcacgtatcaaagcctacggcctaacactaagatggaa

SEQ ID NO: 42572 - DNA, 201 bp, Homo sapiens
atcttagctagattttctgagtaacttgctacagcttctccattagcatttgctgtttcaccttgtacttttatgttacggagatggctttttctttaaaygacatgaaccaacctctgctagttttgaacttttctgcagttttcttacctctctcaaccttcatagaattgaagagagttagggccatgttctagatta

SEQ ID NO: 42573 - DNA, 201 bp, Homo sapiens
tcttagctagattttctgagtaacttgctacagcttctccattagcatttgctgtttcaccttgtacttttatgttacggagatggctttttctttaaatsacatgaaccaacctctgctagttttgaacttttctgcagttttcttacctctctcaaccttcatagaattgaagagagttagggccatgttctagattag

SEQ ID NO: 42574 - DNA, 201 bp, Homo sapiens
tgcctaaggtaatagacaagattcagacaggtttttctggctacaacgttgttgcttctttcaccacctcttgctctatcttttcccaaaaatctatcctwatttttcttcatatttcctctccataacagttaaatatttgtaaatatgtgggcagttgagctctttttcaccagaaaagacaggaagaggagctgtctt

SEQ ID NO: 42575 - DNA, 201 bp, Homo sapiens
cgcagccttcctggggagcctttgcgccgcccaggcccgaagcccccgccctccccgatcccaccgacttcttggcctgtacttgagtgggtctgggcgtrcttaagcgttcgtgggcaactgttaaaccagctcagtaaaagtcgtctccacgttggaagcccgggcggaatcccgcggaaggtgtgggttcgtcctttt

SEQ ID NO: 42576 - DNA, 201 bp, Homo sapiens
tagacttttaagggttaggattacaagaagccaagtccgcctggttcataatgatgatttatggctgtgttgtcgactccctgacccttctgtacaagggratagagaaaatacataatttgttgctcattcactctaaaatctgtcaaggctgccccagaagccatgtggtcctggagtcatgtgtctgctaaatggctt

SEQ ID NO: 42577 - DNA, 201 bp, Homo sapiens
atcttgagagaaagacagatatgccttaggaagggtgggagagaatttagacacgtggtctgttttagggtcaactctcacttgggtcattcctgtcattsaacagcccagaggaaaaccaaactaaaagaacagcaaggccaggcgtggtggctcacgcctgtaatcctagcactttgggaggctgaggcaggtggatca

SEQ ID NO: 42578 - DNA, 201 bp, Homo sapiens
gagatggctgctgttaacattattattaggaatttgaggtactgcaaaatgttcttttcatctccttgttttcccttgagtgaaggaaacattttactttkcaatttactatcttaagactgtgacactaaaaatggaagttttagagatgggacattagagctgaaaagaatccctgaattgtaatcaaaccccgtctcc

SEQ ID NO: 42579 - DNA, 201 bp, Homo sapiens
tgcttcagacagttttctctatgtaccagtgaccacaaaaaaaaaaaataagtattgtatgactacaatgttacataactatataccacggatatgtgcgrtaataaaaagagcaagaataccaaacatgagtaatttccctcatttgtagcaagattctggttcaaaaactgagaaatatttcttgttcaatattgtaca

SEQ ID NO: 42580 - DNA, 201 bp, Homo sapiens
ccacggatatgtgcgataataaaaagagcaagaataccaaacatgagtaatttccctcatttgtagcaagattctggttcaaaaactgagaaatatttctwgttcaatattgtacattagtaatggatcccaaaactttaaaagcatctatgactaacatttatcctgcatatgcttctgctattctcactagaccatatt

SEQ ID NO: 42581 - DNA, 201 bp, Homo sapiens
gtagtcccagctacgtgggaggctgaggcaggagaatggcatgaacccgggaggcagagcttgcagtgagccgagatcgcgccactgcactccagcctggrtgacagagcgagactccatctcaaaaaaaaaaaaaaaaaaaaaagaaataccttaagattaatgcagacatgtaagggaaacaatgccagaattttcctg

SEQ ID NO: 42582 - DNA, 201 bp, Homo sapiens
ttgaggcaggaggaccacttgaggcctggagtttgagaccaggctgggcaacaaagtgaggctaggactatagtcccagcaacttgggaggctgaggtggwgagatcccttgagcccaggagttccaggctgcagtgagctatgattgtgccacagaactccagcctgagtgacagagtgagaccctgtttccaaaaaaaa

SEQ ID NO: 42583 - DNA, 201 bp, Homo sapiens
ggttagaatgcctatagctagattatactgggtaagctgtattaaaacctttagatttttaaaaaagtgtagtcaagtatattctgataatttttgaacargagagtgacacgatatgaattataaacttaaagatggctctagatggttgtgtggaagagagtctaaggggtcaaaagtgtaaacaaaaaaactaattta

SEQ ID NO: 42584 - DNA, 201 bp, Homo sapiens
gaataataagctgtcttgattttaggtttaattttcctaaggctattaatggagttgagggacctttacttatgattttgccataaatttgttgttgcagytgtgcttgccctagctgtgaaatccaaggatttattattaattaataatcccttttactgaacaattctaccaaatgataacgtttgcatctgagagttt

SEQ ID NO: 42585 - DNA, 201 bp, Homo sapiens
gagcattgacagtatagtcagacacatccacgaatctcatcaaatcatacaagcctgaaggggaggtattcctctaactggttttatagatgagacagtcrttgtgcagagagattgaggggcttgctcaggatcttgggactagaaaatggtggagcttgtaggctatgacccaaccaacacctatgctctttcctccaa

SEQ ID NO: 42586 - DNA, 201 bp, Homo sapiens
aattggctaaaacaaagggtccacagggcccatgcaagtccaaagcccactagggcagtcagtaaaacttaaagctccaaaataatctcctttgactccawgtctcacatccaagtcacactgatgcaaggggtgggctcccaaggccttgagcagctcagcccctgtggctttgcagggttcacgccctgcagcagcttt

SEQ ID NO: 42587 - DNA, 201 bp, Homo sapiens
gtggaaacaggatatgtcttagggccagacagttctgggttccgatcctggccccatcacttggtagcttataacctggatcaagtgttgtagtaaacttsagtttcctcacctgtaaaatggagacaatgatttctactttacaggtgtccggagagaaaaaaatacctcacagacagtgggctctttgacatgaatata

SEQ ID NO: 42588 - DNA, 201 bp, Homo sapiens
tgaacctgggaggtggagcttgcagtgagccgagatcgtgccactgcactccagcctgggcgactcagcaagactttttctcaaaaaaaaaaaaaaaaaaraattttttattgtctaacatgctagatacaaaagaattatcctatgaacaacaccctcaaggcttttaccttctcaaggagaagacttgtacccatgaaa

SEQ ID NO: 42589 - DNA, 201 bp, Homo sapiens
atttgaacctgggaggcagaggttgcagtgagccgagattgtgccattgcactccagcctgggcaacaagagtgaaactccatctcaaaaaaaaaaaaaawgttcaagtccaaagtctcatctgaggcaaggcaagtgtctttcacctatgaatctgtaaaatcaaaggcaaattagttattccaagatgggtggtacagg

SEQ ID NO: 42590 - DNA, 201 bp, Homo sapiens
atttctccctagaaaatgggtttttctcttctgtcacatggtcaggatgcaaatttttcaaacttttatgctctgcttcccttttaaacctaagtttctcrtctccatctgagaccacctcagcctggacttcattgtccatatttctatcagcattttggtcaaaaccattccacaagtctctgggactttctagacttc

SEQ ID NO: 42591 - DNA, 201 bp, Homo sapiens
aataggaggaaagatgaagagtttcaccaccacgagttaccacaattttaacccagaatcaaagttttgaagtttaggagacattggaacacagtggaaasaggatatgtcttagggccagacagttctgggttccgatcctggccccatcacttggtagcttataacctggatcaagtgttgtagtaaacttcagtttcc

SEQ ID NO: 42592 - DNA, 201 bp, Homo sapiens
ccacctcagcctggacttcattgtccatatttctatcagcattttggtcaaaaccattccacaagtctctgggactttctagacttccaaacatcttcctrtctttttcagaggcttccaaactgttcctacctctgcctgttacccagttccaaagccacttgcatattttcacgttatctttatagcaatgccccactc

SEQ ID NO: 42593 - DNA, 201 bp, Homo sapiens
tcaagtataaaagactctaggacagtgcctgatagttggaggtcttgactgtgttgaattaaccctgtcacaaggtacaaataggaggaaagatgaagagwttcaccaccacgagttaccacaattttaacccagaatcaaagttttgaagtttaggagacattggaacacagtggaaacaggatatgtcttagggccaga

SEQ ID NO: 42594 - DNA, 201 bp, Homo sapiens
acttccaaggctctgatatggcttggctctgtcctcactgaaatctcatctcgaattcctatatgttgtgggagggacctggtggtaggtaattgaatcaygggggcaggtctttcccatgctgttctcatgttagtgagtaagtcttatgagatctgatggttccataagggggagtttccctgcccaagttcactcttt

SEQ ID NO: 42595 - DNA, 201 bp, Homo sapiens
aattaaatggtctttcagaactgcagaggtcatcaagtataaaagactctaggacagtgcctgatagttggaggtcttgactgtgttgaattaaccctgtyacaaggtacaaataggaggaaagatgaagagtttcaccaccacgagttaccacaattttaacccagaatcaaagttttgaagtttaggagacattggaac

SEQ ID NO: 42596 - DNA, 201 bp, Homo sapiens
atccatgtaagatgtgacttcctcctccttgccttctgctgtgattgtgaggcttccccagccacttggaactatgagttctccattaaacctctttcctktgcaaattgcccagtgttgggtatgtctttatcagccacgtgaaaacggactaatacagtaaattggtaccagtagagtgaggcactgctgaaaagatac

SEQ ID NO: 42597 - DNA, 201 bp, Homo sapiens
gctaaattggcttagcagaattcttgctaaaactgggctcttgaagacatgcccaaggacaggacctagtgggtcagaggagtctgactagagttaggtcragaaaaaagtgttttgttgcattctactgtaagaaccagaaaataaggagtcaaataaatatataatgtaaggttagtgttaagtgctgtgaaggaaaag

SEQ ID NO: 42598 - DNA, 201 bp, Homo sapiens
agattctggatattagccctttgtcagatgggcagattgcaaaaattttctcccattctgtaagttgcctgttcactcttatggtagtttcttttgctgtrcagaagctctttagtttaattagatcccatttgtcaattttggcttttgttgccattgcttttggtgttttagtcatgaagtccttgcccatgtctgtgt

SEQ ID NO: 42599 - DNA, 201 bp, Homo sapiens
tgtcctgaaggtattgcctaggttttcttccaggatttttatagttttaggtttaatatttaagtctttaatctatcttgaattaatttttgtataagatrtaaggaagggattcagtttcagctttctacctattgctagacagttttcccagcaccatttattaaatagggaatcctttccccatttcttgtttttgtc

SEQ ID NO: 42600 - DNA, 201 bp, Homo sapiens
tctcaggaatgtagttttacagttggtttatgctcatcaggatcaaaaaagtcacacttaccattttgtcaatacatctgttttaatatgtagtgttttcycttcccactcttttttaaaaatgtcatctattagttgaaacattgaattattttaactgttgaatatcccgatcttgttggatttatctcaataattatt

SEQ ID NO: 42601 - DNA, 201 bp, Homo sapiens
agtttcagctttctacctattgctagacagttttcccagcaccatttattaaatagggaatcctttccccatttcttgtttttgtcaggtttgtcaaagawcagatggttgtagatgtgtggtgttatttctgagggctctgttctgttccattggtctatatctctgttttggtaccagaaccatgctgttttggttact

SEQ ID NO: 42602 - DNA, 201 bp, Homo sapiens
gtacttttatgttacggagatggctttttctttaaatgacatgaaccaacctctgctagttttgaacttttctgcagttttcttacctctctcaaccttcrtagaattgaagagagttagggccatgttctagattaggctttggctcaagggaatgttggagttgatttcttatttagatcactaaaacgtttcctatat

SEQ ID NO: 42603 - DNA, 201 bp, Homo sapiens
gtggtgaatatcccttgattgtctcaggaatgtagttttacagttggtttatgctcatcaggatcaaaaaagtcacacttaccattttgtcaatacatctsttttaatatgtagtgttttcccttcccactcttttttaaaaatgtcatctattagttgaaacattgaattattttaactgttgaatatcccgatcttgtt

SEQ ID NO: 42604 - DNA, 201 bp, Homo sapiens
aacatctttgttctgccagtagtcattcacgagcacgttgttcagtttccgtgtagttgtgtggtgttgagtgagtttcttaatcctgagttctaatttgkttgcactgtggtctgacagacagtttgttttgatttctgctgttttacatttgctgaggagtgctttacttccaactatgtggtcaattttggaataagt

SEQ ID NO: 42605 - DNA, 201 bp, Homo sapiens
aggaactaaaattaccatgtatcttttagactcatgtgctggatgccaagaaatattaaagaatataagacacaaatacaaatcctgaataatgagttgakctataaatgcactaaaaaatcaagttgtaagtatgtgaaaattaaacctcaaatattacaaaagggtgaggaaaagggatccccatttattgttaggtgc

SEQ ID NO: 42606 - DNA, 201 bp, Homo sapiens
tccccctcatttcccaagttcccacaggaacctgggaataggttgtgcccagaggttagaacggaaactgcagcaagataactctgaggggacaatgcccmgttgacgtcatttcaactactttgcttcagctagaggtggttttttttttaatcttccatttttcttcaggttactcttctactccaccctgtctagtgt

SEQ ID NO: 42607 - DNA, 201 bp, Homo sapiens
ttgttcattatcttttgttctttttcctctctgagcttcactttgggtgtatttcagttgactatgtcttcaagtttacccgcctttccttctgtagtatstaatctgttaagcccattcagtgaattcttttatttagaatattgtgttttagtttccattttactctttttagaatttttttttctgtattatgtttgt

SEQ ID NO: 42608 - DNA, 201 bp, Homo sapiens
taagcatttagcagcacaatccatgatccatattcagggtgtgtattagtccattttcacaccactgataaagacatacctgagactgggtaatttgtaaygaaaaagaggtttaatggactcacagttccacgtggctggggaggcctcacaatcatggcagaaggtgaaaggcatgtcttacatggcgacagacaagag

SEQ ID NO: 42609 - DNA, 201 bp, Homo sapiens
caccagaggaggtgggaaactctgcagtcagtccgagaagcccttagaccctcccccagggcttttatgttgagctgcaggaagttctggagttgggcaargagactggactccccggtgtacccagtgctgtttttttgttcatgcagcctgtgattcatagcttccctggggtgttggggagaatcacatttgggtcag

SEQ ID NO: 42610 - DNA, 201 bp, Homo sapiens
gtgtccatctgtcccaggaaggacaaactcatgtcttcagcactgccacaggtctatctttaggccatcagccacctcccctccgctctcttcccttctcytgcctctccaagtgctttgatttgtagtcggaagttcctcttgtccacttgcctcttccccctcatttcccaagttcccacaggaacctgggaataggtt

SEQ ID NO: 42611 - DNA, 201 bp, Homo sapiens
agcaggcaacggcctcagtgtgatcttttttgtcagtattcttattttttcctcttaagtttttccaataatacatttttataatttcaaaatgattatamagtagtctgctgtcttccatgtctgcttatttgaaatagtgttccacgtagttgaggattcagtcctagacacttatggctaagaatgattctgggatct

SEQ ID NO: 42612 - DNA, 201 bp, Homo sapiens
ctgaaactttggggttgttttaccttcaaatattctaaaataagtcctgagtaggacattaatgcaagaccactaaactaatatactgtactagacaccaytggtattatcagtaaccaattatttcaagtctttgctcacagtcaccttcttggtgaaccctaccctggccaccctatttaagttgcagtttcttttttt

SEQ ID NO: 42613 - DNA, 201 bp, Homo sapiens
ttcagtctatattttgaataggtggtccaaattgggaccattgctagctctgcattttaggtgaactgatgaacatttctgatcctcagtttttccatttrtaagatgggtagaacagtacctactcataactctgtactgtaggtaagatgtataaactttttatcacagagttctttttttttttttttgaaacaagat

SEQ ID NO: 42614 - DNA, 201 bp, Homo sapiens
gcaatgtcatccatacatacattttctggtcctaccctggaggggtggtatttccaaactcttcatttaggtatggtatcgtccaaggagctcttggaagagatactctctacaaaacatgttttttatttgtttgtttgctttcctcttcaatggagggaagaaaaaagttaacttttggagggctctcctgctaggtgc

SEQ ID NO: 42615 - DNA, 201 bp, Homo sapiens
cagtggcttactcctgtaatcccagcactttgggaggcagaggcaggaggattacttgagctaaggagttcgagatcagcttgggcaatatagtgagaccytgtctctacaaaaaaatcaaaaattaaccgggcgtggtggtgcaagcctgtagctgtagcccagcttcttgggaggctgaggcaggaggataccttgaga

SEQ ID NO: 42616 - DNA, 201 bp, Homo sapiens
gcttctctggttagtggctgcggatgcagctccttcattaaatgcagtacatggaacttctaccagtagcctcttccccacaaatgacccacattgttgtwaagttagcaaccactgacaggaagtggcagaatgcgtctcagccacacagcagatttcattagacactctcccaaagtagctgtttgggtcaatttggcc

SEQ ID NO: 42617 - DNA, 201 bp, Homo sapiens
acacacacacacacacacacatacacatatatacatataaatatatttggttgtatatttttgttgttacaaaggggcttaaaacacccaactatattagygctttgatcttttcttctgtgcatatttgtgtctgtatatttcataaatagaaaattaggacactcctttgcaaatactgaatattctcctgtgttgttg

SEQ ID NO: 42618 - DNA, 201 bp, Homo sapiens
ccccccaaagctaatattctaacctgtttattatatttattcactgttggtcttatgtttgaacaaaatgattttgtttatctccaaaaagcaataaggcrtcaggaccatgtattctgttatagaggcacatagctacttgttttcaggggtgctttgccattaaaaccatggcaacattttcaaagtgacttattgatc

SEQ ID NO: 42619 - DNA, 201 bp, Homo sapiens
gggtttccctgccttgcctttccccttgaatgaggtccgtgtgtgccaaggcacttcctgctttcagccgctttgatagaattcagagcgagaaggtgctragaggtcagacatagctcagaggagcacaagctgtttgaaaaaagaacattttgatttcaacttattgaaaaagcacaattaggaattgggaaaaacagc

SEQ ID NO: 42620 - DNA, 201 bp, Homo sapiens
aaaccaaaccccaaacccagaaagccatttttgatttctctggtgttcgcttgattaacatgggctgtgaaatggttttctgcagttcacattgtgcgcarggatacctgtgtacatctgtggataatatgtatatactgtaagtgcttccctccccctcacattatattatagagtttccattctgaggtgaggctaccc

SEQ ID NO: 42621 - DNA, 201 bp, Homo sapiens
acagggagggagggtggagagtggggctttgccagagttcgcaaaggcctatgggttcccaaagccacactcaagtattcctcaggcctttgaacaattcygggggccttgctctcccctcttgtccttccaattagattccagttggggattcttccacttcttttcaaggccacttccacaaagggggagctgtcgtgg

SEQ ID NO: 42622 - DNA, 201 bp, Homo sapiens
gattccagttggggattcttccacttcttttcaaggccacttccacaaagggggagctgtcgtggaagctgatatttccatgaaaaccttccatttctcaggcaaacataccaggcagctgtcatggcaataccatggtgaaggggaataatgttatttggcatttcgccctttaaaaaagtgtatgtgtgggggtgggtg

SEQ ID NO: 42623 - DNA, 201 bp, Homo sapiens
ccacttcttttcaaggccacttccacaaagggggagctgtcgtggaagctgatatttccatgaaaaccttccatttctcaggcaaacataccaggcagctstcatggcaataccatggtgaaggggaataatgttatttggcatttcgccctttaaaaaagtgtatgtgtgggggtgggtgggaggaggaggatgggcaga

SEQ ID NO: 42624 - DNA, 201 bp, Homo sapiens
aaataggatttagcaattgcttagttattaattagaagaacaatgaagcaatttgggatgacttacagatttctggaatgatacagaaatcttgtggatgrattgatcattcaaaaacagttcgtagcctatcacctccttccttaaaagtgttcaataatttaacataacctaaagattagtgtttaaaactctttagct

SEQ ID NO: 42625 - DNA, 201 bp, Homo sapiens
acaagaacagcatgagaaagagccattttcatgattcaattacctcccaccaggtcctccccatgacacataggaattatggcagctacaatttgagctcycctgtggggacacagccaaaccatatcaccttcctaatgtacttccttgaaactcaaggaagtagtgggttccagtttgaaaattactggtctacagaga

SEQ ID NO: 42626 - DNA, 201 bp, Homo sapiens
cagcaaagcattcaagaggtgacttgggtgctgttaaaggcattcagttttataaagaaagcagagcataaaagttcagaaaatttgcagcctaacagtgygacagaaaagaaaatcccatttgctgaggagaaattcaagctgcctgcataaatttgcataagtaacgaggagccaaatgttaatacccaagacaatggg

SEQ ID NO: 42627 - DNA, 201 bp, Homo sapiens
ccacctctttcatcagcctgacctcgatgtgagacataaagtcaaaggagatcattttggagctttaagatttgactgccctgctgaatttcagacttgcwtggggcctgtagcccttttgttttggccaatttctcccatttgggatggctgtatttacccaatgccagtacccccattgtatgtaggaagcaactaact

SEQ ID NO: 42628 - DNA, 201 bp, Homo sapiens
gatttgactgccctgctgaatttcagacttgcatggggcctgtagcccttttgttttggccaatttctcccatttgggatggctgtatttacccaatgccrgtacccccattgtatgtaggaagcaactaacttccttttgattttacaagctcataggcagaagggacttgccttatcttggatgagactttggactgta

SEQ ID NO: 42629 - DNA, 201 bp, Homo sapiens
gcatgcgccaccatacccagctaatttttttgtatttttagtacagaaggggtttcaccatgttggccagacgggtctcaaacccttgacctcaggtgatmcacctgccttggcctcccaaagtgctgggattacaggcatttgccaccatacccagctaatttttttgtatttttagtacagaaggggtttcaccatgtt

SEQ ID NO: 42630 - DNA, 201 bp, Homo sapiens
ttttgaactgctttaaaattcctgcctgcacctgttatttctggatgatttatattagcttatttttctcctgattatgggtcacctttatttcttttccttttttttttttttttttttgacagagtctcgttctttgtccaagttggagtgcagtggtgcgatctcagctcactgcaacctccgtctcccggttccagt

SEQ ID NO: 42631 - DNA, 201 bp, Homo sapiens
tcatagctccactaggcactgccccagtggggactctgtgtgggggctccaaacccacctttatccttttcactgccctagcagaagttcttcatgaggaytctgcctctgttgcagacttctgcccggacatccaggtgtttccctacctcctctgaaatctaggcacaggttcccaaagctcagctcttatcttctgct

SEQ ID NO: 42632 - DNA, 201 bp, Homo sapiens
tggagtgcagtggtgcgatctcagctcactgcaacctccgtctcccggttccagtaattctcatgcttcgttctcctgagtaattgggattacaggcatgygccaccacgcctggctaatttttgtatttttagtagagacaggttttcaccatgttggccagggtagtcttgaattcctggccccaagggagttgcctgc

SEQ ID NO: 42633 - DNA, 201 bp, Homo sapiens
tttactttctagttttttcccccatttttcaaataaaaatagtatttgccatagctgcttgataagcattgtggacacattttggaattttaaagtgatamagacacttgtattaggttggtgcaagagtaattgaggtttttgccgttacaaaaacccctggactacattacttaaatggcaaaaaccacttactcttgc

SEQ ID NO: 42634 - DNA, 201 bp, Homo sapiens
tatagcaatgccccactctttgcggtacacatttcctgtattcatcactttcacactgctataaagaataactgagactgggtaatttatgaaggaaagakgtttaattgactcacagttctgcatggctggggaggcctcaggaaacttacaatcatggtgggaggcaaaggagaagcaaggcacattttacatggtggc

SEQ ID NO: 42635 - DNA, 201 bp, Homo sapiens
tttctcatttgtttccctttccttgggggtcagagatttgttatgcttaatgtccaaattctgaaaacaattgtttcatatattttgtccattcttctaawtttttttaatggcagtagggcaagtccaatactagctatcccattatgatggaagtggaagttttgtagagtaagtgttttgatagatatgggcacataa

SEQ ID NO: 42636 - DNA, 201 bp, Homo sapiens
catcaatcatgaatattttccttttgtatttaatatagcaaagtggactaaaaaaggatgcttaattaaggtataggcagtgatttgaacattgtaatttmttaattacagtgtaattgtaaagtgacggttatgaaaactatatagcagtgagggggtgtttataatatgttacatgaaaacatcagaaggtaaacattt

SEQ ID NO: 42637 - DNA, 201 bp, Homo sapiens
aatcatgaatattttccttttgtatttaatatagcaaagtggactaaaaaaggatgcttaattaaggtataggcagtgatttgaacattgtaatttcttarttacagtgtaattgtaaagtgacggttatgaaaactatatagcagtgagggggtgtttataatatgttacatgaaaacatcagaaggtaaacatttgtac

SEQ ID NO: 42638 - DNA, 201 bp, Homo sapiens
atattaattacatagtcaatccttttcatgtcttacattaagtacccattcctagttatgtaagctaacatgtacaggtaatgaaatggacaattcctcaygaataatgaattagaggcttgcagcttatacatagttttgttctcaaaattctcttttttccagacgtttctcttatctcatcctctttgtcctgtcttt

SEQ ID NO: 42639 - DNA, 201 bp, Homo sapiens
agggtcttgcctcaatgttgatggctgctgactgaccagagtggtggttgttgaagggtggggtggctgtggcaatttcttttagggagaccagaatgttkactgcattggttgactcttcatttcatgaaagatttctctgtagcatgttatattatttgatagcattttacccacagaagaacttttaaaaaaaatttg

SEQ ID NO: 42640 - DNA, 201 bp, Homo sapiens
ttttcaaagtttttgctttttattatttatttatttatttttgctttttaaaagcctctcaacaaactctccttattcccatgtgactgaggatgaaacaktctcagattaaacagacttctcaaggtcacgcattgtcagtgccaacattcaaaagaaggctaggtcaggttcttgaacatccttgtgaaattattcttc

SEQ ID NO: 42641 - DNA, 201 bp, Homo sapiens
tatgggatacatagagtcatcatttattattatttactttaaatagtgagagaggggcagcatggtatagtgcaaaaaagacacttagagtcagaagcttyaggttccacgttggccagtgccactatcgagttgcattgtgtggatgagtcggttttctgtgtgtctcagtttttttccacctgcaaaatgactgtgtgg

SEQ ID NO: 42642 - DNA, 201 bp, Homo sapiens
gcttcatgtattccctataatcctgtgttccagcttcactgttttttaaaaatttgcagtttgtcatacatacatacttactctttgaacttgatttcactttttttttttcagacatggtctcgctttgtcacccaggctggagtgcagtggcacaatcttggctcactgcagtctccacctcctgggcttgagggatcc

SEQ ID NO: 42643 - DNA, 201 bp, Homo sapiens
ccctaaggaagaaggtgacaagatgagaagatggacacacagatggaaaaaacatggccaggtgtcctgagctgataattaaatgaaattttaaaaatatwgagtctaagagatagcttgatgctgttcttgcctccagtctcagctttgctgtattagctgagtgaccttgggcaaatgttttctattttgtgaatgata

SEQ ID NO: 42644 - DNA, 201 bp, Homo sapiens
tattttgaatgcacaggtattctcattgataactacctttatccatattagtctccttgcttcctggaagcaacacacagaaatctgtattccagcctttrtttatgctctttcctctgctaacgcacccgctccttcttctctgcctatacgaagagtttccattctttaagctggtttctgctcaccctaccccctcac

SEQ ID NO: 42645 - DNA, 201 bp, Homo sapiens
ctaatgatgaatggggagaggtttcagtccttgaatcttctggagtagatgttgggcaggtgcagttctagaaatacaatgtatactctgtatagaggtarccgagttgaagggattattaacactatgtttgaggggctctgggggaaggcttctgaaagtggtaacatcacggttgtttggacaggcaaattagcagaa

SEQ ID NO: 42646 - DNA, 201 bp, Homo sapiens
acagatgggagagttaaatgacgtactcaaagactacagctacaaaaaattcaggttcagcctgtgcctggctgatttcaaaccccctttccatctcgcaracttacagttcaggaaggctaacctgtccaaatgaactgctcaaggggataggcagttagcttatcttgcctactctggatcaaatgtaagctgctgatg

SEQ ID NO: 42647 - DNA, 201 bp, Homo sapiens
gagagcatcaagtacccactgaaaactggtgagacaataaatgacgctgtgctctgtgccgtggggatcgtcattgccatcctcgcggtaagtgtccagaytctgctatggtggatcctgtctgacttcttcctgtattgtcatattatagaatgtctgagccaacagagacttataccaagtagaagccaactttctctg

SEQ ID NO: 42648 - DNA, 201 bp, Homo sapiens
gcagctgcccagtttgtgagtggctcccctccttagctccagttaaaagtacctaaagatagaatatctggtggcttcacagttccatggaaagtcagccrgacccagcgtccctttctggcctacttctctgtggccttatcactattcttcatttctagtctttgtaaaatcaggctcatactccttacccggaaagga

SEQ ID NO: 42649 - DNA, 201 bp, Homo sapiens
ggaggtgcagcaataaagtgaccaggaaagtgtctagcggtagctaatgttaattcccacctccctccaacccaccgcccatttttgctgatgcctactayttcagcagagccaagagctgccaaacattcgttcaatttttatctgaaggtctgcagattttggggtgttttctggagctgttctttataaatgagcatc

SEQ ID NO: 42650 - DNA, 201 bp, Homo sapiens
ttaaaataagaaaggtccacaagacacctgggaaaaccagccctttcattttgcacatgaagaaaatgaaccccagagagcagatgaggaagtgtgatcckgtgatcaaactggtagttggtggcagagctaagactgatggtaataataacataaagttattacttaactcccagacttgcttgtgcagtcttactgata

SEQ ID NO: 42651 - DNA, 201 bp, Homo sapiens
aagactgatggtaataataacataaagttattacttaactcccagacttgcttgtgcagtcttactgatatcagacatttcttcattgaaccaatgactartgttgacttactttccctgccaggatattgacagagctgatccaccttggaccacttgaggcttccattacccagtaggcaaaaagaacggccacacaga

SEQ ID NO: 42652 - DNA, 201 bp, Homo sapiens
aattggctataccaattggcattcaaatgacatggcattcaaatgacagcaaggagtatttcaaattcatttactggattagtcagtaaataggtattgcrtgccagctggctgccaggtcatgtgctgagggcatcctcagtgctctcactttagtaatgcccctgtggaagttcttgtcacattgttgatgggtggtta

SEQ ID NO: 42653 - DNA, 201 bp, Homo sapiens
acctcagtctcagcatgtctaaaaagccaactcagcccgggcaacatagggagaccctgtctctacaaaaataaaaaaattagctgggcgtggtggcacgygcctgtaatcctagctacaccagaggctgaggtgggaggatcgcttgagcctgggaagtcagggctgcagtgagccgtgatcacaccactgcactccagc

SEQ ID NO: 42654 - DNA, 201 bp, Homo sapiens
aatcctgttagagtgggttacatggctaagtaaatcctttgttggagagatttaagtcttgaaggatatttaagtcttgaaagataaataggagttgtttwaattcagatgttaaagacattacttcatggagttgttaggaagatcaaatgtgatgatttatgtaagagctcagaaatactttgcatggatgggactatt

SEQ ID NO: 42655 - DNA, 201 bp, Homo sapiens
tttgcacacttctaagaccagtagcaattaattactttaaatagaagccctgtcacttacaagcaacataaatatttgtattttgaacctctaagtaatarttgtgttgaccattctggccttaagtgatttaaaaaaatcagtgagtgatattttaacagggaatatgtttataaagaaagggagggtcaggtcatagag

SEQ ID NO: 42656 - DNA, 201 bp, Homo sapiens
taccttatagttttgttactatgtgaaacatctatgatactttgttgattaagaagttcatttaaacacaattatttaattgtcataaaagaaagattatyattcccattttatagatgataaaacttagtttttccctttctgatttgcccagggctaaaaagtggcagagtcagaactcatatccagttctgacttgtc

SEQ ID NO: 42657 - DNA, 201 bp, Homo sapiens
cactcactagattcttttttttttttttttttggtcatgctttgcaaaaattttgtaatgcaccttttattacgaatacatttaaactccaggctattgcrttcagagtttgatgaaattagttacctagcacatgtgtgatacacagtgaaagttcagttaacttgagccagtgccattcccttgattgttctgaacagt

SEQ ID NO: 42658 - DNA, 201 bp, Homo sapiens
tggtcatgctttgcaaaaattttgtaatgcaccttttattacgaatacatttaaactccaggctattgcgttcagagtttgatgaaattagttacctagcrcatgtgtgatacacagtgaaagttcagttaacttgagccagtgccattcccttgattgttctgaacagtgcctttttcatcagaggccatgagatttgct

SEQ ID NO: 42659 - DNA, 201 bp, Homo sapiens
cacaataaggtttgagaaatacccccactctttgctcattaaacctgcagactctgttcaggtgtgcttcccccaagccacactcctccggggcttggctsggagcatgctgggtgcagacatcggtaacctcttagcttaatgtaccaaaattgcatgcataaagatctgtatcaagactgtcagattctcaggggcaga

SEQ ID NO: 42660 - DNA, 201 bp, Homo sapiens
agtgagttagttctcacaagatctgatagttttataaggagcttcaccaccccctccacttgctctgcacttctccttgctgccaccatgtgaagaaggaygtgtttgcttccccttaagccatgattagaagtttcctgaggcctccccagccctgtggaactgtgagtcaattaaacctctttcctttataaattactc

SEQ ID NO: 42661 - DNA, 201 bp, Homo sapiens
tagattctatcaccctttctcaaatttagatgctatcagataatccagaggtcagcctcccgagtagctgagattacaggcgtgtaccaccacaccaggctatttttttttttttttgagatggactttcactcttgttgcccaggctggagtgcaatggcgcgatctcggctcactgcaacctccacctcctgagttcaa

SEQ ID NO: 42662 - DNA, 201 bp, Homo sapiens
aatctttgacaaacctgacaaaaacaagcaatagggaaaggattccctatttaatacatggcgttgggaaaactggctagccatatccagaaaactgaaastggaccccttccttacaccttatacaaaaactaacccaagatggattaaagccttaaacgtaagacctcaaatcataaaaaccctagaagaaaacctagg

SEQ ID NO: 42663 - DNA, 201 bp, Homo sapiens
accaaaagcaatggcaacaaaagccaaaattgacaaatgggatctaattaaactaaagagcttctgcacagcaaaagaaactatgatcagagtgtacaggaaaaaaaaaagaaagaaagaaaagaaaaaagaaaaaaggtttgtatttcattcttcaataagaagtgtttcaaaaaaaatgtatagttatactttgttaaa

SEQ ID NO: 42664 - DNA, 201 bp, Homo sapiens
tttatagttttcaaaaaattttaaacttttccaaccattatttctctactccactgagatttgaattacatgcatgttacactgcttgatattatccacargtcattgtaattgttcattatcttttgttctttttcctctctgagcttcactttgggtgtatttcagttgactatgtcttcaagtttacccgcctttcct

SEQ ID NO: 42665 - DNA, 201 bp, Homo sapiens
tatagttttcaaaaaattttaaacttttccaaccattatttctctactccactgagatttgaattacatgcatgttacactgcttgatattatccacaggycattgtaattgttcattatcttttgttctttttcctctctgagcttcactttgggtgtatttcagttgactatgtcttcaagtttacccgcctttccttc

SEQ ID NO: 42666 - DNA, 201 bp, Homo sapiens
attaagtcttcacaaccaccctatatgaaaaggaacagttatctctagttacatacggggaaactgaggcacagagtcacaggattgaaatccaggagatgtggttccacagtcgtgcagtctttttcattttagtattctcaaaatctagcgtagtacccggtgttggatgttaagatcttaaacaaacaaacaacttgt

SEQ ID NO: 42667 - DNA, 201 bp, Homo sapiens
taagtcttcacaaccaccctatatgaaaaggaacagttatctctagttacatacggggaaactgaggcacagagtcacaggattgaaatccaggagatgtggttccacagtcgtgcagtctttttcattttagtattctcaaaatctagcgtagtacccggtgttggatgttaagatcttaaacaaacaaacaacttgttt

SEQ ID NO: 42668 - DNA, 201 bp, Homo sapiens
ccccaattttacatttaggaggcagacatgaaaatatgccttagccttcaggtctggaaccttaaaacaaacaaacaaaaaccagtgtgcataggaatatrgaaagaacatatccggaacagtcagccagtaataccttgtgtcagatgcaaggggctatggagagaaatgatttgcaagcctaattagacctgctcccca

SEQ ID NO: 42669 - DNA, 201 bp, Homo sapiens
tattttctaatagtatcactatgtggaaaaggctggaaactgaagataagtgtcttattcttagccatccggcctaaccacccatctgagacttgaagctrgttaggatccctgtaaacaattcctgatggaattgtctactctttattagggtatgggatgttgtgctgttttgggggattgcattaaaaaacaggattt

SEQ ID NO: 42670 - DNA, 201 bp, Homo sapiens
tctgaggatcttagctagtgcaggagatttatgggaaaggaataattatgatgttagacagagggggccctcaaccttcccatctattaaatgaaaacaartgacattaagatctcttacagttctaaactttcatcaggatattactgttatgcacctaactccattctgagtaagatttatgatgccaacaaatatctg

SEQ ID NO: 42671 - DNA, 201 bp, Homo sapiens
tgtccttcaacctcagaagagccattgggccccttggagctatactttgcttttctataaattggtcacaacggttcaccaatgccataggcttgttttgrttgtcaaatcatgtgatattgtgtgtgtgataagtgagaatcatccttcatatgtctgtagtgttgtacagtttacagcgtggcttttatgtgcacgctc

SEQ ID NO: 42672 - DNA, 201 bp, Homo sapiens
ccatctcgagcaggcaaataacaccttaatacaaactgtcataggccaaggcaggtggatcacttgaggtcaggagtccgagaccagcctggtcaacatgrtgaaaacctgtctctactaaaagtataaaaataagctgggcttggtggcacgtgcctgtaattccagctacttgggagactgaggcaggagaatcgcttg

SEQ ID NO: 42673 - DNA, 201 bp, Homo sapiens
tccactacatctgtgcaattaccaagaccaccaacagagagaggccacattaatccttcaactgtgttgtcccctgatcagatggctacagagttcttctragaccttcttatccctgggggaacagtgggagggggcatctatttgtgatttaacaacacaggcatggagattgcactaaattttcatctgttccctttc

SEQ ID NO: 42674 - DNA, 201 bp, Homo sapiens
aaataaataaaaagttggtcatatctaaaaatactttcacagcaacatgtagactggtatttgacgaaatatctaggcaccatagcctggccacaagtackcccctagttctatctggaaaatgctaattcttcctgctcatttagagcagtgaccctatcttcccttctcagggtcagcataaacccagctacattatgc

SEQ ID NO: 42675 - DNA, 201 bp, Homo sapiens
atccctgggggaacagtgggagggggcatctatttgtgatttaacaacacaggcatggagattgcactaaattttcatctgttccctttctccaccacccrcactcactctcatgtcctggaagaagtgagaacagcagcaattcttccttagttaggtacagctcttagggattcatgactatttgaaaaacgtatcaat

SEQ ID NO: 42676 - DNA, 201 bp, Homo sapiens
tacataataggttgctggaagacggggccaggtcttttcctctgggcacatggtaggtacttaaacaccaggcggacatttctccaggaagcattccgtasctgtctcctcccccaccttccaaaggtcacagagaaccctgggcccacctctgtggctgcagtcactgtgctgattgtcatgtctgtttacttgtatatt

SEQ ID NO: 42677 - DNA, 201 bp, Homo sapiens
tgtgaacatctgtctctctggagacatacatactactgcctagtaggacttctaagagaaagccagctcgatgccattgggaacagcacaggaattagaasgaggaagccccagcttcagtgatggtcttcttgctgtctcatttttatcagagtgattcactgccctctctggccttcatcatactcatttatataagtg

SEQ ID NO: 42678 - DNA, 201 bp, Homo sapiens; identical to SEQ ID NO: 9635

SEQ ID NO: 42679 - DNA, 201 bp, Homo sapiens
tagtagctaatgtttactaacacttatcaccacctacatgctgcactttttaaaatctttgtctatctcctctcccactcctctatacacatacaagaaartaatatccatgaagacaagaatatatttattttgttctctactgtatccccagtgcctaaaatagtgcggagcccatggctggtactctatttgttgcat

SEQ ID NO: 42680 - DNA, 201 bp, Homo sapiens; identical to SEQ ID NO: 9636

SEQ ID NO: 42681 - DNA, 201 bp, Homo sapiens
ttcgcctcgtctgtagaggtgaggtattcaggctgcctttcacaacccaaatttcattaaatagacttttaagggttaggattacaagaagccaagtccgsctggttcataatgatgatttatggctgtgttgtcgactccctgacccttctgtacaaggggatagagaaaatacataatttgttgctcattcactctaaa

SEQ ID NO: 42682 - DNA, 201 bp, Homo sapiens
aactgtaaggggtataactgtattataaatattataaactgtaaagcattatacacttcaccctgcatgagctaatgttagaatcattttcattttacctrtggggaaaaccagttctatccagttaagtgagcttgcctcagttttctcatctgtaaaatgggactaatgatagcaactccacctacttcagtgagttgt

SEQ ID NO: 42683 - DNA, 201 bp, Homo sapiens
gtaatcagtaattggtggattattttcagtagtgataaatctcctctaagcatcatatcatagatacagtatgaaaatcaagaaagatttgagaaggatcktcaggctcagagaagacagcacaggctgactggaggaaattcacaaacactgaagggcatcgtactacaagtttcttagttgttagactggtattctatt

SEQ ID NO: 42684 - DNA, 201 bp, Homo sapiens
cgtgccaagcaggagtctgtgacctctgctctgcttgtgccacatgacagaactcttccccacgaatcagggccgctgtcccagggaatgccaggaaggascaaagttctcttcttactcacaactatggctgtattgaatggtttttgaaacacagagacatcacctgaggttaagaggattgataaaaaagcagcatgt

SEQ ID NO: 42685 - DNA, 201 bp, Homo sapiens
attttcatctgttccctttctccaccacccacactcactctcatgtcctggaagaagtgagaacagcagcaattcttccttagttaggtacagctcttagrgattcatgactatttgaaaaacgtatcaatacggaggtgatgatatgctccatttgaagtcataatgcttaggaggccgagaaatactttctgtgagggg

SEQ ID NO: 42686 - DNA, 201 bp, Homo sapiens
cctgatcagatggctacagagttcttctgagaccttcttatccctgggggaacagtgggagggggcatctatttgtgatttaacaacacaggcatggagaktgcactaaattttcatctgttccctttctccaccacccacactcactctcatgtcctggaagaagtgagaacagcagcaattcttccttagttaggtaca

SEQ ID NO: 42687 - DNA, 201 bp, Homo sapiens
agtgccactatcgagttgcattgtgtggatgagtcggttttctgtgtgtctcagtttttttccacctgcaaaatgactgtgtgggattatgtctattattrccattaaacatgcggtgaccgatttctagtagaggcttgacgttagagacttgacatatgctgaatgtctaccctatgcatctactctgctgagctcttc

SEQ ID NO: 42688 - DNA, 201 bp, Homo sapiens
tggggcttttccaggtccttttctaccatgccattctttctctttgcttggtatgtgctatttacttccttttttttttttttttttttttttttttttgkgaaacggagtcttgctttgtcacttaggctggagtacaatggtacgatcttggctcactgcaacctccgcctcccaggttcaagtgattctcctgcctca

SEQ ID NO: 42689 - DNA, 201 bp, Homo sapiens
ccacccatctgagacttgaagctggttaggatccctgtaaacaattcctgatggaattgtctactctttattagggtatgggatgttgtgctgttttgggrgattgcattaaaaaacaggatttgggatgtgggagagattaggttaaaatttagaaagtggggagaaaacgatccacaagtcctagagtgtatttggtag

SEQ ID NO: 42690 - DNA, 201 bp, Homo sapiens
ttggtacagttttggtaattagtagcattaataatagtatctatcaattttataattgaaagcacctgaacaattttataattaaaagcacctgaataaatgatggtgatgagtcatttccacaaatatgcattgagcacctttaatgcaccaggttctgtgctgggtgtcgaggtctaatgatgaatggggagaggtttc

SEQ ID NO: 42691 - DNA, 201 bp, Homo sapiens
tggtacagttttggtaattagtagcattaataatagtatctatcaattttataattgaaagcacctgaacaattttataattaaaagcacctgaataaatgatggtgatgagtcatttccacaaatatgcattgagcacctttaatgcaccaggttctgtgctgggtgtcgaggtctaatgatgaatggggagaggtttca

SEQ ID NO: 42692 - DNA, 201 bp, Homo sapiens
gttattttgcaaaacagatattagccccatgtgtcagtaatctacagtcatttgtaccttaacataaaatgccaaagcacagtaatatattcttagtgtaaaaaaaaaaaaaaaaaattcaaggctgggggtggtggctcacacctgtaatcccagcattttgggaggccgaggtgggaggatcacttgagctcaggagtt

SEQ ID NO: 42693 - DNA, 201 bp, Homo sapiens
ctacattcacctatactgtccctccctgaaccacccagaccagtttttaaatttggcctttcctgaagtgaaacttttttttttcttttgaggcagggtcycaaaaacccaagtcatttttgacactagcataaaaatgttgctttttttctaaaggtaaattaatttatcattattgatgctttaaactataccacctaa

SEQ ID NO: 42694 - DNA, 201 bp, Homo sapiens
catagtaaaagtaggcagtgttggatacttatcatcgatttttctcttgtttcttcatcttgagtttttgggtgtttttgtttgtttgtttgttttttgtttttttttttttttttttttttttttagtgtttggccttccttctcctgcataagtgattatggcaaattgcacacacacaccccaacaggcactagggaa

SEQ ID NO: 42695 - DNA, 201 bp, Homo sapiens
atagtaaaagtaggcagtgttggatacttatcatcgatttttctcttgtttcttcatcttgagtttttgggtgtttttgtttgtttgtttgttttttgtttttttttttttttttttttttttttagtgtttggccttccttctcctgcataagtgattatggcaaattgcacacacacaccccaacaggcactagggaag

SEQ ID NO: 42696 - DNA, 201 bp, Homo sapiens
agtaggcagtgttggatacttatcatcgatttttctcttgtttcttcatcttgagtttttgggtgtttttgtttgtttgtttgttttttgttttttttttkttttttttttttttttagtgtttggccttccttctcctgcataagtgattatggcaaattgcacacacacaccccaacaggcactagggaaggccagaac

SEQ ID NO: 42697 - DNA, 201 bp, Homo sapiens
ttctgatcctcagtttttccatttgtaagatgggtagaacagtacctactcataactctgtactgtaggtaagatgtataaactttttatcacagagttctttttttttttttttgaaacaagatctggctctatcacccagactggagtgcagtggtgcaatcttggcttactgcaacctccgccttctgggctcaagtt

SEQ ID NO: 42698 - DNA, 201 bp, Homo sapiens
aaaagataaggaagggaattccacgcagaaggaataccatgaagacatggcgatgggtgagaacatgatatgttttgtgaccctagaaatgcagaacaacraaacttgggggataatggggagaggtgacctcaatgaatagtagcctcattctccctttcagcttcaaaattggatggtttctgggaatggggtcccctg

SEQ ID NO: 42699 - DNA, 201 bp, Homo sapiens
atcatagactgaatgtatgagactgaatattaagactgaaaatacccttttaagaagtcatttttgcccattcattctgttttgttcctttgtccttctgyttctttatttattcagtcatttcgcaataaatatttattgagttcttcccgtgaagtaggcactgtgctaaattttggggatacagtggtaaataaagac

SEQ ID NO: 42700 - DNA, 201 bp, Homo sapiens
ttaatgtgaggtgacagtgggggatgggtgtttgcactgaagggtaaccctttgctgactgtgcccttctgagctttgctctcagcaggaggacagcccgygggggcctgctgttgtggttccttcttggcgccactgccctaattggagtcccctgcacccccagttaaaaaaattaaaaggttgggggatccttactag

SEQ ID NO: 42701 - DNA, 201 bp, Homo sapiens
tcaggtcaaacagcagaaacccttctgctaatcccctgccccttcctgccttttctcaggagtattacggtagatgtttccattcagtcctctggaagcaytcgtgatatcaaatccaacacttatagcagcaagctagcaatttttgtttagtaaaaaccagaggtggaatatgaatataacagtttggaagaatctgga

SEQ ID NO: 42702 - DNA, 201 bp, Homo sapiens
aaaaagcagcatgtatggcacaaaggccaccacttgaggtgccaagaaacacagaatccattttccagtctgccagataacctcctgagccaagcctttayggactccctgttaattgagttgtaatcttcgctgacatttgctgagagcccaagcactcagagagaaggtagcaaagctggagttgaccccagacagcct

SEQ ID NO: 42703 - DNA, 201 bp, Homo sapiens
ccttgacctcaggtgatccacctgccttggcctcccaaagtgctgggattacaggtgtgagccaccaagcccggcccctttaacatttcttgttgtgcagktctattggcaataaactttctcagcttttatttgtctgaatctatattttaccttaacttttatttatttttattttttaaattttattttatgaatatc

SEQ ID NO: 42704 - DNA, 201 bp, Homo sapiens
tagctgccgcttatggttacttagtaaaaactcctgttgctaaatggctcaaatggatgtctgtgtgtttattttgccatctaatacaaagcataaatttytcttactccagtagctcatcaaacccttgaatctttcatcataagcacattgaggcaggaactatgcctgtgccatcctcacacctttgcaagtggcact

SEQ ID NO: 42705 - DNA, 201 bp, Homo sapiens
aatttttcttactccagtagctcatcaaacccttgaatctttcatcataagcacattgaggcaggaactatgcctgtgccatcctcacacctttgcaagtrgcactcaataaatgtttctcaagtattgttcagactcagtgaggtcacatccccaggaggaaaaaggacgctgggaatgagtgatacgagatttgtcatt

SEQ ID NO: 42706 - DNA, 201 bp, Homo sapiens
tgaggccctggctctaccctcatctcaggctcttctaaagagcttttgtattctaaagaggatttttccatcagagaggtaggagctgtaggaaccccgarggcagataagcagccctcactctagataaggtatgctgggggagcttactgagggaatcctgtacacagcccacatcaaaggaaggctgagaatggcctg

SEQ ID NO: 42707 - DNA, 201 bp, Homo sapiens
atctcccaccgggtccctcccacaacacatgggaattactggagctacaattcaagatgagatttgggttggaacacagccaacccatatcagtgtgtcasgttttttgtttttttttttcaccaggactactgttgcattcatgtgggatatttattatgctgtattatgcaatattcctgggtcccaatcactatgtac

SEQ ID NO: 42708 - DNA, 201 bp, Homo sapiens
gccccatccagaacccggttctgattagagggcaagagtgacagacgtggagggtggaggggcccagagctggaaattgaaccatcatcctgctgcttgcwgtcctgagccttctcctgctgaatgtcaggtttgtttaaaacagcaagagaggccttgactgagttggatgcccctgctcccattcagatggtccccaca

SEQ ID NO: 42709 - DNA, 201 bp, Homo sapiens
agattctatcaccctttctcaaatttagatgctatcagataatccagaggtcagcctcccgagtagctgagattacaggcgtgtaccaccacaccaggctwtttttttttttttttgagatggactttcactcttgttgcccaggctggagtgcaatggcgcgatctcggctcactgcaacctccacctcctgagttcaag

SEQ ID NO: 42710 - DNA, 201 bp, Homo sapiens
tcggctcactgcaacctccacctcctgagttcaagcgattctcctgcctcagccacccgagtagctgggattacaggtgcctcagccacccgagtagctgrgattacaggtgcccgccaccacgcccagctaattttttgtatttttagtagagacggtatttcaccatgttggccaggctggtcttgaactcctgacctc

SEQ ID NO: 42711 - DNA, 201 bp, Homo sapiens
tgaatggtaagtgggtaagaaggacaactcttggtggcagtactcagccctctgttgtcctggacacttcaagataaggttccatatttgcctcttcctaytcagcagtagaaaactcgacagttaatcagagtagatctccttaagggtcatgcctcttggaggtctcacccctaaagatgacctggtaaatgcaatgtt

SEQ ID NO: 42712 - DNA, 201 bp, Homo sapiens
ggaatagggaggccagaggagaaggagagaggagaagggaatggctagaaagtggagcagtcagaacacacacaaaatgtgttaagtttgctattttataygggaatggtttgtggtggtcctgaaagaattacaatagtaacatcaaagatcactgatcacagatcatcttaacaggtaataataatgaaaaagttggaa

SEQ ID NO: 42713 - DNA, 201 bp, Homo sapiens
atacttcaatgcaaaaatggatataaagaacccaacacattgtgagtgtgcattcaatagtggctgtattatccactgtgttttttttttttgcagcccaraagtcttgtatttattttattttatttttttaacatctactatgccatgagttcatacgttccagcagcaggctccttccccttggttctcacaaagttg

SEQ ID NO: 42714 - DNA, 201 bp, Homo sapiens
aataataatgaaaaagttggaaatattctgagaatatcaaaatgtgacatgaagacacaaagtgggcacatgctgctggaaaaatgacattgatagccttrcttgatacagggttgtcaccaactttgcattgtaaaagtgtactatctgtgaagcacaaacaagtgaagtgcaataaaatgaggtatgcctgtattctgt

SEQ ID NO: 42715 - DNA, 201 bp, Homo sapiens
aagggacttttgtggtgagtgatgagttgaccatcactgtctctgggctgtggttacaagcaggaagtggccatggctgggctgtggagttaagacaaagrcagcagggtgtgtggttgtgcacatcataggcatttaccttacagaacatcagctgtcccccatccttaatgtaaatgatgtcactatatctatcttgag

SEQ ID NO: 42716 - DNA, 201 bp, Homo sapiens
ctcttattggtagttctttgaacagtgaaagaaaagcctggaaaatggcattcatgaagcagctactatgtgccaggcactgtgctagaggttgtgtgtgygttgatctcctttagtcatcaccacaactcattttactgtgggaaaaaactgggactcagggaaatggagtgggaaccagaggaagtgctggatctgggg

SEQ ID NO: 42717 - DNA, 201 bp, Homo sapiens
ttctttttagagcagtacccattcccttagatgtctacagcatcacctttctcatagattctcatatacgtggccaaataaacaactccatgttttctaamaggcctagagaacatctatcgggtgcctctcctctttccctttgtgtttgtcattttggtgaattactggaagatggcagttccagctgaaaggccactg

SEQ ID NO: 42718 - DNA, 201 bp, Homo sapiens
tgtctacagcatcacctttctcatagattctcatatacgtggccaaataaacaactccatgttttctaacaggcctagagaacatctatcgggtgcctctyctctttccctttgtgtttgtcattttggtgaattactggaagatggcagttccagctgaaaggccactgtgtttttggtggtcttccctagttccaagat

SEQ ID NO: 42719 - DNA, 201 bp, Homo sapiens
catcgtaaaccaggcacacaatcaacagcttgaatttggggagggggaagggaggctagtagaattctttccaacctttaaaagaaaaacagtccatttgscagtagtttcttaaaggtggactaaggatctttgtgtttgaaaactgaaaaatgaaaggtctagttttcctgtgtgctccaaattgacagttgtgggttt

SEQ ID NO: 42720 - DNA, 201 bp, Homo sapiens
gattagatagtgctttcctatagttccggagaaacacaagccaagaaattactgcaataattgttatctcttgtccagtgctactgtgtatggggatacaygtgaaaaatgtggatgcatttcacccttgaaaccccaagagctagatattcttagggttttcagtttagcacagggttaaaagcacatgccctggttcag

SEQ ID NO: 42721 - DNA, 201 bp, Homo sapiens
gatattgtgtgtgtgataagtgagaatcatccttcatatgtctgtagtgttgtacagtttacagcgtggcttttatgtgcacgctcttctttgcacctggdagtaatcctgggaggttgattcttacagctaactcaaccggggctcaaggatattaagtgactctctcataactaagtagtggcatggccagaccaggag

SEQ ID NO: 42722 - DNA, 201 bp, Homo sapiens
aggagaatcgcttgaatccagggggtggatattgcagtgagccaagatcatgccactgcactccagcctgggcgacaggatgagaccacgtatcaaaaagaaaaaaaaaaaaagctacataataggttgctggaagacggggccaggtcttttcctctgggcacatggtaggtacttaaacaccaggcggacatttctcca

SEQ ID NO: 42723 - DNA, 201 bp, Homo sapiens
ctgtgacatcatagctaccctttaccttgtcgttgattcttcatttagtatttcttttctatagttaagttcttgtctctcccttaaaaaaaaagatacacacacacacacacacacacacacatacacatatatacatataaatatatttggttgtatatttttgttgttacaaaggggcttaaaacacccaactatatt

SEQ ID NO: 42724 - DNA, 201 bp, Homo sapiens
accatcatcctgctgcttgcagtcctgagccttctcctgctgaatgtcaggtttgtttaaaacagcaagagaggccttgactgagttggatgcccctgctsccattcagatggtccccacaacaaaggaacggaatggcagtggaggagaccagtgtggtttagagatgcaaatcatcacgcgttatggagaaagcagaca

SEQ ID NO: 42725 - DNA, 201 bp, Homo sapiens
gcaaagctggagttgaccccagacagcctgacacagagctggcactccaagacccaggctttggcaggtctcctctcatctctccaccccttcacctcccrgcatgtcaaacatttcaatattttccaacacctgagtttctgtattagatacctgtcccctttgatggaacacagttccagtgtcacctcatctctgatg

SEQ ID NO: 42726 - DNA, 201 bp, Homo sapiens
gagtcccatctattcccttctgatttactccagggctgcctgggcacaggggaatggatgaaatgagctcccaaacctcttctggccctgcagaagtctarctctttgcccagtaatgtgaccttgaggtaatctgatcttgccactgctggcccccactcttaggcaggcagaaacatggatgtgggagagagaaggaag

SEQ ID NO: 42727 - DNA, 201 bp, Homo sapiens; identical to SEQ ID NO: 9634

SEQ ID NO: 42728 - DNA, 201 bp, Homo sapiens
caaatgatgtatctcaggggagaaaaaagagactccatgttttcaaagtttttgctttttattatttatttatttatttttgctttttaaaagcctctcarcaaactctccttattcccatgtgactgaggatgaaacagtctcagattaaacagacttctcaaggtcacgcattgtcagtgccaacattcaaaagaaggc

SEQ ID NO: 42729 - DNA, 201 bp, Homo sapiens
tatgatctgcatttaaattcccaaatttaaaacaaaccaaacaaaacaacgcacttcagactcttttggaaacctttgaaaggaacttgatttctgtgtgmtttgaaagtatatattgcaatcaaggtattggtggtaagtgtgtttttgaggtttgtcacaaattaacaaaattatatgcctaaagagttttgcagagaa

SEQ ID NO: 42730 - DNA, 201 bp, Homo sapiens
aacttgatttctgtgtgctttgaaagtatatattgcaatcaaggtattggtggtaagtgtgtttttgaggtttgtcacaaattaacaaaattatatgcctraagagttttgcagagaaatgcaaatcattgtaagcgccttgtcataataagtagtgtgctttggttcctgtttatgtatccctaaaacacataatacact

SEQ ID NO: 42731 - DNA, 201 bp, Homo sapiens
tgccttgcagccccttctaggcactactaggggcgggcatccagacatgggcaacctggaagcccaacaggtgaacttatgatgttagagatcacagctartggataacatcttcctcttttctactgcctcccccactaagtgggcagtcctgagatacagtgtattctgattcttaggagcacggcacttggcagcaac

SEQ ID NO: 42732 - DNA, 201 bp, Homo sapiens
tattgcaatcaaggtattggtggtaagtgtgtttttgaggtttgtcacaaattaacaaaattatatgcctaaagagttttgcagagaaatgcaaatcattrtaagcgccttgtcataataagtagtgtgctttggttcctgtttatgtatccctaaaacacataatacactattacattgacacgaaggaaaccattctca

SEQ ID NO: 42733 - DNA, 201 bp, Homo sapiens
attggcatcatgtaaacagcttgatagtagattttcaggactgggaaggaagagaactaatctttgttaaatacctgccttctgatatttcatcctcacarcttttcaaagtggatattggcatcctctttttagagttgaggctcagagaaattaggcaacttgctgaagatcacatagagtgtcagtggcaaaactggt

SEQ ID NO: 42734 - DNA, 201 bp, Homo sapiens
tataaagcaaaacatttttaaaaaccactcctagtttcatcatccagaaaagataataactttaatatttagatattgtatcagtctgttttcacactgcsataaagatactacccgagactgagtaatttatgaaagaaaaaggtataattgacttacagttccaaatggatggggaggcctcaggaaacttacaatcat

SEQ ID NO: 42735 - DNA, 201 bp, Homo sapiens
ggccatttaaatgttgggaggtatcagttatgtaagaatgatgtgctgttgttgtcacacacaataagtcaatcttaaaaaggcatttatccctgctgatrttatagtttttatacagaccaatttaatgaactggatgtcattttgatgtgtgaattttggtaagtttgtttgccagaaattctaattacttaattacct

SEQ ID NO: 42736 - DNA, 201 bp, Homo sapiens
atctagaccactgggcagatgactgcccaagattgacagtgtgcatcaatggtttgtagagatggtgatcacctgctgtgtgtaggtaggtgccgggtgawacctcccttatagcaagcaggctttgtggtaggcaccttggcctataagctgatgtgtaaaatacagatcttgcctttggatcttatggtttaaagggaa

SEQ ID NO: 42737 - DNA, 201 bp, Homo sapiens
tgacgtactcaaagactacagctacaaaaaattcaggttcagcctgtgcctggctgatttcaaaccccctttccatctcgcagacttacagttcaggaagkctaacctgtccaaatgaactgctcaaggggataggcagttagcttatcttgcctactctggatcaaatgtaagctgctgatgttacatgtaccacatttc

SEQ ID NO: 42738 - DNA, 201 bp, Homo sapiens
tgtgacatcatagctaccctttaccttgtcgttgattcttcatttagtatttcttttctatagttaagttcttgtctctcccttaaaaaaaaagatacacacacacacacacacacacacacatacacatatatacatataaatatatttggttgtatatttttgttgttacaaaggggcttaaaacacccaactatatta

SEQ ID NO: 42739 - DNA, 201 bp, Homo sapiens; identical to SEQ ID NO: 9633

SEQ ID NO: 42740 - DNA, 201 bp, Homo sapiens
gttcatgcctgtaatctcagcactttgggaggccaaggcaggagaattgcttgagcccaggagttcaggatcagcctgggcaacatagtgagaccctgtcwatatatatatatatatataaatgattaaaaaaggctgtaaattccccgggggagagattttttggtctcttcattcactactatatcctacttcccaaaa

SEQ ID NO: 42741 - DNA, 201 bp, Homo sapiens
ttctctagcccagaggccttcatgcagatgaggaagtgaatgcagataagccagaatgtcagcagtagactagaagaggtcaagatgattagactttcagsttttgtccagctctacttaccctttcagggcacctaggactttactaaagcccctctgggtattctgatctgggaaagtgtgttttggtctagaataggg

SEQ ID NO: 42742 - DNA, 201 bp, Homo sapiens
ccgcttcttggaaaatgcctcctcttccctctgtgaccttgggagtgactcacacagaccctaaactcagtgttcattggagaagaggaggttatctgaaggctgagccctctctcagcctgaggccctcgtacatcgagtcacagacttcctagggataacttgggatggaccacatactgatttgccccaaatgaatgg

SEQ ID NO: 42743 - DNA, 201 bp, Homo sapiens
atttacaatgtaaagatggtttggaaaggggtgataaatctctttccctgccttttactcactcacctgtgaacatgcaagaacagggactcaatcttacytatcatttttctccaaatgcctgacacccagccttgtgctcagtgggacctcatggtccagaatggcttggaatcgcagcactgagagattcatttcatt

SEQ ID NO: 42744 - DNA, 201 bp, Homo sapiens
atgctcacaaattcccagtgccaaaagccgctgaaagccctttattgaggtcaaaaaataatgattgcagttggataatcccatctagttaaaaaaaaaayggctgccaaagatggcttttctttagatagcacttactgtacttagggcatgagggtgagccaggtcccaaggctttctcctccaaagagggttattcct

SEQ ID NO: 42745 - DNA, 201 bp, Homo sapiens
gctcatttagagcagtgaccctatcttcccttctcagggtcagcataaacccagctacattatgctgtcactccacatagctattgactttgatgttcagrcccagtagcactgtagaggacaagtctcccacagagagtgctagctcttagtaaggagaggcaggccacttctgcggttctaaaggtttagctaaggcta

SEQ ID NO: 42746 - DNA, 201 bp, Homo sapiens; identical to SEQ ID NO: 9638

SEQ ID NO: 42747 - DNA, 201 bp, Homo sapiens
ttatttgctaaacggacctaacaggattcttgctgaaggcaggccagggtgatcagctattacccagggaatggtgtgggggtgagaaatttggttagacrtcaagagtgatcaggtagtgagggtggggaattttggctaaattggcttagcagaattcttgctaaaactgggctcttgaagacatgcccaaggacagga

SEQ ID NO: 42748 - DNA, 201 bp, Homo sapiens
aaataaaggtcaatatttcacttataattctggatttgcaacaaagtatttttaataaacaactgtctctattctggagagaaggcaggttaattaaatcmcatgtgactaattaacaaaaaagaaaacaaatgaaagttccatacttaactattcttactagttacttaactcgaataaagtataacatttcaaaagcag

SEQ ID NO: 42749 - DNA, 201 bp, Homo sapiens
ttaagagaatactattatgggcctagcccccttcaaagagataagtagatacacgtgacaatacttgaaaccctttaaaggaaatgtaataaataattttgagatgttatttttagcaggtaccctagtaacaaatattatacttaatccattttcattttgtggctgagtacatttctaaattgcttcaatatgagtcaa

SEQ ID NO: 42750 - DNA, 201 bp, Homo sapiens
gagagttaaatgacgtactcaaagactacagctacaaaaaattcaggttcagcctgtgcctggctgatttcaaaccccctttccatctcgcagacttacakttcaggaaggctaacctgtccaaatgaactgctcaaggggataggcagttagcttatcttgcctactctggatcaaatgtaagctgctgatgttacatgt

SEQ ID NO: 42751 - DNA, 201 bp, Homo sapiens
agtaacaaatattatacttaatccattttcattttgtggctgagtacatttctaaattgcttcaatatgagtcaacattataattttcagtgcagctgagaaaaaataaaacgttttggatcagacttccttcatgagcaaatgcattaattggaataacaaaggttgtttgctttgctgtataaacattatggatctgac

SEQ ID NO: 42752 - DNA, 201 bp, Homo sapiens
gcagatgactgcccaagattgacagtgtgcatcaatggtttgtagagatggtgatcacctgctgtgtgtaggtaggtgccgggtgatacctcccttatagmaagcaggctttgtggtaggcaccttggcctataagctgatgtgtaaaatacagatcttgcctttggatcttatggtttaaagggaattcaagacaagtac

SEQ ID NO: 42753 - DNA, 201 bp, Homo sapiens
gagatgtaaaagaacaacttgaccctctgtggctagcaggaacttagaggtgcaggtgcctttcaagatggcaggcccttactgggtgttctgtgaacatmtgtctctctggagacatacatactactgcctagtaggacttctaagagaaagccagctcgatgccattgggaacagcacaggaattagaaggaggaagcc

SEQ ID NO: 42754 - DNA, 201 bp, Homo sapiens
acagtatagtggatgtgaaagtgctttgaaagctgtaaagtactaagccaatattattaaagcagatcagagtataggaaagtttgtccttcagactcagyggtggaagatgagttctcagtctctgaaagagattgttaggctgctgtgcaaaaatattacttttcttgggataatttacaaatagagtggaatgttaaa

SEQ ID NO: 42755 - DNA, 201 bp, Homo sapiens
tttactgcaatgatgagagcatcaagtacccactgaaaactggtgagacaataaatgacgctgtgctctgtgccgtggggatcgtcattgccatcctcgcrgtaagtgtccagactctgctatggtggatcctgtctgacttcttcctgtattgtcatattatagaatgtctgagccaacagagacttataccaagtagaa

SEQ ID NO: 42756 - DNA, 201 bp, Homo sapiens
agagggaatgaataactttatgaattggggaaatgaattcctagtttggttaaaagcatattctataccttatttcctgttcaataaatggagcattttcrtggaaaaaagccaaaagttttatgaatagtcccttactttttcccatctgttagaaacatttttcaaatataaattaaaaatgaatccctacaagaattt

SEQ ID NO: 42757 - DNA, 201 bp, Homo sapiens
aataacttagatgggacagaaactctgttttaccctaataaaatagaacttaaggcttagtaaatgcttcagacagttttctctatgtaccagtgaccacaaaaaaaaaaaataagtattgtatgactacaatgttacataactatataccacggatatgtgcgataataaaaagagcaagaataccaaacatgagtaatt

SEQ ID NO: 42758 - DNA, 201 bp, Homo sapiens
aaccagatttctccatcccatgtttcagaatcccagatttttcccaaccaagattctgacattagcataacagacttctttggttaagtgtttttgagctrggcaattctaactattcaatcttgaatctggttttcagctttttctgctactcactacaggagataagagcctctttctaacaaggctctcttgccgtca

SEQ ID NO: 42759 - DNA, 201 bp, Homo sapiens
tctcaccacacacacaaaaagattcgtatacaatatgtttgttaattagcttgacttatagccattccacaatcaatatatttcaaaacatatacatactraatatatacaatttttatttgccaatgaaataaaaaattttaaaacagtaaaaaaaaattctgtttggggataagtaattaaggattagtcaaacattta

SEQ ID NO: 42760 - DNA, 201 bp, Homo sapiens
acaccattggtattatcagtaaccaattatttcaagtctttgctcacagtcaccttcttggtgaaccctaccctggccaccctatttaagttgcagtttcttttttttttttttttttgtaattttttttaaatttttttttttttttttttttttttttagaagcagggtctcgccatgttacccaggctggtctcaaac

SEQ ID NO: 42761 - DNA, 201 bp, Homo sapiens
gaaaagcagtggcaggtttcctgaccctttctgggaaagtcaaagtgcaggaacctcaataggctttggtggttgcattcttcccctttgaaagggacaargccatattatcttgagagaaagacagatatgccttaggaagggtgggagagaatttagacacgtggtctgttttagggtcaactctcacttgggtcattc

SEQ ID NO: 42762 - DNA, 201 bp, Homo sapiens
tataggagaaattatttcccgggttttctcttttctaaagacacagaaaagttttctttggctttcctctgggctggggttacagccactgacaaaaactyacatcccctcgtttcctttaagaaattcctctgttctggaacagagcttcctgagagccatcctcgcagagttccgtcgatcaggactggaggaagccac

SEQ ID NO: 42763 - DNA, 201 bp, Homo sapiens
tatttatcatggtaactcagagtttggactcttccacagaagccatggcacactaccccacaaggctgaagaccagaaaaacttattcatgggttggcagscccttgttggatcgaaaactgcactaccaaacctataggtgagtgatggggtcctttggttgtcctggaaatacagcttctcaagctaaacagtcaactt

SEQ ID NO: 42764 - DNA, 201 bp, Homo sapiens
cccgcgtcgcctatcgaatcaatgatggcggctgcatgttagcggatgtacgtcatgcgcccctcttaggtgtacggagtgggcggggcgagctagttggygtcgcaacgaagggacggtctgggggcggggccacgccgattggcgcgaagttttcttttctccttccaccttcttttcatttctagtgagacacacgct

SEQ ID NO: 42765 - DNA, 201 bp, Homo sapiens; identical to SEQ ID NO: 9660

SEQ ID NO: 42766 - DNA, 201 bp, Homo sapiens
gagtccctgctattcaccacacaaagtgcctcttcaccaggctgtacaggtggtaatgggaggggaggagaactgacgaagcaggaagggctacaggacayccttaccagttcaatactggggattagaggaagggaaaaatgtaagccgatagtcatgtttgtgtcctgggttacttggaaagtgatttttttttttaga

SEQ ID NO: 42767 - DNA, 201 bp, Homo sapiens
tcttctttttttttttttttttctttttttggagacagagttttgctgttgttgtccaggctggagtgcaatggcacgatctcggattactgcaacctccrcctcccgggttcaagcgattctcctgcctcagcctcccgagtagctgagattacaggcacctgccaccatacccagctaattttttgtatttttagtaga

SEQ ID NO: 42768 - DNA, 201 bp, Homo sapiens
aggtgcatgtacatctccggtgtccctgggacagggaagactgccactgttcatgaagtgatacgctgcctgcagcaggcagcccaagccaatgatgttcstccctttcaatacattgaggtcaatggcatgaagctgacggagccccaccaagtctatgtgcaaatcttgcaggtaagcagagctgtttaggctttttgg

SEQ ID NO: 42769 - DNA, 201 bp, Homo sapiens
tgaccagcttccaaggatggtccctactgcccccacctccacatttcaagggtctcggtccttccctcagtatacattcccacactcctaactgattatarcgtgtagtggctggctgagacctaccccacgggttttcctctcttgctctaggtgcatgtacatctccggtgtccctgggacagggaagactgccactgt

SEQ ID NO: 42770 - DNA, 201 bp, Homo sapiens
acttttaaactgcaccaaaccatggaggtttaattatttaaaaaaaaaatgttttaggctgggcacagtggctcacgcctgtaatcccagcactttgggakgccaaggcaggtggatcacctgaggtcaggagttcgagaccagcctgaccaacatggagaaaccccatctctactaaacagacaaaaattagccaggtgt

SEQ ID NO: 42771 - DNA, 201 bp, Homo sapiens
ccgggcgtggtggctcatgcctataatcccagtttaggccgggcgtggttgctcacgcctgtaatcccagcactttgggaggccgaggcaggtggatcccraggtcaggagatcgagaccatcctggctaacacggtgaaactctgtccctactaaaaatacaaaaaaattagctgggcgtggtggtgggcaccagtagtc

SEQ ID NO: 42772 - DNA, 201 bp, Homo sapiens
aagcaattctgcacccgagggtcacctcaggaaaccaccgtcctgcttgtggatgaggtgaggtgcccatgggcggacaggagaagaaacagggctgtacytcaggagcaagtgctggatgggagggaggaaagtcctggctcccttctccattcatatgagcccattttctggtgctgagaggcgtgtgtcaatggattg

SEQ ID NO: 42773 - DNA, 201 bp, Homo sapiens
aggattgtatttcctcttaacctttgccttgctatttgtgtctagatatatagtcaacatgtggcactgtgcagaatggagggactgccgtaccccaccaygtcagagaccatggccgtgtgttctcacctgggctcctgtcgcctcctgcttgtggagcccagcaggaacgatctgctccttcgggtgcggctcaacgtc

SEQ ID NO: 42774 - DNA, 201 bp, Homo sapiens; identical to SEQ ID NO: 9668

SEQ ID NO: 42775 - DNA, 201 bp, Homo sapiens; identical to SEQ ID NO: 9669

SEQ ID NO: 42776 - DNA, 201 bp, Homo sapiens
ttctagtgccttttgtacactctggtatccaaaactgcttcccgtgacctcgctgtggtttcttgcagggatgcaaaagaagcaaaagcccagaatgaagygacctctactccccatcgtatccgcagaaagagttctgtcttgactatgaatcggattaggcagcagcttcggtaagactactccttggcaggcagagaa

SEQ ID NO: 42777 - DNA, 201 bp, Homo sapiens
ttttgataaactctacaatgatatccttctcgggttgaatttgaagcatcttcaaggttaaacacagaaagggtgttggttttatgttgccaccatagacrccacccacaaaccttaactccatggctttatcgactacaagttcagctaaaaaacaaaaacaatacagtaacatattagggctaagctcttcctagttgg

SEQ ID NO: 42778 - DNA, 201 bp, Homo sapiens
agtggtagtctaggtatgaaatgtgtaatttgttatatgggacctgggaattgggtttgggggcccaagggtgactttccacctggataatcactgggcartcaaccaacttattcctctgtcattttggctccccagggtcttaccaggatgtgcttccagccctatacatatagccagctgcagcagatcctaaggtcc

SEQ ID NO: 42779 - DNA, 201 bp, Homo sapiens
aagacatctacaattttgtggaaagcaaactccttgaccataccggagggtgagtcatgtgaggcaggcagggtagtttggggaataaggcccctgctagyggaatgccttgggtgttacagttcagccatacaggctttctccagtatcagcagactagaccaaatcgttgctgaagcccaaagcttctgaaacatttgt

SEQ ID NO: 42780 - DNA, 201 bp, Homo sapiens
ggattctctagcatttgaaattgagttttcaggtagaaacatagacaagaaaccataatcattttccattgattaatgagtagatggttggggaatgttcstaaagtcttccttttctcccgtttaccaccaatggtaggctgcatgtttctgctgtacctgagtctcttccctgtcgggaacaggaattccaagacatct

SEQ ID NO: 42781 - DNA, 201 bp, Homo sapiens
gaattccaagacatctacaattttgtggaaagcaaactccttgaccataccggagggtgagtcatgtgaggcaggcagggtagtttggggaataaggcccytgctagtggaatgccttgggtgttacagttcagccatacaggctttctccagtatcagcagactagaccaaatcgttgctgaagcccaaagcttctgaaa

SEQ ID NO: 42782 - DNA, 201 bp, Homo sapiens
agcctttgtatttctgttttatccttgtgtgcattttataagcgtcatgaagacatttacaacccctgtatcactgtcttttaatttcactttgttagatrttttacacctattgttctgccttattcctagtatttctaaatgttacagtttcatttcttaggaattgacctttctgttttcctggatggaaagagatac

SEQ ID NO: 42783 - DNA, 201 bp, Homo sapiens
tacccacagagcaaattgaaatccttcacatcacgtgaagtatgtgagtcatagtcaaaaaagttagaacagtagttgaaaaacctatgtcacagaagtaytggggagctttcttaaaatacagatttctaggcctcttcccacacctagtgagtcagactccaagcactggccctaggaatctgtatttggaaatgctct

SEQ ID NO: 42784 - DNA, 201 bp, Homo sapiens
acatctccggtgtccctgggacagggaagactgccactgttcatgaagtgatacgctgcctgcagcaggcagcccaagccaatgatgttcctccctttcartacattgaggtcaatggcatgaagctgacggagccccaccaagtctatgtgcaaatcttgcaggtaagcagagctgtttaggctttttggaaaatgctgt

SEQ ID NO: 42785 - DNA, 201 bp, Homo sapiens
catcacgtgaagtatgtgagtcatagtcaaaaaagttagaacagtagttgaaaaacctatgtcacagaagtattggggagctttcttaaaatacagatttytaggcctcttcccacacctagtgagtcagactccaagcactggccctaggaatctgtatttggaaatgctcttcagatggttccagtataccgagctgtt

SEQ ID NO: 42786 - DNA, 201 bp, Homo sapiens
tttactcttttcaaagtatatataaaaagactgggagccaatcaggccacttgactatcttctagtgccttttgtacactctggtatccaaaactgcttcycgtgacctcgctgtggtttcttgcagggatgcaaaagaagcaaaagcccagaatgaagcgacctctactccccatcgtatccgcagaaagagttctgtct

SEQ ID NO: 42787 - DNA, 201 bp, Homo sapiens
aaagagattctgccagcagcagagatttcagactctagcagtgacgaagaagaggcttccacaccgccccttccaaggagagcacccagaactgtgtccakgaacctgcgatcttccttgaagtcatccttacataccctcacgaaggtgccaaagaagagtgtaaggttcttctaggtttacttcccattgaagcatccc

SEQ ID NO: 42788 - DNA, 201 bp, Homo sapiens
tactaaaaatacaaaaattagccaggctaatttttacttaggaagctgaggcaggagaattgcttgaactccggaggcagagtttgcattgagttgagatygtgccactgcactccagtctggcaacgaagcaagagtccatcccaaaaaaaaaaaagttctgcaaaaatgaatactaaaataaattgggatgttaagaaa

SEQ ID NO: 42789 - DNA, 201 bp, Homo sapiens
cgaagaagaggcttccacaccgccccttccaaggagagcacccagaactgtgtccaggaacctgcgatcttccttgaagtcatccttacataccctcacgraggtgccaaagaagagtgtaaggttcttctaggtttacttcccattgaagcatccctctcttagtttaaaagttacaaatgctgaagtcacagattagta

SEQ ID NO: 42790 - DNA, 201 bp, Homo sapiens
taaaggcctttgaagatgatgccatccagctggtagccaggaaggtaagtcaccagctgcacccataaatcagtcagcacatctttgctgagtacctgctsggtatgaggccctatgctggtgctctgaggttggagagaaatttagaaagtcgtgtaaaaatatcaaaaaagacaagattatgagaaattccttagcctt

SEQ ID NO: 42791 - DNA, 201 bp, Homo sapiens
cagatcagcacaaatcacatttgctggtgtgtcctggatggtgttttgctttttccttgtgaaatatgttctttgttttcaatacagctcaagcctagaaygccacgttgtgccgctcctcagatccgtagtcgaagcctggctgcccaggagccagccagtgtgctggaggaagcccgactgaggtactgctgctgttga

SEQ ID NO: 42792 - DNA, 201 bp, Homo sapiens
tcttgtaggtagcagcactgtctggagatgcacgacggtgcctggacatctgcaggcgtgccacagagatctgtgagttctcccagcagaagcctgactcmcctggcctggtcaccatagcccactcaatggaagctgtggatgagatgttttcatcatcatacatcacggccatcaagtaagatgctccacttcctgagc

SEQ ID NO: 42793 - DNA, 201 bp, Homo sapiens
accagcttccaaggatggtccctactgcccccacctccacatttcaagggtctcggtccttccctcagtatacattcccacactcctaactgattataacktgtagtggctggctgagacctaccccacgggttttcctctcttgctctaggtgcatgtacatctccggtgtccctgggacagggaagactgccactgttc

SEQ ID NO: 42794 - DNA, 201 bp, Homo sapiens
gtagtgtaaagggcttccgctccccgcgtcgcctatcgaatcaatgatggcggctgcatgttagcggatgtacgtcatgcgcccctcttaggtgtacggartgggcggggcgagctagttggtgtcgcaacgaagggacggtctgggggcggggccacgccgattggcgcgaagttttcttttctccttccaccttctttt

SEQ ID NO: 42795 - DNA, 201 bp, Homo sapiens
acaaatcacatttgctggtgtgtcctggatggtgttttgctttttccttgtgaaatatgttctttgttttcaatacagctcaagcctagaacgccacgttrtgccgctcctcagatccgtagtcgaagcctggctgcccaggagccagccagtgtgctggaggaagcccgactgaggtactgctgctgttgattccccttc

SEQ ID NO: 42796 - DNA, 201 bp, Homo sapiens
gcatttgaaattgagttttcaggtagaaacatagacaagaaaccataatcattttccattgattaatgagtagatggttggggaatgttcctaaagtcttscttttctcccgtttaccaccaatggtaggctgcatgtttctgctgtacctgagtctcttccctgtcgggaacaggaattccaagacatctacaattttgt

SEQ ID NO: 42797 - DNA, 201 bp, Homo sapiens
agacagaattcttaccctaagagacttcaaagtctaggagctggataatgattacaagccaggaagccagtacttacccacatggtgaaaactgtgagctyacaggtagcagtgtggcaacatggaaaaggggtccgtggcaggccagaggttaagccttgctctttgtccatgggctgttattttggagcaggtaacatc

SEQ ID NO: 42798 - DNA, 201 bp, Homo sapiens
atgattaaaaatatagataattcctgttttacatataactcagtggctgaatttggctgtgatgagattgtgggtttgtatattgttaggtaaaaaatttrcacattgtgatgatttctcttagacttaggtaaccctcagatgtcccagcagacttcatgtgcctccttggattctccaggaagaataaaacggaaagtg

SEQ ID NO: 42799 - DNA, 201 bp, Homo sapiens
gaggctttttcttttctttgaatgatcctttttttatgccacccttttttttttttttgaaacagcatctcactcggtcgcccaggctggagtgcagtggygtgatctcagctcactgcaacctccgccttctaggttcaagagattctcctgcctcagcctcctgagtagctgggattacaggcgtgtgccaccatgccc

SEQ ID NO: 42800 - DNA, 201 bp, Homo sapiens
cctgggagtagcatattttggtctctagttggggagttggtgagtctaatttaaataaggttaaggcagactttgaactctgggtttgagtcaagcttcarttataactttttagttataattttttgccaactttttagcagaaagaaagttttactcttttcaaagtatatataaaaagactgggagccaatcaggcca

SEQ ID NO: 42801 - DNA, 201 bp, Homo sapiens; identical to SEQ ID NO: 9671

SEQ ID NO: 42802 - DNA, 201 bp, Homo sapiens; identical to SEQ ID NO: 9670

SEQ ID NO: 42803 - DNA, 201 bp, Homo sapiens; identical to SEQ ID NO: 9672

SEQ ID NO: 42804 - DNA, 201 bp, Homo sapiens
gtatgtgagtcatagtcaaaaaagttagaacagtagttgaaaaacctatgtcacagaagtattggggagctttcttaaaatacagatttctaggcctcttmccacacctagtgagtcagactccaagcactggccctaggaatctgtatttggaaatgctcttcagatggttccagtataccgagctgttatttggggatc

SEQ ID NO: 42805 - DNA, 201 bp, Homo sapiens
gcatgattatcttaatttatctttgagttaaatgagtgaaggagagaaagctaaaggagtgtgaggcagatgcaaaagttgaggcagcaggatgagtataygcggagaggcacagggcttggagcatctgggcaggagcacagtggtgggaatagcaggactgtgacaagacctcttcaaggagtattgcgcactctgtag

SEQ ID NO: 42806 - DNA, 201 bp, Homo sapiens; identical to SEQ ID NO: 9674

SEQ ID NO: 42807 - DNA, 201 bp, Homo sapiens
acctctactccccatcgtatccgcagaaagagttctgtcttgactatgaatcggattaggcagcagcttcggtaagactactccttggcaggcagagaaayattgctgccatctctgatatctataatcttatctcctaatgcctcttatactgtttatttgccaatccattgaaattgaccttttacctagcatgtctgg

SEQ ID NO: 42808 - DNA, 201 bp, Homo sapiens
ttgccaactttttagcagaaagaaagttttactcttttcaaagtatatataaaaagactgggagccaatcaggccacttgactatcttctagtgccttttrtacactctggtatccaaaactgcttcccgtgacctcgctgtggtttcttgcagggatgcaaaagaagcaaaagcccagaatgaagcgacctctactcccc

SEQ ID NO: 42809 - DNA, 201 bp, Homo sapiens
caaactgtggaatgaatgattctatataagcaggtcctactctgaccagcttccaaggatggtccctactgcccccacctccacatttcaagggtctcggyccttccctcagtatacattcccacactcctaactgattataacgtgtagtggctggctgagacctaccccacgggttttcctctcttgctctaggtgcat

SEQ ID NO: 42810 - DNA, 201 bp, Homo sapiens; identical to SEQ ID NO: 9675

SEQ ID NO: 42811 - DNA, 201 bp, Homo sapiens
tgcttgccttttttgaatgttctgcagggaaattaaagagggtgctttactgttgccctgaaattttcaccatgcgccagcaggacattaacgacactgtyaggcttctcaaggagaagtgccttttcacggtacagcaagtcaccaagattttgcacagttgcccctctgttcttcgagaggacctgggtcaactggaat

SEQ ID NO: 42812 - DNA, 201 bp, Homo sapiens
gatgttcactcttcagaattcaaagagttttctgatgttttaagaacccctaccttgtagtgtttatggtgcttataacacagaggatgttatagaatggkgtttgtttgtttgtttatttatttagagacagagtcttatactgtcgcctgggctggagtgcaatggtgcgatctcagctcactgcaacctccgcctccc

SEQ ID NO: 42813 - DNA, 201 bp, Homo sapiens
gaaggtttaggatccaccatttcacagcatctctacaggcctccttctctagaagataagaaaaaggtagccttgtatatttttcttaacagattcttacmgtgtaatctaaaagtctaaatatattatgtgtggtggtgattaattagcaaactcagcacagccttaagaaatgaagataaacctaaactgaaattcctc

SEQ ID NO: 42814 - DNA, 201 bp, Homo sapiens
ggaccaaaattcaagtctccttggtagcattctaggatcaactagatcctaggatctggtagattgtaggattctagtgggtagaggccaggggtgctgtraaacatcctgcagtgcacaggatggtcccacaagagaggatgatccggcccagaatgtcagtgctgagcctgagaaactcatctaaggcctggtccacaa

SEQ ID NO: 42815 - DNA, 201 bp, Homo sapiens
tgtgagcctatatctgaaaagctgttttgcttctgtttgtttttaaaggttcctgaatgacatttctcctttatttttttaggcacgtaacaaaacatagrcctgttttgaagtggcttgttacccaagggtgcctcactcatctgcgccaccaggaagatgaactgtgagggctcctataaggggcaggaagagcaaagc

SEQ ID NO: 42816 - DNA, 201 bp, Homo sapiens
tcacgatccaccacaccgcgctggcgctgggaacggcgtcggtgacggaccgggggccggaagtgaaggacgggggaggaccgctgcttccggcgccgtawctgctgccatcttctccgcgctatggctgcgttcggccgtcaggtaagctcgagctgggcgcgcgggcttctccgggtcgcaggcgggcgggcagcgacg

SEQ ID NO: 42817 - DNA, 201 bp, Homo sapiens
atgaaagaggaaaggaaggaggccctctttgtggctggaatgctggctctgagcagagtcagggtgacgcggcagggcgctggctttccagctgggtcagyggtcgtgaggctcaacacgagaggaggtggggtggctgctttggttgtaacattagcagggggaagacagctgcttagaagcatggtgggaagcagatgt

SEQ ID NO: 42818 - DNA, 201 bp, Homo sapiens
accaaacaggaaacaggaaatgcatgtttgatctgttgtcacgtgtctgtggggagggccctgtcccatcctgaataagatacttatgttgagctattcamatcaaggggactcaatatatcaacaattggttttatttttttctcttttgaatatgttggtgataattccgtgacagttggaagatggggttcattcttc

SEQ ID NO: 42819 - DNA, 201 bp, Homo sapiens
gacttggggcagttattcggtttttctgcctcagctgcctaatttgtgacatggagggaatcgatggtcaaagcaagtcccttctgtgactgcagccatcrtccctcctcagggttagctgggtagctttgagacagcactttgaggagtcaagaacacacgacaaatgcggtaaggcggaggacagaaaccaacttacac

SEQ ID NO: 42820 - DNA, 201 bp, Homo sapiens; identical to SEQ ID NO: 9682

SEQ ID NO: 42821 - DNA, 201 bp, Homo sapiens
atctgttgtcacgtgtctgtggggagggccctgtcccatcctgaataagatacttatgttgagctattcacatcaaggggactcaatatatcaacaattgkttttatttttttctcttttgaatatgttggtgataattccgtgacagttggaagatggggttcattcttccggttcaggaatcactatgtatttccttct

SEQ ID NO: 42822 - DNA, 201 bp, Homo sapiens
cagccagtccctgagagacgcaccaccttggagaagctggtgacagacccgtgggtaacacagcctgtgaatcttgctgactatacatgggaagaggtgtktcgagtaaacaagccaggtgaggcttctcagcatccctccaccccacatgacttcacttggaataacgaggtccccaggctgccttcctaggtcaaaagg

SEQ ID NO: 42823 - DNA, 201 bp, Homo sapiens
tcaaggatgctcaaagttccttgaatctctttaagggccttctggaggagttgggggtctccaaggacccttacccactttgaccagaggagttccactaytatttctttgcattattgactcttcctggtaagatgttttttgaggcagtggtagaaggtttaggatccaccatttcacagcatctctacaggcctcctt

SEQ ID NO: 42824 - DNA, 201 bp, Homo sapiens; identical to SEQ ID NO: 9683

SEQ ID NO: 42825 - DNA, 201 bp, Homo sapiens
tgaactccaagctttcatttcagaggcaatgaatgtttcctgcagcttctgtccaagcacagctgggccctgcactagaggttcctgggccgccacctgcycagtcagaggctctgcgggggggtggtgagcacccaggaatctgagatgtgctccacttcatcccaatctggacctaccatctgtgttctttgtgtcccc

SEQ ID NO: 42826 - DNA, 201 bp, Homo sapiens
cactggagcatattagcatttgctgtgtggctgaggggcttgaggtcctagtagggagtagaaagtttcctagtaggattcacctacttttccagtgataycactcgatcttagcatctgctagtaatgctgtagcttacatggacaaacagtgacaggtcccagggcggcaggaagtccgcagtacgcgtttgtgaacgt

SEQ ID NO: 42827 - DNA, 201 bp, Homo sapiens
ctaggtgcttttgttttctccagcagcctcgtcttacagcgtgactgcaaagaaaaagacttttgttttgcaaaagaaaagcagctcggtgactccgtccwcatcgccacagttgagtcagatggcagtggcagtcctttgccagtggaaggagttcctgctaaggggaggtgcaggaggtgagctgatacctgagtgggg

SEQ ID NO: 42828 - DNA, 201 bp, Homo sapiens
gcactttgaggagtcaagaacacacgacaaatgcggtaaggcggaggacagaaaccaacttacacgtggtgacagacgcctccctcccagactggaaaggmctttgtctcggagaacagccttgtgcaggggcgggacacctttatacaggctgcgacaaagaagggcagtggctcaccaggtgctcctgacggctcctcc

SEQ ID NO: 42829 - DNA, 201 bp, Homo sapiens
aatgaattctcgtgttgttcttggatgggtgtctgggtgcgtgtgtttctgtttcctgcttttttgtgtgttgtctccattatttcaagaataggtattcwataagtcagtatttgataattagttgggggtttctgatttgtttttatgggagtggatgtgctaggcaagcatttaaaaagatacattaatatttcaggt

SEQ ID NO: 42830 - DNA, 201 bp, Homo sapiens
acagctccgggccggaatcacgatccaccacaccgcgctggcgctgggaacggcgtcggtgacggaccgggggccggaagtgaaggacgggggaggaccgytgcttccggcgccgtaactgctgccatcttctccgcgctatggctgcgttcggccgtcaggtaagctcgagctgggcgcgcgggcttctccgggtcgcag

SEQ ID NO: 42831 - DNA, 201 bp, Homo sapiens
agaaaagcagctcggtgactccgtccacatcgccacagttgagtcagatggcagtggcagtcctttgccagtggaaggagttcctgctaaggggaggtgcrggaggtgagctgatacctgagtggggcccttgcctgttgggttctctactggaggacagtgggcacagcaaagattcccttacttgtacctggcagccca

SEQ ID NO: 42832 - DNA, 201 bp, Homo sapiens
tgagtttctggagtatcctgaaattatatgcttgccttttttgaatgttctgcagggaaattaaagagggtgctttactgttgccctgaaattttcaccaygcgccagcaggacattaacgacactgtcaggcttctcaaggagaagtgccttttcacggtacagcaagtcaccaagattttgcacagttgcccctctgtt

SEQ ID NO: 42833 - DNA, 201 bp, Homo sapiens
tcacagctacagagggccggagctggagatgtggtctctgggagtcactctgtacacgctggtctttgaggagaaccccttctgtgagctggaggagaccrtggaggctgccatacacccgccatacctggtgtccaaaggtgagcgtgagctgcaagtggtagacagtcgacactgtccttagagaccagccactttttt

SEQ ID NO: 42834 - DNA, 201 bp, Homo sapiens
agcctggccaacatggtgaaaccctgactcaactaaaaatagaaaaattagctgggcttggtggcacgcacctgtaattccagctacttgggaggctgagrcatgaaaatcgcttgaacccaggaggcggaggttgcagtgagctgagatggcgccactgcactccagcctgggtgacagcaaggctgtctcaaaaaaaaa

SEQ ID NO: 42835 - DNA, 201 bp, Homo sapiens
agcctgtacttctgttgaggagtttcaagtttttaagaagctcctggctcgggaggaggaggagtctgagagcagcacatctgatgacaaaagggcaagtstggatgaggatgaggatgacgatgatgaggaggacaatgatgaggatgacaatgatgaggatgacgatgatgaggacgacgacgaggcggaggacaatga

SEQ ID NO: 42836 - DNA, 201 bp, Homo sapiens
tctttctgaaaatgacaaattgcagaatacacagacacatgcacatgaaattttaataaagataaaaagcctaaaatatactctaactcttcaaaaaacayttttatgaaagaggaaaggaaggaggccctctttgtggctggaatgctggctctgagcagagtcagggtgacgcggcagggcgctggctttccagctggg

SEQ ID NO: 42837 - DNA, 201 bp, Homo sapiens
tgacccttcgctgagctcgagacccttcattgagctccaccttctgctctcaagtgggtctggagcctggggaacagctcgggagtacaggtgaaacttckcgaattgcctgttccttctttctgaaaatgacaaattgcagaatacacagacacatgcacatgaaattttaataaagataaaaagcctaaaatatactct

SEQ ID NO: 42838 - DNA, 201 bp, Homo sapiens
gtttgtttttccagggggctctgaggaagagaagagaggaaggtcacatcagttggctctgccatccagtggggactgggctgatgtgtgggaaggaaggyctgggggcctggggaccaggagcctgcgttcttctcagcccctgctcctgagctgcatggacttggggcagttattcggtttttctgcctcagctgccta

SEQ ID NO: 42839 - DNA, 201 bp, Homo sapiens
tgtagcttacatggacaaacagtgacaggtcccagggcggcaggaagtccgcagtacgcgtttgtgaacgtggtttctctcagttcacccagtgacccttygctgagctcgagacccttcattgagctccaccttctgctctcaagtgggtctggagcctggggaacagctcgggagtacaggtgaaacttcgcgaattgc

SEQ ID NO: 42840 - DNA, 201 bp, Homo sapiens
ctgttttgcttctgtttgtttttaaaggttcctgaatgacatttctcctttatttttttaggcacgtaacaaaacatagacctgttttgaagtggcttgtyacccaagggtgcctcactcatctgcgccaccaggaagatgaactgtgagggctcctataaggggcaggaagagcaaagctgtcctaggccaaccagagat

SEQ ID NO: 42841 - DNA, 201 bp, Homo sapiens
tttaagaacatgaatctggaaagtagtctgaggtccagacttttctggcacacatgaccaggtggcctagaaatagtttttccctcttcctccatgtcccygctcccatccttaaagctgcaaaagctaacaatattgtacctgcttgactcccatctctgtggccttgaaataccctgttctttgtgagcttccttctct

SEQ ID NO: 42842 - DNA, 201 bp, Homo sapiens
aggtgagctgatacctgagtggggcccttgcctgttgggttctctactggaggacagtgggcacagcaaagattcccttacttgtacctggcagcccacaygcaatggggaaaagggagagtttgtctttattgccttgcttggccataggcaaaactgtttggaaatgagacatttcactgtgccagtgttttcattttc

SEQ ID NO: 42843 - DNA, 201 bp, Homo sapiens
acacagccaaaccatatcaaacaccgactatgtgctagtcttttttttttctgaagtactgggatgtagaaacaatgaataagcataattaatatgttaaragaagaaaaatgaagcagggagagggcaaggagagttaccaagggaggaagtatactatttaacagggtggttcagcgaaagtctctcctgtagatgctt

SEQ ID NO: 42844 - DNA, 201 bp, Homo sapiens
actaacttcctagaggctgctgaaatcttatgtatcaagaaagatcttattaactgataacattagtatgtagttttcaagctgaattacaagtccacaawccatagaacaacaacatttaaaatttatacttcagaaaatttatggataaaaacttttaaatctcatgtttgcctttgtgcacaatagtaaacaatgcaa

SEQ ID NO: 42845 - DNA, 201 bp, Homo sapiens
tctgttgtgttagtatttgacaaatgtatttattgcatgatcatagttttccattgtaaacctaatatgaacgcttttttttctcatttgtcgtgtgctgwggaatttgatttctttacttttttggcattcattccctcattagacactgaaagagttttaccaggtaaggcattatttcactgcattttcttttagcca

SEQ ID NO: 42846 - DNA, 201 bp, Homo sapiens; identical to SEQ ID NO: 9699

SEQ ID NO: 42847 - DNA, 201 bp, Homo sapiens
ttttttacaaggcatggaggagtgacggcaggaactttctgtgctctgacaacccttatgcaccaactagaaaaagaaaattccgtggatgtttaccaggkagccaagatgatcaatctgatgaggccaggagtctttgctgacattgtaagtaacaaggcagtgaacgaaatttttcactgatagagtacaactaacttc

SEQ ID NO: 42848 - DNA, 201 bp, Homo sapiens
tgcagacctacaaagtttggcttccaaaatggcgacttcatattttgtaaatttatcaaataaatgatttttcttaatgtaccttaagtagatggaaattkagttgaaatttaaaattttgattttcagaagcttaggtgcaattgtatttctttttttagtggaaattaatctcactaatgactaccgtgtcagcggagg

SEQ ID NO: 42849 - DNA, 201 bp, Homo sapiens
aaattattacttttacccatttatttttacactgtttcctattttattcgctatgccaaagctttaaactttctgaatttttttgttcttttttattttgsagaaacttattgcatatgaaagaaacagattaaatatgtattttctccataagtgatttctgagtgatcctgttagactgactctatattggcacaaagt

SEQ ID NO: 42850 - DNA, 201 bp, Homo sapiens
taacttttaaagactatcacaagcttatgtaatgctactgaatgtaagcttgcattggaactccaagtgagttttgttgagactggaaggtgactactttwgtattcctcaccattttaacaaagttggccttttacacagttgccaacaggctgacctggaggcattggcaacatcaagtaacataaatatcttgatctt

SEQ ID NO: 42851 - DNA, 201 bp, Homo sapiens
gaagagtgtactagtttctgctcttaaagtaatccataggcagaagagagacatacaggtgtatgttcattgaaatatgacagctaccatttgaaaaatgyatggaaatatagatgcttagtgcatttggtaaagaagcgggtgagactaagggaaggggaatttttagggtagcagtgcttaagtatgttacaggggctt

SEQ ID NO: 42852 - DNA, 201 bp, Homo sapiens
gtgaataagtgaatgaattaaaacattggccaaagcttactcatgtctaagcctctggggttaaaaagagcatatgtgttattggcaacaaacacagaagraatgactggctttagatttccagacaggttggagccaagttcttcttgctgaacatcctttaaataatttaaaatttgcaaagccttcagaagaatacag

SEQ ID NO: 42853 - DNA, 201 bp, Homo sapiens
gcagaagagagacatacaggtgtatgttcattgaaatatgacagctaccatttgaaaaatgcatggaaatatagatgcttagtgcatttggtaaagaagcrggtgagactaagggaaggggaatttttagggtagcagtgcttaagtatgttacaggggcttaaaagaacagttcagtgaaggagagattgaagtccagaa

SEQ ID NO: 42854 - DNA, 201 bp, Homo sapiens
atctccttcggaactgaatttgagaataagaattgaggattgtatttatattcagttttgatttttattaaattcaatctgaaaatttttattacatgaamttataaagcgtagaaaatatagataagcacacagaagaaaataaaaataccctgtaattacactacccagagataactattatgaagattttggtaaata

SEQ ID NO: 42855 - DNA, 201 bp, Homo sapiens
gagctttgtgtgagatgagaaagctgtgtcaggctgatggtattatcatgattccttggaatggatcaccatcccaaatcaccagacactccctgatcagsagggaacagcacattctccagctactgtattatttgggaggttcaggtaggaagtgagtgcatagcctcaaggggtctggtggaggtcctcttgggaaat

SEQ ID NO: 42856 - DNA, 201 bp, Homo sapiens
tttccaaaaagtgacaccttttcttttttgatattctagtttttttaaaaattgtattttgggaaattatgtaaaggcaaatatacacgtaagacaaagaytagaaaaatattcaaaattataatagtagctctatggggataagctttatcattggtgaattttttttatattttctatatttaggtaatgtaattattt

SEQ ID NO: 42857 - DNA, 201 bp, Homo sapiens
tgaacaggaatgctttttaaatgttgttcctctgagtgcaataaacctgtgtaatctaggctacctaatgagcatctttgagcatctgccactgcagagtrcattcaaatttcaggcaaaatttgggaaatgctgttgcagcagtggcccagtaagacccagtgctgtcattggtcaagataggtcaccaattacaagact

SEQ ID NO: 42858 - DNA, 201 bp, Homo sapiens
ccaagcttaagtagttttaatgagcaatagcaagtggcttataaaagatactggcaaattgaaaatgtcttaaatcattgaagatccattgaaaaattatsaatttattatagtaaatatgcttcttgggaataaaggtttcttatttctagaccggctaaaaaaaacaaaaaaaggaattcatgccaaaaatgaattttc

SEQ ID NO: 42859 - DNA, 201 bp, Homo sapiens
agactgcagcaacaaaggaaagaaatctcactccatttctctcataattccataaatagtttgcctgcctttcattgagggcagttagttaacattgaggrcagctagttaacagcaagagctacagaaaagtcctgtaattaatcaacctgcattgccttcagtctgaatctgagtattaaaattcagtaggtgcaatta

SEQ ID NO: 42860 - DNA, 201 bp, Homo sapiens
aaagagcagaggcacatgctaatataatgaactattgcaatgagtctatttgcaatgtaagctgatgatcagcttgttttagctgatttataaattgccaygtaccagaattacttatactaaaacacataatttaaacatcatccttaagaaatgagatagaaaaaaggaaaagggtcagtattcaggcttctgccctgc

SEQ ID NO: 42861 - DNA, 201 bp, Homo sapiens
atttatttgaagaaatgtcctaatatgactctgatgtgaacacctttcagaagtgtggtgtttattatttggtagtggcaaatgtgaaaacataggcattgcattcactaaactatagcgaacagagaatttgctgacctgtaagtgcattgttgacttttaccttgtccttaactttgacccttcctcagtattaatgag

SEQ ID NO: 42862 - DNA, 201 bp, Homo sapiens
acatttttctactattgcatctatttttatgtaatgtattaactataatgtaaagtttaatttttgcatggtaatttaagaaactaaatttcttactcctycttttccctaggagcactgaatcaaaaaaattggggaaagaaatatccaacatgtaatagcccaaaacaatctcctatcaatattgatgaagatcttaca

SEQ ID NO: 42863 - DNA, 201 bp, Homo sapiens; identical to SEQ ID NO: 9705

SEQ ID NO: 42864 - DNA, 201 bp, Homo sapiens; identical to SEQ ID NO: 9707

SEQ ID NO: 42865 - DNA, 201 bp, Homo sapiens
gttcaatatcatgtagctgctaagtaggtgagcttggattagtgtgtctgaattcaaagaaaaagaattttagtagtatatgtcctgatctatgtaccccrttttctgtttctgatatttaacaccatgaatgcccttagattctgagtgattctttgttgagaatgaaagtagtaacagagagcaatgttataaaaagcc

SEQ ID NO: 42866 - DNA, 201 bp, Homo sapiens
ttgttttaatatgccaggacaaaatgtaattgttataatttaagaaatacataattaagagaaaacaacacatctgaggaaagtaattacagtgctcagaygttaattaagagacactaaaaaacagactacttgttgaaatagtgatgtttgatagaatattagctatgttattaaaagcttaaaatccattattttatt

SEQ ID NO: 42867 - DNA, 201 bp, Homo sapiens
aattttatgtgcaggaagttttctttaaaatttttaaagctagaatactatttttgagacaagaacaggacacaagagtatacactgtacagatacctacwtcaaattgttactaagaatacatgggataattccacaacttggctttctgtgccttagatgggactcctaaaaggctctaaagtgggtctcatatacgaa

SEQ ID NO: 42868 - DNA, 201 bp, Homo sapiens
aaaaaacatttccttcgctccccctccctctccactctgagaagcagaggagccgcacggcgaggggccgcagaccgtctggaaatgcgaatcctaaagcktttcctcgcttgcattcagctcctctgtgtttgccgcctgggtgagtgagaagagctcggtggggtttcagctccgggatcggtgggatgagggtgggag

SEQ ID NO: 42869 - DNA, 201 bp, Homo sapiens
aatagcaaataatttacattcttcattttgactctgttgatcctctgtaaaattattgtacttaacaataatgaacacctagcatatcaagatttattatrtaataatttttatagatgtccattgtataacagtctgcatttactgaaatcattataaagaagtgagctacttgcttttatttttgcagttaaaaaagag

SEQ ID NO: 42870 - DNA, 201 bp, Homo sapiens
tttttgcagcaagatggatggagctgcaggtcataatcctaagtgaactaatgcagggacagaaaaccaagtacctcatgttctcacttataagtgggagstaaacattaattacacatagacataaacatgggaacagtagacactgtggtgtacgagagagtggagaggtgggtgagttaaaaagtctccctatcaaat

SEQ ID NO: 42871 - DNA, 201 bp, Homo sapiens
ctaggtattcctgtatgtggtaataaccacagacatgggaacagcttttgaatcctaagacctgtaccccagtgaatataatgagagagaatataagtcaragagggaattcaaattgttcctctgggagcctgagaaatgtaaaaaactggtttactccctatactaatcctaaaaacagttgtcatcactcttaattca

SEQ ID NO: 42872 - DNA, 201 bp, Homo sapiens; identical to SEQ ID NO: 9687

SEQ ID NO: 42873 - DNA, 201 bp, Homo sapiens
tcattcctggaccagcaggcaaaacaaagctagagaaacaattccaggtgagtcctcttggaagcctcttggatgtcactacagaactgaatgtccctgcrtcttctcatttgagttgacagggtcacgttgagtgggcagtgtgggtacaatgactttgtatttgagccatcgttgttccttactgtgggctacagtgcc

SEQ ID NO: 42874 - DNA, 201 bp, Homo sapiens
gaaaatttcaattgattgccaggttaaatcacgtatatagtcaattctttataatttatttgtccaagtaattcctgctaatgaatctgtagcccgctctrttgttttgcactattttgtgtctcttgaaggcaagcatgctatagaggctcctgctgaggcggagcaccttaggagagtaaccagtagctcaggattctt

SEQ ID NO: 42875 - DNA, 201 bp, Homo sapiens
gaatgtttaggatgcatatgatttttggccactctggagaattttgaacgtagatggcaatgctgtctgaaaaatggatccctgtgaaagaagcataaagygtgaaatcacatttaattagccaagagtggctagtgtatgttgccattaaatcctttaaattacagcacatctgggcaccgtccatcccacaagaatgta

SEQ ID NO: 42876 - DNA, 201 bp, Homo sapiens
taagcaaacttacacaggaacagaaaaccaaataccacatgttctcacttataagtgggagctaaatgatgagaacacatggagacatagaggggaacaayacacactggggcctttcagagggtggaggatggcaggagggagagaatcaggaaaaataactaatggactaatgggtatgagccttaatacctgggtgat

SEQ ID NO: 42877 - DNA, 201 bp, Homo sapiens
ccggacccagagcggcagccgcgcccctccgccccccgcgcgaccccgggtccgaggcacgctcccagcggagcggtcctgcgcccccgccccctccaggmgccgcggcgcgcacagccgggctggagcgcgcacccggcactgaggcttcgctgctctcggagcgctcagaccgcggccgccgcagccggcgaaagaggc

SEQ ID NO: 42878 - DNA, 201 bp, Homo sapiens
ctttgtttgtttgtttgtttgtttgtttgtttgttttgttctgcatttgccgtctcattggtaataacaagactgcagcaacaaaggaaagaaatctcacyccatttctctcataattccataaatagtttgcctgcctttcattgagggcagttagttaacattgagggcagctagttaacagcaagagctacagaaaag

SEQ ID NO: 42879 - DNA, 201 bp, Homo sapiens
gaggcaggagcttcacttctcactgtatactattcatactggaggaaaaaataatttttgacaaatatgttgacacaaaatattttcaacttaacgtgaaytaattttagcaagaagggcaaaggtagttggacaagaaccgtagcttcgtgtagtcacctgtcaaaatgtagggcctctgcttggctgaatctcagtgag

SEQ ID NO: 42880 - DNA, 201 bp, Homo sapiens
aggcattatcctatccatggagtggagagagagagagcatgatgttgcagcaatactgagataatgaattaatattttccaagcagagcccacaaaagacrttagttgcaatctttcgagttgcagggaagagacacatcccaggtaacatcatcagtgattatctgatggaaattctcatcagactgatttatagtgctt

SEQ ID NO: 42881 - DNA, 201 bp, Homo sapiens; identical to SEQ ID NO: 9692

SEQ ID NO: 42882 - DNA, 201 bp, Homo sapiens
cataaggaggtgggaagaggtgttactagtaagcatgttctgggtggtcttctggtgcacatgtgcagtaactgtacatgcttgttcatatgttgcatgtytcattagcatcttaaaactccacccaggggtgtggtttttactattataatgagcatagggtcagtttggggacaggtaaaatcaaaatatgcatgctct

SEQ ID NO: 42883 - DNA, 201 bp, Homo sapiens
aacaaacaaaaaaaacatttccttcgctccccctccctctccactctgagaagcagaggagccgcacggcgaggggccgcagaccgtctggaaatgcgaakcctaaagcgtttcctcgcttgcattcagctcctctgtgtttgccgcctgggtgagtgagaagagctcggtggggtttcagctccgggatcggtgggatga

SEQ ID NO: 42884 - DNA, 201 bp, Homo sapiens
gaattcaggatctttgaattaagtgaattatagtgctgcaaggtacactaagttcaaatgtttaagtattattattaaatatgtaatgaatcagattctgwacttctcagtcacatcttactgctttaagagccacattaacaataaattatacccaactcctctggaagaattaacttcttaatttatgctggttataga

SEQ ID NO: 42885 - DNA, 201 bp, Homo sapiens
tgtgaaattcaatatgttgtgactctcagtttgatctatttatcctctgaaaacaaattgtaaccacatataaaaaatattcatgcctttttcccaaatartaactagcctctattcagaaaattaattccttttcattgcagagttgcaattttctttatttcatttctctctcctttttacgtatactgtggttgcttc

SEQ ID NO: 42886 - DNA, 201 bp, Homo sapiens
tcagatattaggcagttctcaaagaaataaaagtttggcttagcatcttccctcttccttgatgtattcttctcctatcctccccagatacatattatttygttgcacttggaaggttagaatccccctttctgccccttgtctgggtcctccttctcgccaagtgttaccaggctccctagtcattctgcctattttccc

SEQ ID NO: 42887 - DNA, 201 bp, Homo sapiens
atatttaattcttttcagaggctcccaatttttcaattttagatggttcatagtagagtagatattaagcgtacattttcatccaatagatggtgctgctyttggcacagtaacctttacaaacagaaactatttttaagttctaataaatgaaaattacattgcaaatacggtgataattgcccatagacccccacacac

SEQ ID NO: 42888 - DNA, 201 bp, Homo sapiens
atgggatttttgtcagcacgtctgaaaaatactgaaatggcaattttaggttttctttggttttctctggttgggaattttaaattagttcaaggattgtytaataacaaaatgttccgataatagtatgtctttcataattgaaattatcctcatcctgaactgaatatattttcaggtaccaaacaagagaaattaagt

SEQ ID NO: 42889 - DNA, 201 bp, Homo sapiens
aacaaaatgggatttttgtcagcacgtctgaaaaatactgaaatggcaattttaggttttctttggttttctctggttgggaattttaaattagttcaagkattgtctaataacaaaatgttccgataatagtatgtctttcataattgaaattatcctcatcctgaactgaatatattttcaggtaccaaacaagagaaa

SEQ ID NO: 42890 - DNA, 201 bp, Homo sapiens
atatatgcattttttttcctgctgctaaaaactgatactgctttattttgaatgttaaaagattacatcctttggaaacatcattatgtttaattgtagcmtatattctgggtattttgagcctgacattttcctgcctccaacataaaggacagaaagaatgccgcttcttcctgtgacctgaatacactgtcagccctc

SEQ ID NO: 42891 - DNA, 201 bp, Homo sapiens
actatgaagtttcagtgagaaaatattaatatgtgcacatataatcctacctgggatctgtagactggagtttaaattcctactgattaatcctcacaggktctttatctggtattcagtaataaagaatggaaagttttttatatatcatatatgttcttgttcattcacttaaaaatcccaaacacatacgttagttca

SEQ ID NO: 42892 - DNA, 201 bp, Homo sapiens
ttagataacttgttttctgtgtaagacatatatgttatgtcttttttctcttcacatgtgcaagacaacctggatgcaaataaaattatttggttacaacsttttttcttacaaaacatatggtccctgcttttttatgttatggcatttagtgttactgagaaaagaacggaaagttccacctcaaggtcacttctttta

SEQ ID NO: 42893 - DNA, 201 bp, Homo sapiens
tttcaaaggctttatgaaagtgcttggggtggtgtgatgcatagttgacacataagacatgcaagggaatctctggtctccattgattctaaaaccttatrgtcagttctggagaggggaagacagctttaaaaagtacgtggtcatcaaacatctgttgaattcacatttctattgtagatctattttaacaaagaaggc

SEQ ID NO: 42894 - DNA, 201 bp, Homo sapiens
acgaaagttgtttagttaaagatattgtaaatgaactataattatgtagatttacgtctgcttttaaaacacttgtgctctttcactgatttgaaccttcrtatatgctttcatatttattttgccaaagaaactatagataatttgattccatagcaggatgttgaggaagactttttctcttgccttggaatcactgct

SEQ ID NO: 42895 - DNA, 201 bp, Homo sapiens
caaatgttaaacgttgctaccacctcaactaattctgtacccccatttggcagagtaagcaactcgagatcacatttgcagcatttggaattagaattcarttcaccctcaaattcactcaatctctcttaatttttttattttaaaaaaaggtaaacagaaagtaggtcaatcaaatcacattctcattttaacaggtcc

SEQ ID NO: 42896 - DNA, 201 bp, Homo sapiens
aaaatagattgtgaaaaataaaagtctatcaagatggggcaaacgtttaggggaatactatcaaaggtagtgttatgttcaataaaagatggctgaaatasttatgagactaatagacaaatggaaattatttacacaaacttctgtaactgcccagttctgtgaaaaacaataggaaaatcgaattcagaaaacacttat

SEQ ID NO: 42897 - DNA, 201 bp, Homo sapiens
ctcaagtgtctactaggtgcagtttcagcactgagcattttatgtacattttctcatttcattctcctcaaaaccctttgatattggtgttttcatcttayaccttttacaaatgagggaacccggcacagagaactcagataagttgcctaacatcacaaatcctgattcagcctgtgtattccttcccaatccagagcc

SEQ ID NO: 42898 - DNA, 201 bp, Homo sapiens
gtgctcctgtcagcagtatacggaaggacccctttgccaaaacccttcccagcattaaatgcttaacataccaaaagaacagaaacaccactctaatacaycactaactaatacattagttgacatttatttgatgaataatatggttgaacatttacattggtatttattattgtttccatttcttttgtgaactgcttt

SEQ ID NO: 42899 - DNA, 201 bp, Homo sapiens
aaacgtcagcaaaaattacctttacagagatcctgtaccactgactaagatacagtgagaagaaaagagcatattttttgtgacgtttctaataaaaatgsataacctgaagagacatcagacaaactcaaattgagggacattctataaaataactgtagtcttcaaaaggattgagattacgaaagtcgagaagagatg

SEQ ID NO: 42900 - DNA, 201 bp, Homo sapiens
tggcttataaaacaatacaaaagtctaagaaatatatcatttaatatgggcttccctttattcatgtctgccagcggttctaactaaaataaatggaagcrggatgttgcactgaggatttgctttgtagctctttaccagtttattagcctctatttgaagattttttttttatgaggccaaatccagactaaattaaat

SEQ ID NO: 42901 - DNA, 201 bp, Homo sapiens
ctaaataagtgattccttttaatgtgcatactgaaattttctcacatgacaaactgggacacatgaaatggaatttcacgcactattgaactgaattctcrgtagctgctgtgaaatgtttggggagttttagtggatttatccattttagtgaccatatttcccctcacatttgtgaaatgcattttgctgttattttag

SEQ ID NO: 42902 - DNA, 201 bp, Homo sapiens
atatatatgtgtttgtgtatatatatataaaatatatacatttaaattgtatttcaacttttagtgtcttattgagattaattcctagaagtaacttcagrttacaaaaggaaaccaatttttctctgtgtttaaagaaattaaagaaattaaagaaagaaaaaatatcatatagcacaatcttaaaacacttgtatttta

SEQ ID NO: 42903 - DNA, 201 bp, Homo sapiens
tctgcatttttaaaatcatcatattatgacatcactatctccttttaaaagtgttatgttttcttttacataattttaaagttccaaattattagacattytgatttgcatgcaactgtttgaaacattctgttgtgttagtatttgacaaatgtatttattgcatgatcatagttttccattgtaaacctaatatgaacg

SEQ ID NO: 42904 - DNA, 201 bp, Homo sapiens
taggaggactttggggttctgacggtttgatagctttttaaaaattacctttctttccccataccagattagagatgggggtggtggggagagagcttcascatcctctcgccagaacttccggttctctagctttttatacatcctactcacactcgtcctactgatttccacttaggactgcaactacccgtcctctct

SEQ ID NO: 42905 - DNA, 201 bp, Homo sapiens
actgagcagggaaagttttgagtgagggttgacatttcacatttagcatgtttttaacaacttttcacaaccgaccctgactttcagaaatgaaatgaaartggcagaatttatttgaagattcacaatctagaaacataaccactgctcttttgaggcacgccatctcagtggcaccactggaaagtccagattgcctga

SEQ ID NO: 42906 - DNA, 201 bp, Homo sapiens
taacttttctcttgtacagaatcatcaggctaaatttttggcattatttcagtccttggagacatctgagagattccgggatgccagtggtgcctctctgkccacactgacaacaaataattcacctaaggaatagttcacttcagctattttttgctactcattggttgtcagtgccattgaggagagctcagtgtagat

SEQ ID NO: 42907 - DNA, 201 bp, Homo sapiens
gaaactctagcaatagtatttatgcttaggaactagttctctaatagcagtgaccactgtttccagtggctaaacctaggggcctgcaaagctattggaayggacacagatcagttttctgaagaaaattctggcccagtcaatagatactctcatggctgaagcctgagcagatgtgagagggtcaattactgagacaga

SEQ ID NO: 42908 - DNA, 201 bp, Homo sapiens
cagagtgcagaggtcaagtttgggagctggaagaaggaagaaacatgaccagggagaaggtaagcagaaggggtgaactgaaactagatgctgaagacacraggtcataaacgtgaacaaggatcaaagccctggcaactcaagaaaactgctcaacccaggagaggccgctcaccctttacaacagaatacaaactttgc

SEQ ID NO: 42909 - DNA, 201 bp, Homo sapiens
gaaggctcccccatattggcaatcagacattgctgctggcaaccttgaggatcaaaggtgggacttgtctttaggcagtgattctggaaccacagctaaayccccaaatttggctctgtattcaccatataatgtaagttattaaaaaaaaaacaccttttcaaccattattcagattataagatctatcttactatgctg

SEQ ID NO: 42910 - DNA, 201 bp, Homo sapiens
agtctagaaaataaactgattggcacatttgttaaaatccatgttagttttcctgaagaactacacaccctaataaataacttacttatgttcaaaatgarttaaatgtggcaaataattccaagacatttattttacctaattatatgtggttgaacaactaggaacaaatattttacaagtgaaaaccataagacacat

SEQ ID NO: 42911 - DNA, 201 bp, Homo sapiens
gaaatttttcatcaaatgttataaattttgtttgattgtatcaatttgagatacggttcagtattttagaaccaatgtcttaaggtaggcttccatagttscaattaagcttcataagaaatataattaagttgaagcttggcattgtttggtaggtgtctggctggcaccacgttttccaaaaataagatttgtttgaag

SEQ ID NO: 42912 - DNA, 201 bp, Homo sapiens
gagtatatgctccagtgctcaccaaaataagggaataaaccaataaaggggattcatgggattcaggaaaccagagttgcagccagtgaaacagcaatcaraatgacctgagcacacaagctaggcagagcctgctgccctcagtccaactggaacgagttccagtccaactggaatgagaggatttcggggaggaaagtg

SEQ ID NO: 42913 - DNA, 201 bp, Homo sapiens
ttttgtgaaataaacttgagttgtattcagtacacatatggaatagtaagttattacattttaaagatgacagtgatgtaatggtatacttatatattatrtttgcagatagatttttcacagaacaagattcctcggttttaattctacaatgtgatattggaattaaaaacaagtctcttatgtgtgaatattttatct

SEQ ID NO: 42914 - DNA, 201 bp, Homo sapiens
gtcaatagttttatcattaatcctagagaggatgtgctacacaagtttaactctgcacatagcaaatatttgaactgagttgaattcaaatggaatgggayatgggatcagttaaaaatcttcataggagtcaaaagcagaaaaaaaggagatgatcttttgttaggatatttgctttattttcttctcaactaccttcct

SEQ ID NO: 42915 - DNA, 201 bp, Homo sapiens
atgttaaaagattacatcctttggaaacatcattatgtttaattgtagcatatattctgggtattttgagcctgacattttcctgcctccaacataaaggrcagaaagaatgccgcttcttcctgtgacctgaatacactgtcagccctctccaaagggtttgggcccagttagagcagtgaaactcagttcagcacatgt

SEQ ID NO: 42916 - DNA, 201 bp, Homo sapiens
aacataatgtaatcaatcacagcagtaatccaccatcctctttgccaacaaatttaacctaatcaaggaagcgactctctcttcatattcataagtcctgytcatgcccaattggagggaattgtacaggatgattacatcatagggtggaaattttgggagccaagtcataattccacttactacataggtggtactact

SEQ ID NO: 42917 - DNA, 201 bp, Homo sapiens
atactctaggtttggagagaatagaactatttaagttagcataaatacttatacatgaaagtaaaaaggtaatatatagtatctaaaatttagaagtcaaraattacaataagagtatgttatctgaaaatatggagttaaattacagaagagatagctgaaagaattgaaaatgtgacctgtgggacactggactggaga

SEQ ID NO: 42918 - DNA, 201 bp, Homo sapiens
tttagatttaaggaggcatgtgggtgtgtattgctcactctctgatatacaacatggttattttatgtttggtagtagtagttaaaataaaactatattarttgccttcttactaatgtactaaaggctaaatgaaagaaatttttcatcaaatgttataaattttgtttgattgtatcaatttgagatacggttcagtat

SEQ ID NO: 42919 - DNA, 201 bp, Homo sapiens
gagaaattttgtacaatttcctgaaaaaacgtcataatgaattatacattagtagacttaccttcttgaaggtcagtgggttgttactagcatttgttaargtcacatgtatgtaaacactgtactgcacctatgttttaaaaagtgaaatgaatattatttacttcttggaagattatatactacaaattgaactgttga

SEQ ID NO: 42920 - DNA, 201 bp, Homo sapiens
gtctctgaaaaggttttggtgactcgcccaaagcaggagccactgctatcctctgttgcacaccctctgtttctcccatcagagcactgactatgctttaygctctcagaggcttcctactcttaccttaagtctacttctatctagcctgagacacctgatttccaaacccagacaggagaagcaccaaattatatagag

SEQ ID NO: 42921 - DNA, 201 bp, Homo sapiens
taattatttacacttgcatatttcagaagaatttcttagatctacatattcctccaattcacctgaaattgcatttttttttttttgtagaataaaacaaygggtaagaagaacattcaaaataacatttaaaaccaatctatatttaaaattgaaatcgattactggattgaaaggttatcctaatataagaagagttat

SEQ ID NO: 42922 - DNA, 201 bp, Homo sapiens
ttttgacaatttgtacaaaaaaaaaatgaccaatgtcatcatgtcatgttttcctacaaggtaacaataatgatgctgcctctagaagatgtgataatgtratttacagctaatataatttagtcaattacttagtcaatcaggatttctttttcttgagcattatagtttgatcttttctgcctagcctcatgttatagt

SEQ ID NO: 42923 - DNA, 201 bp, Homo sapiens
aagatgagatttgggtggggacacagccaaaccatatcaaacaccgactatgtgctagtcttttttttttctgaagtactgggatgtagaaacaatgaatragcataattaatatgttaaaagaagaaaaatgaagcagggagagggcaaggagagttaccaagggaggaagtatactatttaacagggtggttcagcgaa

SEQ ID NO: 42924 - DNA, 201 bp, Homo sapiens; identical to SEQ ID NO: 9688

SEQ ID NO: 42925 - DNA, 201 bp, Homo sapiens; identical to SEQ ID NO: 9689

SEQ ID NO: 42926 - DNA, 201 bp, Homo sapiens
agaaaagctctttgagcaagtacattatgaatccaagtaattattattgaacagtgtcttaacttgatcccaaacagattgaacaagcctgggcccatccrataatctcacaagaggatttagaagtggttgatttgcttgaatggatattatagacagatatttcctatcatctgtagattttttttaaagtttagctaa

SEQ ID NO: 42927 - DNA, 201 bp, Homo sapiens
ccaggtagtgacattgatacgttcttgctagactatgctattatagaaggatatatataatgagatgctaaacctaaaattattgactaaagcttagcaartttctcttcagtgcactaattagttttatttaattatcaagagtgtgttctcccactaattaggataaaacaatatgaatatgacatccaacattatcaa

SEQ ID NO: 42928 - DNA, 201 bp, Homo sapiens
ataattatttgtccctcagtcaaaatagaaacttaaggaagaggttgctaaataagaaaataaattctaccaattctccagaaaatccctggcatttcccyaaccatgcttttatcagccctgctaaggatgaaataactctgtactgatgaaaaattatttgcgtttctttacactcagttttatcagtttcactgacct

SEQ ID NO: 42929 - DNA, 201 bp, Homo sapiens
ggaagaggctgtcttcatcttttgaagctcatttcctggtaatctcccctgcctgctctcagcttcagccattctggcctttttgctgtttttccaacacrtggggcttggtcttgtcttaggaactctgcgcctgtgccagcactgctcttccctcaggtgtctgcagacttcttcgctgatctctttcaaggctttgct

SEQ ID NO: 42930 - DNA, 201 bp, Homo sapiens
ttcatctgttttataagcaggaaatacctgaaaataaggaatgtcaagattctagtatatgttattagaagtgaatggcattcatagtcatggaaaataawgttaaattattaaatgctatttaaagccacagaagttctagacatcgaataaaaataagaatgatacaataacttagctaatgacaacaataaaagcttt

SEQ ID NO: 42931 - DNA, 201 bp, Homo sapiens
aatgtttctagattgcgtacatttaaaataacttttcatgtctaattctgatgcacatctttagcaaatatgaacagcaaccttgccactgtctctgattsttaacttcttccttctcttatcctttccttatcttatcttctttccttttcttatcctttcagagcctcttccttttctgaaacttagatgggagatagg

SEQ ID NO: 42932 - DNA, 201 bp, Homo sapiens
gatggttatgaagttgataacgtgtttagcactggtttgtactcattctgtatccaggaatctctttttattcattgtgttaaatattcatgagcacttaytctgtgtctgatactatgatgtagaggatcgaagagtgtactagtttctgctcttaaagtaatccataggcagaagagagacatacaggtgtatgttcat

SEQ ID NO: 42933 - DNA, 201 bp, Homo sapiens
gatcccagcacttttggaggccgaggcgagcagatcccttgaacccaggagttcaagagcagcctgggcaacatggtgaaaccctgtctctaaataaataygtaaaagaaagaaacagaaaccagacatttctgtttttagctgtgggttgctacacctctgtgaaatcataggtgtttaccactgtcttaaatcactggt

SEQ ID NO: 42934 - DNA, 201 bp, Homo sapiens
attatcaatatagtgtccctatccactgttctttgatagcagtcaagtatgggaaacaatataagagatggttatgaagttgataacgtgtttagcactgstttgtactcattctgtatccaggaatctctttttattcattgtgttaaatattcatgagcacttactctgtgtctgatactatgatgtagaggatcgaag

SEQ ID NO: 42935 - DNA, 201 bp, Homo sapiens
tgtcctgtatgtgactctttgaaactcatcccattgagaagcagggtctatggtccctcctcttggatctatggtgaaagtgatgctatgtgacttccaakcccaagtcacaaaagaatcagtttctgcctgattctcttggaatgtttgctcctggagcagccccaccatgctgtgtcaaagctgcatagccatggaaag

SEQ ID NO: 42936 - DNA, 201 bp, Homo sapiens
gacttctcaggggttttcacttcttagtgcctgcttcacttcctttgccccagcttcctgataaaccttctctgtccagttaaacaaaggcaaggaacctsctcatccaaaaagagaaactacttaaatatactgttactgaatagactgttagagaatcttcccctgggctgaaaaagtagacacaagtttagatacctt

SEQ ID NO: 42937 - DNA, 201 bp, Homo sapiens
agttgggggactgaggaagaaatatggcagcagagactgagggcagagtggagcctggcaccaggaggagcaggttcccagttcattgtgatgcacctggyggctcccctggggccttccccacccagagtgttcctctttctcaaatgcctacatgctttgtcctggaaacaacagagccccagcaactccatagtgggg

SEQ ID NO: 42938 - DNA, 201 bp, Homo sapiens
taaaaaatcattatcaaggagcaaaaagatagaaaaatcatttctattattcagacaaatttttattaagtgaagcatattttaatgactgaggcacagamtcacaaaaattattttgaaatatagtgagacacattttgacttagggattttatttcctttatcccttaggaggaatgtgtatatggctgtttatcctgt

SEQ ID NO: 42939 - DNA, 201 bp, Homo sapiens
gttgtatttatgcatataacatactcatatatcattcagatttttatgttcagtcaacttgtgttagaatatgaaggagtaaacttctcatcaactccctrgcttgccttctaccttaatgatattttaaacttactgacaaaggaaaatttaaagtgtggatattattagtttaatcaatactcattggattgtacagcg

SEQ ID NO: 42940 - DNA, 201 bp, Homo sapiens
tgacatccacccaaactgtatttgaagctcaggcccaagctgtctatataccttcaagaaataacataacctggggctctgtttttttcaacggtgaaatrgggggctgttctgagcattaaatgagataaataaagtgtgaagcacttgtcacagagcctgcttctaaacagaaagctctcaacaaatgttagctgctgg

SEQ ID NO: 42941 - DNA, 201 bp, Homo sapiens
gtgcagatcaaatagatgcttcacattgttgcagaaaagctctttgagcaagtacattatgaatccaagtaattattattgaacagtgtcttaacttgatsccaaacagattgaacaagcctgggcccatccgataatctcacaagaggatttagaagtggttgatttgcttgaatggatattatagacagatatttccta

SEQ ID NO: 42942 - DNA, 201 bp, Homo sapiens
tgggtgggaaaacagccaatccatattatgcccataaaacatcttgtacaaaatgggacacagtgacgaattgctaataatgattagcacttctcagcacrttgaagtagagtaaggaggttacactccagatgcttttttaagctgttgtagacatctgagcccagtgcctaaaatacatttcaaagcagtgctattaaa

SEQ ID NO: 42943 - DNA, 201 bp, Homo sapiens
gcctcccaagtagctgagattactggcatgcgccaccacacccagctaattttgtatttttagtagagacagggtttcgccatgttagtcaggctggtctygaactcccgaactcaggtgatccgcccacctcggcctcccaaagtgctgggactacaggcatgagccaccacgctccaccgaaagttttttcttaatgga

SEQ ID NO: 42944 - DNA, 201 bp, Homo sapiens
agcctctacctcctgggttcaagcgattctcctgcgtcagcctccctagtagctgggactacaggcgcatgctaccacgcccgactaatttttgtattttyagcagagacggggtttcaccatgttggccagactggtctcgaactcctgacctcaggtgatccgcctgccctcacctcccaaagtgctgagattacaggc

SEQ ID NO: 42945 - DNA, 201 bp, Homo sapiens
ctcatctctactaaaaatacaaaaaaaaaacagccgggcatggtggtggacacctgtaatcccagctgctcgggaggctgaggcaggagaatggtgtgaamccaggaggcggagtttgcagtaaggcgagattgtggcactgcactccaacctggatgacagagcgagactgtctcaaaaaaaaaaaaaaaaaaaaaacac

SEQ ID NO: 42946 - DNA, 201 bp, Homo sapiens
aatcaaatgctgaccatcataatttgacaatttacaagtttacataattaagttagttttcctcttgttagtgtaagcagttttaaataatagaatagacrtgcatatatgtatatatacatatgtataatcacatacatctgcataaatacatacgtaaatatatatattctttggtcatccatattaggagcctactca

SEQ ID NO: 42947 - DNA, 201 bp, Homo sapiens; identical to SEQ ID NO: 9691

SEQ ID NO: 42948 - DNA, 201 bp, Homo sapiens
gggcaagtgtaaactaaaatgtaggactcaagctctgtgggagtcagaaaggaaaggaaaagggcattccaggcagggacacagcaggtgcaaagatcggsaagtagaaatgagctgtcttttgagtaaaagctattggatgtttcggacacagtgaggtctggagcatgtattaatagttgcatgtagttggacattggt

SEQ ID NO: 42949 - DNA, 201 bp, Homo sapiens
catgggtcaggagtctattttgttataataagaaacaaacaaacctggtttctttagtctgtatcccggtgattccaataattgccaaagattctttttcyttttttgctaaagggttcatgcttagcagagtgctttgaacataatccataatccataaatgtgtgttcaacaaaaataaatattgcttttctccccgtt

SEQ ID NO: 42950 - DNA, 201 bp, Homo sapiens
gaattccatttttcctagtaaatgcatttatagttataagaccaaacatcttgggaagtgtgtgtgccatttatattcctgtgatacattacatttatttatttatttatttatttatttatttatttatttatttatttattttgagatagagtctcactctgttgcccaggctgtagtgcagtggcgtgatctcagctc

SEQ ID NO: 42951 - DNA, 201 bp, Homo sapiens
acctggtttctttagtctgtatcccggtgattccaataattgccaaagattctttttctttttttgctaaagggttcatgcttagcagagtgctttgaacmtaatccataatccataaatgtgtgttcaacaaaaataaatattgcttttctccccgttccccactgaacttgttgaccaaattttttaccacattgatat

SEQ ID NO: 42952 - DNA, 201 bp, Homo sapiens
aattccatttttcctagtaaatgcatttatagttataagaccaaacatcttgggaagtgtgtgtgccatttatattcctgtgatacattacatttatttatttatttatttatttatttatttatttatttatttatttattttgagatagagtctcactctgttgcccaggctgtagtgcagtggcgtgatctcagctca

SEQ ID NO: 42953 - DNA, 201 bp, Homo sapiens
attccatttttcctagtaaatgcatttatagttataagaccaaacatcttgggaagtgtgtgtgccatttatattcctgtgatacattacatttatttatttatttatttatttatttatttatttatttatttatttattttgagatagagtctcactctgttgcccaggctgtagtgcagtggcgtgatctcagctcac

SEQ ID NO: 42954 - DNA, 201 bp, Homo sapiens
ttccatttttcctagtaaatgcatttatagttataagaccaaacatcttgggaagtgtgtgtgccatttatattcctgtgatacattacatttatttatttatttatttatttatttatttatttatttatttatttattttgagatagagtctcactctgttgcccaggctgtagtgcagtggcgtgatctcagctcact

SEQ ID NO: 42955 - DNA, 201 bp, Homo sapiens
tcagattaccattgattgataggacctatgtctacaagtttaagacagtcatcacttttttcatcatgcctgatggataattagcaggtgacgtagttatsaacacttagcacatagacgtgaagacattcactgcttatactgaacagatggactacagatactgaatcttgtcatacattaaataatatgccttgaaat

SEQ ID NO: 42956 - DNA, 201 bp, Homo sapiens
tatttatttatttatttatttattttgagatagagtctcactctgttgcccaggctgtagtgcagtggcgtgatctcagctcactgcaacctctacttccygggttcaggccattctcctgactcagcttcccaagtagctgggattacaagtgtgcaccaccacgcctggctaatttttttattttttattttttttagt

SEQ ID NO: 42957 - DNA, 201 bp, Homo sapiens
acactactgtgaacactagcaacatattcaacctcaatgccaacatgttttaatttaccattttatattctatgagatgctgccttcttcccattcagtcrtagttattggtacatcctctatcgatccatctgcccatccagccacccattcatccatccttctctacctatatatcttatctctccttccaaaatgttt

SEQ ID NO: 42958 - DNA, 201 bp, Homo sapiens
aagaatgcattcgattcaaataagaaagtatggctgttctggtcacacacaagtctgttatacctcgctggatatgctagaatgagagagtctttaaataycgaattgattctatttctgtaaatagaatatcctgtctaaatagtctttccattttgataactgtatgtagaaaatgctacttatagaaaacaaaaaggc

SEQ ID NO: 42959 - DNA, 201 bp, Homo sapiens
tgttaaaagaagaaaaatgaagcagggagagggcaaggagagttaccaagggaggaagtatactatttaacagggtggttcagcgaaagtctctcctgtaratgcttttgaggagagatttgattgaagttagaaagcaagtcatttgagccttacagacatctgtggagagtattgcgggaataggtgatagccagtgtc

SEQ ID NO: 42960 - DNA, 201 bp, Homo sapiens
tgtgttattccaaggcacaaagaacattatcactttctaactgagccataatatgaaatagtttgagaagctttgcattaggggaagtgacctcagaaagktttcatctgtagcaccagcaaggtgcatggaataaataaaatatctggatgttttattaatttggcccttcttgtgtgtttatagtcattgaattaattg

SEQ ID NO: 42961 - DNA, 201 bp, Homo sapiens
actgtgcatatttaaaacacaatgtattcaaacactctttgggtacagacctagactttaagatgattttcagtacctattgattctggttgatgcctcaytatgagatgtattaccagattttccatgactgtatagacggcttcatggtgtgactaattattatttattttcagggcaaaattatgcaatgttattttc

SEQ ID NO: 42962 - DNA, 201 bp, Homo sapiens
tagagacaggtctccctctgtcacccaggctggagtgcagtggtatgatcagagctcactgtagccctgaccttctaagctgaagcaatcctcctacctcrgcctcctgagtaactgggactacaggcatgtgctaccatgcctggctattttttttttcttcaaatttattgtagagacggaatttatctatgttgtctg

SEQ ID NO: 42963 - DNA, 201 bp, Homo sapiens
cttgctctgagaccggagaggcttctgggaattttatcctcacaagaaacattcatttcatttaaatagtatgtgaagcaagacatttaagttagttagargtgcatatcatttaaaatggcaggagatgacagtttctgcaagccatttctgaagttaaaaaacaaggtagtttaaaataaattgtatttcagcagtcac

SEQ ID NO: 42964 - DNA, 201 bp, Homo sapiens
tacttataatcccctaaacctcaatcatgtaaaatcttggccttacccgttctcattttcagaaagaaaagcattcagaagaatataaaatgaaaactacrctgccactcctttcttccttgtgatggccatggaaatgctagcgtttaaccagagacttggactctcaatatttcaaatgttttaaaagaactttaagta

SEQ ID NO: 42965 - DNA, 201 bp, Homo sapiens
aaatggcaggagatgacagtttctgcaagccatttctgaagttaaaaaacaaggtagtttaaaataaattgtatttcagcagtcactattttcttaatttrccaatgaacttgaatgacatattaaagaactttaggcattatactctggtttgtgatccgcttgaacacaaaatgcatattatgtgatcttatttccaag

SEQ ID NO: 42966 - DNA, 201 bp, Homo sapiens
cttgcaggtgtaggataatcatacttatttctcttttttgggagctagattattgaattgtaggcttttaagaaataaggggacttccaggaagttgatastgttgggtagaattgatctcataagctaattagaatttttgcagcccatttgcaacaaaaatagcaatgccctttttcttagatttttattaagagagat

SEQ ID NO: 42967 - DNA, 201 bp, Homo sapiens
catggtaaatttcaaggagaaacataattctgagcagcaagaggaaaagttctcagaaaccttaaactaacttttataaatgcaaacttggtcgagaaaaraagggcacagagcataacagaatgaacagaaagaacttgtaaaacatactatataagtgctctttttactttgaaaaaaaaaaacagaccacttaaacat

SEQ ID NO: 42968 - DNA, 201 bp, Homo sapiens
ccacaaatttcctattttgaaagttctatatatttgtttaatatggaacatttacatgtcatgcactgggctgactgctgggaatatagaggagaacaagrctgtccagtccgttgcttgcatagaatactgctgttgcacttagtactagagcaataccaattatgatagcatcacttaattaaggttgggcaactgtgt

SEQ ID NO: 42969 - DNA, 201 bp, Homo sapiens
attgatggtttagaacccattctatggtaattgtttatacatttctcttcccattctactccatgaagtcctcagcaccagagactaacttaccacatgayatgtaaatgatgtacaattggcaaagagatcttgagagtctctgtatctgtttgtagggggaacccaccaacaaacagctttgatatagtggttcatctc

SEQ ID NO: 42970 - DNA, 201 bp, Homo sapiens
cgtaatttatgctggactttgaatttccaaccttcataaggacatatgtacatttttaaaaaggaacacattaacagcaatgattctgtaattgatatagwgtagatgttttaaaattttattgtgataaaaacacataacttgaaatctaccttcttaaatttttaagtgtacagtatagaattgttaattatatgcacg

SEQ ID NO: 42971 - DNA, 201 bp, Homo sapiens
tgggtaggttcactagatcatctttaagattgtagccagcgaggcatggtggctcatgcctgtaatcccaaaactttgggatttatatatatatataattwtatatataattatatatatgtataattttatatataattatatatatataattttatatataattatatatattatatgtataattttatatataattat

SEQ ID NO: 42972 - DNA, 201 bp, Homo sapiens
tcactgcaacctctacttcccgggttcaggccattctcctgactcagcttcccaagtagctgggattacaagtgtgcaccaccacgcctggctaatttttktattttttattttttttagtagagatggggtttcaccatgttggccaggctggtcttgaactcctgacctcaagtgatccgcctgcctcagcctctcaaa

SEQ ID NO: 42973 - DNA, 201 bp, Homo sapiens
tttaccattttatattctatgagatgctgccttcttcccattcagtcatagttattggtacatcctctatcgatccatctgcccatccagccacccattcrtccatccttctctacctatatatcttatctctccttccaaaatgttttgagatttcaagttatcccaattgaggctaaggtaggtaagggaatccaggat

SEQ ID NO: 42974 - DNA, 201 bp, Homo sapiens
acatgggtcaggagtctattttgttataataagaaacaaacaaacctggtttctttagtctgtatcccggtgattccaataattgccaaagattctttttctttttttgctaaagggttcatgcttagcagagtgctttgaacataatccataatccataaatgtgtgttcaacaaaaataaatattgcttttctccccgt

SEQ ID NO: 42975 - DNA, 201 bp, Homo sapiens
gctactcgggaggctgaggcaggagaatggcgtgaacccgggaggcagagtttgcagtgagccgagatcgcacttctgcactccagcctgggcaacagagygagactccgtctcagaaaaaaaaaaaatgtgaagggcagggccaaggcttattttaagtttcccatagctcctggcacaaggatgtgcatttagctgatg

SEQ ID NO: 42976 - DNA, 201 bp, Homo sapiens
tctgtatagtttctgccacaatctggtttcatttctgctcatgtgggccttctgtaggatagtttctgtggccctcatgtctctcattcctcatcagtctrccatactctccattttccaggatattaacctagttaggagggtccctttgacacttgtttctgtatccactcacctttctcttattcgacctgctctctc

SEQ ID NO: 42977 - DNA, 201 bp, Homo sapiens
taactgaatgtaattctaattgcagcgagaagccattcaagaattttatctaaaggaactaatttactagaaaaaaataaagatttaggtgtgtcactatrtaagaacaaatgttacattaaaactcattaggataaatgccttgtagcttgaaggtttagatggaaagtgagattgtcgttttcagtcaaacagaattca

SEQ ID NO: 42978 - DNA, 201 bp, Homo sapiens
tttcttttcttctctggctctatccaagatggcaggacattttgggtattatagccacagtggaagaatatgtagggcattgaggtttcctatattaacamagtatcactttgaacccagctacaacttcaaattctgtctgtgcttttagcatgcctgatatctacttgctcttctgcatctgctacaggtaaaactgag

SEQ ID NO: 42979 - DNA, 201 bp, Homo sapiens
cagattaagtcaatgcagaaaatgtggatgggaaaaaaatgacaaaaataaggataaagtcttgttcctttctgattacttgagtttatgtgagaaaaggkttttttttttttaacctacattagaagaaaagatctataaaattgtggtggtaatagcaggaaaagccatgaacacaaacaatatatggttgcttgaaat

SEQ ID NO: 42980 - DNA, 201 bp, Homo sapiens
tgcaggataacatcaaggggtttgaaggacatttactaggactaatgacttacatgtgacaaatcatttctgttttcttatctaattataaaagcttctamgcaagatccttctataagtgtgaaggtagaattacacctttgtctagtgtttcttaagcttgactgactaattcaattttagtattcagatccactcatc

SEQ ID NO: 42981 - DNA, 201 bp, Homo sapiens
tccttttgtggcctgagcatgtcagtattaaactttgctctggtagggaagtgttggccatagattagggtgtagttgacaaaccttcatctggatgtagrtccagaaagtccccactgcaggttaaaggacactggactctgcactcaggcacctagagtcctgcaagtcctgggaacctgcatttaaataaaaatgcac

SEQ ID NO: 42982 - DNA, 201 bp, Homo sapiens
tatccttaatgaaattctccatataaatgttttctattatttacagagagaaggaaaaaatgttttcaaatgtaaacatctatttgactgtaagacattamattgtacagttttacaaaaccgaaattacactatttattatgcgtggtccacactaaaattgaaactatattatttctacattttttctcagaatttaca

SEQ ID NO: 42983 - DNA, 201 bp, Homo sapiens
taagtatattaattaatattcagcctgagagatctttctctccctctgctttgcaaatctggcccatgaagagatatttattactctgcttcgttagtaawatatcataaaatgttatagtttttcttttccaaattagtccaaactatcacattataagtgcattttggaaagtaccagggcactctctgatgggactaa

SEQ ID NO: 42984 - DNA, 201 bp, Homo sapiens
agagagaaggaaaaaatgttttcaaatgtaaacatctatttgactgtaagacattaaattgtacagttttacaaaaccgaaattacactatttattatgcktggtccacactaaaattgaaactatattatttctacattttttctcagaatttacatgcaacatccaggcatgttaaagaaagttgtccatcaaaagatg

SEQ ID NO: 42985 - DNA, 201 bp, Homo sapiens
catggtacatcgtaagtgatatgtaaatgttggctgtcgttgttattgtgcttgttattattattattagctggagtttgtatccctagctggctggccartatgttgtattcagtccctgatgccaaagtgatttatccctaatggaacagagactatttaaactttattgagggacatccaaatctttcactgggctct

SEQ ID NO: 42986 - DNA, 201 bp, Homo sapiens
gtagaagtctcactcagtagagtaacatcatgtagtatacacctaaattaaaatatattttcttattctgaattcatgttttttgacaatgaaataatttytcttttatttctaaaggaacaccccaacctaagccctccctaaacaaaaaataacatcaaaggtttgaagtgaaaaataatttctaactgatataaagct

SEQ ID NO: 42987 - DNA, 201 bp, Homo sapiens
gaacaaatcagatttctgaaatacaggttttgattgataataaatgtagagaaaattggtaattgttgcttaacaattgaatgctgagatttagttagaaktatacaaataattgaagttgtttcagaagctactttataagtgataggtacgtttatttctgttaaattatgctctctaacacaatttttttattcacgt

SEQ ID NO: 42988 - DNA, 201 bp, Homo sapiens
taaattactgacaacatatacaaattcatggttttcataactataaaatcattttgaatattattaagcagtccaaaataattaaattaataaaataactycatgttttcacttttaaagttttttcttaattctatctcttttaactcactgcctgattcaagaaaattttacattaactgaataattagcttagtaact

SEQ ID NO: 42989 - DNA, 201 bp, Homo sapiens
atcgcaattagataatcattgtttattttctctgctagtaaaactaaatgctaatgtgtctcccctattaaaaaaaaagttaaaattgcatagattctttmctgagtccagcttcacaagtatcattgctggtagcatctagtagaagcttcaatgggatgggcaagtcctagcagctcagaatgaggaaacttggcccct

SEQ ID NO: 42990 - DNA, 201 bp, Homo sapiens
agtagaagcttcaatgggatgggcaagtcctagcagctcagaatgaggaaacttggccccttcttcttctgtctgagctggaactgtctgggctttgtgtrggacgcattgtgcttcttccccttgctgggcctcctttacttcaatctctgtggtttttgtttgttcgtttgttcgtttgtttttgtttttgttttttgg

SEQ ID NO: 42991 - DNA, 201 bp, Homo sapiens
gctaaataatactattatggtaagataagttagtagcatataataacataatacataaatataataacacattatttttgtcatttgatgaattgtgtttkctactcccttttatatactttttcttacacagattgggttttcttctcacttctaatattatttttagctcgttcctttaattgttatttgtatatacgt

SEQ ID NO: 42992 - DNA, 201 bp, Homo sapiens
tcctcacttttaaaagaaatctaggtaagaagagagagtaggatgaaagttaaaagtgtgaagatggatagtgatctgtcaccaaaaataagttcctagtsatctatgaagatcctacatgagcgctccctggactgtcaaatcttgagttctgtgatttctcacctcttgatcctcatgccttttcttctacctggaaca

SEQ ID NO: 42993 - DNA, 201 bp, Homo sapiens
atttatagatatattcactgattatctgatcaacgtaatttatgctggactttgaatttccaaccttcataaggacatatgtacatttttaaaaaggaacrcattaacagcaatgattctgtaattgatatagagtagatgttttaaaattttattgtgataaaaacacataacttgaaatctaccttcttaaatttttaa

SEQ ID NO: 42994 - DNA, 201 bp, Homo sapiens
tgtgtgtgtattttgtcagagcactgctgctagaatttttagtagaatgcagttgataaattgttaatcaatatgaaacagagactttctttagggtaagrccacaatcagaagcatttttagaattcaaaatatttataatgattttttttagtagaaaatcagcaccctgattttaacttggtgggggggtggtaaaaa

SEQ ID NO: 42995 - DNA, 201 bp, Homo sapiens
attactattatttttactgctgagttgtttgagttcctgaactttcttttacctattacaatccagtgtcaagaagatagtgtattaatttctttgtttastttattgatcaatgtttattgataatatctgccttcatgcctacaatgaagcaaaaccttataatactgctttctgtatttcttcaagattccatagcca

SEQ ID NO: 42996 - DNA, 201 bp, Homo sapiens
tacattttttcatgatctccatccactgctaccacctatccacacttgcatcatgtcttcttgggttatttcactggcttcccagctggtctccctacttyaccatacaaatcagccagggtgattttgttcaaatgtaagtcagattatgtcactctccaatttcttgtttaactcagaataaaagccaaaatctctact

SEQ ID NO: 42997 - DNA, 201 bp, Homo sapiens
ccacttttaattcttccatctctcttacagcctacacataatcttccattgcaaatgtcagtattgctcctgggttacattttttcatgatctccatccaytgctaccacctatccacacttgcatcatgtcttcttgggttatttcactggcttcccagctggtctccctacttcaccatacaaatcagccagggtgatt

SEQ ID NO: 42998 - DNA, 201 bp, Homo sapiens
atgattgggtcagaactttggggatgtaagaaaacatttcttacaaaaagatccacccctgcctccctccaccagcgcatgcgaataaagtacagattccytttgtggcctgagcatgtcagtattaaactttgctctggtagggaagtgttggccatagattagggtgtagttgacaaaccttcatctggatgtagatcc

SEQ ID NO: 42999 - DNA, 201 bp, Homo sapiens
cctgccatctcactagccacatacattgtactccactgtcttcctcaatctctttttctagttccttctcatccccccaacttctaaacattgtagtcctkagagttcttccttgggctacttctgttttgcatctacactatttgcatgactatctcatccctgtattctctacattgataactcccaaatttgtctttc

SEQ ID NO: 43000 - DNA, 201 bp, Homo sapiens
aaaagattcagctctatcttatagaaaggaaaccctttggcaagatcataaactacatatagaaatataggcttttctgttaataacattctaaagtatgyatgtttttttcaccataagagcctgtgtctccacatctaaaataaaagatttacctgaagcttgatagcatacaactatattgttgattaacaataaaca

SEQ ID NO: 43001 - DNA, 201 bp, Homo sapiens
tcctttggagacggtattagtcataaaactatgtatggtctttgtattaggataaatttactttggcttctgaagtttttgataaggatatatcttctgtrcaaaagcagaaagggctgtaaaatactagagaatgtagacaaaggtaccataaattactttggaaggacttcttgccatcctgaagcaaggttttgtgtg

SEQ ID NO: 43002 - DNA, 201 bp, Homo sapiens
tacagccattggttacctgttgctgtcaatagctgtattgtcagcattttatcatggattgaatgctttaaaatttttgagcagcataaaagatttgtagrggaaaacctattttccttagaaacgagagacagtgttttttgatgcttcaaagtcttaaaaaatgtaggaatattagagttatgccttgccctgcttggt

SEQ ID NO: 43003 - DNA, 201 bp, Homo sapiens
ctacagtatcatttattcacttaaaaagctgttgtcatgttcattatttgtacaatgaaaaaatgggagagatgcattttattgcaggcttctactgttgktaaagcactagatttttccactttgaattgttcaaaattattagtttatcaaacaaattgaaagaaaagccagggttctgttgctaacttttgaatgaaa

SEQ ID NO: 43004 - DNA, 201 bp, Homo sapiens
tgattaaggtgttcttaaataattgttgaatagaattatggatgcacttcaaatctcatttgctagcattgtaatatatttaatacaaacttaaaaaaacmaaaacaataaaagataaaatagttgtcaggacagagtagcataaagggagtgtctttgtagcataatattttgacctatgagaaattttgtacaatttcc

SEQ ID NO: 43005 - DNA, 201 bp, Homo sapiens
ttcatctcctaaaattcatcttcgtgctccctccccactccaaaaacaaacaaacaaacaaataaacattctacttataccctttctatatattcagtggygtggcccttcctggcttcataggaccatggtattaccaacgaggttatttaaattctggtttcattctagttctgaaagccaatggagctgcactcttct

SEQ ID NO: 43006 - DNA, 201 bp, Homo sapiens
agaagctctccactgttcacagcccttgtaaccaaccttaaaattccatttaaaagaccaacttcagatgtcaacctctatagaaacttttatctcaaacyaaaacaatttctgttttcatatccctccactacattgcacctctcacttgacacctgtgtatataccctagtttcacctattaccttagaaatgttcctg

SEQ ID NO: 43007 - DNA, 201 bp, Homo sapiens
tgcttaatgtcatgttattcgatagagaataaaaatggtaaagtaacagtaaataatttttaagagagcctatgactaaaaattttcatattaaatgacaytcaagctattttacttggtttatctcctgagtgaggaaaggaattcatgatgggagtgtaccttcagggtggaataggtagattcagataggtttctaac

SEQ ID NO: 43008 - DNA, 201 bp, Homo sapiens
taaaaattttcatattaaatgacactcaagctattttacttggtttatctcctgagtgaggaaaggaattcatgatgggagtgtaccttcagggtggaatrggtagattcagataggtttctaactctttagatgtgaagggcagggctgggcgcggtggctcacgcctgtaatcccagaactttgggaggctgaggcagg

SEQ ID NO: 43009 - DNA, 201 bp, Homo sapiens
gggacaccattcaacccatgacaccagtaactgcagctatgtcatgaatgagccagataaattttatctgttttgtgaccccaaatagggaatatcctttraaatgacactggtcacagagaagatacagcaaaagtctaagtagagtggtccacacacatccttgctagcaaaaatctcaagttcttcatatacatagtg

SEQ ID NO: 43010 - DNA, 201 bp, Homo sapiens
tccaggtgagtcctcttggaagcctcttggatgtcactacagaactgaatgtccctgcatcttctcatttgagttgacagggtcacgttgagtgggcagtrtgggtacaatgactttgtatttgagccatcgttgttccttactgtgggctacagtgccacatggtaaatttcaaggagaaacataattctgagcagcaag

SEQ ID NO: 43011 - DNA, 201 bp, Homo sapiens
taaaaccttgaaaaggcttcactttacttgggattttctacactagcctactaccctgcatgtttgcatcacctggggatgctttttaaaaatctagatgmccaggcctgaccactagagatcttaatgcaaatggtctagcgtggggcctgaggcattggtatttttctaaaactccctggattattcacataaggatta

SEQ ID NO: 43012 - DNA, 201 bp, Homo sapiens
ccatgatcgagaattcaggaagaggaggtggtacatgcttgagaggtgtggtgagggagaagacgtgagatatttccaaatctaccttatttttaggttaytgggagatgtcccaataaacatgtatatttggcagttggatactggttctgaagcataagagaggtctggcctgaagaaatggatttgggagtgatcagc

SEQ ID NO: 43013 - DNA, 201 bp, Homo sapiens
tgcggggctgtgtactgtactgtcttttttgctgttcatttttatgctataggtatgatgggcttaaatggaaagtacacgtgtctggtgtgaattgcagmcacacacacacacacacacacacacctgaaaggtagtaacaggcacaagcaccaacctgacttttcagggttttttttattactttcaatttagtcatat

SEQ ID NO: 43014 - DNA, 201 bp, Homo sapiens
gaggaattaaagacaattatataactcttaaaaattgtttactctggatagaatgattaagataactataagaaaactttgagttagtaagatttgggggktgtttatttggggtttctttgcttatgttttaatatgagacatgagagcttctttaaaaactaatgggaagggagataattggagtgtacagagaccctg

SEQ ID NO: 43015 - DNA, 201 bp, Homo sapiens
cacctgaaaggtagtaacaggcacaagcaccaacctgacttttcagggttttttttattactttcaatttagtcatattcaagtctgcgcaattacttacaaaaaaaaaagttccatctaaatctctaggtttggtcagtgctgccaaagtcagaggagagctgcaggttgatatacttattcacagatttcatttttcat

SEQ ID NO: 43016 - DNA, 201 bp, Homo sapiens
ctgtgcagtagaacaccaggatttatttgtcctatctgactgtaactttgtacctgttggccaatccctctccattcccgactgtccccgctactctcacsagcaggtagtcactcttctactctctacttctatgagatcaatgtttttaggttccaacatgtaagtgagagcatgtggcatttgtctttctgtgcctgg

SEQ ID NO: 43017 - DNA, 201 bp, Homo sapiens
tcttattttgttgaaatatccttggtggtccatggtattttaaagaccaaaattgtaaaaaatgtagttaaagtaacaacataatgggattgttgaggacygtgaaataatatcctcaatgccttttcttcttgagggtttttactggatacttgctctacctatacctctcctaactacagaactgaacatgatgtgaga

SEQ ID NO: 43018 - DNA, 201 bp, Homo sapiens
ttatgtaagtaaatatcacagtagcaaggaaataaaccagagagtattgctttgtatgtcttcaaaaccacatgcccagagcatgttgcggatctctttgaaaaaaaaaaaaagataaaattcacacattatacaattcatctttttaaaatggtccagtggtttttaatatattcgtgaagttgtgcagccatcaccact

SEQ ID NO: 43019 - DNA, 201 bp, Homo sapiens
tttcagagaaaatttcaattgattgccaggttaaatcacgtatatagtcaattctttataatttatttgtccaagtaattcctgctaatgaatctgtagcscgctctattgttttgcactattttgtgtctcttgaaggcaagcatgctatagaggctcctgctgaggcggagcaccttaggagagtaaccagtagctcag

SEQ ID NO: 43020 - DNA, 201 bp, Homo sapiens
tagggctctagttcgtgaaatagacacatttcataaaagaaaaagggaagagaaaattacatggctaattaaaagaaatctaagtctaggctgcagtttgyattgtcacacaaaattcacttaaatgtgttacacttttaggcaaaatgccattataataattttatgttgacctgtgttgccctccaatttcatgcatca

SEQ ID NO: 43021 - DNA, 201 bp, Homo sapiens
gattttatttcctttatcccttaggaggaatgtgtatatggctgtttatcctgttatctgtgaataccatgtgacaactaaagaataaaaatatcaaactwttaaagaattaaagttagttttattccgaagcctgactgaggactatagactgaggcctatagccgggagcactgctgctgcacactgttgcagccacgg

SEQ ID NO: 43022 - DNA, 201 bp, Homo sapiens
gtggggacacagacaaaccatgtcaggaactaatgtggtttttcccaatcctgaaattctttgatggacaagttatcatcagaagacaggataatcagaaytcaacatacttgatttgacagagcatggaatagaaacctgatgccagatagtgataaagaagcaaagtaaaatccaagatagtaggcttgcaatgaaata

SEQ ID NO: 43023 - DNA, 201 bp, Homo sapiens; identical to SEQ ID NO: 9686

SEQ ID NO: 43024 - DNA, 201 bp, Homo sapiens
cagaaatgaagaaatatgtctttataatacatatactaaataaatatatgtatttttatatatgcttgtatacatacctgtttgcatatttgtaagtgctygaggtaagttcaaggtggaatgggttgaaaggagaatgtttaggttatctgaaataatataaaccaaattcctctcaatttagttaggaggttagaaagc

SEQ ID NO: 43025 - DNA, 201 bp, Homo sapiens
cacgccttccaggcatcagatgctttcatgctgccttcttaccaccttacaaggtttttctgctaagaagcagggacctgctaaagcacaggggggaaaawcagaccttaaagttcagtagacttgattttaaactccagcaccaatacttattagtcatataaaaattgtcaacttacttaaactccccaagcttcagtt

SEQ ID NO: 43026 - DNA, 201 bp, Homo sapiens
agatgattctaaatgagtctccacaaaataatggccagagcttaggattaacattttaaaaaatggagtcttgggcttttctcacaagaatattagctacwactcagggctgagttggcttagaacattttcactttttatacagttttatgatttttaatcacacctttgaattccatttttcctagtaaatgcatttat

SEQ ID NO: 43027 - DNA, 201 bp, Homo sapiens; identical to SEQ ID NO: 9767

SEQ ID NO: 43028 - DNA, 201 bp, Homo sapiens
gtatgaagtagattaagttcaactgtatccacgccttccaggcatcagatgctttcatgctgccttcttaccaccttacaaggtttttctgctaagaagcrgggacctgctaaagcacaggggggaaaaacagaccttaaagttcagtagacttgattttaaactccagcaccaatacttattagtcatataaaaattgtc

SEQ ID NO: 43029 - DNA, 201 bp, Homo sapiens; identical to SEQ ID NO: 9768

SEQ ID NO: 43030 - DNA, 201 bp, Homo sapiens
taaaaactgtttgtttgtttgttttttaaataatgagtactacatgtgaataacagtacaaacatagcaaaagtatgaagtagattaagttcaactgtatscacgccttccaggcatcagatgctttcatgctgccttcttaccaccttacaaggtttttctgctaagaagcagggacctgctaaagcacaggggggaaaa

SEQ ID NO: 43031 - DNA, 201 bp, Homo sapiens
aatccatctatctgtcttaccaggtagtgacattgatacgttcttgctagactatgctattatagaaggatatatataatgagatgctaaacctaaaattrttgactaaagcttagcaagtttctcttcagtgcactaattagttttatttaattatcaagagtgtgttctcccactaattaggataaaacaatatgaata

SEQ ID NO: 43032 - DNA, 201 bp, Homo sapiens
aactctaccagtttttggatagaaattctataatctgtatacaagtttatatataagaatagacccatatttattggtgtgtgtgtgtgtgtgtgtgtgtrcacacacaaacacatctgtgtatattgtatcaaaaatatttttttccactctttggctttccttttaactctcttaatgactattgatgaatagatcttg

SEQ ID NO: 43033 - DNA, 201 bp, Homo sapiens
agaaatagaggtattgaagtattcctgggaatttcagtcagttcaaatgatctcagtccagttggaaaccagaataaagagccttcaaggtggttttataygcagtaatatgaatgtgctaacacttgggggtgctcacccatgagagtgccaaggagacgtgcctaggcctacacatgttttcccagagccaaggaggcc

SEQ ID NO: 43034 - DNA, 201 bp, Homo sapiens
taagtgtatacagaaaggaggaaccgatgactcaaataggaatcaagccagaagcttctgccatatgggcagcatggacttcaaccaaaacaatgaaacaktgctgtggtttagcagaggtcctaccatgaatagaaggataccaggttgccactgtgtctcagactgcatctctgtgtcgttgacccttttaccaaaggt

SEQ ID NO: 43035 - DNA, 201 bp, Homo sapiens
tatgtaagtaaatatcacagtagcaaggaaataaaccagagagtattgctttgtatgtcttcaaaaccacatgcccagagcatgttgcggatctctttgaaaaaaaaaaaaagataaaattcacacattatacaattcatctttttaaaatggtccagtggtttttaatatattcgtgaagttgtgcagccatcaccacta

SEQ ID NO: 43036 - DNA, 201 bp, Homo sapiens
agcatggacttcaaccaaaacaatgaaacagtgctgtggtttagcagaggtcctaccatgaatagaaggataccaggttgccactgtgtctcagactgcawctctgtgtcgttgacccttttaccaaaggtaggaaacagagctgtagtcatgccccatatctataataagtatgtggataataagcatcgagtacagccc

SEQ ID NO: 43037 - DNA, 201 bp, Homo sapiens
aaaattatagttctcagctccaagcaagggtggatgtatgttgactaatggagtgatggtggtgtgtgtttcccagcagcccagggaccctatgcatcttsggtgtgcctcataaggtcaggagaagacaacagttttaccagggtttcagcagatatgatagcaacagcacataccattgtgcaatatcttattatctta

SEQ ID NO: 43038 - DNA, 201 bp, Homo sapiens
ggggaactatctttcttcaggattctgctttggatggataagaatgttgacaatacgacaaaagtcacttgttccaaaaggtggaaagtactacatttttraagaggagcaatctctcactttccacacttgataatttatacatttctcaccaaataaataacaatttatcagaaaattttgttacatcaaaagcatgaa

SEQ ID NO: 43039 - DNA, 201 bp, Homo sapiens
gtaagatttggggggtgtttatttggggtttctttgcttatgttttaatatgagacatgagagcttctttaaaaactaatgggaagggagataattggagwgtacagagaccctgggtggtacaaagaggcgggattcaggacacaggtaaaggaattagtgttcaaaatcagtaaaacctatgtgcatgtttacagtagt

SEQ ID NO: 43040 - DNA, 201 bp, Homo sapiens
tatgagcacagaaaggaattatataggtttaaaattaatttttaagaatgaatactttcatcccactttcaaaaggctttattttttaaaaaaagtatttaaaatgaggcctgagtcaaacatttcagtatgagaagccttgcacaaaatttagctattgtagttatggtcctttggagacggtattagtcataaaactat

SEQ ID NO: 43041 - DNA, 201 bp, Homo sapiens
ctagcttgccttctaccttaatgatattttaaacttactgacaaaggaaaatttaaagtgtggatattattagtttaatcaatactcattggattgtacarcgtaagccagacactgtactaggcatcagagatgcagtgatgagtgtaagtaatcacaagtatgcaaacaatagtgattaagcgtgattttttttttaaa

SEQ ID NO: 43042 - DNA, 201 bp, Homo sapiens
ggtttcgccatgttgcccagatggtttcgaactcctgagctcaatcgatctgcctgctgtggcctcacaaagtgctggaattatagccatgagccactgcrcctggcccattgcacacatactctaaaataaaactgttaatagatgcagagggaaaagggagataattttaaggaatctgtatcatatcagtcattttct

SEQ ID NO: 43043 - DNA, 201 bp, Homo sapiens
acttttgggaagagttttctatagtcactatctattttctctcctgtcctttgctcctgaactcagtttaaaaagggttctgctcccaccattccaaaacaaaaaaaaataccttatcagtctcaccagtgcctttgacgttggtacatccaatattcagtgttcttggtcctcactttatggacctaccaagagctttca

SEQ ID NO: 43044 - DNA, 201 bp, Homo sapiens
aatgagcaatagcaagtggcttataaaagatactggcaaattgaaaatgtcttaaatcattgaagatccattgaaaaattatcaatttattatagtaaatrtgcttcttgggaataaaggtttcttatttctagaccggctaaaaaaaacaaaaaaaggaattcatgccaaaaatgaattttcagtcaatatactgggaaa

SEQ ID NO: 43045 - DNA, 201 bp, Homo sapiens
cttgcattaatttccccatctggatggggcctctttacctacatagggaaattcctggcctaggtggatccagcaaatccttcattactgaatctggctgyaagttatctttaccttacactactcttgacacatttatccctagcaatttccaaggaaatttccttttttataatctttgtatttacctgactccagaag

SEQ ID NO: 43046 - DNA, 201 bp, Homo sapiens
ttatagccatgagccactgcgcctggcccattgcacacatactctaaaataaaactgttaatagatgcagagggaaaagggagataattttaaggaatctrtatcatatcagtcattttctcagagtataacacagtaaaaattggaaattgacagtgaaaggtttccataaaaattttgatatttgggcattaaaaatac

SEQ ID NO: 43047 - DNA, 201 bp, Homo sapiens
tagagacattcaggaatatgtgcagctctcataagtttcatcctactcactgaattcacttcagagaagatttcttttaattgtagaataatgtgatgggtttttttttttcatgttctatgaatgattctatgctgtggaacagccttcaatggagaaattcagaagaagcaggatgtgatgttttcacaatccaaaaat

SEQ ID NO: 43048 - DNA, 201 bp, Homo sapiens
caagggaatctgagagagtagccatttttagcactcaatataattcagatcaagtgcactaacttcctaaagttgtcacttatgcttcagaagatactcaygaccagccaaataattaagctgtaaataatgaggcagccattaagcttggaatcgtgtgtttcatacagtgcagatttccgtgtgtatgacacatgctca

SEQ ID NO: 43049 - DNA, 201 bp, Homo sapiens
tatccattttagtgaccatatttcccctcacatttgtgaaatgcattttgctgttattttagttattctgaaaatgtgaattcatttacctgcctgttcaragaacaggcatgagagctaagggaaatgatgataagcacaataacaacaacaaatacaggtgatattcactaatttattcattcaatactaactacaggg

SEQ ID NO: 43050 - DNA, 201 bp, Homo sapiens
cttatgtgtgaatattttatctctatttgttattatcaaaataaacactattcatagagttcaatttcatcaataattaataatgtgactaatgcatgataaaaagaataagttaaattatgttttttgcttacaaatatcacattaattgaataactggagtaatattatgctgcttttattaaatatgtagtgacaagt

SEQ ID NO: 43051 - DNA, 201 bp, Homo sapiens
tcttaaatcattgaagatccattgaaaaattatcaatttattatagtaaatatgcttcttgggaataaaggtttcttatttctagaccggctaaaaaaaamaaaaaaaggaattcatgccaaaaatgaattttcagtcaatatactgggaaaggagtcaagaaactctgccttgtccagacataagtgcacagtgaatcag

SEQ ID NO: 43052 - DNA, 201 bp, Homo sapiens
caagctgtttaatgtcacatttgaaaaaattatctctaattcttgaagtcacttttaagattttaaaaagtcaagccataaatttgctatctttaaatagsagtttggtttaattatcacttaagcacttttttactttctcattttaggtctttaatttgggtattaatttttcatctattttatatttcacaggttgta

SEQ ID NO: 43053 - DNA, 201 bp, Homo sapiens
aaacttagatgggagataggaaggtatggttgtaaaagcattacatctgtcatatgatctatcacatatcatataagaaaatgcattatattttggaaactttaattttatacacatatatatgaaatatgttcatatgaaatacatttcactttattaagctattcaatatctcaataagctattcaatattacaggcac

SEQ ID NO: 43054 - DNA, 201 bp, Homo sapiens
ggctaaatttttggcattatttcagtccttggagacatctgagagattccgggatgccagtggtgcctctctggccacactgacaacaaataattcacctraggaatagttcacttcagctattttttgctactcattggttgtcagtgccattgaggagagctcagtgtagatcaaagaaaacggtgtagatcaaagaaa

SEQ ID NO: 43055 - DNA, 201 bp, Homo sapiens
tgcacacatactctaaaataaaactgttaatagatgcagagggaaaagggagataattttaaggaatctgtatcatatcagtcattttctcagagtataayacagtaaaaattggaaattgacagtgaaaggtttccataaaaattttgatatttgggcattaaaaatacccttttaaataatatacatatttaagaggaa

SEQ ID NO: 43056 - DNA, 201 bp, Homo sapiens
cctttgatgtgcaataatgctacctgtggtctgttttaagatgctcttttttggccaggcgcagtggctcatgcctgtaatcccagcactttgggaggccraggcgggcagatcatgaagtcaagagattgagaccatcctggccaacatggtaaaaccccgtctctactaaaaatacaaaaattaactgggcgtcatggt

SEQ ID NO: 43057 - DNA, 201 bp, Homo sapiens
gaatagttcacttcagctattttttgctactcattggttgtcagtgccattgaggagagctcagtgtagatcaaagaaaacggtgtagatcaaagaaaacrgtgattcggtgattgttccccttcttcccagccacccaccatctgaacctaatgcatcattgtacaatggccgtaaaggatgacaagggactcagcaatc

SEQ ID NO: 43058 - DNA, 201 bp, Homo sapiens
aaagtttttaaaattaaatagaaaattaaaatgattaaataaagatttaacaaaacctaatgcaggttctatcaaaagactattaaaatagacaaacctgkgtccagattgatgaagggaggaaagaatgtgagtaaataatattgagattaaaaaaagagatataatttagaaacatttttaaacacaaaagcatacttt

SEQ ID NO: 43059 - DNA, 201 bp, Homo sapiens
tatagtaggttctatgttagtgctgtttgcttttttctattgatctgtctatcaattcatttttttagtaattgattaaccaagcctttattaattcacacttcttctaaatgttctagtcaatttttactctccatttattattctatataaattttcaaaaaaattctccagttagaaacatcccagtgagatttgacc

SEQ ID NO: 43060 - DNA, 201 bp, Homo sapiens
aatgtgtatatggctgtttatcctgttatctgtgaataccatgtgacaactaaagaataaaaatatcaaacttttaaagaattaaagttagttttattccraagcctgactgaggactatagactgaggcctatagccgggagcactgctgctgcacactgttgcagccacggcttttacacaggttgtggaggttcagta

SEQ ID NO: 43061 - DNA, 201 bp, Homo sapiens
ccaggctggggtacagtggcatgctctcggctcactgcaacctccgcctcccaggttccagggattctcctgcctcagcctcccgattagctgtaattacsggcgtgcgccaacacgcctggctaatttttttgtatttttagtacagatggggtttcactatgttggccaggctcgtctcaaactcctgacctcaggtga

SEQ ID NO: 43062 - DNA, 201 bp, Homo sapiens
tttttttcacaaatagtgttcccaacctttgaaccttcatacttttccttatctaattgtgatgtttcctttaacatatattaaatttgcatctatagtargttctatgttagtgctgtttgcttttttctattgatctgtctatcaattcatttttttagtaattgattaaccaagcctttattaattcacacttcttct

SEQ ID NO: 43063 - DNA, 201 bp, Homo sapiens
atagtaggttctatgttagtgctgtttgcttttttctattgatctgtctatcaattcatttttttagtaattgattaaccaagcctttattaattcacacttcttctaaatgttctagtcaatttttactctccatttattattctatataaattttcaaaaaaattctccagttagaaacatcccagtgagatttgacct

SEQ ID NO: 43064 - DNA, 201 bp, Homo sapiens
tgaagacattcatttgatgcacaaagtctatttcacaagcatttaatttctaacatatgccagactcagagtttggcaatggcatgtagatgaaataggcmagttaacagacaaaatacagtatgttaagtgcttcagtggaggtaagcatgggaaatttataggagtgttactaattcaggtaagtcaatgagtggatga

SEQ ID NO: 43065 - DNA, 201 bp, Homo sapiens
tagtaggttctatgttagtgctgtttgcttttttctattgatctgtctatcaattcatttttttagtaattgattaaccaagcctttattaattcacacttcttctaaatgttctagtcaatttttactctccatttattattctatataaattttcaaaaaaattctccagttagaaacatcccagtgagatttgaccta

SEQ ID NO: 43066 - DNA, 201 bp, Homo sapiens
tcacacttcttctaaatgttctagtcaatttttactctccatttattattctatataaattttcaaaaaaattctccagttagaaacatcccagtgagatytgacctattcattaatatggaaaaaaaaatcacaacttccccaaattcactgtttccattgaagaatgtagtagatctcttcatttattcacattttctt

SEQ ID NO: 43067 - DNA, 201 bp, Homo sapiens
atgtagatgaaataggcaagttaacagacaaaatacagtatgttaagtgcttcagtggaggtaagcatgggaaatttataggagtgttactaattcaggtragtcaatgagtggatgaaagcatggataaatatgtaaatgaataacttaggttaattctctggagctcctatttagtattctgctgtcctctttatgtgt

SEQ ID NO: 43068 - DNA, 201 bp, Homo sapiens
aaggttgacaggaaaaaaatgtggtacttcatccacagattttattttatacctgaagctcaagtaaagctagtttaatagaagctatcctcatgcatatygtttaagctcaagaaataaatcttctgacattgtcaacttttaattttagcacccaaaaagtagagaatgctttaagtgaactgttatgatgctgtaaaa

SEQ ID NO: 43069 - DNA, 201 bp, Homo sapiens
gaataagaagtaatttcatactatataaacagagtgccaatgtatgaatgaataatgttctacaagtacatttgtaaactagctatttgtagctttctctrcagaaacagttctgccatccgcaatcaggttccaaacctatcctgcaaagatttattttacccacaatgtagctgaaatgaagtattaatgttagtacag

SEQ ID NO: 43070 - DNA, 201 bp, Homo sapiens
ttagattattgagctaatagagccacattacttgggttcaccactggctcttgaaatgacagtggggaacctttgagcaacctacttagcctttctgtgaytcaatttcctcatctgtaaaataaggtttatacagtatctacttaccaaggttgtgcgaagatcaaatggataatatatgtaaagtaactagtatagttc

SEQ ID NO: 43071 - DNA, 201 bp, Homo sapiens
tctcttgggcatggtggcggcgatggtggtgggatgtaggtgctgggtgtgggatgcagctgggcacggaatgcagcgttgcacgagctttggtctgtccwggggtcattctcaccactgcttcttccaatacacacttttaaatggtgcttctatggtctcccacatcaggagagccctcagtgctttccctcagcctaa

SEQ ID NO: 43072 - DNA, 201 bp, Homo sapiens; identical to SEQ ID NO: 9774

SEQ ID NO: 43073 - DNA, 201 bp, Homo sapiens
cgtgactggtaccatgatacactcaggtatgtccccgtcgggattttagaagtcatcctttgccattctcccttcctcactcccaaataagaatcctctgraacattcctaaccttcaaaatgacatcttttgttgttgttgttgttgtttttgagacagagtctcactctgttgcccaggctggagtgcagtggcacaat

SEQ ID NO: 43074 - DNA, 201 bp, Homo sapiens
gacaccaaacaaacagagcaggtggactggctgtcttctgcccttgaagtcatacactagtcaatatcttcagcttagtttgcatttgtggcaataagatvtaagtatattgtgcagacctacaaagtttggcttccaaaatggcgacttcatattttgtaaatttatcaaataaatgatttttcttaatgtaccttaagt

SEQ ID NO: 43075 - DNA, 201 bp, Homo sapiens
tcttaggggagagtggttattagattattgagctaatagagccacattacttgggttcaccactggctcttgaaatgacagtggggaacctttgagcaacstacttagcctttctgtgactcaatttcctcatctgtaaaataaggtttatacagtatctacttaccaaggttgtgcgaagatcaaatggataatatatgt

SEQ ID NO: 43076 - DNA, 201 bp, Homo sapiens
aaactctaccagtttttggatagaaattctataatctgtatacaagtttatatataagaatagacccatatttattggtgtgtgtgtgtgtgtgtgtgtgyacacacacaaacacatctgtgtatattgtatcaaaaatatttttttccactctttggctttccttttaactctcttaatgactattgatgaatagatctt

SEQ ID NO: 43077 - DNA, 201 bp, Homo sapiens
atgttggccaggctggtcttgaactcctgacctcgtgatccacccacctcagtctcccaaagtgctgggattacaggcatcagccaccatgcccagtcttstttgttgttttaaaacactctctatgtaattgtgtaagcaggaaacccaaggatcatccctggcttgctccgtatttcttatctcctacatctcacaatc

SEQ ID NO: 43078 - DNA, 201 bp, Homo sapiens
ggatatcgacattcatttacagcttatactatggattttttctttattcaatatttttaaagaaaagcacatttatcaaatttgctttgtcaaagtagtcraagtcaattcattaagcaacatatcacttctgagagtttagcttactcacaatattacctatttagaacaaagatgaagttcaagaaaaattctatcaac

SEQ ID NO: 43079 - DNA, 201 bp, Homo sapiens
ctaagtactattgttgacagctgaagtgatacctcagttcttcttggtttaaaatagtttaaacaagagctacacagcaaaggaggtgtagcatagagtartttattacaatggataaagatattttgaaagttaggtgcagaataaacagtataccctgagagagaaagaagtcaggacaggctgcttgtaagggtgaga

SEQ ID NO: 43080 - DNA, 201 bp, Homo sapiens
cgtgctactgactcataactagtatcattgtcatgtgtatatatggacagccaagatatcacagtgagtatggtatactattcaagtttttcatgattaargtgttcttaaataattgttgaatagaattatggatgcacttcaaatctcatttgctagcattgtaatatatttaatacaaacttaaaaaaaccaaaacaa

SEQ ID NO: 43081 - DNA, 201 bp, Homo sapiens
actgtatatggaagacttatgatgtgatataatagtattggaaaacggaggaatctagcagaggaatgatgcatttgaggaaatctgttatgtggtagagwtaacattacgtatcagtgaagaaacagcagattaatctataaataacattgggaaaattttcatgtcaaaaaaagtaacattgtatctctaccactcctc

SEQ ID NO: 43082 - DNA, 201 bp, Homo sapiens
tcaaccaaaacaatgaaacagtgctgtggtttagcagaggtcctaccatgaatagaaggataccaggttgccactgtgtctcagactgcatctctgtgtcrttgacccttttaccaaaggtaggaaacagagctgtagtcatgccccatatctataataagtatgtggataataagcatcgagtacagccctgatggtagt

SEQ ID NO: 43083 - DNA, 201 bp, Homo sapiens
tcaaagaagatatcttaatgactaatgagcaccaaaattcacaatttcacagaaattaagacgatgcaaatcaaaaccatgatatactatttttcatttayccgactgtcaaaaataaaacactgaataactgaatactcctaatgctctatggaaaccgtcacacatgtgcacattaagagacatacaggagatgctcat

SEQ ID NO: 43084 - DNA, 201 bp, Homo sapiens
aaattcagtaggtgcaattagacagaatcaggcaaatataaaggtcataacattagtcacagtgtcaccttatttctgagccttttctttcttctgaagtrgtgtcttgtcagtggggtgatagagcaacaagaactctctgttgttatgggagtttgttaaattttatctgcgatttttccaattttaattaaatacttg

SEQ ID NO: 43085 - DNA, 201 bp, Homo sapiens
ggttgcacatctatagtggaagccgtgaggaagattatctcaatgctaaaagaattactagagatttctttgcttcttgtaactcccctggtgtaaaacayagaagctccaggaagttcactaaaacaaggttaaattcaaggaattgttggaaaacatttcatatatatttttagtcagtatcttatcttgattggtgtg

SEQ ID NO: 43086 - DNA, 201 bp, Homo sapiens
tttctttagggtaagaccacaatcagaagcatttttagaattcaaaatatttataatgattttttttagtagaaaatcagcaccctgattttaacttggtgggggggtggtaaaaattttgagaaaaattggtttccttgatagggagttatcaaggaaaacaaaactttgatttcctttacataagtgtaaacagaaatg

SEQ ID NO: 43087 - DNA, 201 bp, Homo sapiens
atgtaagttacctggtttttgtttgctttatttgttttcacctagctataaaaaaagtgtttttggaacttactattttttaatgcacatatttaaaatgraattcattaatcttcacatttttattgaatagttatccaaatgttttattctttttttagaatgtgattcttttttaacaggttgggacagaagaaaatt

SEQ ID NO: 43088 - DNA, 201 bp, Homo sapiens
aggtaagaacttacaaatggttgtatattattttcctccattacttttagactttatgtgaaggtggggtaggctgagtatttttaaatttaaaaaaaaawtttaaattagaagctatactaaattatgtttaaagttacatttaattaaatggatatcataactttgccaacaataacactatagagtagatacatatga

SEQ ID NO: 43089 - DNA, 201 bp, Homo sapiens
attaattttaattctcatgttttaatgtaatcccttaccttgtaagtaaaatgggaaaaatactacctacctaaactctcctaagtaaaatgggaaaaatrctacctaccgaaacttactattctctaccaatgtagaaagttgatgagtgatagtgatgtagtaagttgataaatgaagtgctttgaaaacacacaggac

SEQ ID NO: 43090 - DNA, 201 bp, Homo sapiens
gcggatcacgaggtctggagttcgagaccagcctgaccaacatagtgaaaccccgtctctactaaaaattcaaaaaaattagccaggcgtggtggcatgckcctgtaatcgcagttactcaggaggctgaggcagaagaatcgcttgaaccggagaggtggaggttgcagtgagctgagatcatgccattgcactccagcc

SEQ ID NO: 43091 - DNA, 201 bp, Homo sapiens
atgctaatttctatctctgattactccctgatcactttagtagcatccatttagatctgccatctctcatgccttctcattattcctagttagtaagaaascctattacaagagtaataatcattatatacctattatcttgtcacacccattatcctgatcactgatcatgtttaatatcttgctcagcactgggaaatt

SEQ ID NO: 43092 - DNA, 201 bp, Homo sapiens
gctgaggcagaagaatcgcttgaaccggagaggtggaggttgcagtgagctgagatcatgccattgcactccagcctgggctacagagcaagattctgtcaaaaaaaaaaaaaaaaggattacaattacaatattcttaaagtaaattctataataaagggaaatcaagggcctatggtcaagaacaaccctttctaaagt

SEQ ID NO: 43093 - DNA, 201 bp, Homo sapiens; identical to SEQ ID NO: 9695

SEQ ID NO: 43094 - DNA, 201 bp, Homo sapiens
actactgctgctcactcatgcctgccattgggttttattaccttactgtaattcctgattttcctcaatgattccactcctggtaaactgtcactaactamcattactttgtgttttcttgttataggatgattatgtacttgaagtgaggcactttcagtgtcctaaatggccaaatccagatagccccattagtaaaac

SEQ ID NO: 43095 - DNA, 201 bp, Homo sapiens
ctgaggcagaagaatcgcttgaaccggagaggtggaggttgcagtgagctgagatcatgccattgcactccagcctgggctacagagcaagattctgtcaaaaaaaaaaaaaaaaggattacaattacaatattcttaaagtaaattctataataaagggaaatcaagggcctatggtcaagaacaaccctttctaaagtt

SEQ ID NO: 43096 - DNA, 201 bp, Homo sapiens; identical to SEQ ID NO: 9696

SEQ ID NO: 43097 - DNA, 201 bp, Homo sapiens
ggaacaatgtttttgttgttaaacaaatatttacctcaacatataataccatgggataaaaatgcttgagctacaacccctgtccctaggagttaaaattmtgttttagaattattatgccaggcttgtatcacagaagccaaagcacacagattgtgagaaatttggcaaaatatatttaagttgtttttaaacattttg

SEQ ID NO: 43098 - DNA, 201 bp, Homo sapiens
aagcttctataagcaatgacagatgaattgacagatagatgtgtttttatttttattacttctgtgctatagaattattgatatgcaattaccgagtaggaaaaaaaaaaaaaaactttcaagccaggtgtggtggctcaagcctgtaatcccagcactttgggaggctgaggtgggtagatcacaaggtcaggagttcga

SEQ ID NO: 43099 - DNA, 201 bp, Homo sapiens
ttgccatgtataattttgtagactctgtactcgtgggcaaatttaattttacttggaaagtttgtcttagcaaatcaaggttttgggttagatcatttggrtcataaactcagctttcttatcaaatggagaaagacaacaaaaatagaacatctgaagatacaaagtatttaataaccaggtgatgtgttcataggtgtt

SEQ ID NO: 43100 - DNA, 201 bp, Homo sapiens; identical to SEQ ID NO: 9697

SEQ ID NO: 43101 - DNA, 201 bp, Homo sapiens
aagataaaggtgctgtctctcttgttgattacttttcaaagaggtagttcccaggtccttgagaggtacatttctggattataaagttaccaagtggctaytaaaaagatttacgcctcacaggagtagagaaagaattacaagccgggcacagtggctcacgcctgtaattccagcactttgggaggccaaggcgggcgg

SEQ ID NO: 43102 - DNA, 201 bp, Homo sapiens
aaaataaaaaataaataaataaataaataaataaatagatttgtgatgcacactgcctaaatgcttcctagatgggttacactcatctgtcatataaatgrctaccccactgtatactacccaagattgatgattgtcatattgaaaatctttatgaattcaacagatttttaaaaatcatgttttgttactttaatttgc

SEQ ID NO: 43103 - DNA, 201 bp, Homo sapiens
ttgaaggataggcagagaggacattcctttgccttgccaactcttcctgcctcctaacctattgtgtattgccaacaatacataataaatgaagaggtaakgaatgagaagaggttctttcttctgtgaccacttcctttcctctgtctgacttccttccaggttttgtaagcaatcttgtgtgggtcttcccccattctg

SEQ ID NO: 43104 - DNA, 201 bp, Homo sapiens
taacaacttcatttcatttaagggtttcagaaaataaatgtcactcttcctagtaaccttaagttttctatgacaattcctaaacaaagacagttcagtgaaaaaaaaaaaaaaagataaagtgaagtcattttattttttttaatctcatgaacacatagcccaagattatcctaggagatgttaaaaatcttcttttcg

SEQ ID NO: 43105 - DNA, 201 bp, Homo sapiens
gacaactaaagaataaaaatatcaaacttttaaagaattaaagttagttttattccgaagcctgactgaggactatagactgaggcctatagccgggagcrctgctgctgcacactgttgcagccacggcttttacacaggttgtggaggttcagtatgtgcaaaatcacatcagattcactcaaaagttacgttaaagta

SEQ ID NO: 43106 - DNA, 201 bp, Homo sapiens
aacgtgatacatagagatgttatcacagaataaaagtcagcctggtttagttttgttaacagctaactttctagtttcagaagtgaaactagaaggaggtwattttcctctaaccaatcaattttcaaacagagaactcagatatttaccaagtatgtatgagtaaaatgaaaaacaaactttaatgcaccctccactctc

SEQ ID NO: 43107 - DNA, 201 bp, Homo sapiens
tctgtctgagctggaactgtctgggctttgtgtaggacgcattgtgcttcttccccttgctgggcctcctttacttcaatctctgtggtttttgtttgttygtttgttcgtttgtttttgtttttgttttttggggttttttttgtttgtttgtttgtttgtttgtttgtttgttttgagaaggagtgtctcactcagtcg

SEQ ID NO: 43108 - DNA, 201 bp, Homo sapiens
aggcctatagccgggagcactgctgctgcacactgttgcagccacggcttttacacaggttgtggaggttcagtatgtgcaaaatcacatcagattcactyaaaagttacgttaaagtagaaacacatcgaggtttgggtgtgagagtctatctaactacagatgactaaagtacattggttatagattacagaagcataa

SEQ ID NO: 43109 - DNA, 201 bp, Homo sapiens
tctcagctccaagcaagggtggatgtatgttgactaatggagtgatggtggtgtgtgtttcccagcagcccagggaccctatgcatcttgggtgtgcctcmtaaggtcaggagaagacaacagttttaccagggtttcagcagatatgatagcaacagcacataccattgtgcaatatcttattatcttaggaggcaacca

SEQ ID NO: 43110 - DNA, 201 bp, Homo sapiens
tttgtgtaggacgcattgtgcttcttccccttgctgggcctcctttacttcaatctctgtggtttttgtttgttcgtttgttcgtttgtttttgtttttgytttttggggttttttttgtttgtttgtttgtttgtttgtttgtttgttttgagaaggagtgtctcactcagtcgcccaggctggagtgcagtggcgcaat

SEQ ID NO: 43111 - DNA, 201 bp, Homo sapiens
gcccatccgataatctcacaagaggatttagaagtggttgatttgcttgaatggatattatagacagatatttcctatcatctgtagattttttttaaagyttagctaagatttatattctggtcaaactttttctatgctagataatggtgactaaagcaagcctcgttgtggaggctgaacagggttcagttaagtgat

SEQ ID NO: 43112 - DNA, 201 bp, Homo sapiens
ttttgttttttggggttttttttgtttgtttgtttgtttgtttgtttgtttgttttgagaaggagtgtctcactcagtcgcccaggctggagtgcagtggygcaatctcggcttgctgctgcaatctccgcctcccaggttcaagtgattctcctgcctcagcctcctgagtagctgggactacaggcgcccgccaccaca

SEQ ID NO: 43113 - DNA, 201 bp, Homo sapiens
acatttgtaaactagctatttgtagctttctctacagaaacagttctgccatccgcaatcaggttccaaacctatcctgcaaagatttattttacccacartgtagctgaaatgaagtattaatgttagtacagtcagggattaagggacaatcatacaggaaggaggagaatgaatctgaacactcccatttattggaag

SEQ ID NO: 43114 - DNA, 201 bp, Homo sapiens
tgtctctgtgtgccaccttatcatccttctttcgttcacagcaaactgtttttaaaaagtgctttaattctactggttccctctaattcactctgtagtcygaattgcaagtctatcatttcacggaaattgatttattctatgaatgtggggtttggagttgggaaataaccaaatccaaactcattcttcactcatgac

SEQ ID NO: 43115 - DNA, 201 bp, Homo sapiens
ttgaatccaagtcactcaccactgatagctttatactgtttaaatgactttttaattttggtgtttgggtatgtttgttagcatgtagaaagcaagcccarggtaatttataaagctatgacttacagtgtatggagcactaagtagagtttattcaaggcaactggtgctagatgctatgaagattactgtagtcttcac

SEQ ID NO: 43116 - DNA, 201 bp, Homo sapiens
cttgcatctaaaaagtgtcttcttaagtatatcatctttccattttgctggaattctaaattttatgctacttatcattgaaaaaatactgaattacttcrtttttgtattttattaaactaaaatttgaatccaagtcactcaccactgatagctttatactgtttaaatgactttttaattttggtgtttgggtatgtt

SEQ ID NO: 43117 - DNA, 201 bp, Homo sapiens
tcaatagctgtattgtcagcattttatcatggattgaatgctttaaaatttttgagcagcataaaagatttgtagaggaaaacctattttccttagaaacragagacagtgttttttgatgcttcaaagtcttaaaaaatgtaggaatattagagttatgccttgccctgcttggtgggttttgagtgacattctgagacc

SEQ ID NO: 43118 - DNA, 201 bp, Homo sapiens
gcgtttacccctcatcttcagtgttcttagagccaatgaggtagcctgacatatgtattaagtgctcagtaagggtctgtcaactgactaaaacttgctgyacaggagaagagctcaatacaatttgaacattaggctgtcattcttaccattatccaggaacaagttgtagagttcactaagatattgattattggcaat

SEQ ID NO: 43119 - DNA, 201 bp, Homo sapiens
atagcttaaaaaaaaagtaaaacaaaattctgcatttttataaaacttgataaaaatatttcaaactgtacggtcaccagtgcacagttatcaaaaatgcrcacacttcgcttggcatttccagcaccttcagctttctgtgcctggtctccatttctgcagggttattcccctccttgccagtatcatcttttccctttt

SEQ ID NO: 43120 - DNA, 201 bp, Homo sapiens
atgcatatgatttttggccactctggagaattttgaacgtagatggcaatgctgtctgaaaaatggatccctgtgaaagaagcataaagcgtgaaatcacrtttaattagccaagagtggctagtgtatgttgccattaaatcctttaaattacagcacatctgggcaccgtccatcccacaagaatgtatccaatgatgc

SEQ ID NO: 43121 - DNA, 201 bp, Homo sapiens
cgtgatccacccaccttggcttctttacaggcgtgagccaccacgcccggcctgtaaataattttcaatgttttacatgcacaatcatgttatttgcacaytgtgatggtattattttttcctatacaatcttaagattttcgtttcttttttctttattgcactggctcagtcttccaattcaatgttaaatagaagtgg

SEQ ID NO: 43122 - DNA, 201 bp, Homo sapiens
cccctggggccttccccacccagagtgttcctctttctcaaatgcctacatgctttgtcctggaaacaacagagccccagcaactccatagtggggctccytctgaaagaggcagaaatgagaagaggaagatgctgggggttcagcagccgaggtgcatgtggtgcaggcattcagtccaattaaacaggcacccagagt

SEQ ID NO: 43123 - DNA, 201 bp, Homo sapiens
accataagtagtgtagaatgtatttatgtatttatttatttttttgagatggagtctctatcgcccaggctggagtgcagtggcgcgatctcggctcactrcaagctccacctcccgggttcacgccattctcctgcctcagcctcccaagtagctgggactacaggtgcccgccaccatgcccggctaatttttttttgt

SEQ ID NO: 43124 - DNA, 201 bp, Homo sapiens
agctgtttggagttaaacaactcatgtaattgtcacttttcaagtcaataatgtaaaccccacaggacaaattattttagtgccatacttacagattacatttttttttttaaagacagtcttgtcttgctctgtctcccaggctggagtgcagtggggtgatctcagctcactgcaacctctgcctttcaggttcaagca

SEQ ID NO: 43125 - DNA, 201 bp, Homo sapiens
caccatgtccagctaatttttatatttttagtagagacggggtttcaacatgttggccaggctggtttctcactcctgacctcaggtaatccacctgattyggcctcctttagcgctggaattacagcgcaagccaccatacccggcccagattacattttttgtcattgggctccatttttcttgaaatttagtctgtaa

SEQ ID NO: 43126 - DNA, 201 bp, Homo sapiens
tttgcattgtcacacaaaattcacttaaatgtgttacacttttaggcaaaatgccattataataattttatgttgacctgtgttgccctccaatttcatgyatcagtaagggcctagtggaaggcttatttagtttcaatttcctttgttttctgtatggtaattctgactctttaaaccaagaattttcaaggagcaaaa

SEQ ID NO: 43127 - DNA, 201 bp, Homo sapiens
gaaaaacctgttattgagagtgtcctatagtgaattcaagcaataatgggtaattgaactgtattagcccattttcatgctgctgataaagacatacccgmgactaagcaatttacaaacgaaagaggtttaattggacttacagttccacatggctggggaagcctcacaattatggcggaaggcaaggatgaccaagtc

SEQ ID NO: 43128 - DNA, 201 bp, Homo sapiens
tttaatgactgaggcacagaatcacaaaaattattttgaaatatagtgagacacattttgacttagggattttatttcctttatcccttaggaggaatgtrtatatggctgtttatcctgttatctgtgaataccatgtgacaactaaagaataaaaatatcaaacttttaaagaattaaagttagttttattccgaagcc

SEQ ID NO: 43129 - DNA, 201 bp, Homo sapiens
cttaaatatactgttactgaatagactgttagagaatcttcccctgggctgaaaaagtagacacaagtttagatacctttaaatccatgcgagtgtatttwtttatttattttattttttttgagacggagtctcgctctgtcgcccaggctggagtgcagtgacgcgatctcggctcactgcaagctccgcctcccgggt

SEQ ID NO: 43130 - DNA, 201 bp, Homo sapiens
attatacaaataattgaagttgtttcagaagctactttataagtgataggtacgtttatttctgttaaattatgctctctaacacaatttttttattcacrtagatgatgtcggagcaattccaataaagcactttccaaagcatgttgcagatttacatgcaagtagtgggtttactgaagaatttgaggtatgatttta

SEQ ID NO: 43131 - DNA, 201 bp, Homo sapiens
tactgttactgaatagactgttagagaatcttcccctgggctgaaaaagtagacacaagtttagatacctttaaatccatgcgagtgtatttttttatttattttattttttttgagacggagtctcgctctgtcgcccaggctggagtgcagtgacgcgatctcggctcactgcaagctccgcctcccgggttcacgcca

SEQ ID NO: 43132 - DNA, 201 bp, Homo sapiens
gctacacttctttatcctccttcagggatatgactgaggaagtctagacttataataggttaaatgagaaagtgttgaacaacccgatcgtgtgcacaggrctagtaaatggttgattgacatgagactcagatctatgtctgaattccaagtccttaactcctactatctaatcattttttagaaaaaatttttcgaagg

SEQ ID NO: 43133 - DNA, 201 bp, Homo sapiens
ttactgaatagactgttagagaatcttcccctgggctgaaaaagtagacacaagtttagatacctttaaatccatgcgagtgtatttttttatttattttwttttttttgagacggagtctcgctctgtcgcccaggctggagtgcagtgacgcgatctcggctcactgcaagctccgcctcccgggttcacgccattctc

SEQ ID NO: 43134 - DNA, 201 bp, Homo sapiens
gcacttaaaggatcacacaacttgattttcttctctgctgtgacacaatagcctcactttgcattcgtttcacaatctgggatcattatccaagctcagtragaatcaatttctcatagatgattgcctgaatcactgccagctcagccacattttttacatcatttaccaggaagtatagtttttaaaaagtcagaacaa

SEQ ID NO: 43135 - DNA, 201 bp, Homo sapiens
cacagcagatgctgtggcctctgtaatgagacagcaccatcctgtggtgaccagttaggtaaggaacctcccaaggaataaccacattatctggccacccrcctagaatgaatggagacaggtggagagaggctgtggaaagcaaaatgagaatatacaacacactgaggaaggagtcacctgagaaagcagagtagaatt

SEQ ID NO: 43136 - DNA, 201 bp, Homo sapiens
cggctcactgcaagctccgcctcccgggttcacgccattctcctgcctcagcctcccgagtagctgggactacaggcgcccaccaccatgcctggctaatyttttgtatttttagtagagacagggtttcaccgtgttagcgagcatggtctgtatctcctgacctcgtgattggccggcctcggcctcccaaagtgctgg

SEQ ID NO: 43137 - DNA, 201 bp, Homo sapiens
gcaaaactctgcatcacattataaaacaaatatttatgagaacttctaaggaaagaagagataattggcaccaaccaattttccctaaaagcaagtcaagrcaaattattctcatttccttttgcattaagtttttaggtttgtagattataggaatattttatttaggaaattatttgggaaaatctctcaggtggtcct

SEQ ID NO: 43138 - DNA, 201 bp, Homo sapiens
aatgactttcttaaatatcataatgctaaaaggaatttgtgctagaattttcctaaataaattgataactaccttctctgacctgtaaccccctgccaatwgcatatatcagccagacttgaaaagattttttgctgtcctgatgtgattgtcccattagtacagaaaacaaaggaaaatgtagtttgacgaaacaggttc

SEQ ID NO: 43139 - DNA, 201 bp, Homo sapiens
aaagacttgaaggtagctggcacctgtaattccagtgctttgggagaccaagacaggaagattgcttgaggccagaagtagaagaccatcctgggcaacayagagagactctatatctacaaaagaattttaaaaattagctaggcgtggtggcacatgcctgtagtctcagctacttgggagactgaggcagtagaatca

SEQ ID NO: 43140 - DNA, 201 bp, Homo sapiens
agcaaatccaaaacttggcatatgccaaaatatattacctctaaactctgtagtttccattctttcatacttcattagcatatctaggaagtaagatctayttgcagcactttgaaaaaaataaataaatgacatgtagtttttcttttccaagaccctaaaagtttgttcttgaagatcagttgtatttatgcatataac

SEQ ID NO: 43141 - DNA, 201 bp, Homo sapiens
ttgtatggagagtgccatttattaggaaggcatttctttttggcatcatggaatggacactggctcttctaaggatcacagaatttaatagaaccatctgstcctgaaagagttagtgaaaactgtctttttttttttttttttttttttttttgacagagtctctctttgtcacccaggcttgagcacagtgtatcgatc

SEQ ID NO: 43142 - DNA, 201 bp, Homo sapiens
agataatgtttgctccattaagagtaatatataactgctttaaaaacgtgatacatagagatgttatcacagaataaaagtcagcctggtttagttttgtyaacagctaactttctagtttcagaagtgaaactagaaggaggttattttcctctaaccaatcaattttcaaacagagaactcagatatttaccaagtatg

SEQ ID NO: 43143 - DNA, 201 bp, Homo sapiens
atttgtgaattaatgcatattttatctgtatttccatttgtatggagagtgccatttattaggaaggcatttctttttggcatcatggaatggacactggytcttctaaggatcacagaatttaatagaaccatctggtcctgaaagagttagtgaaaactgtctttttttttttttttttttttttttttgacagagtct

SEQ ID NO: 43144 - DNA, 201 bp, Homo sapiens
agaaatacattataaataatcgcaaaaaccatgtgagatttatatattcatataaactctgtaaggttagagaccaggccttattcattttttgcattcayagcaggcgctcaatagattatttgtgaattaatgcatattttatctgtatttccatttgtatggagagtgccatttattaggaaggcatttctttttggc

SEQ ID NO: 43145 - DNA, 201 bp, Homo sapiens
acaacactttcttaactacttggtgttttgggttctagaaatacatgataggacctataaagtaaggaaaataattttcttgaatggagcttgtaggaatygattttattcccttagactatgtgtgtatattgtcacagaatttcacatccctgctgcaatactattatgactgccatagtaataataatttatttatca

SEQ ID NO: 43146 - DNA, 201 bp, Homo sapiens
ttcgagagcaacagtacaagttctctagacaggtgttttcctcatacactggaaaggaagagattcatgaagcaggtatgtatttaaatataatcttctacaactctcatagatgcagtgttataggaggtaattttggtaaactgacaaatatagaggacttagagctttagaaatgttttaattattaattttgtagct

SEQ ID NO: 43147 - DNA, 201 bp, Homo sapiens
ttgtttcagggtttgaaggccagatggcccacctaagaaaactctaccagtttttggatagaaattctataatctgtatacaagtttatatataagaataracccatatttattggtgtgtgtgtgtgtgtgtgtgtgtacacacacaaacacatctgtgtatattgtatcaaaaatatttttttccactctttggctttc

SEQ ID NO: 43148 - DNA, 201 bp, Homo sapiens
tgagactggccaattttcactggtctttccctcttttgattatgatctcagtccgggagtaaggtcagcattcaccttgacctgtccatctttaatgtcayttctggtacgcgaacttcactttcactgattctcccagaaatacacgtaagcatataggcatcctctatgaggttggagctgtcatgaatgtgattaatg

SEQ ID NO: 43149 - DNA, 201 bp, Homo sapiens
tcaggtaatccacctgattcggcctcctttagcgctggaattacagcgcaagccaccatacccggcccagattacattttttgtcattgggctccattttkcttgaaatttagtctgtaaccctggggagtatgtttgaaagttttaatagttgtccaaaaaaatgttatctgtcagttcccattactctagcagaggatt

SEQ ID NO: 43150 - DNA, 201 bp, Homo sapiens
aaggagcagagagtttaataggtaagaaagatgggagaaggcagaaggaagaagctccccgtacagagacagagggagggggcctccaaagctgaaagagsagaacctgagttgtgtgtttttatatattctagatacaagtcccttatcagatatctgatttgcaattattttttcccattctgtgagttatcttctcac

SEQ ID NO: 43151 - DNA, 201 bp, Homo sapiens
tcagtcaaacagaattcaagtgtttcaatttaaccactcatgaatattgctccaaataaattaaatgacctacatcaaagagtgtcattagcagttttaaktattcaatttttaaaattaaagatggttggctttactttatagcagtagttggttctttgctcttgtcgatagtttgtggtgtgctcttaccagatgcta

SEQ ID NO: 43152 - DNA, 201 bp, Homo sapiens
ataaaaaacattgttcattttcttccataaagtacaaatctttaatattcttttttaaaatctgaattaataacaatgattctttttaattttctaaattmtataaattatactaaactactaaatttcatgatttccagccaaattacataaaaattcttaactgtgatttgtacaccagtgttaatgcaaaagcattta

SEQ ID NO: 43153 - DNA, 201 bp, Homo sapiens
ccacaagagggcttatgatgaccctaaggcaactttcagagctattctgcaagaagagagatttttatttcccaaaccagggggtaatttccaccagggckttgtttgtttgtttgtttgtttgtttgtttgttttgttctgcatttgccgtctcattggtaataacaagactgcagcaacaaaggaaagaaatctcactc

SEQ ID NO: 43154 - DNA, 201 bp, Homo sapiens
tattgttaaaactcatgctaaaatatcatggatagttgtatactatctatgcatgccggctcatagtatgtgaagacacatcaaataaaaactcctatgastatctttacaagcgtgctttgtatttaaataacattaaagataattaaatattgtgttagtgaggaactttatttccttatttggaatattcttaaactt

SEQ ID NO: 43155 - DNA, 201 bp, Homo sapiens
ttttttgtatttttagtagaggcggggtttcaccatgttagccaggatggtctcaatctcctgacctcgtgatccgcccgtctcggcctcccaaagtgctsggattacaggcatgagccaccacgcccggcccctagttaatgactttcttaaatatcataatgctaaaaggaatttgtgctagaattttcctaaataaat

SEQ ID NO: 43156 - DNA, 201 bp, Homo sapiens
taaattcctagctcttctatatagaaggtttaaagttgtatcccatccttaggaaaccctctctaagtgtctttttattgagcctatcttttttttttttwaaaaaaaagcaaaatataatacattaaaatttaagtacaaattctaataagctatacatagataaataatttccaaaaagtgacaccttttcttttttga

SEQ ID NO: 43157 - DNA, 201 bp, Homo sapiens
gtagctgggactacaggtgcccgccaccatgcccggctaatttttttttgtatttttagtagagatggggctttaccgtgttagccaggatggtctcgatytcctgacctcgtgatcctcccgcctcggcctcccaacgtgctgggattacaggcgtgagccactgcgcccggccaataatggagaatttaaagcagtggt

SEQ ID NO: 43158 - DNA, 201 bp, Homo sapiens
cactaatgaaaaagatgctgatgggatcctggcagcaggtgactcagaaataactcctggattcccacagtccccaacatcatctgttactagcgagaackcagaagtgttccacgtttcagaggcaggttagttacggatcagaaggacagattgaggtgtggtggtttgcttgctctaaaagtaaaatgaaaattatag

SEQ ID NO: 43159 - DNA, 201 bp, Homo sapiens
aaattcctagctcttctatatagaaggtttaaagttgtatcccatccttaggaaaccctctctaagtgtctttttattgagcctatctttttttttttttaaaaaaaagcaaaatataatacattaaaatttaagtacaaattctaataagctatacatagataaataatttccaaaaagtgacaccttttcttttttgat

SEQ ID NO: 43160 - DNA, 201 bp, Homo sapiens; identical to SEQ ID NO: 9703

SEQ ID NO: 43161 - DNA, 201 bp, Homo sapiens
atgaagcctgggtgatacatggagggataagcagcagcctgataaggagtagaaatgggctgaaaataggaaggtgagagaactctgaggagaagacttatttttttttttcttttaacccttcagttccttccccctttgctctgtcttcttattaccatctgacatcttagggaagcagagctttcaagtaacagctat

SEQ ID NO: 43162 - DNA, 201 bp, Homo sapiens; identical to SEQ ID NO: 9704

SEQ ID NO: 43163 - DNA, 201 bp, Homo sapiens; identical to SEQ ID NO: 9769

SEQ ID NO: 43164 - DNA, 201 bp, Homo sapiens
gagctttatccattttgtttgaggtaatatatatacactttacactaatgtaattcctttttaagtcacattaaatattgacgtgaaatatcaagacataktttctaacaaagagaggagctcacaagtaaaattaaaactggtggtcattttcaaaaaaagatgacccttgcctggtatttttaaaaggagactcttgtg

SEQ ID NO: 43165 - DNA, 201 bp, Homo sapiens
agagtttacagctggaatagacttttaagatcagatagtctagtcatttcgtattctaatgtggaaagtgtggttaagaaagactaggccgggcgtggtgkctcacgcctgtgatcccagcactttgggaggccgaggcgggcggatcacgaggtcaggagatcgagaccatcttggctaacacagtgaaaccccgtctct

SEQ ID NO: 43166 - DNA, 201 bp, Homo sapiens
atctactgctttgatgcggaccgattttcaagttttgaggaagcagtcaaaggaaaagggaagttaagagctttatccattttgtttgaggtaatatatakacactttacactaatgtaattcctttttaagtcacattaaatattgacgtgaaatatcaagacatagtttctaacaaagagaggagctcacaagtaaaat

SEQ ID NO: 43167 - DNA, 201 bp, Homo sapiens
taggccgggcgtggtggctcacgcctgtgatcccagcactttgggaggccgaggcgggcggatcacgaggtcaggagatcgagaccatcttggctaacacrgtgaaaccccgtctctactaaaaacacaaaaaattagccaggcgtggtggcaggcgcctatagtcccagctactcgggaggctgaggcaggagaatggcg

SEQ ID NO: 43168 - DNA, 201 bp, Homo sapiens
ctgaggcaggagaatggcgtgaaccctggggggcggagcctgcagtgagccgagatagcgccactgcactccagcctgggcggcagcgagactccgtctcaaaaaaaaaaaaaagaaagaaaagaaagactaaaaccttgaaaaggcttcactttacttgggattttctacactagcctactaccctgcatgtttgcatca

SEQ ID NO: 43169 - DNA, 201 bp, Homo sapiens
agtgtaagtaatcacaagtatgcaaacaatagtgattaagcgtgattttttttttaaagcatggtaaatacctcatggagatggtgttaatgtaaggtacrgaaccctaattggcctaagagtttcagggaaggcttaccagagaaagcgactttagattcagataaagcataaataggagttaaatcaacatgggtgaaa

SEQ ID NO: 43170 - DNA, 201 bp, Homo sapiens
tctccccatcacctgccaaatgaaaaaaaaaaaagggctctttagcttggcatataatggctttaatgagctggcccacctatcctgtttcattcctcatsattaccttccccctgcctgctgctataccagccttttcaaaagcaggtctctccgattctgtttataatcctgcctgaatagcagactatgcaccttctt

SEQ ID NO: 43171 - DNA, 201 bp, Homo sapiens
taatggctttaatgagctggcccacctatcctgtttcattcctcatgattaccttccccctgcctgctgctataccagccttttcaaaagcaggtctctcygattctgtttataatcctgcctgaatagcagactatgcaccttcttcaagtgaagccttctttcctgactcttcttttctgcaggccagagcacatccct

SEQ ID NO: 43172 - DNA, 201 bp, Homo sapiens
aaattagtggcaatcacggaagaaatggcttgcccttgagtgtctgaacatataggattctattaataaaaattactaagtacattataaggcttgtctgyaaaagaactaataagccatttagaaatattacattacacatcaaacattatttaaatgcaatcacttgagctaaagtaattatgaaaaaaattacacaat

SEQ ID NO: 43173 - DNA, 201 bp, Homo sapiens
aagatgaagttcaagaaaaattctatcaacaagagccctgagcaatcaaaatacatggtacagaatccatgcactaaacctaatacaattattttaatgcraaagcctctcaaattgtctctcagtggtattggggttttgttgttgttgttgttgttgctttgagacagagtctcgccctgtcgcccaggctggagtgca

SEQ ID NO: 43174 - DNA, 201 bp, Homo sapiens
cttagaatgtagaattctctttgctgatttttatgaagtctttgtgtatcataaaactatcattgttacttttatagatgcaaatctactgctttgatgcrgaccgattttcaagttttgaggaagcagtcaaaggaaaagggaagttaagagctttatccattttgtttgaggtaatatatatacactttacactaatgt

SEQ ID NO: 43175 - DNA, 201 bp, Homo sapiens
gatttgggtgggaaaacagccaatccatattatgcccataaaacatcttgtacaaaatgggacacagtgacgaattgctaataatgattagcacttctcakcacgttgaagtagagtaaggaggttacactccagatgcttttttaagctgttgtagacatctgagcccagtgcctaaaatacatttcaaagcagtgctat

SEQ ID NO: 43176 - DNA, 201 bp, Homo sapiens
aaagttttgagagttatttgggattcttttttagtaaatatgacagctaaagggaaactgttaatactgttagtcaaaaagtttcattatgaatcatgctrtctgccttttaaacgcattcttcatactgtgggagaagtaaatgggactcattgaaaagcaatgtagagtgaaatcgattttaattcacaggacatggat

SEQ ID NO: 43177 - DNA, 201 bp, Homo sapiens
cagttttgtaccagcagttggatggagaggaccaaaccaagcatgaatttttgacagatggctatcaagacttggtaactatatgatcagttgttttacayagggtaacattataatttaatttccaaggtaagaacttacaaatggttgtatattattttcctccattacttttagactttatgtgaaggtggggtaggc

SEQ ID NO: 43178 - DNA, 201 bp, Homo sapiens; identical to SEQ ID NO: 9698

SEQ ID NO: 43179 - DNA, 201 bp, Homo sapiens; identical to SEQ ID NO: 9702

SEQ ID NO: 43180 - DNA, 201 bp, Homo sapiens
cctgagaagtactcatgctctgatctgagtgggaaatagttgttcagtgctcttgaaattgaaacaagaattttctttcaaccagagaaatgggaaaggayttagtgattgcctgtaaaaacctaaggaactgttcaactatatagagccactgtttggccgcatggaggatcttaacacatccctaggtattcctgtatg

SEQ ID NO: 43181 - DNA, 201 bp, Homo sapiens
ctgtgcaaaagcagaaagggctgtaaaatactagagaatgtagacaaaggtaccataaattactttggaaggacttcttgccatcctgaagcaaggttttstgtgaatgtttacagctgactgtcacatctttagttacaaaattcaattttgttgcattatatccattcataattgaaacattggtgttttatttcaaat

SEQ ID NO: 43182 - DNA, 201 bp, Homo sapiens; identical to SEQ ID NO: 9706

SEQ ID NO: 43183 - DNA, 201 bp, Homo sapiens
atgaagaatgagatattgctataacttcaaaatacctcccctcaaaatactttctaattacaagacagagaataatattgcagtggaaagcctgacagatrctttaatcaagtgatcaaagtaaacgtcagcaaaaattacctttacagagatcctgtaccactgactaagatacagtgagaagaaaagagcatatttttt

SEQ ID NO: 43184 - DNA, 201 bp, Homo sapiens
tgcctggtttgcaagagctcctgggtggttcgatccctgggagatgccaacggaaggtgtcacccccgtctcttgctgctcccgggagtccattggaaaaycaaagccatttagtcccaaccccctgtggccagcagctgttcctgagggccctgtgcactgtggccatgcccgtcacttgctggtgaccttggttagtgc

SEQ ID NO: 43185 - DNA, 201 bp, Homo sapiens
tcagtttctccatctgcgaaatgggtctcacagtccctgctcttcttgcttccgcaggcttttggggcatgtagcggacgggtaggcaagagggggccttrcggagtgcgtgtatgaccagcctctctgactgtctgtctgtctctccgccttgctcagctggcccgagataacttcttccgctgtggtgtgctgtatgag

SEQ ID NO: 43186 - DNA, 201 bp, Homo sapiens
cagccttcacagtgaggggtcttggcaggaacccctgcccttctctgccacacctgccactgctgctcttcagctggggccgtggaagcctcaccttctcsctgctctgtcttctctaacctccctcggtggggcctccgagcccagcccctcccccaggacagggagacacgggacccagctcaagttctgcagaccagc

SEQ ID NO: 43187 - DNA, 201 bp, Homo sapiens
ggtgtcacccccgtctcttgctgctcccgggagtccattggaaaaccaaagccatttagtcccaaccccctgtggccagcagctgttcctgagggccctgkgcactgtggccatgcccgtcacttgctggtgaccttggttagtgcccctggctgctgaggagatgacagtgggcaggtggtccatatgatcacgggaccc

SEQ ID NO: 43188 - DNA, 201 bp, Homo sapiens
gagtgcagtggcacgatctcggctcactgcaagctccgcctcctgggttcacaccattctcccgcctcagccccccgagtagctgggactacaggtgcccrccaccacgcctggcaaattttttgtatttttagtagagacggggtttcaccatgttagtcaggatggtctcgatctcctgacctttgatccgcccgcctc

SEQ ID NO: 43189 - DNA, 201 bp, Homo sapiens
ctccttacccagtttctggcaaggagccaggcctcgtctcctgcccccagcagtgagcaggcaggaggcccatttctcagctgtagctctgtgagccgagrgatggcagccaggaggctgctttctcagggcagggcgtgtagattttgtcccgtactgttgggaatgcccaggaaagcttattaaaacgtttcttctggc

SEQ ID NO: 43190 - DNA, 201 bp, Homo sapiens
tggctgccgaacccctccaggcaggctgcaatctgcaatcatcgttaaatcggcttgcagttaatttggacattgttactgggggatggggcccgggagcrctcccttccagctgtgggggtctgccgagttaatgctacagttggctggtttccccctgaccattttggccctggctttggtaaatcatttaatgagtgc

SEQ ID NO: 43191 - DNA, 201 bp, Homo sapiens
tggggagcaacatttttctgggtccccagcatgataggtggtgcggctggggtctcaggaaggtgggccattcggccatctttctagtgagctgggcaccrgggatcccaaggggccagggctctgggttgagcccaggctccctgatgccccactgtccccagacaggtgtaaataccccgagatcacaggctgctttga

SEQ ID NO: 43192 - DNA, 201 bp, Homo sapiens
cccgagtctgtgagttgcctgagttcagctggatgaccgaggggtccccgtgggataaccgcaccctctgctgtatgttcatctgggagctcagctgcggyccaagcaaccaagatggcctctcaccctccaagggcctcgctccacgtggcctctaaccattaatggtctagcccagccctccttacagcttgtcaattg

SEQ ID NO: 43193 - DNA, 201 bp, Homo sapiens
tgggctggcatttcgggcgaggggttggacgaaagcctgaggggccgactcactgtggcggccaccttgttttgcagagggggacctacctgccgcagacrtacatcatccaggaggagatggtggtcacggagcatgtcagtgacaaggaggccctggggtccttcatctaccacctgtgcaacgggaaagacacctacc

SEQ ID NO: 43194 - DNA, 201 bp, Homo sapiens
tgagggccaaagggacagtgagggttccagggctttggtgtttgagccttggtgttgattgggcacagtaggcagaggcagcgctggggcgggatttaggrgttctgcctctgtgtggggctttatggaggaaatgccttcgcctccaagcagggacatctgcgctttcctgtctactttctggtagcctgtaatgctgcc

SEQ ID NO: 43195 - DNA, 201 bp, Homo sapiens
gcagggccatgagagagaagtgcccacccgcagtctaggtaaggtgggggatccccagccttcacagtgaggggtcttggcaggaacccctgcccttctcwgccacacctgccactgctgctcttcagctggggccgtggaagcctcaccttctccctgctctgtcttctctaacctccctcggtggggcctccgagccca

SEQ ID NO: 43196 - DNA, 201 bp, Homo sapiens
catgttagtaaactttcacagcttcccaaggccctggcgtggtgcagagggactttaggtgttgcaagttggctctgcccatcacctgctagatttggagscttggaaacagttcacttctgcgggcctcctgttgccccacttggccaacccgcacatttcctccttacccagtttctggcaaggagccaggcctcgtct

SEQ ID NO: 43197 - DNA, 201 bp, Homo sapiens
actttcatggctgtcgtccattcctgggatttggcgccccggcaggccccacggtggcttctctgctttcctgccgcttctctctccattccctcatttcygctctcttctctcagcagtccttgcatgtttcaagaccgtcagcagattgccagtgaggatgagtttctcttagtgtggagaaaaaatgtttatggtgaa

SEQ ID NO: 43198 - DNA, 201 bp, Homo sapiens
gcttaggactatgcgatctggggaaagaattagaatcctggcatctttaggacagaactgcatgttagtaaactttcacagcttcccaaggccctggcgtrgtgcagagggactttaggtgttgcaagttggctctgcccatcacctgctagatttggaggcttggaaacagttcacttctgcgggcctcctgttgcccca

SEQ ID NO: 43199 - DNA, 201 bp, Homo sapiens
aggtggaggtggaggaatagaagccagattgaggtaggatgagtgtagggagtgataaggaaatggagactgaattttcaagaggtttggctaagaagaaraaaagataaacagggtatcaagtggaggaggacgtggggtcaaagaaggggtttgtttttgttttaaggctaatacgagcatgtttcagagctgacagga

SEQ ID NO: 43200 - DNA, 201 bp, Homo sapiens
aacgtttcttctggctggcagtgaccccagaaccctccttggtgtctgaactggactccaaaacaagatttattttattttatctattttattttattttwtttttttttttgagacagagtctcacttttacccaggctagagttccgtggcacgatcttggctcattgcaaccttcacttccaggttcaagtgattctc

SEQ ID NO: 43201 - DNA, 201 bp, Homo sapiens; identical to SEQ ID NO: 9780

SEQ ID NO: 43202 - DNA, 201 bp, Homo sapiens
acgtttcttctggctggcagtgaccccagaaccctccttggtgtctgaactggactccaaaacaagatttattttattttatctattttattttattttatttttttttttgagacagagtctcacttttacccaggctagagttccgtggcacgatcttggctcattgcaaccttcacttccaggttcaagtgattctcc

SEQ ID NO: 43203 - DNA, 201 bp, Homo sapiens
gagggggacctacctgccgcagacgtacatcatccaggaggagatggtggtcacggagcatgtcagtgacaaggaggccctggggtccttcatctaccacytgtgcaacgggaaagacacctaccggctccggcgccgggcaacgcggaggcgtgagtggctggcttcacccacagtagcccctgtcccgtgccccagacc

SEQ ID NO: 43204 - DNA, 201 bp, Homo sapiens
cctttgccataaagctagcaggcctcaccttgtcggtgaatttgatttgtggagcaggccctcgggctctcccacgtagcgctttgacttttttttttttyccttttctgtctttctggttgttagcaatctcacaagctagtttccctggttttccagaatgcagaagcaaaagtctggccacaatgcagcctcaacagc

SEQ ID NO: 43205 - DNA, 201 bp, Homo sapiens
cagataactcaaaatgcacctgctgaacccactgcatctctttcggtggcttccaggtgtgtcttggtttctctttcgaggtgtgtctccttttctctttygaggtttgtctcggtttctctttagccaggacgagtccgggtgaccctggtgggccttcctttcccttctaggtgtcatctccttccctccctttccccc

SEQ ID NO: 43206 - DNA, 201 bp, Homo sapiens
gcaccccaggaccccccaggaaggttttgcaggaataaagaatgaaggcagaagcaagatggaggatgaaggaggcgtggatggcttcagaaggcaagacrgaggcagcagtttggcgcctgtctcaaagcctcctccccgcgccaaggacaggtcggaggaggggggcgtggggacaggtagagcggaggctccagcgtt

SEQ ID NO: 43207 - DNA, 201 bp, Homo sapiens
catttgcctttgattaatggtcctgtgtcaccccctccccagcctgcatacctggggatcagatttcagtttcctagtgtgtcctggtctcaggccctcgrcaggaggagctgggtctcctggagcggttgggggagggtcccgtgccagccaggagggcaaatctggccagcttagccctaccccagtgtcctgatgccc

SEQ ID NO: 43208 - DNA, 201 bp, Homo sapiens
cggtttctctttagccaggacgagtccgggtgaccctggtgggccttcctttcccttctaggtgtcatctccttccctccctttcccccaagactccctcygggcccagccagcaggtgaagcctgacttagggaaggggggatttccaggggaggggccctggcccccactgacccagcattgctatccacaggaggagc

SEQ ID NO: 43209 - DNA, 201 bp, Homo sapiens
gccaccttgttttgcagagggggacctacctgccgcagacgtacatcatccaggaggagatggtggtcacggagcatgtcagtgacaaggaggccctgggktccttcatctaccacctgtgcaacgggaaagacacctaccggctccggcgccgggcaacgcggaggcgtgagtggctggcttcacccacagtagcccctg

SEQ ID NO: 43210 - DNA, 201 bp, Homo sapiens
acccaggctagagttccgtggcacgatcttggctcattgcaaccttcacttccaggttcaagtgattctcctgcctcagcctcccaagtagctgggaatamaggcacctgccaccatgcccggctaatttttgtatttttagtagagacagggtttcaccatgttggccagactggtctcaaattcctgacctcaggtgat

SEQ ID NO: 43211 - DNA, 201 bp, Homo sapiens
ccgcacatttcctccttacccagtttctggcaaggagccaggcctcgtctcctgcccccagcagtgagcaggcaggaggcccatttctcagctgtagctcwgtgagccgagggatggcagccaggaggctgctttctcagggcagggcgtgtagattttgtcccgtactgttgggaatgcccaggaaagcttattaaaacg

SEQ ID NO: 43212 - DNA, 201 bp, Homo sapiens
tttacccaggctagagttccgtggcacgatcttggctcattgcaaccttcacttccaggttcaagtgattctcctgcctcagcctcccaagtagctgggawtaaaggcacctgccaccatgcccggctaatttttgtatttttagtagagacagggtttcaccatgttggccagactggtctcaaattcctgacctcaggt

SEQ ID NO: 43213 - DNA, 201 bp, Homo sapiens
gaggcttggaaacagttcacttctgcgggcctcctgttgccccacttggccaacccgcacatttcctccttacccagtttctggcaaggagccaggcctcstctcctgcccccagcagtgagcaggcaggaggcccatttctcagctgtagctctgtgagccgagggatggcagccaggaggctgctttctcagggcaggg

SEQ ID NO: 43214 - DNA, 201 bp, Homo sapiens
gtggaggtggaggaatagaagccagattgaggtaggatgagtgtagggagtgataaggaaatggagactgaattttcaagaggtttggctaagaagaagawaagataaacagggtatcaagtggaggaggacgtggggtcaaagaaggggtttgtttttgttttaaggctaatacgagcatgtttcagagctgacaggaag

SEQ ID NO: 43215 - DNA, 201 bp, Homo sapiens
tgtgtctcaattcctacagagatttctaagtccctaaagtcaccgaggccaggtcggcacatcccctatcttctgtttgaaagaatataccacggtcacgrctggtataagcaagaggcctaagagctcagataactcaaaatgcacctgctgaacccactgcatctctttcggtggcttccaggtgtgtcttggtttctc

SEQ ID NO: 43216 - DNA, 201 bp, Homo sapiens
cctaaacaaaagctcttggggtcctgaaaccaaaaaatttaggaatcactgcactaggttgtacgcccagcacttggccggcattgagcccatggtcaagsgtaaggagaggcccgagggggatgtgcacagtgctgaaggtgcacaggaaagggacttatcccagccggtctgggaaggccttccaggggaagtggggtg

SEQ ID NO: 43217 - DNA, 201 bp, Homo sapiens
tctgggtgaatggtgtcacttcctggccctcctgtggctcaggctgaggctggtggtctttgtgactcagccaggatgcagggctcactggggtttttctktttcctcccagggatcaacaagcgtggggccaagaactgcaatgccatccgccacttcgagaacaccttcgtggtggagacgctcatctgcggggtggtg

SEQ ID NO: 43218 - DNA, 201 bp, Homo sapiens
agacataagccacctaaacaaaagctcttggggtcctgaaaccaaaaaatttaggaatcactgcactaggttgtacgcccagcacttggccggcattgagyccatggtcaagggtaaggagaggcccgagggggatgtgcacagtgctgaaggtgcacaggaaagggacttatcccagccggtctgggaaggccttccagg

SEQ ID NO: 43219 - DNA, 201 bp, Homo sapiens
tttagtagagacggggtttcaccatgttagtcaggatggtctcgatctcctgacctttgatccgcccgcctcagcctcccaaagtgctgggattacaggcrtgagccaccgcgcctggctggccaaagcttcttgcagccctgcctgggtcagctgtcacctcctgcagagactgacccaaccccttctcctgccagggtc

SEQ ID NO: 43220 - DNA, 201 bp, Homo sapiens
gggggtcctccagacattttctgtccttttcctaagcagggcgggtcagaccctcagctccccagggcccaggccccacactcccctgtgctctaaaaggrtgggaggtgaaacctgaggagcgaagcaggcgcccccagggcaggacccctgtgctgtgctgagagatagggcctgtcctgagtcacttaggcctgaacc

SEQ ID NO: 43221 - DNA, 201 bp, Homo sapiens
ctaagcagggcgggtcagaccctcagctccccagggcccaggccccacactcccctgtgctctaaaagggtgggaggtgaaacctgaggagcgaagcaggygcccccagggcaggacccctgtgctgtgctgagagatagggcctgtcctgagtcacttaggcctgaaccacccccctccagggggaagggagaaaggaaa

SEQ ID NO: 43222 - DNA, 201 bp, Homo sapiens
agggaaggggggatttccaggggaggggccctggcccccactgacccagcattgctatccacaggaggagcagcccccacaacatcgatccaagagggggrgctcagtgggcggcgtgtgctacctgtcgatgggcatggtcgtgctgctcatgggcctcgtgttcgcctctgtctacatctacagatacttcttccttgc

SEQ ID NO: 43223 - DNA, 201 bp, Homo sapiens
gggggggctcagtgggcggcgtgtgctacctgtcgatgggcatggtcgtgctgctcatgggcctcgtgttcgcctctgtctacatctacagatacttcttycttgcgcaggtgaggggccgggccaggtaggggcaaggcctcgagaaagggtcatgtctagagaggcatggagggaagtgtctgcaagggggcagcagga

SEQ ID NO: 43224 - DNA, 201 bp, Homo sapiens; identical to SEQ ID NO: 9778

SEQ ID NO: 43225 - DNA, 201 bp, Homo sapiens
tggtggatggaagcttccgggcttcatcctgtagctgttacaccacttgtaacagcctgcttgactgccggtcggtgcctgtggggggccagtgtggatcrcaggcctagagctccctggctggggacaagcacccatgcccagaccccatggggctcctggagcccctgcccccatcagtcacagcctccttggtggagt

SEQ ID NO: 43226 - DNA, 201 bp, Homo sapiens
gctcagtgggcggcgtgtgctacctgtcgatgggcatggtcgtgctgctcatgggcctcgtgttcgcctctgtctacatctacagatacttcttccttgcrcaggtgaggggccgggccaggtaggggcaaggcctcgagaaagggtcatgtctagagaggcatggagggaagtgtctgcaagggggcagcaggaagcccc

SEQ ID NO: 43227 - DNA, 201 bp, Homo sapiens
catgggcctcgtgttcgcctctgtctacatctacagatacttcttccttgcgcaggtgaggggccgggccaggtaggggcaaggcctcgagaaagggtcaygtctagagaggcatggagggaagtgtctgcaagggggcagcaggaagccccagacatgccctcaggtgggagcgagtgcccggccagcccacaagactgg

SEQ ID NO: 43228 - DNA, 201 bp, Homo sapiens
ctgccagcttgggaagtgggctggaccggaagcaccccctgggacagcaaagcactccctcccagcgccaactggatccctcctcccctttgggggcccaytggctggccatgcccctcttagcctgccccttctccccacaccctgcctgtgcctgcattcacacacacacacacacacacacacacacttatgcacaca

SEQ ID NO: 43229 - DNA, 201 bp, Homo sapiens; identical to SEQ ID NO: 9781

SEQ ID NO: 43230 - DNA, 201 bp, Homo sapiens
acaagactggggtgccccctcctccttggggcctccttggatgcaggccagtcccacatttagccccttgtcctggggagccaagcatgaatccgggtgasagcactgggcccgccccacagggtcaccctggggaattctcaccagaaactcagatctggcagaaactggaactgtgatccccctccacagctcagaccc

SEQ ID NO: 43231 - DNA, 201 bp, Homo sapiens
ccccagacatgccctcaggtgggagcgagtgcccggccagcccacaagactggggtgccccctcctccttggggcctccttggatgcaggccagtcccacvtttagccccttgtcctggggagccaagcatgaatccgggtgacagcactgggcccgccccacagggtcaccctggggaattctcaccagaaactcagatc

SEQ ID NO: 43232 - DNA, 201 bp, Homo sapiens
gccccagaccctgacctgatgccccaccgtctcagtttctccatctgcgaaatgggtctcacagtccctgctcttcttgcttccgcaggcttttggggcaygtagcggacgggtaggcaagagggggccttgcggagtgcgtgtatgaccagcctctctgactgtctgtctgtctctccgccttgctcagctggcccgaga

SEQ ID NO: 43233 - DNA, 201 bp, Homo sapiens
tccccacaccccaattcgttgtgtggacacctcccagcagcccctgggtctgtgccctgggacagtattcggggtgtccagccactgtgggatgcagcccyggagcctcaccttccctgggctctcatccccgcacagcccacaggagccccccatgctgcgatgacgcatcctccctggagaacttgcactgaatcaaac

SEQ ID NO: 43234 - DNA, 201 bp, Homo sapiens
ccaggcagtcccaagcatgtatctacaggcccctccaggagccccctccagaagtaagagtgggcagactggcccgcccggccattcagttgatgggatcrcaccaggctgcctggcctcccttactgatggagtgactggactggcccaccagacacagtgtctgtcaaggtttctccaagacaggggtcagggatatcc

SEQ ID NO: 43235 - DNA, 201 bp, Homo sapiens
tttctcctgttagcaacaatggttcttgctgagtatgaagcagccgaggctgattttctcctcagcctcctgccagctgcacgctggctgtcatggcaggrccagtgcgttgtatcgaggggtagtacattcaccatcgagtgcattgcgtgtacagctcagcgggtctctgcagagtgggtctcatgcgtattcatgtaa

SEQ ID NO: 43236 - DNA, 201 bp, Homo sapiens
ccatttagtcccaaccccctgtggccagcagctgttcctgagggccctgtgcactgtggccatgcccgtcacttgctggtgaccttggttagtgcccctgsctgctgaggagatgacagtgggcaggtggtccatatgatcacgggacccctaaagcagggcaaggtggggagaggccccggcctcctcatgggccaggca

SEQ ID NO: 43237 - DNA, 201 bp, Homo sapiens
gcctctggacgtcgggggtccgaggccgggtgcccccttcccaccccacgccctgccgtctgggcctccctgctcccctctcttttctccattcccagccyctcgctgggctgtcccccgaccccacggggagggctcccaactgccccagtgcccttgcatcctgggtccccgggctctgtgcgcgttcccccacccctg

SEQ ID NO: 43238 - DNA, 201 bp, Homo sapiens
ccccccgagtagctgggactacaggtgcccaccaccacgcctggcaaattttttgtatttttagtagagacggggtttcaccatgttagtcaggatggtckcgatctcctgacctttgatccgcccgcctcagcctcccaaagtgctgggattacaggcatgagccaccgcgcctggctggccaaagcttcttgcagccct

SEQ ID NO: 43239 - DNA, 201 bp, Homo sapiens
cgtgtgctacctgtcgatgggcatggtcgtgctgctcatgggcctcgtgttcgcctctgtctacatctacagatacttcttccttgcgcaggtgaggggcygggccaggtaggggcaaggcctcgagaaagggtcatgtctagagaggcatggagggaagtgtctgcaagggggcagcaggaagccccagacatgccctca

SEQ ID NO: 43240 - DNA, 201 bp, Homo sapiens
tccttaagacctgctcaggagcgccagaggggcaggagggcatccctggtgcctggtttgcaagagctcctgggtggttcgatccctgggagatgccaacrgaaggtgtcacccccgtctcttgctgctcccgggagtccattggaaaaccaaagccatttagtcccaaccccctgtggccagcagctgttcctgagggcc

SEQ ID NO: 43241 - DNA, 201 bp, Homo sapiens; identical to SEQ ID NO: 9809

SEQ ID NO: 43242 - DNA, 201 bp, Homo sapiens
ggccttccccaagcagtaccccctgttccgcccccctgcgcagtggtcttcgctgctgggtaagtacagccccctcctcgcctcctgctccaccaggaggrctgcggcgccggagccccccgcacagctgcacggcggcgcttcccagtctggggcgtgctgacgtcgggagactctaacaccagaatgtttgccgagcgc

SEQ ID NO: 43243 - DNA, 201 bp, Homo sapiens
tcttcctccccagataacgtcctcctctcccagccacccggccaactccttctactacccgcggctgaaggccctgcctcccatcgccagggtgacactgstgcggctgcgacagagccccagggccttcatccctcccgccccagtcctgcccagcagggacaatgagattgtagacagcgcctcaggtaacggacatac

SEQ ID NO: 43244 - DNA, 201 bp, Homo sapiens
ggctccagacagtacctgagagactctgtcctgtcagacacgcacccacaggtgacctgtgtgtcacagctgacaaggaagcttgctaggatggccctgtrtggccaccgggtgacagctatgctgcagggcacctgtgggggtctcgggacccagccaccacacagctcggggctctgctcacaggcgccttggcctggg

SEQ ID NO: 43245 - DNA, 201 bp, Homo sapiens
tgacgtgggtgccatcacagaagtctctggggcccccacgccactaggacggccactgttgtgctgaggcattgagatttgaaggagaccaatggggaackccatccggtaatggaatgctgtgtgaggaatcccacaggggccgcctggccggagggtggatcagacaggacctatgtggctgccctctcctgaatgagg

SEQ ID NO: 43246 - DNA, 201 bp, Homo sapiens
gccagccgagggaccagagtgggcagtggggacggagcacagaccaccgcccacaagggtctctcctgtgacttctggcttcccgagggcagaggctgggmtgggcatgtggcggctggcacccaggaggctccgccaggtccacgccaagccagcctggctcagctctggcttcctgctcacacgctggatgcctgtccc

SEQ ID NO: 43247 - DNA, 201 bp, Homo sapiens
gtgcaggcttgggctcctcactcatttgtccacgcggatgccccattccaagcagatgtccccgagccacttacccaacaggcagacgtgccagcactgtycgtggtgtgcaactggtctggcgggaagagcccctcgtgggcagagggtccagagaggtgcggtttgccccacatttgggggcactgggccacagtgggc

SEQ ID NO: 43248 - DNA, 201 bp, Homo sapiens; identical to SEQ ID NO: 9814

SEQ ID NO: 43249 - DNA, 201 bp, Homo sapiens
tcgggtaaatgtagcagctgggtccaggctcgggcagagcagctttctacagcaggggtgtccgccctctcccggggttcccacggggttcccaggggccycttactctgccacgatgtgggagttccaccaccacagggacttgagcggcagctccggctcttacgtagaaacgcgcaactccagtccctaggttgtgtc

SEQ ID NO: 43250 - DNA, 201 bp, Homo sapiens
gcggagaaacgcaagtgcccccgaagggtgggcgtggcctctgatgaatgcacacgttggtgggaggtggcttccgtttgtacgaagcgcctcttcacgcragcgttcacctcggtctcccctttgcttggtccagttccagaaacgccgctggactgcgaggtctccctgtggtcgtcctggggactgtgcggaggccac

SEQ ID NO: 43251 - DNA, 201 bp, Homo sapiens
cgtggcctctgatgaatgcacacgttggtgggaggtggcttccgtttgtacgaagcgcctcttcacgcgagcgttcacctcggtctcccctttgcttggtycagttccagaaacgccgctggactgcgaggtctccctgtggtcgtcctggggactgtgcggaggccactgtgggaggctcgggaccaagagcaggactcg

SEQ ID NO: 43252 - DNA, 201 bp, Homo sapiens; identical to SEQ ID NO: 9815

SEQ ID NO: 43253 - DNA, 201 bp, Homo sapiens; identical to SEQ ID NO: 9816

SEQ ID NO: 43254 - DNA, 201 bp, Homo sapiens
ctcacaggcgccttggcctggggcggggcaggtgctgatgagcattctcctagctcttccaggcacctgctggacagggcaggctgggaacgctggggccragtggcagttccctccctactcagctgggtggcagccactggcctcacggagcgcctgtggtctggagcgcattgctgggtcgtgggtcagggcctgttg

SEQ ID NO: 43255 - DNA, 201 bp, Homo sapiens
ggggcggggcaggtgctgatgagcattctcctagctcttccaggcacctgctggacagggcaggctgggaacgctggggccgagtggcagttccctccctrctcagctgggtggcagccactggcctcacggagcgcctgtggtctggagcgcattgctgggtcgtgggtcagggcctgttggctctgggtctctgggtct

SEQ ID NO: 43256 - DNA, 201 bp, Homo sapiens; identical to SEQ ID NO: 9808

SEQ ID NO: 43257 - DNA, 201 bp, Homo sapiens
tcctgctccaccaggagggctgcggcgccggagccccccgcacagctgcacggcggcgcttcccagtctggggcgtgctgacgtcgggagactctaacacyagaatgtttgccgagcgcctgcggtgtgcggttccggggatgcggtgggggcagggggcgctcacggggagggcgcaggtgggtcgcggcaggggcagcc

SEQ ID NO: 43258 - DNA, 201 bp, Homo sapiens
cggcccagaaccttgtggcacctccagagggacccccaggactggctgcgaccgagctttaagggtctagtcccgggggcagccagtcggccaaggccccrggtccctgcgacggcgaaggcatcccggaggccgcacccagaccggcccggcaagctgcagggactcggactgaaaacctgcccgttacccctggtcgct

SEQ ID NO: 43259 - DNA, 201 bp, Homo sapiens
agcagtaccccctgttccgcccccctgcgcagtggtcttcgctgctgggtaagtacagccccctcctcgcctcctgctccaccaggagggctgcggcgccsgagccccccgcacagctgcacggcggcgcttcccagtctggggcgtgctgacgtcgggagactctaacaccagaatgtttgccgagcgcctgcggtgtgc

SEQ ID NO: 43260 - DNA, 201 bp, Homo sapiens
gccgggtgagtactgcgtgcccccgggacacccagagagggcccgggcctcctgcactttccccgcggcccagaaccttgtggcacctccagagggacccycaggactggctgcgaccgagctttaagggtctagtcccgggggcagccagtcggccaaggccccgggtccctgcgacggcgaaggcatcccggaggccgc

SEQ ID NO: 43261 - DNA, 201 bp, Homo sapiens; identical to SEQ ID NO: 9811

SEQ ID NO: 43262 - DNA, 201 bp, Homo sapiens
tacgtcagtaacgggctgcgcgactttgcggagcgcggcgaggcctgggcgctgatgaaggagatcgaggcggcgggggaggcgctgcagagcgtgcacgmggtgttttcggcgcccgccgtccccagcggcaccgggcagacgtcggcggagctggaggtgcagcgcaggcactcgctggtgagcgcggggccggccggg

SEQ ID NO: 43263 - DNA, 201 bp, Homo sapiens
tagtgcaaatttacagcactggttaaaattagaagctgtctccagaaacagaaagcataatgtattccaaagaggagaagtgaaagcagtccacgcccacrcacagtatattgaaactggtgaacactaaacacaaagaacgaaccttcaggctgggcgcggtggctcacgcctgtaatcccagcactttgggaggccgag

SEQ ID NO: 43264 - DNA, 201 bp, Homo sapiens; identical to SEQ ID NO: 9812

SEQ ID NO: 43265 - DNA, 201 bp, Homo sapiens
agctatgctgcagggcacctgtgggggtctcgggacccagccaccacacagctcggggctctgctcacaggcgccttggcctggggcggggcaggtgctgrtgagcattctcctagctcttccaggcacctgctggacagggcaggctgggaacgctggggccgagtggcagttccctccctactcagctgggtggcagcc

SEQ ID NO: 43266 - DNA, 201 bp, Homo sapiens
ggcggggctcctggcctccttaggggctgcccgctctgggccacacagccagagaaacactgtccatctggctggcttggcctgtggggtgcaaaagaggygttttcactttgctttggaaacatggaaattaccaagtgacttaaccataacaccaaatgatgatttttaaatttatgaaaattatggaaccagatggga

SEQ ID NO: 43267 - DNA, 201 bp, Homo sapiens
ggactcggactgaaaacctgcccgttacccctggtcgctcgcaggcgcacgggcgatctaaccccgcgccgtccattccgctgatgggggtctcggaagcrccgcaggagagctttgcggagcagggagggggtcgcgggtgctcggggccgtcctcagagcccaaagtgccgcagccctctcggctttccaccccgaggc

SEQ ID NO: 43268 - DNA, 201 bp, Homo sapiens
aggtgatggaaaaccccagcccggccgccgccctgggcaaggccctctgcgctctcctcctggccactctcggcgccgccggccagcctcttgggggagartccatctgttccgccagagccccggccaaatacagcatcaccttcacgggcaagtggagccagacggccttccccaagcagtaccccctgttccgccccc

SEQ ID NO: 43269 - DNA, 201 bp, Homo sapiens
cggaggccgcacccagaccggcccggcaagctgcagggactcggactgaaaacctgcccgttacccctggtcgctcgcaggcgcacgggcgatctaacccygcgccgtccattccgctgatgggggtctcggaagcgccgcaggagagctttgcggagcagggagggggtcgcgggtgctcggggccgtcctcagagccca

SEQ ID NO: 43270 - DNA, 201 bp, Homo sapiens
aactggtctggcgggaagagcccctcgtgggcagagggtccagagaggtgcggtttgccccacatttgggggcactgggccacagtgggcaggggagcacrtggccagtgccctgggctaggagagggataaagtcagctgtggccaagcagaagcagtattgcaggggaagggtggggagagactgtgctatgagctctg

SEQ ID NO: 43271 - DNA, 201 bp, Homo sapiens
tggccccctcctgtcctcctgggcagaggcagaggtggcaactttgtgaaccagacttctcccccgctgtccctgcaggtggagattctgcctcagggccrtgagagtcccatcttcaagcaatttttcaaggactggaaatgagggtgggcgtcttcctgccccatgctcccctgccccccaccacctgcctgcttgctt

SEQ ID NO: 43272 - DNA, 201 bp, Homo sapiens
aactttgtgaaccagacttctcccccgctgtccctgcaggtggagattctgcctcagggccgtgagagtcccatcttcaagcaatttttcaaggactggawatgagggtgggcgtcttcctgccccatgctcccctgccccccaccacctgcctgcttgcttctctggctgcctggtcagtgcagaggtgccccctgcaga

SEQ ID NO: 43273 - DNA, 201 bp, Homo sapiens
gatggacatcctatgaattcagcaaggtttggctgcagcacaggcaaccttctgtctcctggagcccatgaccaggctggaacccacctatgccttcaccyttaggtgtgcctggctctaaccaggttccggaatgacaggaccacaggatggtgcaagacttgtcttggaaaaaaacacctgagacgcttaattagaaca

SEQ ID NO: 43274 - DNA, 201 bp, Homo sapiens
accaggtcagagcccacctctaggcacccccaccctgcagcttccctcagagccagccctgcttctggctggttctcaccctgcagaagacccgggtgccyttggagccgggtccccacctttctgcccgtcttccagtgggatggggtgcagagggctctgggtctcctgtcagtccactcagatgggccgtctgggctg

SEQ ID NO: 43275 - DNA, 201 bp, Homo sapiens
taaatgctgtttctgcatctattgaggtgattacacatacatgtttgttaatagggtgtatagcattgattttcaaattttggcctgtttttttttttttkgcgttgtgagcggctttatttatttattttaaatttataattgacagataataattgcacatacttagcaggagcagtgtgatgtttcattgtacatatg

SEQ ID NO: 43276 - DNA, 201 bp, Homo sapiens
agtcatctggagcttctcaaacactgacatccaggctccacctagagagtctggttttaatgagtccaatatggaagctagtcactggggtttttctttcttatttttctgtaaattactttttttttttttttttttgagacagagtctcactctgtcacccaggctggagtgcagtggtgtgatctcggcttactgcaa

SEQ ID NO: 43277 - DNA, 201 bp, Homo sapiens
agatattaaaccaaccttgcattcctgggataaacctcatttggtcatcatggtttattttttatatattatttgatttcatttgctaaaattttgttaattttttttttttttttttttttttgagatggagtctcactctgtcacccaggctggagtacaatggcatgggcttagctcactgcagcctctgcctcttgg

SEQ ID NO: 43278 - DNA, 201 bp, Homo sapiens
ggcgcactccgtgtctcattcttgagcgctccctgatggcttgagcttggggcagccacttcaccagctcaggcctgagtcacaggctgggctgcctgttscaggggatgtgggcacagcatgtgatcctctgtgggatggagaaacgttaaagtttccctccgcaaacctctgctctctgcatgtcctcttccggaatcg

SEQ ID NO: 43279 - DNA, 201 bp, Homo sapiens
gatattaaaccaaccttgcattcctgggataaacctcatttggtcatcatggtttattttttatatattatttgatttcatttgctaaaattttgttaattttttttttttttttttttttttgagatggagtctcactctgtcacccaggctggagtacaatggcatgggcttagctcactgcagcctctgcctcttggg

SEQ ID NO: 43280 - DNA, 201 bp, Homo sapiens
ctgggagaactcccagagaaggcggaggccacttaatgtcctggaagtttccttggacagctggggcttgatacgggcctggaaggataagggggcttgtgtgtgtgtgtgtgtgtgtgtgtgtgtgtgtgtgtgtgtgacagattcttcctctgttgcccaggctagagtgcagtagtgccatctcggctcactgcaacc

SEQ ID NO: 43281 - DNA, 201 bp, Homo sapiens
atattaaaccaaccttgcattcctgggataaacctcatttggtcatcatggtttattttttatatattatttgatttcatttgctaaaattttgttaattttttttttttttttttttttttgagatggagtctcactctgtcacccaggctggagtacaatggcatgggcttagctcactgcagcctctgcctcttgggt

SEQ ID NO: 43282 - DNA, 201 bp, Homo sapiens
tgccgattacactctctgcaggaaaaaggcaaggtgacctgctcagcggtggatgaaggctgagacctaggttccctcccgccttccttccccatttcccsaggggagccagcccaaacccaggatgcccccaccattccccaggagcctgacatctaaggccaggggtgggagaagggatgtcctggggagaccggtgca

SEQ ID NO: 43283 - DNA, 201 bp, Homo sapiens
atagggtttcaccatgttggccaggctggtctcgaactcctgacctcatgatccacccaccttggcctcccaaagtgctgggattacaggcgtgagccacygtgtccagccaaattgtgttaatttttgtatgtgtatgttcatgagagatactgatctgtaattttctttttgcataatatatttatctggttttgttat

SEQ ID NO: 43284 - DNA, 201 bp, Homo sapiens
aacactgacatccaggctccacctagagagtctggttttaatgagtccaatatggaagctagtcactggggtttttctttcttatttttctgtaaattactttttttttttttttttttgagacagagtctcactctgtcacccaggctggagtgcagtggtgtgatctcggcttactgcaacctccacctcccaggttca

SEQ ID NO: 43285 - DNA, 201 bp, Homo sapiens
tgagtgcacctcacttccagcctatgcttggtgaaggcttgaagccaatgctgagcttttctttcttgaattctgtgcatttctttgtaatttggaatccwcctaatttccaaatgggttcggggcccctgtgctgcagggattggggtgatgagagggagtggggctgcctggaatttgcttttcaggtcttcactctct

SEQ ID NO: 43286 - DNA, 201 bp, Homo sapiens
gtgcatttctttgtaatttggaatcctcctaatttccaaatgggttcggggcccctgtgctgcagggattggggtgatgagagggagtggggctgcctggmatttgcttttcaggtcttcactctcttgtctgctcctgggacctgggcagtgggcagcgaggcacagtgggagggacctagggaggaccagcctccccct

SEQ ID NO: 43287 - DNA, 201 bp, Homo sapiens
ctgggccgttgtccctggctggtgccacccctcctgccgcagcacagtgtccacaagtcatcccgtggggagctgacagggctcagctaccgttggtggcrtttattaaactgtgcacccacgcccttgaagcagtctgttgcctctgtctgtgtccctgaaatcttggttctcatctcatggctcatccaggggagcttt

SEQ ID NO: 43288 - DNA, 201 bp, Homo sapiens; identical to SEQ ID NO: 9840

SEQ ID NO: 43289 - DNA, 201 bp, Homo sapiens
cagcagtcatcccgggatgagcagggggcctgtgccgtgctggctgtgcacctcaacacgctgctgggagagcggcctgtgcagcaccgcgaggtgcaggrcaatgagtctgacctcttcatgagctacttcccacggggcctcaagtaccaggtcagagcccacctctaggcacccccaccctgcagcttccctcagagc

SEQ ID NO: 43290 - DNA, 201 bp, Homo sapiens
tcacaagggccttgccctgccctctcccacttgtcccaggccagcagtcatcccgggatgagcagggggcctgtgccgtgctggctgtgcacctcaacacrctgctgggagagcggcctgtgcagcaccgcgaggtgcagggcaatgagtctgacctcttcatgagctacttcccacggggcctcaagtaccaggtcagag

SEQ ID NO: 43291 - DNA, 201 bp, Homo sapiens
ctatgcttggtgaaggcttgaagccaatgctgagcttttctttcttgaattctgtgcatttctttgtaatttggaatcctcctaatttccaaatgggttcrgggcccctgtgctgcagggattggggtgatgagagggagtggggctgcctggaatttgcttttcaggtcttcactctcttgtctgctcctgggacctggg

SEQ ID NO: 43292 - DNA, 201 bp, Homo sapiens
gccactggaaagggcctctccagccccacgtgagaggtcctttttgtggcatttgtaataataatggcttcttctttctttccagatctgaagacagcatrtacacagccattccccagaggtaagctgcatgccccatctcctttcacaacttccccttctttacctccaagggctgcccctccccactgctctcctcat

SEQ ID NO: 43293 - DNA, 201 bp, Homo sapiens
cagtggctctccattcccaggctcagtgcaggatccaggcctgcatgtgtggcgggtggagaagctgaagccggtgcctgtggcgcaagagaaccagggcrtcttcttctcgggggactcctacctagtgctgcacaatggcccagaagaggtttcccatctgcacctgtggataggtaaggggatctggatgggggaagg

SEQ ID NO: 43294 - DNA, 201 bp, Homo sapiens
tgagactcagtctcaaaaaaaaaattcattgctcttctctcttgtttctgttttctgttaatttctgcttttattttaatttctgtgagatctcagcagayggaagaccctggcccaggggtcagagaccttatttccatgaaccactcactagctgtgtggccttggactcatttctgagactcattttctttgtctgca

SEQ ID NO: 43295 - DNA, 201 bp, Homo sapiens
gggctggtgtgtggggggtgagatcaggcactgtccctcctccccaggtctctgatgccactggacagatgaacctgaccaaggtggctgactccagcccmtttgcccttgaactgctgatatctgatgactgctttgtgctggacaacgggctctgtggcaagatctatatctggaagggtacgtggctcctctgtaaca

SEQ ID NO: 43296 - DNA, 201 bp, Homo sapiens
ggcaaggagaaagacaaactgagggaggaggaaaaagtaatgtgaagccagtgaccctgcccagaaaatgtgactaacccagcagcggtgggggctgtgcmgcgcctgccccaggccctgaatggagaacatggctttccttgctggtctcagactcagagatgccctccctgatttgccttggctgtgacctgcagcggg

SEQ ID NO: 43297 - DNA, 201 bp, Homo sapiens
cagactgagcactccgtattggcaccatcctttataaggacggaggggcaggaggccaggaaagagggagagaagctgagaagccgtaaacccattccaartgagatcactctgaccattggagaatgtccctatatttgtaaggactgatgccagcctccttctgccatctagacattgcctctgatgctctggagcttt

SEQ ID NO: 43298 - DNA, 201 bp, Homo sapiens; identical to SEQ ID NO: 9841

SEQ ID NO: 43299 - DNA, 201 bp, Homo sapiens
tgcctataatgccagcactttgggaggccaaagcaggaggatcacttgagcccaggagtttgagaccaacctgggcaatagagtgagacacagtctctccaaaaaaaaaaaaaagtttagctgggcgtggtggcatatgcctgcagtcccagctactcaggaggctgaggctggaggattgcttgagcctgggaggttgag

SEQ ID NO: 43300 - DNA, 201 bp, Homo sapiens
tctcgcaaagtttacagcacagtaagcttgtccttagcttcccctataccctccttcccacgcccaattctaggaccctttcgggcgccccagcctcccayaggggctccccgccagctcagaccggccgggcccctccctctgactcaccgggggcggctcctggccgcgcacctccagggggcggggggcggctgagac

SEQ ID NO: 43301 - DNA, 201 bp, Homo sapiens
cttcccacgcccaattctaggaccctttcgggcgccccagcctcccataggggctccccgccagctcagaccggccgggcccctccctctgactcaccggrggcggctcctggccgcgcacctccagggggcggggggcggctgagacagcgcccagggcctcggagcaaggcgttggcaggcaagtagtgcgcttcgggg

SEQ ID NO: 43302 - DNA, 201 bp, Homo sapiens
cgaggggttttcatctaccttggtgctgccggtttgggaaaattcttaagggactgactccacatctccaaagagcccctcggcattcttgggacccctgstccatttattgtaaaaattgctggctcttctgtggactcccttaaatttcctcaagaaaaatgggatggcagctaaagagggtccctgctctttttaaaa

SEQ ID NO: 43303 - DNA, 201 bp, Homo sapiens
ggcccagggcccagaagtcatgatgataaacatctggtgaatgagaagcagaccaaagggtagagacctgagaggcatcagcatggcatgcggaagatggygaagaatgttttatggcctcagccattccctgagaactgagcttagccaggtgcagtagcccacgcctgtaatcccagcactttgggaggccaaagtggg

SEQ ID NO: 43304 - DNA, 201 bp, Homo sapiens
catgatcagacccgggcagacgaggggttttcatctaccttggtgctgccggtttgggaaaattcttaagggactgactccacatctccaaagagcccctsggcattcttgggacccctggtccatttattgtaaaaattgctggctcttctgtggactcccttaaatttcctcaagaaaaatgggatggcagctaaagag

SEQ ID NO: 43305 - DNA, 201 bp, Homo sapiens
atcaaatgcattctttgagcacctgcatgaggttccagctagatccagaggcaaaatacacttcctgccctaaaggaccctacagtgtagtagtggaggtrggtgggtccataactcaccacactatggcagagtggggaaaagtaaaggctttaagaggtgtagaagaggctgtttggtaaggtggtgagtttcccatca

SEQ ID NO: 43306 - DNA, 201 bp, Homo sapiens
tttgtctgcataatggaactagggctcctagaggtggagtagttgatgaatatgaaagtacttggccactggaaagggcctctccagccccacgtgagagktcctttttgtggcatttgtaataataatggcttcttctttctttccagatctgaagacagcatgtacacagccattccccagaggtaagctgcatgcccc

SEQ ID NO: 43307 - DNA, 201 bp, Homo sapiens
aggggcccaggtcagagcagagttttgcatgatcagacccgggcagacgaggggttttcatctaccttggtgctgccggtttgggaaaattcttaagggaytgactccacatctccaaagagcccctcggcattcttgggacccctggtccatttattgtaaaaattgctggctcttctgtggactcccttaaatttcctc

SEQ ID NO: 43308 - DNA, 201 bp, Homo sapiens
aaatgcattctttgagcacctgcatgaggttccagctagatccagaggcaaaatacacttcctgccctaaaggaccctacagtgtagtagtggaggtaggygggtccataactcaccacactatggcagagtggggaaaagtaaaggctttaagaggtgtagaagaggctgtttggtaaggtggtgagtttcccatcactg

SEQ ID NO: 43309 - DNA, 201 bp, Homo sapiens
gaagccagttgtcccaggaaggtgacattggactagacctataggaggggagatgccactccaggcaaagggagaaggtgagctgagccaccaaggtgggkaagggtgcagacatgcacacaccaggggtctagtgagactgggacccgggctgggggacaggagcagggggagggaaattcctaagcaaggtggaaggtg

SEQ ID NO: 43310 - DNA, 201 bp, Homo sapiens
tgttcccctccctgaaatattccaggggcccaggtcagagcagagttttgcatgatcagacccgggcagacgaggggttttcatctaccttggtgctgccrgtttgggaaaattcttaagggactgactccacatctccaaagagcccctcggcattcttgggacccctggtccatttattgtaaaaattgctggctcttc

SEQ ID NO: 43311 - DNA, 201 bp, Homo sapiens
cagcctggctggtggggtgggctggactcagccctcactcacctcacctctgctgggtgccctagtgcagggcgcagtttgccccaccagaagcagtggcyctgggcatgatgggctgggaagttccagggcaggggtccctataaacctggcctgccctggcccctgcaggtcctgggccccaagcctgctctgaaggag

SEQ ID NO: 43312 - DNA, 201 bp, Homo sapiens
ggtggtcgtgggcattttcagagagccctctgtgctgtgctctgccttcctggttgtcctgcctcagggacagttcagagaggagagagggagagctgtgsgcccttctctgagctggggagcaggacacaggcatctggctctgacccggactttcctgcttccttgcagaacatcttcgcctggtgtggtggaaagtcc

SEQ ID NO: 43313 - DNA, 201 bp, Homo sapiens
agatcttcctgtttttcaagagtatccagaaatctcaaattttttaagaacctgcagattctttgatacaattcacgaaacaaaccagtgcaaagcaaacrcagtacacccattccaatgtaattccaatggcaggcccattccaaccctcagactaccaatatttgaactcaggtttgaatgtcagaatccaatcattgg

SEQ ID NO: 43314 - DNA, 201 bp, Homo sapiens
agtaccaaaataagactttgcctttcctgtaatccaaagaatcaaaagagaattgaaaagaatgactttctcactgtgatttaatattaattaaggtaggrtttccacaccaccagaacacctatcccactttggaaagcactgatctggtggtccagacattcctgcagtgtcccttccaaatgactgtccagcttcttc

SEQ ID NO: 43315 - DNA, 201 bp, Homo sapiens
ccaccagaacacctatcccactttggaaagcactgatctggtggtccagacattcctgcagtgtcccttccaaatgactgtccagcttcttcctgaacatwtctaaagacaagagctctttggaacccatttgtccttagaaaactctaacaatacttttttttttatccaaaataaaacaaataaatttaaaaaccagaa

SEQ ID NO: 43316 - DNA, 201 bp, Homo sapiens
gtgacataatcattctttaccaacaatttggaatctaacttttaatgatttgtcttcggttccagaacccttagaatcatagcactttgcagtgtttttayaagctagtctataaaggggccagaagaaaatatttttgcacagaaaaacaatatagttctagagagagatttgaagtgactttctttgtgctccctcccc

SEQ ID NO: 43317 - DNA, 201 bp, Homo sapiens
gattctgaaggcaggttgttttcataataaagatgtcatgatgtcttgaattgggctagtttagctaagcccagatcaaatgaagaaaaagaaactagtcragatcattatctttaccacttgctctggaatgtgtttctcaaatatgtatttagatgaatgcatggctgtcgtaacacactcccacaattacctacatac

SEQ ID NO: 43318 - DNA, 201 bp, Homo sapiens
gatcaaatgaagaaaaagaaactagtcaagatcattatctttaccacttgctctggaatgtgtttctcaaatatgtatttagatgaatgcatggctgtcgyaacacactcccacaattacctacataccaaagtaacttcccgtctccccatcaccccagtgcccttttctcccatatattttaaagtgataaggctcaat

SEQ ID NO: 43319 - DNA, 201 bp, Homo sapiens
cagacactctgacatctctgtttagtctctggtgtaaaaaggttcgtctctcatatttcttgaggttggggaaaggaaatggtcacagagtttaggtgagsgtgggaaagtgatgccctgctcatttggggttttgtcttccagagttcttcctccattttcctgatgccaccagtattaaggccattgtgtgtgaacaga

SEQ ID NO: 43320 - DNA, 201 bp, Homo sapiens
aacaacacctctcttcaaaacttttgacctaaaactatcccttataaataaatgatgtctcctctctatagagaagagatgtcctactttagagaaatgaygtcctcctactatagagaagaacttttagacaatgtaggtgttgtcttaaggaatgtaaagaaatagagacacatcctagagtaggactgcacttcccag

SEQ ID NO: 43321 - DNA, 201 bp, Homo sapiens
caaacgatggtaaggcctcaaagccctaacagtaagaaactattttgttaacacccttagctatgaaggagcaaagggaacccagaaagagctatagcctygggagggaagggcctcaggagccctaaatggaggaagggagctgccacaaaatctgtcaaagagagctctgggagaatatagactccctctgccctgtga

SEQ ID NO: 43322 - DNA, 201 bp, Homo sapiens
tagttagccagaaagctaatgataaaagtcatttccagtcttactttgattattcctagtagcagggtttttaataatataatggctgagtgaagaacccyattggctgacaagaggataaatgagtcaagtttggactcccctgaaaatatgaactacatgggccacacttagggaggaccatatattcttttcaagctg

SEQ ID NO: 43323 - DNA, 201 bp, Homo sapiens
aatcccaaaactttgggaggctgaggtgggtggatcacgaggtcagaagattgagactaccgtgaccaacaatgtgaaataccgtctctactaaaaatacaaaaaaaaaaaaaaattagccatgcatggtggcgcatgcctgtaatcccagctacttgtgaggctgaggcaggagaatcgcttgaacccagaggcagaggt

SEQ ID NO: 43324 - DNA, 201 bp, Homo sapiens
attcccgcttctccccaccaacccaccacccccagcctttagctcctagttaactcagtgctgggcatgctgctttctctataacttacatggactttttwaaaaaatggaatcacatgtttcagtaataatagcaaggcaaaaactttaaaaacatttacaacactggcataagtaaattttctttggcaaggaaagtaa

SEQ ID NO: 43325 - DNA, 201 bp, Homo sapiens
caatcaccatcaagatcaggaattctattctcattaaaatcacagagggatgagtttacttgtttcatgtggccagcatctcctgactggggcatctatgyagaaactgaatagatgatgggaaaaagaccatctcttgagttagaagagaaaccccactatagacttggagaagatgagctgtcatcaccaactattaat

SEQ ID NO: 43326 - DNA, 201 bp, Homo sapiens
aatttgcaagatgttctcctatattctgtttaatttgattatcacaacaacactgtgaggtagaaccagcacaactgttcttgtttcacagctgtagaatrtgagagaaaggataccaggtgatttatctattataccatagcacgatccccacagaaaagaaaaggactattgtgaatatttgggtttatggttttaaaa

SEQ ID NO: 43327 - DNA, 201 bp, Homo sapiens
ctgagaagtgaatttcggagctgccccttctgagagtttccggcgacctcgctgagagtgagaggaagtccctgcggtgggccctctggcaaaccacataytgggaagatcgcgggactgtgttaagctgtcatgagagtcaattgaatggtcaagaccagcgtagacagaaataaagcttgaccactcagaggccgccat

SEQ ID NO: 43328 - DNA, 201 bp, Homo sapiens; identical to SEQ ID NO: 9870

SEQ ID NO: 43329 - DNA, 201 bp, Homo sapiens
cggttcccattgtataaatgaaaattctagagcaagaagacagagcttcaagtcagggacacggaactaaggctccagatttcacaagtctcatttgtctktgatccctgaagcaaccactttcctattaaggtaaattgaagaaaccataaaattaatccggtaacaacatgggagccagcgagaattcctacctcatta

SEQ ID NO: 43330 - DNA, 201 bp, Homo sapiens
cacctgagtctttcaccattaaatgcagaaagaaccagaggtggggccctgtgaaattcccaagaaaagtcaacctgaggaacatggcctcacaaatgggwagtaaaggagaaaaggtgcttgacaggctttcaacgacagaaaccttccctttcgaagggagcttgcaggaagggagccaggagacctgaggatctctgg

SEQ ID NO: 43331 - DNA, 201 bp, Homo sapiens
cccagagttctttaattaattgatctgaaatggagcttgggagttgacatttatttgtagttctctagatgattctattgtgcacccatggttgaaaactrccactttacagtttttctagaattgttgttttctggcgccacagtcccccactgttactactttagttgatacctttattagttcagataccccctcttc

SEQ ID NO: 43332 - DNA, 201 bp, Homo sapiens
cccgccaccacgcccagctaatttttgtatttttagtagagacggggtttcaccatattggccaggctggtctcgaactcctgaccttgtgatccacccgyctcggcctcccaaagtgctgggattataggcatgagtcaccgcgcctggctagttatttttaatcacaaaagcaatgcattctctattagaaatgacaca

SEQ ID NO: 43333 - DNA, 201 bp, Homo sapiens
acctcattggattgttgtgaatatgcaagttaatacacattaaacatactgcctgacacacaatcgctgctaaaacatcggcactattaatctttcacacrctttgttaaaagcttacacacaaatataccattgtttttatgaaaacggaatcatatgtattgttctgtaatatgctttatttggatagtattctcctat

SEQ ID NO: 43334 - DNA, 201 bp, Homo sapiens
tgacagcaggagacaaaggaagagactataaatgcaagaggaacattgaccttggaaagtaaactttacccaacggggagagaacgctttgattgacctargctttgtgtggaggttgcttctctttcattctttatttttaatccagtctcctctgtggtacctgaggcaggaaagcatccattgctaagaaaagcactc

SEQ ID NO: 43335 - DNA, 201 bp, Homo sapiens
tgttaagggaaaaaagaggggaacccctatatataaaaccacaatcttgtttcatctataatacccctggtccccctccttcatctacactgccacccccmcctacacccaccacttgatcattttatagcagatattttattacatttttgaaaacaaaggaaacataagacaggtgtactattttaagattatattaac

SEQ ID NO: 43336 - DNA, 201 bp, Homo sapiens
catcagtttattaatatttaaaatagacacaaggcctggtacagtggctcacgcctgtaatcctagcacttcgggaagccgaggcaggcggatcacgtgaygtcaggagtttgagaccagcctggccaacatggcagaaccccatctctactaaaaatacaaaaattagctgggcctgttggttcatgcctgtaatcacag

SEQ ID NO: 43337 - DNA, 201 bp, Homo sapiens
ccctggcaggaataaaagtggacatttatcttcatattattaaatgcctccacctttcacctcttttatgaaagaagcccattcaaggccactgaatgaayctcacatgcagcttgtctagctgtacattcgcctgcacattcaacgctgagttattatatttctgaaaacaggtattcctatgatttcctggcctgggtt

SEQ ID NO: 43338 - DNA, 201 bp, Homo sapiens
ctataatacccctggtccccctccttcatctacactgccacccccccctacacccaccacttgatcattttatagcagatattttattacatttttgaaarcaaaggaaacataagacaggtgtactattttaagattatattaacatatttcatgtttctttaatgccccaacacacacacacatacacacacacacaca

SEQ ID NO: 43339 - DNA, 201 bp, Homo sapiens
gggtgtaggagaagccattttattctgagttttaaacttccaagaatgatgagttagctttctcatttctgatgtcaatcacacctgtttgggattcaggraatgcctggctacatatcttttgtggggacaaattggaaatcaactatcctttcccgtccacttcatctctctttagttgacatttgcctgagggagaag

SEQ ID NO: 43340 - DNA, 201 bp, Homo sapiens
tttatattattatgtacttttgaagtaaaacgtctccccccaccccccatagcaaagagatataatagccaaaaccaaaaaggaaatacagtgggatgtcrttagtaataccttttgtttgtcttaggtgtgagaggattcttgctcttatccgtgtgatacatgttttggctaaagctttgaagtcataagatatgtagt

SEQ ID NO: 43341 - DNA, 201 bp, Homo sapiens
cggatcacgtgacgtcaggagtttgagaccagcctggccaacatggcagaaccccatctctactaaaaatacaaaaattagctgggcctgttggttcatgyctgtaatcacagctactcaggaggctgaggcatgagaattgcttgaaccaggaggcggaggttgcagtgagccgagattgtgccactgcactccagcttg

SEQ ID NO: 43342 - DNA, 201 bp, Homo sapiens
tctatgaggctttggctgccattttcattgctcaagttaacaactttgaactgaacttcggacaaattattacaatcaggtacaaggaaagagttctatayaccctttcttaagaatgcctttaaggctgggcgtggtggctcacgcctgtaatcctaacactttgggaggccaaggcgggtggatctcctgaggccagga

SEQ ID NO: 43343 - DNA, 201 bp, Homo sapiens
gcgtcattgctgaaagttctgtgtaggtcttttaccatagtattgaattttacattcattataatgctttttattatgagctctaattccaagttagttayttttaattcagaaagaaagtaaatatttgctttctggaggtaactgcacttgagtatctgcaaggagagcccctcaagttctgtttttggggatcctccc

SEQ ID NO: 43344 - DNA, 201 bp, Homo sapiens
gccaggagtggtggcgtgtgcctgtaatcccagctactcgggagtctgaggcaggagaatcacttgaacccaggaggctgaggttacagtgagccaagatygcgccactgtagtccagcatgggtaacggagtgaggctctgtctcaaaaaaagaaatataaataaataaataaataaataaatagaggggattagcaaat

SEQ ID NO: 43345 - DNA, 201 bp, Homo sapiens
gctgaagcaggagaattgcttgaacccggaggcagagattgcagggagctgagatcatgccactgcactccagcctgggggacacagcaagactccatctsaaaaaaaaaaaaaaaagaatgcctttaaaagacaagaggatgaccagggttgggaaggggatcccacataatcaagaggtggggatttggggtaatcatt

SEQ ID NO: 43346 - DNA, 201 bp, Homo sapiens
gcctgtaatcccagctactcgggagtctgaggcaggagaatcacttgaacccaggaggctgaggttacagtgagccaagattgcgccactgtagtccagcmtgggtaacggagtgaggctctgtctcaaaaaaagaaatataaataaataaataaataaataaatagaggggattagcaaatgttaacaaggtgttaaaca

SEQ ID NO: 43347 - DNA, 201 bp, Homo sapiens
gtggatcacttgaggtcaagagttcgagactaacctggctaacatggtgaaatcctgctctactaaaaacacgaatattagtcgagtgtgggggcatgaasctgtattcccagctactcaggggactgaggcacgagaatcacttgaacccaggaggaagaggtttcagtgagcctagtttgcaccactgcactccagcct

SEQ ID NO: 43348 - DNA, 201 bp, Homo sapiens
ctgcaggccccacatgccagcttaggccctgcctctgtgtgcttcccattccagtgggaatgattttcccatcctagcccaatagggtgaggctgagctaygccgacactgggaagagagctagtgtcattaagtggaattgagtttcggatctagggaaagttacaagaaatgtgccctccacattctcaaactctaacc

SEQ ID NO: 43349 - DNA, 201 bp, Homo sapiens; identical to SEQ ID NO: 9883

SEQ ID NO: 43350 - DNA, 201 bp, Homo sapiens; identical to SEQ ID NO: 9871

SEQ ID NO: 43351 - DNA, 201 bp, Homo sapiens; identical to SEQ ID NO: 9872

SEQ ID NO: 43352 - DNA, 201 bp, Homo sapiens
agtttattacttatgggtggcattgatcctactttaaaatatagctgaaaaaacctacttatttggaatttttgaccaaaccaatacagaaatccttagaytgacaaacatatacgccaatgccaggttgtaaaaatattccaacttaacctaccaatttgccaccaaaaaagaggcattcagtaccgttttaatctctac

SEQ ID NO: 43353 - DNA, 201 bp, Homo sapiens
ggaagatcaaccaaaattagtgagtcagaattaaagagtgttttaaacaaaagcaactttagaatttgtaattcatatagtaacccaatctaagtgttagaaaaaaaaaaaaagcatgtggcctctatccagcatagcaacaaaaacactaataagaatggctggttattcaaaaaaatgattattgagcccctctatgtg

SEQ ID NO: 43354 - DNA, 201 bp, Homo sapiens
ataaaaggcccaaaaaggtttagataaaggaagatataccctggataagttaagggagggcgctccctttttccctttgtataacttatcaaagattggcrggtaaatttaggcgcagcaaattgaaaggcacaaccaaggtttgaatttcaagacggggtttctgtctccagagagggcaactccattcttcttgtcctc

SEQ ID NO: 43355 - DNA, 201 bp, Homo sapiens
ggtaatgcccacaacactcaccaactctgctgccaccaacacttatcttttcctggtgtacccgcatgatttcatttccttctccagttgcctcccacccycgttaccttttatgctagtgggagaagggggagggggcgggagattttcccatctgaatattttatcagtggacacttggatttttaacaagtggaagct

SEQ ID NO: 43356 - DNA, 201 bp, Homo sapiens
gagttgagaaaagctagctgttgacttcgttaagtaaaatcaacaaaacttttcctcagcttaagctctagatttagttaatgtcattcaaaatagatgaraaagtaggcaaaatattgtgtacccatttagactccttcagtcagtaccatggctgttgagaggctgcgaggacagtagagtgggtgagtctggaccctg

SEQ ID NO: 43357 - DNA, 201 bp, Homo sapiens
cacttagggaggaccatatattcttttcaagctgtaaaatccactaacatttttgtttttccatttgttgcttggttcaatgcaatctttaccttacacayaatgaaacagaatttaaggagcaaacttattacttggaaaattttgcaagtgactattactttctttgcaggaacatgttccctccaaatctggtagaag

SEQ ID NO: 43358 - DNA, 201 bp, Homo sapiens
gtgccaaagcttaactgataatgtggaattcactactgaacatcatgtttactgctgactaaacaaattgctattggaaagcctcttctctccatcttctsggtataactgcattgtgtagtagccattctggtcttttctgcaccagaaggaacactggagtaagaactcagaggtcatgctcccataggaaatatttcc

SEQ ID NO: 43359 - DNA, 201 bp, Homo sapiens
ctctgctgaaggacggatttacctgaatgatcttccaattttgagtctgggtagaatctagggtcctaagtcttaagtgtctgcaaattcattttaccagrcaagatagacttctttttgcttcttcatggtgaagatccttgcaataatctcagatcctcaggctggaagccggtgcattaccccatgatgtacttcttt

SEQ ID NO: 43360 - DNA, 201 bp, Homo sapiens
gatgtttgcatctgaaaaggtaaacaggggccagctgagtggtgcaggggacattcgctctggctgcatttatttgtagtaattcctgtttggttcttaaraacacaaacttctggagctaccagttgcagcattgactagctgtgggagaagtcactttggcattcagggcttgtttatggagtggaaataatagtagtg

SEQ ID NO: 43361 - DNA, 201 bp, Homo sapiens
caggctggtcccgaactcctgacctcaggtgatccacctgcctcagcctcccaaagtactgggattataggcgtgagccaccgcgcccggccctgcacttkgttttcttaaggaacactagagcttgaagaaaaagacgtgttgacaagttttaagggtcaaatttaaaaatcagtttccctgataaagtatgtgccatca

SEQ ID NO: 43362 - DNA, 201 bp, Homo sapiens
agaaagaaagtaaatatttgctttctggaggtaactgcacttgagtatctgcaaggagagcccctcaagttctgtttttggggatcctccccttttgaaarcactaatcggacctcaaaaccagattttatctttgaggactgacttccactgccttttttttttttttttttttttttttttgatagagtctcactctca

SEQ ID NO: 43363 - DNA, 201 bp, Homo sapiens
ggttaatgttttcttctatctcatgtcttgaattcccagcagaggctacacaaaatttacttctacttcatataccagtttatcatggtacagattattgstcatttttattcttgaatagagctacaggccaagcaacttcttgcattgatattgatgtcttctttcacatatgtaagtaatatatgtagtgattacaag

SEQ ID NO: 43364 - DNA, 201 bp, Homo sapiens
tctttcacatatgtaagtaatatatgtagtgattacaagacattccttttgttcattaaagaaaacccccaggagactctttggagtaagctatgggtaasccactgaatactctttaaagaagcaaacctatatcattaagggaaagctaaagatacgtaagttttttgaagttgacatcaaggagggcagcattgcttg

SEQ ID NO: 43365 - DNA, 201 bp, Homo sapiens
agatttatcttttctgtgttgaaatccacacaagggacataaaataaccctcaaaaaaatataaacacaatatccaaaccttttggaaatttaaatgttawgtattattcagtaatgtctgcccactgtagttggacaaaaccacattcaggtctatgtgtcagctttgtccctcagccctgtgatttgcttttggtggct

SEQ ID NO: 43366 - DNA, 201 bp, Homo sapiens
caggattttcccaaggaaaatagtttgcggtgtcatatttgtggtctctctagagagacaattccgtaagtggttcctaagccttggaaaattctcttttrcaatagtacccacaaataatgttcaaagagctatttttgaggaaaggattcctcacatttttgcaggtgtaagtcattcctgcctcagtggagtacaaag

SEQ ID NO: 43367 - DNA, 201 bp, Homo sapiens
cactatacattcatgagaaaatgagactgagagggacaaatgacatcttagtattattatgagaatggcttaaagagaaggctcgttccccactgttgggwctctcacttcagtcaaactaataactgaacattcatcatctatatggccttataacctttaatagctactattatgaatattatgtgtctattacgtaat

SEQ ID NO: 43368 - DNA, 201 bp, Homo sapiens
gaggaatagtgttttattattctaaataccttgccattattaagagtttttttatgattatactgtctcaatgttgaaagaaaaatttttaaagatttgcrtttcaatttttttacctataggcaagactgtaccactctgggcaacaaacttaagtttcagaaatttaacttaggaacttttcaaggaaatttgagattt

SEQ ID NO: 43369 - DNA, 201 bp, Homo sapiens
aaagaatggtactattttatgttttgcaagttttcttaatgtctggcttaatacaagacagttggagtttcctgtttctgcagtttcacaactgcttcagkgagttgtgacatcacacatcatgtagtctttgcaaaactccactatacattcatgagaaaatgagactgagagggacaaatgacatcttagtattattat

SEQ ID NO: 43370 - DNA, 201 bp, Homo sapiens
acctataggcaagactgtaccactctgggcaacaaacttaagtttcagaaatttaacttaggaacttttcaaggaaatttgagatttgtgtcaagaaaccyttttattaacgattaatgtaaaatttggaatacggttcttaagttaatgtgaacctgcaaaatctaccatttttgcctccataataagtcagaccttgta

SEQ ID NO: 43371 - DNA, 201 bp, Homo sapiens
tgttacatgagagttttctgattgccagctagtttgcttccctgacaggcatttccagatgtgaggaaagatttattttggcactcccagctccaagtggmgtgagcgcacacacacatacacacacacacacacacacaacattcactctccttcagtgcttaggatcatcatcctctgccttcaaagttggtaaattga

SEQ ID NO: 43372 - DNA, 201 bp, Homo sapiens; identical to SEQ ID NO: 9874

SEQ ID NO: 43373 - DNA, 201 bp, Homo sapiens; identical to SEQ ID NO: 9875

SEQ ID NO: 43374 - DNA, 201 bp, Homo sapiens
gaatctataggcattggctaatgtcagtgactactacactctgagattctgctttaatattataaacaccaacttcaaaagcccttttggcttctttgccrgagagtatcaggtgtaaggtctctctttgcacttgcatctagtgtctgcctagagaggatcatttcctcagcctcggcttggtcaaatgatggcattctc

SEQ ID NO: 43375 - DNA, 201 bp, Homo sapiens; identical to SEQ ID NO: 9877

SEQ ID NO: 43376 - DNA, 201 bp, Homo sapiens
tgtggtatttacatgaccagtttgggaaaagaaaggctgctcacaaactgagggaaccaagcctggccaccctgagcagatcaatatttgccccctgtgaracgttctgggaagtgccgcataaaatcaatccactgctaggaagtgctcccttctgccgggaccattttcttcccttctgcagcccacgctgggttttgg

SEQ ID NO: 43377 - DNA, 201 bp, Homo sapiens
ttatttttaagtttaaaaccaactatgagaagagaagctttaaagtgcccatccaggccaacgaaacgcttgtgggtgctgtgataaacaatgtgtctgasgccatggagactcttacccgaatcacagaggagctggtcccagttccaggatctgtgaatggagtcaatgccctgggtctagttgtcttctccatgtgct

SEQ ID NO: 43378 - DNA, 201 bp, Homo sapiens
cacggtggctcacacctgtaatcccaccactttgggtggccgaggcgggtggatcatgaggtcaagagttcgagaccagcctggccaacatggtaaaaccragtctctactaaagataccaaaaaatagccaggcgtggtggcatgagcctgtaatcccagctactcgagaggctgaggcaggagaattgcttgaacctgg

SEQ ID NO: 43379 - DNA, 201 bp, Homo sapiens
taaattcctatttttaggcttcccaaagaaaaacacaatcctatgttctgttggctgacaagactaagattaaaaagtgacataaagcgtaggactgcagmctttctatagtttattatttgtctcctgaaaaggaagatatttgtatttcttttaggaacttcactccaacagatttattctaaaacaattcctgactgt

SEQ ID NO: 43380 - DNA, 201 bp, Homo sapiens
ataagcataactagaattgtctgcaaaataagcttatacacatggtaaaggcctcatgattctaagcctgtgtcccaggttccctttcaagttaccaagayttgcagagttacttcattattatgaagatggtgagtgcatgcagaacaaatgtattcctggtaaaagaacattaacatgatggggaatgcagctattcta

SEQ ID NO: 43381 - DNA, 201 bp, Homo sapiens
aaaggaacttaattaaaataaagccttttttttctatatcacctgttcgtgaatgcttatttgtttcctaattatgccccaatctttgtaactctgtattragccaggtcagaatgagttccactgcattcaagttagacaaagggatttttttacttgttgaaactagaaagagtttttttctataagttctattgaacc

SEQ ID NO: 43382 - DNA, 201 bp, Homo sapiens
aaatcatctttcgagattccagagagtcttaagttattttataaagtgttgtgaaagtctccactttcatgttaaaaagtactatatgctgcataacattyttcagaaagggttattatggaagggccgagggtcaaagttccaaggtcctgaaagtattacactgcttccctgagcagtgtcagaccagaaaaaccaaca

SEQ ID NO: 43383 - DNA, 201 bp, Homo sapiens
tgtctgtaaaatacatagtatggatatttctcctttttaaaagtgttagattatacttcaatttttaaaagcattaaaatatgttagcttgtatagatacyactagaaaataaaaagttagatgaactttttctcttgggtgaatttttagacagtgtaagatagatgacagaccacactgacaagtagttcaagaatctg

SEQ ID NO: 43384 - DNA, 201 bp, Homo sapiens
atcacgaagtgtctttgaatctggctgaatatctagacttaatgagtgtttaaggctccatgtcaacctgcaaagatacctggtgaagcacccttatgtayttttctaaaaaaaccctgccctgttccatactttaatcaacgactcaacaacatagaagtcatctacatagtgttttcatacgacataagcccaaaaagg

SEQ ID NO: 43385 - DNA, 201 bp, Homo sapiens
tgagcggagattttcgggctgaccaaaacttgaggcgaactgagtctccatcttaacactcaaacacacttcatggcggcctggaaacaaggcaatcattrtgaagcttcagcccagttcttctgaaaccaacgtattgggcctgcttcattgtctctctaggggctaatcacaaacatgtgggaagggaagctaaggaat

SEQ ID NO: 43386 - DNA, 201 bp, Homo sapiens
ttattaaggcatcacgtatgttaatttattgaattctcaaaaacatccatttgccaagagagtgagggattacataccttgaccagtcacaagctgataartggggggagccaggattcaagccaagcagccctggagttcatgttgatgacaaccatttccttccagttcgtaccaacacgtttctgttttcctccaatt

SEQ ID NO: 43387 - DNA, 201 bp, Homo sapiens
tttgcatggctaaagagaaatttttggtcaaaacttggaaaaattgttaacatttataatattgttaaagagaaaagaattataagctgcaaacaactaayataaaatgaacttttaaaactgtaacctaattgcaagttgggagtgttgccaaattggaccattaagagagttttagctcttgtccaggactgtgctaag

SEQ ID NO: 43388 - DNA, 201 bp, Homo sapiens
tataagctgcaaacaactaatataaaatgaacttttaaaactgtaacctaattgcaagttgggagtgttgccaaattggaccattaagagagttttagctyttgtccaggactgtgctaaggcaaggagtctgaggggcagaatttagttcgccaaagatctttttaaggtgttagtctgaagtgagtaatttccaaacta

SEQ ID NO: 43389 - DNA, 201 bp, Homo sapiens
ttaatttcagtttcaagcaacaaacaacttcagtccatttcagagtgctaacgttggaatctggttccagaatctttgcagagtgtgggtgggcacaggtkcatgtggctcctttggccataagaatctgctgcttcccagcctcatgactgggcctggagtcacactcctgcttcagctgttctttggcaaagcagggcc

SEQ ID NO: 43390 - DNA, 201 bp, Homo sapiens
tcacgaaacaaaccagtgcaaagcaaacacagtacacccattccaatgtaattccaatggcaggcccattccaaccctcagactaccaatatttgaactcmggtttgaatgtcagaatccaatcattggcagtcctgtgccaaagcttaactgataatgtggaattcactactgaacatcatgtttactgctgactaaaca

SEQ ID NO: 43391 - DNA, 201 bp, Homo sapiens
ttctgtgcgtaaattcacctacttttcccgccaccatcagtggtcctggtgctgctggtgaatgggcatcatggggagacagggctttccacgtgatagargtttctttccaaacccaggctttacaggtagatccaagggtggctttcgtcagcctgttgcccccactgcccaacacacactttgctttttgctgctatt

SEQ ID NO: 43392 - DNA, 201 bp, Homo sapiens
taactcacatacatgcaatttacccatttaaagtgtacaatttaatggcttctagtatatttacagagttgtgcatccatcatcacaatcaattttaggayatttttatcaccccagaaataaagcctgcattcgttggccatcaccccccgattcccccaagccctcagccccaggcaaactctagtctactttctttct

SEQ ID NO: 43393 - DNA, 201 bp, Homo sapiens
gaaatgctgttcccattgttttccactggagaattccctggactgacttcctgaaaatcttctgtttgcctccaccaggaatggcggcgctagatagtaargcatcagggaagatgggaatgcgagctgtagtctattatatgactaccaccatcattgctgtggtgattggcataatcattgtcatcatcatccatcctg

SEQ ID NO: 43394 - DNA, 201 bp, Homo sapiens
ggctttcttccctggtctttcagcttagaatcaatccataggcacgacattcacagaagatagaatttgactcaggagcacagcccaaatcttgaatgtakgttttaacgcttaaactaactttattctaaccttacccccagattactatgattgcatccaatgtccaaaagttatttcagccactaaggttgatttgtg

SEQ ID NO: 43395 - DNA, 201 bp, Homo sapiens
ccactacctgaatattaaaccaccattagaatctgatactcgtcattgaaatacagcataaccttttaatacatttgtggaaacaccattttaaattgttaaaaaaaaaaaaaactcaattaactgtaattggattacactataattggattttagtgggattggggaggataaagaatgaagaaaagtgaagatacagct

SEQ ID NO: 43396 - DNA, 201 bp, Homo sapiens
attcagttcaattggacatttactgattgtgtacgttgtgcaaggcatcagctgggttctgcgggggagggtgggaataggggttctcagtcagatctagytctgaagaacccttttatagcctcattggaaggggaaggacggatttttaaaaagaaaatagaatatattccgaatttatgcacatttctcacacgtggt

SEQ ID NO: 43397 - DNA, 201 bp, Homo sapiens
acttctatgaggctttcatttcaattccttttcttctgtgagggacaggccttccttgggaagaaaggtcaccccttgagtctgacatgctctgcagtcartttgagaagccttttggttaattttggacaagtcaagcctggtggtggaattcggtcccatttagcattctgccagctaggaagcgtgctatctcgatca

SEQ ID NO: 43398 - DNA, 201 bp, Homo sapiens
ctctttccccacaaggtttgtctcttgttgttccagacagaatgaacctcattattttggattaattgggggaagatcaaccaaaattagtgagtcagaaytaaagagtgttttaaacaaaagcaactttagaatttgtaattcatatagtaacccaatctaagtgttagaaaaaaaaaaaaagcatgtggcctctatcca

SEQ ID NO: 43399 - DNA, 201 bp, Homo sapiens
ctagtatatttacagagttgtgcatccatcatcacaatcaattttaggacatttttatcaccccagaaataaagcctgcattcgttggccatcaccccccrattcccccaagccctcagccccaggcaaactctagtctactttctttctctatagatctacctattatgaacatgtcatgtaagtgatatcattcaatat

SEQ ID NO: 43400 - DNA, 201 bp, Homo sapiens
tgtatatatcagtacttcgttcctttttatagctgaataataatatgatacatacatattgcatatacatggacatgtgatatgtccatataatggaataytacccattcatataatgaacatatcacatgtccatattccatatatgacatgtccatataatggaatattatccattcattagttagatatttgggtttt

SEQ ID NO: 43401 - DNA, 201 bp, Homo sapiens
agttgcacttaaaactaatttatacaattagtacacctaaaatgacatgttggttccaaatagtaattatattctaactggtgctgacttgaagctgagtwtcaacgcttaggcacagagaccgaatattttatgtgtttgcactctctcacccagcaactgggaaaggtagattggggaaaatgttaacacagatctctt

SEQ ID NO: 43402 - DNA, 201 bp, Homo sapiens
ccaatggcccgctttctggtttaggtggcagagtggctgatgatgccacatttgaaggtaggatacaggagaaagactggggccttgggggtgcacgaggrtaagttcagtttggacctgttgagtttgtggggcgggatgccaccgaggtgcatatacaatggaagaagcttgctgcaaatcaagatttagaaggtattc

SEQ ID NO: 43403 - DNA, 201 bp, Homo sapiens
gagtggctgatgatgccacatttgaaggtaggatacaggagaaagactggggccttgggggtgcacgaggataagttcagtttggacctgttgagtttgtrgggcgggatgccaccgaggtgcatatacaatggaagaagcttgctgcaaatcaagatttagaaggtattcctacaacctccaaactgaacgaagacagtt

SEQ ID NO: 43404 - DNA, 201 bp, Homo sapiens
tattcatggtatcagtgacatgggtagtatcatctcaatgaaggaacaacttagggaaggaacgatgcacccgtctcttgccctgcctctccagtattcgrgcttccttgctgggaaataactctattagcagagaagaagggggtcttttctttttctttctttctttcttttctttctttctttctttctttctttttt

SEQ ID NO: 43405 - DNA, 201 bp, Homo sapiens
gctttaatttgtatgttacattcaacttttgaagccctttcacatctcttaccatctatcatcttcacaataaactgtgaaagagatgaaccagggtttcrgtttttatccctccctctaagccttcaccccctaccaccaatttagcagaagtttagaaagtgaaacattgagtgatgtgtcaaaggcgcttagaaataa

SEQ ID NO: 43406 - DNA, 201 bp, Homo sapiens
actcagaaggctgaggcgggaggatcacttgaggccagaagttcgagaccagcctgggcaacagagtaagaccctagctctaaaaataatgaaaataagcraatggaaatttatgtccaacagcttcatcaaactgtagtttgtaagcaaacataaaaatcataagtgtgagacaggcttatgatttctccaaattgggcc

SEQ ID NO: 43407 - DNA, 201 bp, Homo sapiens
ttaaggtaaattgaagaaaccataaaattaatccggtaacaacatgggagccagcgagaattcctacctcattactggaagggataggtttctgccctgckgcatggaattcgattaccttatcacagctgcataattgtaaatattttcattggttatacaactgctgtgtcttttctgagaaactcagccccaatgtgt

SEQ ID NO: 43408 - DNA, 201 bp, Homo sapiens
aaatgttaagtctttggctacactaaaataattgttgaaatcccttaaaatgtagatggtaaactcatcagttataactttttgttgcactaaaatatgastttatttctttagttgtagtgaataaaaataaagttaattacaaaagtaaagcaggtaacacaactatttgaatatgcttaacactattgaactgtacct

SEQ ID NO: 43409 - DNA, 201 bp, Homo sapiens
ggaataatgacttcattagaacacctataacctgattgcagtagtacatacatgcacattattaagtttaataatgaatttattttatggacatcttctawttatggcaagtggtactagatttccatttgtactataacatagaattttctcttaaagtaaatttacttaagtaaaaaaggtgatctgaagaataatact

SEQ ID NO: 43410 - DNA, 201 bp, Homo sapiens
aaaatctcatttacgttttttctgaagcgcgtcctcttgtgttacatggcaagtcaggcatcggcaccgtgcgtattttgcagcgtatatgctctacgtgsggagctttgtaaaagtgttttctgttctggtacttctgttaacagcatcacagccacagctgccagtattggggcagctggaattcctcaggcgggcctg

SEQ ID NO: 43411 - DNA, 201 bp, Homo sapiens
gtgcttgacaggctttcaacgacagaaaccttccctttcgaagggagcttgcaggaagggagccaggagacctgaggatctctgggctcatgcaaccttgytaccagagcaggaatcccctctccagcccctggaaagtggccatggagctcccctaaatggtccattcttaggtggtctcaactacgaagtctgtcttct

SEQ ID NO: 43412 - DNA, 201 bp, Homo sapiens
ctgtttcaaaaaaaaaaaaaatctcatttacgttttttctgaagcgcgtcctcttgtgttacatggcaagtcaggcatcggcaccgtgcgtattttgcagygtatatgctctacgtggggagctttgtaaaagtgttttctgttctggtacttctgttaacagcatcacagccacagctgccagtattggggcagctggaa

SEQ ID NO: 43413 - DNA, 201 bp, Homo sapiens
gatggtctcaggggagcacctagcagtctcttgggcacctaagcataagcaaagtgtcccagtgcttcttctgtgcctgttctccaggacttccaccatcytgattgcctctccaccatccactgtgctcccagagctgatcctggtgctccagatgtcatgtgactgggtagggacagtggtctagatccaatcctctat

SEQ ID NO: 43414 - DNA, 201 bp, Homo sapiens
ttgttgcaaggattaaatttgctgctaacctaggcaacacccagcatatagcaagagctcagtaagcattagttatttactatttatttcagtgatacaamcaatatgggcaggattttgccccacctttctgcgttttccaattcaacttttctccttgaccatattactgttacattggaaaaaagcaataaatattta

SEQ ID NO: 43415 - DNA, 201 bp, Homo sapiens
tgccaaacaacctaaatgttcaacaatagagtgaggacaaagtaaagcctgatacagtgaacgaatctgatatcaggagacctaaaagtgatgtttatggkgaccgtatatggaaaagtatattctgtatgatttccatgtgtttaactatgtattggaacattctgcaaaagagacacacaaagtggttgcctttgctct

SEQ ID NO: 43416 - DNA, 201 bp, Homo sapiens
ggtccacctcagccactccatggacttaggtgagcacgtaacccctctttaagcctactgtggcgccagcctgccagctgtgtggttttggcaatttaccygccctctcaatgactctgattcctcatctgtgagatgtggataacaataatagtcctggcctcgatacaatgcgtgaggcaatgtgcttgtgaggacttg

SEQ ID NO: 43417 - DNA, 201 bp, Homo sapiens
ctctgtgttgcagatacaaataccttttaccattagaagataaaagctcactttaacctcacttgaatataagagctttgttgcctaaaatattaaaaggraaacagacactcttggttaaataatatttcccaaacatttctccagatggtgtcaattcactcctgttgtaattccctaacgcttctgcttaggatctgt

SEQ ID NO: 43418 - DNA, 201 bp, Homo sapiens
tcaccaactctgctgccaccaacacttatcttttcctggtgtacccgcatgatttcatttccttctccagttgcctcccacccccgttaccttttatgctrgtgggagaagggggagggggcgggagattttcccatctgaatattttatcagtggacacttggatttttaacaagtggaagctttgcaggataggattct

SEQ ID NO: 43419 - DNA, 201 bp, Homo sapiens
aagggaaagaaaatgtttctccccaggtctagttggcttagaccaggatgcaaacaaggttgcagtttctgtgcatgctgcaaacagagtctaaggggaaygagttagaggcataagaaagcctgatcaggattgaaaatctgccctggacaatccataaaatgcataaggacccaacggaataaagaaatttgagagttg

SEQ ID NO: 43420 - DNA, 201 bp, Homo sapiens
aatgttctcgtgctgcagaacactcagtggtagatgaagggtggtttgtgtatcttaatgactgagtccctgctcatcgatatcccaatcacttgacttcktaacacagtttatctccctacttgaaatgttttacctttccccccattcgaaagttattccacacacattcatgaagcattttacaaatgctgcagcctc

SEQ ID NO: 43421 - DNA, 201 bp, Homo sapiens
caacaacactgtgaggtagaaccagcacaactgttcttgtttcacagctgtagaatgtgagagaaaggataccaggtgatttatctattataccatagcaygatccccacagaaaagaaaaggactattgtgaatatttgggtttatggttttaaaaaaatcccattatagtcattttattagggtttcagaagaaagcaa

SEQ ID NO: 43422 - DNA, 201 bp, Homo sapiens
gtggattgggggcagattgtggcgcgagatctagaaaaggatcaaggttgagcggatctgcttaaaagtgactggtaagaggaatcagagctattagtttaaaaaaaaaaaaaatctggtctctcctatttcccggtcttcacttctccctaagcatttaatccagtgtgaagtcttaaacaaattagaagtcttagtatc

SEQ ID NO: 43423 - DNA, 201 bp, Homo sapiens
tgtgtgtcacaaagaaaaacactacttcatacttctacttgtgataaacgaagctgaattgtgatttcagatgatttatagatgtgcccagagcactttgyttatttcatggaaaaaaaatgaaaaaattaccctgtaaaatagtcacatgtatttcccatgtactgtgggcacctgtgttctttttatgaccatatttac

SEQ ID NO: 43424 - DNA, 201 bp, Homo sapiens
aacattacaaaggaggatgttaaaagttacctgtttcggaatgcttttgtgctgctcacagtcaccgctgtcattgtgggtgagtcatttgattaaaaacaaaaaaacctgtatcttgtttctctggggcatctggctgcccggggaatattatcagatgaactagttgtaggtatcaaaatggtagcctaggctttcctc

SEQ ID NO: 43425 - DNA, 201 bp, Homo sapiens
cttttgaattaactaagcaaaccaaactaagaaaccaaatttgattcttttgacaacattaatcatgaatgttcagtaactttacaaccctccacttggayaggggaattattagaaacaaattattattgtaactctacagcattttagactttgccttacaaaatactttcagggatgtttaaaagtgtatagctgcca

SEQ ID NO: 43426 - DNA, 201 bp, Homo sapiens
tgacatcttttaagagatgccaggaagagaaataccctcatgagttgatgaaggccagttagctagcagtgcattcacacagcattgtcatttaactgcawgatttacccggttacctcaaaagaaaacttacagttctcctatagaccattaagccacttccttctcattcatttaacacatactcatttataattcatg

SEQ ID NO: 43427 - DNA, 201 bp, Homo sapiens
agttttcaaattcctaggtttttattgcttttagtaaaaaaaaaaaaaaaaaaatcactgggaaaacctatgtactgggttgaatcttttgtttagactgttttttttttttgcctttttgaaataaaatgtatatgatttaatgtgtagaagtggaaactagaaaaatattatgataaagacatgtgaatccatatattc

SEQ ID NO: 43428 - DNA, 201 bp, Homo sapiens
agggagttaatcacaatgatctgcaggtatcaagccaccctataacattatttcataccaagttgacattcaatagctatgtttttatttagttcatacarttaattaaggcttttcaccatttctgcatgaactttaccctcagatagtttagattagaagtattttattatattacattttctttccctgtaattttta

SEQ ID NO: 43429 - DNA, 201 bp, Homo sapiens
acttaagcccaggaggttgaggctgcagtgagccatgttcatgccattgcactccagcctggatgacagagcgagaccctgtctccaaataagaaaaaaawaataataataataataataataatggtaatagctaacactcacaatgtatggaaagcactattgtgtttaagtgtattaactttatttaattctcacaac

SEQ ID NO: 43430 - DNA, 201 bp, Homo sapiens
gggtgagctgctttaccacagagaaagactggttgtggccgggagaggtggttcacgcctgtaatcccaaaactttgggaggctgaggtgggtggatcacraggtcagaagattgagactaccgtgaccaacaatgtgaaataccgtctctactaaaaatacaaaaaaaaaaaaaaattagccatgcatggtggcgcatgc

SEQ ID NO: 43431 - DNA, 201 bp, Homo sapiens
gtcatgctacgtctccttggtcggaaagacagagcaaagagggctctgagaagtctgtgtatcaggctgtgtttccatgaaggcttttttcattgctgggstagaatgtaataggaaactagaactgcctaccaagataagcagccttcgtattcaccgcatttcctcttgatttgatgctgatagctggccgaccctacc

SEQ ID NO: 43432 - DNA, 201 bp, Homo sapiens
gtggttgaacattctattatttggtgagactatgactgtctaattggtcagtgagaatctgacttgtctagcaacaaaagaactccttgagaagaggagckactatttgtacatttgcattgcagccctggttgcagtgatgaactcttgctatagtatgttacaaaattatgtcattgatttgtagattgagtatagttg

SEQ ID NO: 43433 - DNA, 201 bp, Homo sapiens
ttctacaaattacacagacccctggaggatccctgtgtatactgggaaatgttactggagaatgtgttgcctagggaagaaacaaaggcaggctccattgctttagagtggaaaggcaacctcaaatgcctccagtggccacgtgggtgatgcatgtacatgaagctgccctttcaggctattttttgttttcctattttg

SEQ ID NO: 43434 - DNA, 201 bp, Homo sapiens
gctggcagatcacttgaggtcacatgttcgagaccagcctggccaacatggtgaaaccccatctctactaaaaatacaaaaattagccaggagtggtggcrtgtgcctgtaatcccagctactcgggagtctgaggcaggagaatcacttgaacccaggaggctgaggttacagtgagccaagattgcgccactgtagtcc

SEQ ID NO: 43435 - DNA, 201 bp, Homo sapiens
gtcatatttgtggtctctctagagagacaattccgtaagtggttcctaagccttggaaaattctcttttacaatagtacccacaaataatgttcaaagagytatttttgaggaaaggattcctcacatttttgcaggtgtaagtcattcctgcctcagtggagtacaaagagtgatgtgagggaagcagagctgctggcag

SEQ ID NO: 43436 - DNA, 201 bp, Homo sapiens
tttggctaaagctttgaagtcataagatatgtagtctaggtattgtaattgtgcatttcatatttcaaaaattgtaaaattcaaatgttaagtctttggckacactaaaataattgttgaaatcccttaaaatgtagatggtaaactcatcagttataactttttgttgcactaaaatatgagtttatttctttagttgta

SEQ ID NO: 43437 - DNA, 201 bp, Homo sapiens
tgcaaggagagcccctcaagttctgtttttggggatcctccccttttgaaaacactaatcggacctcaaaaccagattttatctttgaggactgacttccrctgccttttttttttttttttttttttttttttgatagagtctcactctcacccaggccagagtgcagtggcgtgttctcggctcactgtaacctccgcc

SEQ ID NO: 43438 - DNA, 201 bp, Homo sapiens
tgtcattcatcattcattcaacaaagctatactgagttcctgcagtgttagtcactgggcatatagtaatcaatgtaaaccatcgtgtattactatacttsaagggctgtgacctggaaaatcactgatatgttattccagaatgaataaaagtgaagttgaacttaaggcatatactttaaaagaatggactttttaata

SEQ ID NO: 43439 - DNA, 201 bp, Homo sapiens
atgtgtttcaaataagtgaccactaatgaagctcagttttgcaaagggtgagctgctttaccacagagaaagactggttgtggccgggagaggtggttcaygcctgtaatcccaaaactttgggaggctgaggtgggtggatcacgaggtcagaagattgagactaccgtgaccaacaatgtgaaataccgtctctactaa

SEQ ID NO: 43440 - DNA, 201 bp, Homo sapiens
ctgtctaagatgatggagaaatgacaaggagggaagtgtggaaacaggtgagagggagcagagtaggagatgggttctgaggcaaggtggatctagggggrcttgccaggagcacccattgattgcatggtcttgggctttgactacatgagaggaggagtcagtggagggagtaggggagagagatcctgacctaggtct

SEQ ID NO: 43441 - DNA, 201 bp, Homo sapiens
gggcatgatcacaagtgatgcctcacagaggaacccagaagcaggagagctgccaaatgaccccgtgaggggaccacactgttcttaacctgctcccctayttatacaattgctgacttagttccctttaagttagaacatgggagaggaaggaactgtctgtcccaaagaccaaacgcacagacagtcagaactaccagg

SEQ ID NO: 43442 - DNA, 201 bp, Homo sapiens
ggctggagtgcagtggtgcaatctcggctcactacaacctccacctcccaggttcaagcgattctcctgcctcagcctcctgagtagctgggacaacaggygtgcaccaccacacctggctaatttttgtatttttagtagagagggggtttcaccatcttggcctggcaggtctccaactcctgacctcaggtgatccac

SEQ ID NO: 43443 - DNA, 201 bp, Homo sapiens
cctaggctggagtgcagtggtgcaatctcggctcactacaacctccacctcccaggttcaagcgattctcctgcctcagcctcctgagtagctgggacaayaggtgtgcaccaccacacctggctaatttttgtatttttagtagagagggggtttcaccatcttggcctggcaggtctccaactcctgacctcaggtgat

SEQ ID NO: 43444 - DNA, 201 bp, Homo sapiens
tttctataacactcatctctgaatacaaagtaacagagtaacagtaatcattttagaaaatttgacaataggaaaatataaagaaaaaaataaaaatcacytttaatcctcgttgtgctttttatttttaagtttaaaaccaactatgagaagagaagctttaaagtgcccatccaggccaacgaaacgcttgtgggtgct

SEQ ID NO: 43445 - DNA, 201 bp, Homo sapiens
attaaacgctacaggtttgatgtgaaaattaaatcatttagataaagcatcgcctaccctaagttactgacaggatcaggcccagaactgtctttctacarcatcacacttgctctcccttctactcaaaaaaacctaccttaggagcaaattcgggatccatagctgtcattcctcatttgtgaatttagaaagctaagc

SEQ ID NO: 43446 - DNA, 201 bp, Homo sapiens
ttcctcttttctataccaaaccaagtgggaccctcttttccctgctcatttctctgctataagaaacacttctcttgtcaaccagattaaaaacactagcrttttctaggaattttggggggaaaggatggttcttaccttgtattgaaagcttagtagttgtcagacacagtgtgtcttgcatacaaatatctcattgag

SEQ ID NO: 43447 - DNA, 201 bp, Homo sapiens
ctccaaattgggccaattcctgaaatagaaatttttatttgatttctcatataattattgcatgcctgccataataattgtaatggctaaattgctaaaayattttttgactcattaaatgctctcatatgcattatcaaggagtttagaattcattaacagaaacaagatgaattagtataaagcagctaagatttataa

SEQ ID NO: 43448 - DNA, 201 bp, Homo sapiens
tagagaagtgttacttccccttagcagcagtcccagttgatcaccaccttgaagtggaatttcctgatttttcttaatacctaataacaaacaactttatygaagaaataagaactttggttgtgtaatttttcagaaaaaaaaatactatgatgcaatccctttgcatggctaaagagaaatttttggtcaaaacttgga

SEQ ID NO: 43449 - DNA, 201 bp, Homo sapiens
aatgatctttcacccatgtatctggatatacctagaagtgaaattgctgggtctaaaggtatactcattcataatgttgataagtattgctaatttgtacyccatagaatttgtagtcatttgctacaaatgtgggatttaaaaaagagttagcctcggtactgtactgcctctgccaaaggtaagcatgagtggactttg

SEQ ID NO: 43450 - DNA, 201 bp, Homo sapiens
acagtcccccactgttactactttagttgatacctttattagttcagataccccctcttctaggaagccttccctggctttcccctgctaatacagggtckcagaggtgtagatacgtttccaccttatcacagttactgcatcacaatggaatgcactgttaacatgtctatcttcctcatagaggcttcttgaaggtac

SEQ ID NO: 43451 - DNA, 201 bp, Homo sapiens
aatctcttgttcttcaaaccaataaatgctccctttaaggacaggttggatttggttatttcttgttatactgacattttttcccaaagaaagaatttacygataacatacttcatcacacaatgttcacagaaagatcttgacagattttttcagcaggaacagcatttgctgctggtgtttgtgtttttttcatttgat

SEQ ID NO: 43452 - DNA, 201 bp, Homo sapiens
tttttttttttttttggcctattttattttacttatgtagtaaataaattaacatagtccaaaataaaaaaatagaaaagcttataaaaagaaagtatctyattgacccctgtcccccaaggttcccgtttatcttgttattcatttctcgtatgcctttggagaaatgttatgactataaaaataaatatgtatttattc

SEQ ID NO: 43453 - DNA, 201 bp, Homo sapiens
cctaggctttgtgtggaggttgcttctctttcattctttatttttaatccagtctcctctgtggtacctgaggcaggaaagcatccattgctaagaaaagyactcagtcaccaacatgattaaaaatgcccttgtctttaatgccaacaaagcccagagaaatccatttttcaggaatttgtacaagatggatatgaactt

SEQ ID NO: 43454 - DNA, 201 bp, Homo sapiens
gtgctataacacccattctggctttactccagcaatttgctgagggtctgcctgaggtagcaacggaagagatggaaaagagaggtcgaactgaaagcccrctggtgagacttggcaattgattcaatgagagaaggtggactgcagaccaatggcccgctttctggtttaggtggcagagtggctgatgatgccacattt

SEQ ID NO: 43455 - DNA, 201 bp, Homo sapiens
ttgtacaagatggatatgaacttgggcacaaagacagatcagaatgtggtctccacaggagcccccacttggaaggctcctttgaaaccctggcaggaatraaagtggacatttatcttcatattattaaatgcctccacctttcacctcttttatgaaagaagcccattcaaggccactgaatgaacctcacatgcagct

SEQ ID NO: 43456 - DNA, 201 bp, Homo sapiens
agctcctgagagtggcatacaataagtgctcaataaatgcatcccacatgagctgaggataattagctaaaaataaggaaaatattgatgcttttgtttgyttgttttgtttttgagagagcctcgctctgtcgcccagactggagtgcagtggtgcgatcttggctcactgcaaccttcgcctcctgagttcaagtgatt

SEQ ID NO: 43457 - DNA, 201 bp, Homo sapiens
accttagaagattgtgagcaccattgtggtgggactcagagaaagtttggtaactgacactctaaacagagttgggggagaaatgctgcagcttcaccaastggcctgggcattctagggattacccatggcctttgcaatgtgtaattatccatggttgaggtttttttctttcttctttgacttaagacatccattagt

SEQ ID NO: 43458 - DNA, 201 bp, Homo sapiens
actaagcaaaccaaactaagaaaccaaatttgattcttttgacaacattaatcatgaatgttcagtaactttacaaccctccacttggataggggaattaytagaaacaaattattattgtaactctacagcattttagactttgccttacaaaatactttcagggatgtttaaaagtgtatagctgccagtttatttaaa

SEQ ID NO: 43459 - DNA, 201 bp, Homo sapiens
aatacttagccccgggtttcgagaaagtggccaaggataaaagaggctaagtgcatggcatcaaagccaaagctggcctccttatctgtgggagctgcagytggttttctcagaggcagaaagtacactgaacctagttacataagacccgagttcaagttcccactccattccacttggtgttaagtcctttaaactgtt

SEQ ID NO: 43460 - DNA, 201 bp, Homo sapiens
gtcattgtacgaggaccaaattagataaaccatgcttagtatatcagaagacacatagtaagcacatgataaatattagttagcatgatgattagttcaatttttttttttttaatctcatttacgggccaggcatgatggctcatgccggtaatcccagcactttgggaggccaaggtgggtggatcacttgaggtcaag

SEQ ID NO: 43461 - DNA, 201 bp, Homo sapiens
agattgcaatagaagaaaaaaaatataaaagcaaaaaaatttcccaagaaactaccacaaatacatacttttatactgcacataatgaacattcccgactrtacagtgctataattatagtccttatgtatgtttaattgtaaaagtcacacatctaccctacttgaatgaatgtatctgattgactcattggtaaaagat

SEQ ID NO: 43462 - DNA, 201 bp, Homo sapiens
tgatacgattcaaatacgaatgaaattataaattgaaggtcatggcttcaatttccacttaagctaattacctttgtattaagatttttgagcaaacccarccagttatctggcaatcgtagacaccattttaatcagtactttaccttctaaatatgcaaatatttagagttcacacaaactctaaatatgttcatgtga

SEQ ID NO: 43463 - DNA, 201 bp, Homo sapiens
actaagattgcaatagaagaaaaaaaatataaaagcaaaaaaatttcccaagaaactaccacaaatacatacttttatactgcacataatgaacattcccractgtacagtgctataattatagtccttatgtatgtttaattgtaaaagtcacacatctaccctacttgaatgaatgtatctgattgactcattggtaaa

SEQ ID NO: 43464 - DNA, 201 bp, Homo sapiens
ttccagtgggaatgattttcccatcctagcccaatagggtgaggctgagctatgccgacactgggaagagagctagtgtcattaagtggaattgagtttcrgatctagggaaagttacaagaaatgtgccctccacattctcaaactctaacctctacaggcccatcccttcgcccccttccctcgctcttccagctggca

SEQ ID NO: 43465 - DNA, 201 bp, Homo sapiens
aacctgggaggtggaggttgcagtgagccaagattgggccattgcattctgttaagccattgcactccagcctgggcaacagggcaagactccgtctcaawaataaataaataaataaataaataaataaataaataaataaattgcaatgtgaataatgaaacatcagtgaaaataagtagttttatattattatgtact

SEQ ID NO: 43466 - DNA, 201 bp, Homo sapiens
cacttgaacctgggaggtggaggttgcagtgaactgagattgtgccattgcactccagcctgggcaacaaaagcaaaactccatctcaaaaaaaaaaaaaaaaaaagattctctatctctattccgtatctctatccacacacacaaaaagggacaattggcataaattcctatttttaggcttcccaaagaaaaacacaa

SEQ ID NO: 43467 - DNA, 201 bp, Homo sapiens
gattgccagctagtttgcttccctgacaggcatttccagatgtgaggaaagatttattttggcactcccagctccaagtggcgtgagcgcacacacacatacacacacacacacacacacaacattcactctccttcagtgcttaggatcatcatcctctgccttcaaagttggtaaattgagtttgcgctacagcagaat

SEQ ID NO: 43468 - DNA, 201 bp, Homo sapiens
attgccagctagtttgcttccctgacaggcatttccagatgtgaggaaagatttattttggcactcccagctccaagtggcgtgagcgcacacacacatacacacacacacacacacacaacattcactctccttcagtgcttaggatcatcatcctctgccttcaaagttggtaaattgagtttgcgctacagcagaata

SEQ ID NO: 43469 - DNA, 201 bp, Homo sapiens
gaggctgaggcaggagaatcacttgaacctgggaggcagaggttgcagtaagctgagatcatgccactgcactccagcctgggcaacagagcgagactccrtctcaaagaaaaagaaaagaaaagaaacaaggtgaacatgttttattcactagttgcttttttttctttaaagaaatacatctgtttgaaaaatcttaat

SEQ ID NO: 43470 - DNA, 201 bp, Homo sapiens
attctctatcaccagctttatctctgtcttcctttcccacccttcttatttgtaatttgtttgttaaagagatcaggttgtcaggtaaaattagtcttccrcaatctggattttgatgattatgtcaccatggtattgtttaacatctttctctttcccccaaaccattggttttcagtcatgagagatagatataagcat

SEQ ID NO: 43471 - DNA, 201 bp, Homo sapiens
ctgaacactactttaagtgctttctatatggaagcccctttaatgccagtgaaaaccctatgagggagcttctatttttcacattccacagaggaggaaastgaggcttggagaagccacatggtaccagagccaaaagtagaatccaggtattctaacgtcagagtctgaactcttaaccactgtgccactgtctcttag

SEQ ID NO: 43472 - DNA, 201 bp, Homo sapiens
agatcaccaggtgatcagaataatagcttaaattgtacattaaaacatcaaaaaagaatcccaaatacatatataaaataattcttttgaaagaatttaayggcagttaatctgtgtgtgaatcaccagagtgcttgaacttgaggtaaacttagattatcctgccagaaaaatgttttaagtatttatttacacacacat

SEQ ID NO: 43473 - DNA, 201 bp, Homo sapiens
gctaacttacctgcagagtgattgggctgccaattatagatacctgtctaaagggcccattccccattgatcttctgaaggaaattcctctatgccatctyaaggaatggggctgtggcaggtaaagccaagagagatttggggagcagagggtaccttcagcagcacctctcaattcccaccatgggtgactttgcacca

SEQ ID NO: 43474 - DNA, 201 bp, Homo sapiens
ttcttaagaactaataacatcaagaatggcttggaaacagcttgtttagggatttttaatttgtaatacccactgaaatctctaaacaggtctaatccctraagggctttttcattgagcaccattagcagaaattagtacaatactttaaaatttgcaagatgttctcctatattctgtttaatttgattatcacaacaa

SEQ ID NO: 43475 - DNA, 201 bp, Homo sapiens
aaaagtgacccccatgtagtgaaaggagggctggctaggaagacagaggtgggtatcaaaagctctgtatctgccttttcccccaggtctaagagaaaaayattgtgtcctagagcaattctcagtgaggggaaagcccgattctgcaagaatcaggggaaatttatatttacaaaagaaaaaaaagaagtccacagtttc

SEQ ID NO: 43476 - DNA, 201 bp, Homo sapiens
ttattttgcacaagggacccatgagtctaatggcaatgggacactttaagcctcactatccagatcagcctctgctcttcattgttgtggggttttttttwaattgttattaaaagtacattttggagagcaaactaagtcagatttggggggatttttatcactcaacattttgttgtgaaatgccctacatatagggaa

SEQ ID NO: 43477 - DNA, 201 bp, Homo sapiens; identical to SEQ ID NO: 9890

SEQ ID NO: 43478 - DNA, 201 bp, Homo sapiens
ttaaaaataacagtaacagtgacaagcaagatagaaatatatttctctttcatgcagcacagctctgctccacaaagccttcaaggctgattgataggtgytctgtggtataagagactaagtctctagggtattatcattatccaggtggtccgggatgactcaccacccccagattttagtcagtcggaagtggggaga

SEQ ID NO: 43479 - DNA, 201 bp, Homo sapiens
tgtatctattcatatttatcatattagacacacttataaatttccacttgttaatttattacatgttttatttaaaggtgataataattcataaaataaawtaatggaatgaatttattatcatctttaaacaaaaaggttatatatgctaacataaatagcatttttttgcaaaaaacaaccatttcgaccccaaaattt

SEQ ID NO: 43480 - DNA, 201 bp, Homo sapiens; identical to SEQ ID NO: 9878

SEQ ID NO: 43481 - DNA, 201 bp, Homo sapiens; identical to SEQ ID NO: 9879

SEQ ID NO: 43482 - DNA, 201 bp, Homo sapiens; identical to SEQ ID NO: 9880

SEQ ID NO: 43483 - DNA, 201 bp, Homo sapiens; identical to SEQ ID NO: 9896

SEQ ID NO: 43484 - DNA, 201 bp, Homo sapiens
ttagattatagatgtatacactcattaataacaaggttcaaaaaatataaatatgtataaagtaaaaagggaaacttgcctgccatcacatcgctccacawccttctgtaagtgaccattgttcatgtttggtttggaaagacttttcctatgcatagacatgcacacacttcttttttgtagttagtgaaatcatactat

SEQ ID NO: 43485 - DNA, 201 bp, Homo sapiens
gctatggtcctccttgagaagaattccttactgtagttaacacctgctctaaataagcactctgaagtgcttcttacaaagggtaacgtgggccaggcacrgtggctcacacctgtaatcccaccactttgggtggccgaggcgggtggatcatgaggtcaagagttcgagaccagcctggccaacatggtaaaaccgagt

SEQ ID NO: 43486 - DNA, 201 bp, Homo sapiens
atgagagttcaataggttcatcgcccttgaagttgtggggaaagttttgtgcatttgcctttttctgggggtaaaattcttaatttcaatcggtttctctmacagatcttacgactaaaaaaaaaaaaaaatttacaaatcgctatgtttgaaccatacaccctaacttttgtgaaggcatatgtggtatttacatgacca

SEQ ID NO: 43487 - DNA, 201 bp, Homo sapiens
gatgagcttttacagttgttcctgacagcagtcaagtgttgccagaactccaatgtatagtttagtagagtttcccaagtgcctctctcctgggcccctcrcttctgacacacacagatctcttctttctcaacctgatgcactgttctgtctcatggaatgctgtgatgccctggacttgtgagctttgagagcaaacac

SEQ ID NO: 43488 - DNA, 201 bp, Homo sapiens
atgagtgactgcatgttcactgacactgctgatgcctcaccattctagcctcggccttttcccttcaccttgtgagatttggggccaggttctcacaacaygtacgaaatcccatggctgggtgggataagggtaggggagtataaaggaaatgctgttcccattgttttccactggagaattccctggactgacttcctg

SEQ ID NO: 43489 - DNA, 201 bp, Homo sapiens
aaatcaattgtgtgaggaagaaaaataaataaaatattttcccatttcatgtaaggataaggaagtgatcatttaatcattaggcatgacaaagcaagcaygctagatttggccaaaatgtaattatatacaatgtcagttgcacttaaaactaatttatacaattagtacacctaaaatgacatgttggttccaaatagt

SEQ ID NO: 43490 - DNA, 201 bp, Homo sapiens
agtatcattgcccactatgcacaacgcattatacacagtttggttccagagggactttagagatcatcttgtcaaacctgtcccaaggttttcctttcatratgtttatggagaaagaatttggcaggtctgtaataaaagaataaaggatggcttctttagcattgttttacatacaaaccatacgttgattacaaatga

SEQ ID NO: 43491 - DNA, 201 bp, Homo sapiens
aatgtatcctgcctacaaccaatcacttggtttgaacatttatcctggaatctcctgaatgcatatttctatcaaggttgatagcaacaacctcatagagygtagataggaaggaaaagaaaacaggatgatctagtaggaagaaagggacaagcatttataatactaaaatataactttgataacgtgcaactgctggat

SEQ ID NO: 43492 - DNA, 201 bp, Homo sapiens
atgtatcctgcctacaaccaatcacttggtttgaacatttatcctggaatctcctgaatgcatatttctatcaaggttgatagcaacaacctcatagagtrtagataggaaggaaaagaaaacaggatgatctagtaggaagaaagggacaagcatttataatactaaaatataactttgataacgtgcaactgctggatt

SEQ ID NO: 43493 - DNA, 201 bp, Homo sapiens
ccattttcattgctcaagttaacaactttgaactgaacttcggacaaattattacaatcaggtacaaggaaagagttctatacaccctttcttaagaatgyctttaaggctgggcgtggtggctcacgcctgtaatcctaacactttgggaggccaaggcgggtggatctcctgaggccaggagttcaagactagcctggc

SEQ ID NO: 43494 - DNA, 201 bp, Homo sapiens
agtgaaaaatgccaaacaacctaaatgttcaacaatagagtgaggacaaagtaaagcctgatacagtgaacgaatctgatatcaggagacctaaaagtgaygtttatggtgaccgtatatggaaaagtatattctgtatgatttccatgtgtttaactatgtattggaacattctgcaaaagagacacacaaagtggttgc

SEQ ID NO: 43495 - DNA, 201 bp, Homo sapiens
cccttctctcccatctcctcttccggattctcatctccctcttctgtcacttacatgttttgcagctacagacaggtactcagaaggtggcatggtaacgktttcctgcaggtcatgtctcatcgtgcccacaaaactgctgtctcaaccttcaattttgaaacattcacagcatgctgaattccacatataagtagggtt

SEQ ID NO: 43496 - DNA, 201 bp, Homo sapiens
agccatggtgctttctagaggaaatcagggaatcacatggtgcttcatggttctatatttctatcagtcgtgcatcattaattagttagccagcctggggyttctctttttactttttcaatgatttctctgtccggatgggttcatcatttctgcatactctgtagtgtcttctaaatgtcagtcatttgcacatgccat

SEQ ID NO: 43497 - DNA, 201 bp, Homo sapiens
acatggtgcttcatggttctatatttctatcagtcgtgcatcattaattagttagccagcctggggtttctctttttactttttcaatgatttctctgtcyggatgggttcatcatttctgcatactctgtagtgtcttctaaatgtcagtcatttgcacatgccatgtagcaaattcttactcttttacagtctcatgat

SEQ ID NO: 43498 - DNA, 201 bp, Homo sapiens
ttaatactctatgctatggagagatccagatggtcttggtccatgtgccctgagattttaaggttgaagatagacacaatggcagacatatgtgtggacartgtacagatagcagaataaaacactaagccaacacaagcatggtggcaaagtgttctataaatttcctctagggatttgaaattaaacatgaatgactat

SEQ ID NO: 43499 - DNA, 201 bp, Homo sapiens
taggtcactggaactgcccaaaatacattaaaccataggcttctatacagggaacatttttttaaactttttattgacatagtacacatttagattaagtstacaaatcctaaatgtataccttgattaatttttaataaagtgaaccaacatcacatagggaatcttaaaatataaatttattgatattttcttttttca

SEQ ID NO: 43500 - DNA, 201 bp, Homo sapiens
aggctctgtgccttcagtctgggcagtgcagttttatacacactgattttaggtttctcagtgtgatacatatcacacagggtgatagatattgtgggtaytacagtgtagaccatttctctgattaaagaaaaagggaatttggctgactgaaaaatttgttactttaacatctgtacctggtttttgtaaatgcttggt

SEQ ID NO: 43501 - DNA, 201 bp, Homo sapiens
cctggtggcaaaaggatataaggtcagctttggctttaacttgtggggaaaggaaattgggattctcctccagagagtgcaaacgtgttttgtaaggtggwaggtaggcttcaattggtttagaattttgcattttacagaactgaaagtgtttcataattattagtattatgtatttatgagtttttaacatattgttag

SEQ ID NO: 43502 - DNA, 201 bp, Homo sapiens
ggtatggattcctgtagaaggcagtaaggtttctgggaaaaggaatggcatgatagaagggaagagatgagtgtactgcctagatgggacagttgaatttkaaaaataaatatttccctaaaggaaaaagcggatacagagaaaagaatcagatcaaggagcttagagaatgccaatagttgggaataggagcaagaatac

SEQ ID NO: 43503 - DNA, 201 bp, Homo sapiens
ggatataaggtcagctttggctttaacttgtggggaaaggaaattgggattctcctccagagagtgcaaacgtgttttgtaaggtggtaggtaggcttcarttggtttagaattttgcattttacagaactgaaagtgtttcataattattagtattatgtatttatgagtttttaacatattgttagatatttagggtaa

SEQ ID NO: 43504 - DNA, 201 bp, Homo sapiens
gtagaaagagggcattccaggaagtgtggtcacaggatgagaaaagggaattgggaacatcgagttgactggagtgttaggaaaatatgggtcaagagtakcctgcaacagaatgtagtgcagaagagctgttcagtgagtatttgctgaatgattatgtttaaggccagagaggaagactggagctgtttcattgaggat

SEQ ID NO: 43505 - DNA, 201 bp, Homo sapiens
gagagtgcaaacgtgttttgtaaggtggtaggtaggcttcaattggtttagaattttgcattttacagaactgaaagtgtttcataattattagtattatrtatttatgagtttttaacatattgttagatatttagggtaaatttttaaactctatgatagtgtttcttagcaaattatccacccttgtcaactccttta

SEQ ID NO: 43506 - DNA, 201 bp, Homo sapiens
tcttagcaaattatccacccttgtcaactcctttaaaccctacatctgaacgttgtggactgattattttaaccatttcagaattgacgtttaaacatttygaaatgagtttttacaagtcattttttatcctttgatagcaatatttcttatttttgttgaaggtgggagttgtgaagcaaactgaaactgcagcattaa

SEQ ID NO: 43507 - DNA, 201 bp, Homo sapiens
tggttcgcttggcatacctgggtttcctcttcttcagtaaagtcatttttgatattggaagtcttgcgaatcttctcaggacttttctccttgattgtatkggcaacagtcttgtgtgtaacatcaagcaaacctttgatgtctaagtagtttgcaggcagaagtagtacaaaaagtattccttgatcgactttcaggaat

SEQ ID NO: 43508 - DNA, 201 bp, Homo sapiens
tcatccaagtgatgaagtgggttgatatttgggcctccatggggtctggtgtactccactaagccctttggaagtaagatactggttatctgtctttatgmtctttatatcttaggaaagataaggcatgcaactatgatccaaataaatcagaagaatgaatactgggcagaagatttttgcaaagggcagaagtactgt

SEQ ID NO: 43509 - DNA, 201 bp, Homo sapiens
tctggcctcacaatctaatcacctcccaccaggtctccccctcagcattggggattacaattcaacatgaggtttgggtggggacacagccaaaccatatyaatactctatgctatggagagatccagatggtcttggtccatgtgccctgagattttaaggttgaagatagacacaatggcagacatatgtgtggacaat

SEQ ID NO: 43510 - DNA, 201 bp, Homo sapiens
cgtccctatttgtgcaggcgaggccccgcccccccgccccggcgcacgcagggtcgcggcgtgctcgcgcccgcagacgcctgggaactgcggccgcgggytcgcgctcctcgccgggccctgccgccgggctgccatccttgccctgccatgtctcgccggaagcctgcgtcgggcggcctcgctgcctccagctcagcc

SEQ ID NO: 43511 - DNA, 201 bp, Homo sapiens
aggacagtgaaagaattgagatgtaggggagcatttggaatgtagatcagagaaagctcagagtagtagcgagctgggactgtaacagagtattctacctygggctgtgagcagaggtggcagagatgtgtggcatggtgcatttggctggccatgagagggggatgtgaagggaaatactttgaatgacatctagtttaa

SEQ ID NO: 43512 - DNA, 201 bp, Homo sapiens
aaggtaaaaggaattctttttggggtgtttaatctgaaattataaaattttgaaattaaaggcattttaaaaccaaggttaccattgtttttaagaacacrgttttaaattggagaacattttattttagaactgagcaatagactggctctctagtattacaaggatttttttcctcattctcgtgaatgagcctgcctg

SEQ ID NO: 43513 - DNA, 201 bp, Homo sapiens
gttagaggatgagttgcccagtcagcacagtgtggattttctttgaaggaaaatacctgtgtccttcgtaagtgtcctacacatgctttatagacagggcyagggaacactgtcatgtgagcctgtagaaatttagaatttttctggattgttctcttgattctcatcagtgtttccacggaaattgaaagattgctacag

SEQ ID NO: 43514 - DNA, 201 bp, Homo sapiens
attttgacataatgtgtgaatgattgttactttattacatatataatatatataatacatatatacaaaaaatataatacaaatatatatatatatatatatattttttttttcttttttttaagacagagtctcttttcgtcagccaggctggagtgtagtggcgcaatcccggtctactgcaacctccgcctcccgggt

SEQ ID NO: 43515 - DNA, 201 bp, Homo sapiens
ttttgacataatgtgtgaatgattgttactttattacatatataatatatataatacatatatacaaaaaatataatacaaatatatatatatatatatatattttttttttcttttttttaagacagagtctcttttcgtcagccaggctggagtgtagtggcgcaatcccggtctactgcaacctccgcctcccgggtt

SEQ ID NO: 43516 - DNA, 201 bp, Homo sapiens
tctaggttggagaggtttgttgtttttttttttttttcctctcaaaactttagatattttactccactcttttcttgcttttgtggtttctgagaagtcaratgtaatttttatctttgagcttgtgtggataaggtgtttcttccctctggcttacttcagtattttttttttctttatctttggttttctgtagtttga

SEQ ID NO: 43517 - DNA, 201 bp, Homo sapiens
gtaaaagcttttattcttcaaagaacaccatcaagaaagtgaaaagacaatccactgaatagaagaatttttgtaaatcatatatccagtaagggacttgyatctagaatatatatatatatataaactcttacaagtcaatggtaaaaagataactcagaaaatggacaaatgatccatacaggtttttctccaaaggat

SEQ ID NO: 43518 - DNA, 201 bp, Homo sapiens
aaacttcttatgataacagaatgataacatgtggtgattacctttacttactagtgaaagaaatagcttaatatataagctactctcatgacatctaatgkctagcagccagggatgctgctaaacatcctaaaatgcacaggatatttccctaaaaaacacattatttggctccaaatttcaacactccaaaaccaaaca

SEQ ID NO: 43519 - DNA, 201 bp, Homo sapiens
ttttaggagatattgtccaaattattattttggtaaccattaagttttacttaaaatttgtgtttaataatgctaacaagttaatggttctgtttattacrttttttaatttgattaatttaaaagaatttttataacaagttaatatattctgttttctaggttctcaaattatttctggcattgttaacttagagaagc

SEQ ID NO: 43520 - DNA, 201 bp, Homo sapiens
ttgatagcatatagggtttaatcatgattgttacctatgtttatttaatatgcatggggctcttacattatctgtacaaggggtcttcagaaagttcatgkaaaatgcatattatgaaaaaactttgcatagatttcaaaaaattttggcaccaaaataaactcatactaacttgttagagcatgtctcaataggatgtag

SEQ ID NO: 43521 - DNA, 201 bp, Homo sapiens
tgggagagaatacaagattcatgtatttaattttcataataaaaacactgctcatatggcactcttaatcttcagtgcacattaaattttttttttccatggagctttaaaaaaaatactgatgcctgaaccctacctccagaaatctttttttgttttgttttgttttgttttgtttttattgatcattcttgggtgttt

SEQ ID NO: 43522 - DNA, 201 bp, Homo sapiens
ggtacacacatccttgacatgcagtttggagtatttctagacaaaggggatgggcattttacattttgaaaaaacaacctgttcttcaaaaaaggttcatyccaccatcagaaaaatgccctttttttccatgccctgggtattagtaatgatttacatttttccaaaggtcaattttaggagatattgtccaaattatta

SEQ ID NO: 43523 - DNA, 201 bp, Homo sapiens
gctttaaaaaaaatactgatgcctgaaccctacctccagaaatctttttttgttttgttttgttttgttttgtttttattgatcattcttgggtgtttctygcagagggggatttggcagggtcataggacaatagtggagggaaggtcagcagataaacaagtgaacaaaggtctctggttttcctaggcagaggaccct

SEQ ID NO: 43524 - DNA, 201 bp, Homo sapiens
tttagttttagaaagcctcaaatagctttatcttcatatttgctttgaaagtttagatgaatataaatatccagattttaaatttaaagaaattgctcccrttatcttccagtattacattcaatgtagataaagtcagtaagagtctgattctcatcccttgcttaatgatgaattttttctttctctgaggcatttaga

SEQ ID NO: 43525 - DNA, 201 bp, Homo sapiens
tctaggcatcagtgtcttgttagcatgtctctttaatttcatgatgccttggtcaaataaagtgtctgagcgtgtatcccacttctttttatttttttctrtaaggtctcactctgtcacccaggccggagtacagtggtgcaatcttagcccactgcaacctctgtctcttggactcaagcagtcctcccacgtcagcct

SEQ ID NO: 43526 - DNA, 201 bp, Homo sapiens
agctgttagtaaaagtgaaggtggagaggaaaaactaggctattggaacagcttcgaccaaagagtgtaaattagtgaaactagtttgcaagaatactagrgacaggggtcaggcacggtggctcacgcctattatctcagcactttgggaggctgaggcaggaggatcacttgagctcacaagttcgagaccagcctagg

SEQ ID NO: 43527 - DNA, 201 bp, Homo sapiens
gatttggcagggtcataggacaatagtggagggaaggtcagcagataaacaagtgaacaaaggtctctggttttcctaggcagaggaccctgcggccttcsgcagtgtttgtgtccctgggtacttgagattagggagtggtaatgactcttaatgagcatgctgccttcaagcatctgtttaacaaagcacatcttgcac

SEQ ID NO: 43528 - DNA, 201 bp, Homo sapiens
aagagctcactgttgttgtgctcatcagaaacactattgtactgcagtcccagctactggttagactgaggtaggggaggatcgcctgagcccaggagttmgaggcagcaatgagctattatcatgccattgcagtccagccggggcaacaaagcgagatcctgtctgttaaaaaacaaaaagaaccattgcagcctcttt

SEQ ID NO: 43529 - DNA, 201 bp, Homo sapiens
ggatgataaggcttccagtccacagaaagagaggggtgaagatgattccagtataatggaaccatgagaacacacagaggaataaaggtgtgtcacatcasctctttgaatatgccacaaaaaaaaaaaaaaaaaaaaggctctgaattagttttccctcagtatctgctggggactggtttcaggaccccccagtatgaa

SEQ ID NO: 43530 - DNA, 201 bp, Homo sapiens
gaacaaaggtctctggttttcctaggcagaggaccctgcggccttccgcagtgtttgtgtccctgggtacttgagattagggagtggtaatgactcttaaygagcatgctgccttcaagcatctgtttaacaaagcacatcttgcaccgcccttaatccatttaaccctgagtggacacagcacatgtttcagagagcaca

SEQ ID NO: 43531 - DNA, 201 bp, Homo sapiens
ttgatcttatagttcaaatttaacttttatactcaaggttttattctggacatatgttcttaaaatctatgtttaaagttttgttttctgtcgtacaaacagagtactgaaatttttcatgctatcttagagttttttttttaaggctatttccatgcctagtaaattgaaacatatttcttttttgcagaccaactgtac

SEQ ID NO: 43532 - DNA, 201 bp, Homo sapiens
attactattccctcatttttcttgatatgatgccaattttttgcaaatataaacagtcatatttgtgacttgtctcatactcaactcctagtgcacacaagggagtttttctcaatctaggagtggagttgttggattgtaaggaacatgtgtctttcatgatctccaaggaggctgtaccagcttagaatcccaccacca

SEQ ID NO: 43533 - DNA, 201 bp, Homo sapiens
tgatcttatagttcaaatttaacttttatactcaaggttttattctggacatatgttcttaaaatctatgtttaaagttttgttttctgtcgtacaaacagagtactgaaatttttcatgctatcttagagttttttttttaaggctatttccatgcctagtaaattgaaacatatttcttttttgcagaccaactgtaca

SEQ ID NO: 43534 - DNA, 201 bp, Homo sapiens
gttttactcttgttgcccaggctggagtgcagtggcataatcttggctcactgcaacctctacctcctgggttcaagcgattctcctgcctcagcctcccragtagttgggattacaggcatgtgccaccacgcccagctaatttttgtatttttagtagagacggagtttcaccacgttggtcaagctggtctcgaactc

SEQ ID NO: 43535 - DNA, 201 bp, Homo sapiens
tccattgccacatcatcagatgttgaaggcacaggcatggatttctttcattctaataccatctttttttttttaatgctaccagaagctgtactttagatttgagtattgttgattctaggggatgttttctctttttgcaggcattctttcctttatctgtttttgtcctgtaccacagctaatgaatgaaatatgcat

SEQ ID NO: 43536 - DNA, 201 bp, Homo sapiens
agtttcaccacgttggtcaagctggtctcgaactcctaacctcaggtaatccacctgcctcggcctccagaagtgctaggattacaggtgtgagccaccgsgcccgcctccagaatcttttatctgaatactataacctcacacgaatcttttcctgaataagaagcagatttttttaaaaagtagagttttggcaaacac

SEQ ID NO: 43537 - DNA, 201 bp, Homo sapiens
cactgactgtggagtatttgtactctatacaaaatatattctttatggacagaaagaaaacatcttgaatcagtccacaccttctaattagttgtaaataccagtactaaaatccacatgataagtgagcactaaatgagtaagttgttatgattttattggcattaaaaatgtcatcttatcaatatctctgtgctttct

SEQ ID NO: 43538 - DNA, 201 bp, Homo sapiens
tattctttatggacagaaagaaaacatcttgaatcagtccacaccttctaattagttgtaaataccagtactaaaatccacatgataagtgagcactaaatgagtaagttgttatgattttattggcattaaaaatgtcatcttatcaatatctctgtgctttctttaactgtgtctagcaaacactagttatcttatttc

SEQ ID NO: 43539 - DNA, 201 bp, Homo sapiens
gttacagagttttatgcaaaagatacagttgacatcaaaggtaaatattttccctgtatgtcctcaagttgaactgatttgaaatttggataaaggtattmgtatgattctcaatttaatgatgactaggtagttattataaatatgtgggagaagaagagctcactgttgttgtgctcatcagaaacactattgtactgc

SEQ ID NO: 43540 - DNA, 201 bp, Homo sapiens
aattatgatataaagccaggtataagatgttattcagttgttttctagtaatcaagctagaataaataaactatacatttcttaaaggaaattaacaggaratacgtttatcaataaacagttcccacaattataaatgcatacttccccagtagccttgatgactggttcatgagccagtatttcttcagtgtgtattca

SEQ ID NO: 43541 - DNA, 201 bp, Homo sapiens
aaaaagtactcattttaatattttatgaaatagagcattttggcagagaaactttagctctttctttctctctctttcttcaacttgggaaagaataaggmataaatctttatcttttttttttcttcttctggccaagacctaaataccagcatttcatgataatggataagttatctttgaaattttccttttttcttt

SEQ ID NO: 43542 - DNA, 201 bp, Homo sapiens
attcttccagtctacgggaagcctgaaatccacctcctcctccacaggtgcagccgaccaggtggaccctggcgctgcagcggccgcagcgcccccagcgsccgccttcccgccccagctgccgccgcacgtagtaggttctgtctgggactgggcagggccatcggggctgggggggcggggcttgtgggtaaggcgggc

SEQ ID NO: 43543 - DNA, 201 bp, Homo sapiens
agatcatcagaggcatctacaaatgagtagtcaccagtgacaaaatctcaaagcgaggcaggctggagaatgggcgatctgttagtcttgccagagaggarggtattagcaaaggcagattgaataagcggaaggtaaaaaaataaaaagcagcaatagcattttttttttacatatacttcattagcacaggtttggctt

SEQ ID NO: 43544 - DNA, 201 bp, Homo sapiens
ttctttcaatctttcaaatctcctctttcatttctttttgactttgaaaaaaatttccccctttcatttcctgcttcttatctttattatctgtagtattkattcagttgtgtgccttctagactatcgttcattctgagaagttttccttttgtctctaattcctgagttctgcccgttgatttctgagtttttctaaat

SEQ ID NO: 43545 - DNA, 201 bp, Homo sapiens
tttgagccgattcttccagtctacgggaagcctgaaatccacctcctcctccacaggtgcagccgaccaggtggaccctggcgctgcagcggccgcagcgsccccagcgcccgccttcccgccccagctgccgccgcacgtagtaggttctgtctgggactgggcagggccatcggggctgggggggcggggcttgtgggt

SEQ ID NO: 43546 - DNA, 201 bp, Homo sapiens
ttataaatgcatacttccccagtagccttgatgactggttcatgagccagtatttcttcagtgtgtattcagcattgctacttccattggtactgcatccrtaccatcaggtgctatggaaaaatagaattgtaatagaaaatgtgttggctcctaatgcagtggccttcaaactaccctccagggtgtgagtcccacaga

SEQ ID NO: 43547 - DNA, 201 bp, Homo sapiens
aagcggttttgagccgattcttccagtctacgggaagcctgaaatccacctcctcctccacaggtgcagccgaccaggtggaccctggcgctgcagcggcygcagcgcccccagcgcccgccttcccgccccagctgccgccgcacgtagtaggttctgtctgggactgggcagggccatcggggctgggggggcggggct

SEQ ID NO: 43548 - DNA, 201 bp, Homo sapiens
aaaataatgttcggcttcctaataagaaagtgaagaggaaaatcaaggtgttttcatcttgcttgtaggatgggtgctgcagacaatatatataaaggacrgagtacatttatggaagaactgactgacacagcagaaataatcagaaaagcaacatcacagtccttggttatcttggatgaactaggaagagggacgagc

SEQ ID NO: 43549 - DNA, 201 bp, Homo sapiens
aatttgtctcatttacatttttctaaattaagtctaataagcgaggaattttccctaagctgtgaattggaattaattatggttcctcacagaaaggtaasaatagtaggagtactaatgttgaaaatgtggccttgtgctgtaaattttttaacagctctttctcatgtttctttaccaagagaatcatggttctttctt

SEQ ID NO: 43550 - DNA, 201 bp, Homo sapiens
ccacaattataaatgcatacttccccagtagccttgatgactggttcatgagccagtatttcttcagtgtgtattcagcattgctacttccattggtactrcatccataccatcaggtgctatggaaaaatagaattgtaatagaaaatgtgttggctcctaatgcagtggccttcaaactaccctccagggtgtgagtcc

SEQ ID NO: 43551 - DNA, 201 bp, Homo sapiens
attctttatggacagaaagaaaacatcttgaatcagtccacaccttctaattagttgtaaataccagtactaaaatccacatgataagtgagcactaaatgagtaagttgttatgattttattggcattaaaaatgtcatcttatcaatatctctgtgctttctttaactgtgtctagcaaacactagttatcttatttca

SEQ ID NO: 43552 - DNA, 201 bp, Homo sapiens
atagacctattcagaatttctgttttttttcttgtgtgagttttggctcattgtgtcttttaaggaattgtttttcaagaaattttcaccaaggttaccaratttgtggacatagagttggtcatagtattcctttattatccttttatttgtccacagcatccgtagtgttgtccttttcatttctgatattagccattt

SEQ ID NO: 43553 - DNA, 201 bp, Homo sapiens
ttttaaggaattgtttttcaagaaattttcaccaaggttaccaaatttgtggacatagagttggtcatagtattcctttattatccttttatttgtccacrgcatccgtagtgttgtccttttcatttctgatattagccatttgtgtcttttctcttttgttcttagttagcttgactagaagcttatcagttttctttt

SEQ ID NO: 43554 - DNA, 201 bp, Homo sapiens
ttctttatggacagaaagaaaacatcttgaatcagtccacaccttctaattagttgtaaataccagtactaaaatccacatgataagtgagcactaaatgagtaagttgttatgattttattggcattaaaaatgtcatcttatcaatatctctgtgctttctttaactgtgtctagcaaacactagttatcttatttcat

SEQ ID NO: 43555 - DNA, 201 bp, Homo sapiens
tctttatggacagaaagaaaacatcttgaatcagtccacaccttctaattagttgtaaataccagtactaaaatccacatgataagtgagcactaaatgagtaagttgttatgattttattggcattaaaaatgtcatcttatcaatatctctgtgctttctttaactgtgtctagcaaacactagttatcttatttcatc

SEQ ID NO: 43556 - DNA, 201 bp, Homo sapiens
ttcctacatgtgtcttccactgtttttctgtcttatgtggttttaactgagtattttatattatttcattttctctctttttttttttttttgttttttgktttttggtttcttggggtgttttttgaggtgggatcttactgtgttgcctaggctggcctcaaactcccgggctgaagtgaccttcccacctcagcctcc

SEQ ID NO: 43557 - DNA, 201 bp, Homo sapiens
aaatgactgttaaacattttggcacattatttccatgtgtgtatatcacttttttccatttgtgaacttgcattcctgctgcaaaatcacttttgtattcygtggtttttttttttttaactttacaattccccatttttaaaaactttattgcagaaaatttcaaacatacacaaaattatacagaatagtgtcatgaac

SEQ ID NO: 43558 - DNA, 201 bp, Homo sapiens
gtttttagcaacctgaagtgaatgggaacatcttcagtttcagaaagcacacaaaataaactaactcttaaaacctctccaggttgggcgtggtggctgamtcctgtaatcccagcactttgggaggccgaggcgggtggatcacgaggtcaggagatcgagaccatcctggctaacacggtgaaaccctgtctctactaa

SEQ ID NO: 43559 - DNA, 201 bp, Homo sapiens
aatgtttttcatattgctagaagaaggctagttatttctgccttgtcttaacagaatgatacgatataattcttaaatgtatcatttgtgatttttaaaamtaacatttgtttttctaattacacaagtaatgcatgttcattatgcaaaattttaaactcaaaattttttaatcacttgtaattccaccacctggagatc

SEQ ID NO: 43560 - DNA, 201 bp, Homo sapiens
ttttaactgagtattttatattatttcattttctctctttttttttttttttgttttttgttttttggtttcttggggtgttttttgaggtgggatcttaytgtgttgcctaggctggcctcaaactcccgggctgaagtgaccttcccacctcagcctcccaggtagctgggagtacaggtgcatggcactgtgcccagc

SEQ ID NO: 43561 - DNA, 201 bp, Homo sapiens
gctgtaatctcatcatttattgtcttctgcctacttcagatttaatttactttcctgtttctggtttgcccttgaactcttatttttaagaatctctacargtgactctgatgcacaaatttaggagccattgtttgcattttaatttctaacattttataggaagaaaaacaggatcagagagagattttgttttgcatg

SEQ ID NO: 43562 - DNA, 201 bp, Homo sapiens
gcgggtggatcacgaggtcaggagatcgagaccatcctggctaacacggtgaaaccctgtctctactaaaaatacaaaaaaattagccgggtgtggtggcggggcgcctatagtcccagctactcgggaggctgaggcaggagaatggcgtgaacccgggaggcggagcttgcagtgagctgagatcgcgccactgcactc

SEQ ID NO: 43563 - DNA, 201 bp, Homo sapiens
agcattttaaaagctcatgctaagcttaaatgtaagaatctactgtatggcttgtaatcttagtttcatgtaattgtttcattagaatatgttattgtaartcacttcaaatgctttttgtactcaatggaaaaaatattaaaatctagcagaatgagatatttgcataagatttagctccaagctgtatctgtaaataga

SEQ ID NO: 43564 - DNA, 201 bp, Homo sapiens
gatcgagaccatcctggctaacacggtgaaaccctgtctctactaaaaatacaaaaaaattagccgggtgtggtggcggggcgcctatagtcccagctacycgggaggctgaggcaggagaatggcgtgaacccgggaggcggagcttgcagtgagctgagatcgcgccactgcactccagcctgggcgacaaggcgagac

SEQ ID NO: 43565 - DNA, 201 bp, Homo sapiens
attttatccctaggatataattatatcccattaaattatatccctaggatatagtttaatattacgcccttgtagctttcattgattttttatgaaataawtcagacgtataataatcctccatgcaccttctaccctactaaagaaataaaacactacaatacaatcgaacctctaatcctccctaatcccattgccctc

SEQ ID NO: 43566 - DNA, 201 bp, Homo sapiens
tgagctgtgtacctaagaaatgctaaaatggtaaattttattatttttatatatatatatcataatttttaaaagcacttgaagtatgtccaataatactrttgtaataggaataatcattgcctctacttaacaattttaatatttaagctctagttatcattcaatatgaaaagtcctcttttcctaattgcagtattt

SEQ ID NO: 43567 - DNA, 201 bp, Homo sapiens
ggactacaggagcgtgccaccacacccagctaatttttgtatttttagtagagatggggtttcaccatgttggccaggatggtctcgatcacttgacctcrtgatccgcccacgtcagcctcccaaagtgctgggattacaggcgtgagccacctcgcacagccaaactttcttgttaatgtatatcttgtcttgcttcta

SEQ ID NO: 43568 - DNA, 201 bp, Homo sapiens
ggggtttcaccgtgttagccaagattatctcaatctcctgaccttgtgatgcgccctcctcggcctcccaaagtgctgggattacaggcatgagccactgygccggccaaaaaattaacattaatttatgaatatatttgaatttcttgaattttcccaatgtccccccgccaccggctttagattttaaaatgaaagacc

SEQ ID NO: 43569 - DNA, 201 bp, Homo sapiens
taactaagaagaaaatatgagaccgggtatggtggctcatgcctgtaatcctagcactttgggagcctgaggtgggtggatgacttgaggtcaggagttcragaccagcctagccaacagggtgaaaccctgtctctactaaaaatacaaaaactagctgggcatggtggcacattcctatagtcccagctactcgggagg

SEQ ID NO: 43570 - DNA, 201 bp, Homo sapiens
gttcgagaccagcctagccaacagggtgaaaccctgtctctactaaaaatacaaaaactagctgggcatggtggcacattcctatagtcccagctactcgkgaggctgaggcacgagaattacttgaaccctggaggtagaggttacagtgagctgagattgcaccaccgtactccagcctgggcaacagagagactgtct

SEQ ID NO: 43571 - DNA, 201 bp, Homo sapiens
tgtgatattcgtcttttggtacctggcttattttacctaacataatgacctcagttccatccatgttactgcaaaggacagggtttcattttttggggggsgctgaatagtattccattgtgtgtatattccacattttcattatctgttcatccattgatggacacttaggctgagtccataacttggctgttgagaata

SEQ ID NO: 43572 - DNA, 201 bp, Homo sapiens
taaagaaagttgaggtctcccaggctaatcatcctggtgttattcttgattctttcttccttttggtccctttatctgttaccaagttctttttttttttyttttcctcgctctgccacccaggctggagtgcagtgatacaatcatgactcattgcaatctctacctccccagctcaagcaatccttccacctcagcccc

SEQ ID NO: 43573 - DNA, 201 bp, Homo sapiens
tatgagatcaacttttttagctcccacatttgagtgagaacatgtgatattcgtcttttggtacctggcttattttacctaacataatgacctcagttccrtccatgttactgcaaaggacagggtttcattttttggggggggctgaatagtattccattgtgtgtatattccacattttcattatctgttcatccattg

SEQ ID NO: 43574 - DNA, 201 bp, Homo sapiens
cgtttgcaactaatccaagtctactttcaaataacactatattgctttatgagtaatgcacgtattttttaataacaaaataatcctgattactttcttcyatcctttgcaccatcactgtcatttatttcacttatacttaagtgtacataagcatatatatatataaacatacataatcgcatacactgttgctattat

SEQ ID NO: 43575 - DNA, 201 bp, Homo sapiens
cttcagttttgaaggattattttgcaaggtacagaattctaggttggagaggtttgttgtttttttttttttttcctctcaaaactttagatattttactmcactcttttcttgcttttgtggtttctgagaagtcagatgtaatttttatctttgagcttgtgtggataaggtgtttcttccctctggcttacttcagta

SEQ ID NO: 43576 - DNA, 201 bp, Homo sapiens
ctaacttgggggacagtggtttgcctgtgacttcatttttcttacagatctaaagagttgatttttcagttggttctactttttccttgtgatggagaggyaacctccaaccttcttatatgctaaactggaaaccagaaacttccctgacctttttatggatgaaaatctttattttcatggttccttctgatctctgga

SEQ ID NO: 43577 - DNA, 201 bp, Homo sapiens
aacagccttaaggaactggcccaattgccaatcactgtgtgaaagaacaaccaccaaatttgttgtttcagcatagtaggattcattctcaatttattccrtcaaacatactagttttttagctacttcgggatatattttgcagtgacttggtcctggtgggtagtgttatgtggaaagatacgcttgttacaatatgtg

SEQ ID NO: 43578 - DNA, 201 bp, Homo sapiens
gtccacagaaagagaggggtgaagatgattccagtataatggaaccatgagaacacacagaggaataaaggtgtgtcacatcagctctttgaatatgccamaaaaaaaaaaaaaaaaaaaaggctctgaattagttttccctcagtatctgctggggactggtttcaggaccccccagtatgaaaatctgcagatgatcac

SEQ ID NO: 43579 - DNA, 201 bp, Homo sapiens
agagtaaaatcctagacttcacacagtttttgataggtcaataggattctcagatctcttgctaatattaattacctgcaaaatgtgagtaaaccggctgygtatgggaaagaataggggctttagatctagaaaactcaagattctgtacaagttctccagcatcctggccatgtgcaagttacttcatccttctagaac

SEQ ID NO: 43580 - DNA, 201 bp, Homo sapiens
tattgagtgtaataattgtattctagttatataggaggatgttttgttcttagaagatagaatcttaaatctttagtgatgaagtgtcatgatgtctgcarctaattctcagatggttcaggaaaaaatgtctgtgtctgtggaggaggaagaagaagggaaatatggtaaaatattaacaattgattatctaggtaaaca

SEQ ID NO: 43581 - DNA, 201 bp, Homo sapiens
cagcgtaggggcattttcttaagttattttatgtcattacctttgttgtttgtatcttttgcacttcctatttgagcagctttcaactgttaggacatggyctccgtgttttaaatctatttgtttgtactttacatttcttggtctttctcattgctgttctcagagatttctttgaatttatcttccaggtttaaaaac

SEQ ID NO: 43582 - DNA, 201 bp, Homo sapiens
cagaaagagaggggtgaagatgattccagtataatggaaccatgagaacacacagaggaataaaggtgtgtcacatcagctctttgaatatgccacaaaaaaaaaaaaaaaaaaaaggctctgaattagttttccctcagtatctgctggggactggtttcaggaccccccagtatgaaaatctgcagatgatcacatccc

SEQ ID NO: 43583 - DNA, 201 bp, Homo sapiens
agtatctatcttagttcataactggttatcctatgccatcatgctatttgttcactatttgagggaaagaactctactccattgtgtattccctgccccaytcaggatggcagtaagtacagctactaatataaattaaagtcattcagaaatgaaattattttcacatttatattacattgttttcacttcatcctggaa

SEQ ID NO: 43584 - DNA, 201 bp, Homo sapiens
gttcaccaacagggaagaagaggagtcagtgccgctaatacgcatttgatgtgaactgaaaactaacccagagcattgtacctttcccttaaatgttctgkgcattttattttattgattttaatttttgtgttttgttgagatggggtgtcactgtcatccaggctggagtgcagtggcacgatcatagctcactgcaga

SEQ ID NO: 43585 - DNA, 201 bp, Homo sapiens
gctgaggtgggagttcgcttgaacctgggaggttgaggctgcagtgagccaagatcgtaccattgtactccagcctgcgtaacagagccagaccttgtctaaaaaaataaaataaaaatgctggggactggatattgcatcttaaaggggcaaggaaaatgaaagaaaatgctgaattctcattttcatatttatagaaca

SEQ ID NO: 43586 - DNA, 201 bp, Homo sapiens
gactacaggtgcacaccaccatgcctggctgatttttgtatgttctgtagagacaggctctcactatgttgcccaggctggtctcaaactgttgaattcaygtgatcctcctgccttggcctcccaaagtgctgggattacagggatgagctaccttgcctggctgattttaatttttatcaatgaacataatttttaaaa

SEQ ID NO: 43587 - DNA, 201 bp, Homo sapiens
ctcattgttcagttcccacctatgagtgagaacatgcagtgtttgattttctgtccttgcaatagtttgtgagaatgatggtttccagcttcatccatgtycctacaaagtacatgaactcatccttttttatggctgcatagtattccatggtgtatatgtgccatattttcttaatccagtctatcattgatggacatt

SEQ ID NO: 43588 - DNA, 201 bp, Homo sapiens
tggtttccagcttcatccatgttcctacaaagtacatgaactcatccttttttatggctgcatagtattccatggtgtatatgtgccatattttcttaatscagtctatcattgatggacatttgggttggttccaagcctttgctattgtgaatagtgccacaatgaacgtacgtgtgcatgtgtctttatagcagcatg

SEQ ID NO: 43589 - DNA, 201 bp, Homo sapiens
ccatttgagaaagagataagatccctcgtgtaggataggcattgtttcaaactgtgcgtatgaaatcagtgcattgaattgcaattagcattttggggtartacttcctagatagtgctttgtgttccacatcatggcatatcagggtgcaaccaatgtccagttgacccaaataagctttttttttttaatgcagtagaa

SEQ ID NO: 43590 - DNA, 201 bp, Homo sapiens
aacgtacgtgtgcatgtgtctttatagcagcatgatttataatcctttgggtatatacccagtaatgggatggctgggtcaaatggtatctctagttctaratccttgaggaatcgccacactgtcttccacaatggttgaactagtttacactcccaccaacagtgtaaaagcgtttctgtttcttcacatcctctccag

SEQ ID NO: 43591 - DNA, 201 bp, Homo sapiens
atatacccagtaatgggatggctgggtcaaatggtatctctagttctagatccttgaggaatcgccacactgtcttccacaatggttgaactagtttacastcccaccaacagtgtaaaagcgtttctgtttcttcacatcctctccagcatctgttgtttcctgtctttttaatgatcattgttctaactggaatgagat

SEQ ID NO: 43592 - DNA, 201 bp, Homo sapiens
gcacctgcaggacagctctgagctgccctcagccctctccttggcctccttcccatgttcatcagtgtccaaagtccagagggggccgaggcagcaggggkctggcatgttagcactgccctgagcatgtgcacacccagccaggttgcaacagttcctaggcttggccttaactttgagatcagagtgggtgctgggagc

SEQ ID NO: 43593 - DNA, 201 bp, Homo sapiens
ctgtcttccacaatggttgaactagtttacactcccaccaacagtgtaaaagcgtttctgtttcttcacatcctctccagcatctgttgtttcctgtcttyttaatgatcattgttctaactggaatgagatggtatgtcattgtggttttgatttgcatttctctggtgaccagtgatgatgagcattttttcatatgtc

SEQ ID NO: 43594 - DNA, 201 bp, Homo sapiens
tcttaaggccttttaaaattagattatatcgaattaattttttttgaggttctgtctttggacttctttcagttgatatagtcttgtcaattttttatttacacacacacacacacacacacacacacacacccatatgtatgtcattggttttgtcaaaaagcctgaaaatgcaaattctgcttgtaaatattggtagag

SEQ ID NO: 43595 - DNA, 201 bp, Homo sapiens
cttaaggccttttaaaattagattatatcgaattaattttttttgaggttctgtctttggacttctttcagttgatatagtcttgtcaattttttatttacacacacacacacacacacacacacacacacccatatgtatgtcattggttttgtcaaaaagcctgaaaatgcaaattctgcttgtaaatattggtagagg

SEQ ID NO: 43596 - DNA, 201 bp, Homo sapiens
aatgagagcttctttgtgcattttcatcaagtgcattctcctcaggaatatatctccttgaaaagaaaaaatggggtgtatttgcagtaggtttattgatrgtcgaataggaagaaacagcatttgagaagtgtggagaaaagatcttcctgattactacagagacctcctaaagtggggccagactgcttgaacagaaag

SEQ ID NO: 43597 - DNA, 201 bp, Homo sapiens
gaacatcacactctggggactgttgtggggtggggggaaggggggagggataacattgggagatatacctaacgctagatgacgagttagtgggtgcagcrcaccagcatggcacatgtatacatatgtaactaacctgcacattgtgcacatgtaccctaaaacttaaagtataataataattaattaattaattaaaaa

SEQ ID NO: 43598 - DNA, 201 bp, Homo sapiens
cttagccccctgagtggctgggactacaggcctgcaccaccatacccagctatttttgtatttttagtagagacagggtttcaccatgtgggccaggctcrtgttgaactcctgacctcaagtgatccacctgtctcggcctcccacagtgctgggattacaggtgtgagccaccacgcccggccagcactacactttcta

SEQ ID NO: 43599 - DNA, 201 bp, Homo sapiens
caatcctgttactgggtatatacccagagaaatataaattgttgtgtcataaagacgcatgcacacgtatgttcattgcagcactattcacagtagcaagrcatggaatctacctaaatgcttatcaacggtagactggttaaagaaaatgtggtacaaatacactgtggaatactatccagccataaaaaacaataagat

SEQ ID NO: 43600 - DNA, 201 bp, Homo sapiens
tctataatactctatttcctatgatgtgataggtaaaacaatggacaaacagttaagaaacctgtgttttagtctattccaatctgtatgatcttgaacargtcacctaacttcactcacccctaaatttttatgaatctgttctaaaagcaacttcagaaattatttgtcagtacacatctctttaataactgcttagag

SEQ ID NO: 43601 - DNA, 201 bp, Homo sapiens
actaggctattggaacagcttcgaccaaagagtgtaaattagtgaaactagtttgcaagaatactagggacaggggtcaggcacggtggctcacgcctatyatctcagcactttgggaggctgaggcaggaggatcacttgagctcacaagttcgagaccagcctaggcaatgtggcaaaaccccatctctaccaaaaata

SEQ ID NO: 43602 - DNA, 201 bp, Homo sapiens
tgccaggtaaacattttaataatgtccatttaagaaatggccatagcttgtaagtagttacatcctcatcaagaacttttgctgtgagcctgtaaagaaayagagtttttctcataaaacaagttttattctctcccatgtggctttttctgactccatatttccatcctaccagcacccccaacccctctcgcacacaga

SEQ ID NO: 43603 - DNA, 201 bp, Homo sapiens
aagagaatagaggaacatgttaaacaccaccataggggtactgtcagcaaaatctagactgtgggaaactataggacaaatgactggtgtttttttttttytaacaaataaatagcaatgacaaaaaaaaaaaaaaaaaaaaaggtgggggagagagggaagagaacctgcatattaaaagagagttaaagaccagtcacc

SEQ ID NO: 43604 - DNA, 201 bp, Homo sapiens
gactccatatttccatcctaccagcacccccaacccctctcgcacacagaggttaaaggagtacataattacagaaagagatcccccaggcgattatagawgagtggttgcgttctttaccttgaagatatgagaactaccataatttaaagtggagaccagcatataatgatacactcagcaactgtttgtatgttaaca

SEQ ID NO: 43605 - DNA, 201 bp, Homo sapiens
gtccaagatctcctgaacactggcctgccctccttaagaaagaaaccctataataccatgaggcatgtaggggtgactcaaaaaactccaggccagaaacyagaacacctaataagtatttgtctcttgtctgccacagattagccctgtcaccttgaggaagtggcttgacctctgaaatgtcttatctcatctataaaa

SEQ ID NO: 43606 - DNA, 201 bp, Homo sapiens
ccatctaaaaagaaaatcaaactgaaactgttcagacctctagatctagataccaatttacaagagaaaaagagaatagaggaacatgttaaacaccaccrtaggggtactgtcagcaaaatctagactgtgggaaactataggacaaatgactggtgtttttttttttttaacaaataaatagcaatgacaaaaaaaaaa

SEQ ID NO: 43607 - DNA, 201 bp, Homo sapiens
ctttttccttagtattaccactgagaatgtgaaaactgaactaaaattacacctttcagtcttcaaggactcacattctagaagggtcctgggatttggtkaggtaatttcatgttcattctattcagaccttacataatttcatagatctggcttctattctcttgtcattattccagactaaagaaagttgaggtctcc

SEQ ID NO: 43608 - DNA, 201 bp, Homo sapiens
acaaaggatttaacagctaaaaagatattttgaaacctctgacctagtactagagtcaagaccattgcctaataaaagtatgtccaagatctcctgaacaytggcctgccctccttaagaaagaaaccctataataccatgaggcatgtaggggtgactcaaaaaactccaggccagaaaccagaacacctaataagtatt

SEQ ID NO: 43609 - DNA, 201 bp, Homo sapiens
gtgacaaatttttcattctaaacaggctgctgtcactttaaatgcttatgggaatactttccacctttacgcttgctatccagctagtatgtagtcagtayataaattaatcttaatgtaaacctgagatacactttgaaagaaagatattcctagaaaaatatcatattagtaaattatacccttttgtttcccaaatat

SEQ ID NO: 43610 - DNA, 201 bp, Homo sapiens
ccttgggcagtatggccattttcacaatattgattcttcctatccatgagcatggaatgttcttccatttgtttgtgtcctcttttatttcgttgagcagyggtttgtagttctccttgaagaggtctttcacatcccttgtaagttgtattcctaggtattttattctctttgtagtaattgtgaatgggagtacactca

SEQ ID NO: 43611 - DNA, 201 bp, Homo sapiens
ttatgttatatatatttatcataatttttaaaagcacttgaagtaagtcaaagaatcctactgtaatagaaataatcattgcctctacttaacaattttartatttaaactctagttattacattttaaatataattaaaatatatttttagtttaaatacttaataaaaatacttaaaatatatataaatataaaataat

SEQ ID NO: 43612 - DNA, 201 bp, Homo sapiens
aggtaatccacctgcctcggcctccagaagtgctaggattacaggtgtgagccaccgggcccgcctccagaatcttttatctgaatactataacctcacaygaatcttttcctgaataagaagcagatttttttaaaaagtagagttttggcaaacacatacatttgtttctaatggatatatctgtgcattatgatatgt

SEQ ID NO: 43613 - DNA, 201 bp, Homo sapiens
ttgttttttgtttttaaatggtagacttgaacgtacttcaatgggatatccagtgggatatgttatttccaagaatttattattctaaaaataaataaatwaattaattaatcacctttggaggatcctagaatgaatcctaatgatacttaaaatcaaaatatcattagtcacttggaggttgaaaactgaaaaataaag

SEQ ID NO: 43614 - DNA, 201 bp, Homo sapiens
tgtcgtcatcatggtgatggtgttggggctggtgaaacactgcccactgcatcaattccagagtaaaaactagattgaatccaaaattttctataaattartgttgacctttactgagttctgagatcaatattaattactgctgtgctttgtaattataaaagggctatttgatgtttcacaccaaggatatgggtggag

SEQ ID NO: 43615 - DNA, 201 bp, Homo sapiens
ttgagcagcggtttgtagttctccttgaagaggtctttcacatcccttgtaagttgtattcctaggtattttattctctttgtagtaattgtgaatgggartacactcatgatttggctatttgtctattattggtgtataggaatgcttgtgatttttgcacattgattttgtatcctgagactttgctgaagttgctta

SEQ ID NO: 43616 - DNA, 201 bp, Homo sapiens
caccacgttggtcaagctggtctcgaactcctaacctcaggtaatccacctgcctcggcctccagaagtgctaggattacaggtgtgagccaccgggcccgcctccagaatcttttatctgaatactataacctcacacgaatcttttcctgaataagaagcagatttttttaaaaagtagagttttggcaaacacataca

SEQ ID NO: 43617 - DNA, 201 bp, Homo sapiens
gactgaaccttaaaactgccaagatttcatagttgagtaagaagttaaggttgaaaaccaacaaaggaggtgtagccagagaggcaggagagaaaaacagkacattacagtgtcatgggagcgaggggaaagagtgcttcaagaagaaaagtagtggtcaacagtgctgaaaggtcaggtgagttgaagcctgaaaagtca

SEQ ID NO: 43618 - DNA, 201 bp, Homo sapiens
tttgtatcctctctctttttttcttagccaagctagaaattattaattttcttgatcttttcaaagaattagcttttggtgttgttgatttttctctattrattttctatttccaatttcactgatttctgctgtaatctcatcatttattgtcttctgcctacttcagatttaatttactttcctgtttctggtttgccc

SEQ ID NO: 43619 - DNA, 201 bp, Homo sapiens
ataataattggtcgttgtacttttcttgtgacttttaggaagatttaaaatttttcaaaagaaagtggaagacagattttaattacaataaaatttaaaaatgaaataacatttattctgtcttattgctttaggtgaaatccttaaccctgtttgtcacccattatccgccagtttgtgaactagaaaaaaattactcac

SEQ ID NO: 43620 - DNA, 201 bp, Homo sapiens
tgatactatggtaaattgtatcattaacaatgttttattttgaattacaggttgggcattcctaatctgaaaatctaaaatctgaaatgctccaatgagcrtttcttttgagcatcatattgttgctcaaaaagctttggatttcagagcattttagattttatttgtaatgcaaatatttcaagattaaaaaaaaattga

SEQ ID NO: 43621 - DNA, 201 bp, Homo sapiens
aaagtgtcagacttacttactttgggtaatatatcttcttcatatatatatatatatatatatatatatatatatatatacaatctaaattcgaagagagyaatatttctattcatgtaaatgccatacacattttactcatcaaggccttcaaataagtttcacatctgacttttacattaggcctaagccaaatgtatt

SEQ ID NO: 43622 - DNA, 201 bp, Homo sapiens
aaactttttcagcagtctgcagctgttataaaaatagttctcccataattcttctttaaagacagttgtcaatatttatacctgtcaaggaagatagcacttttttttttttttttttttttttttttacagaaaattagcttttcaggtcttagaaattaacatgtgacagttttattttattttttttctgctgtacat

SEQ ID NO: 43623 - DNA, 201 bp, Homo sapiens
aactttttcagcagtctgcagctgttataaaaatagttctcccataattcttctttaaagacagttgtcaatatttatacctgtcaaggaagatagcacttttttttttttttttttttttttttttacagaaaattagcttttcaggtcttagaaattaacatgtgacagttttattttattttttttctgctgtacatc

SEQ ID NO: 43624 - DNA, 201 bp, Homo sapiens
ttagtagagacagggtttcaccatgtgggccaggctcgtgttgaactcctgacctcaagtgatccacctgtctcggcctcccacagtgctgggattacagktgtgagccaccacgcccggccagcactacactttctaatgagtttttattgaaaaaaattttagttgaaaatgaagctgttggctcgtaagtgaaaagct

SEQ ID NO: 43625 - DNA, 201 bp, Homo sapiens
tatgtgcagtttagtattataacttttataaataaactttaaatactgtagtgtgatcttattgcaatcattagaaggaaggattatatgagagaaacttwtttttctattataatacacatgcttctcaagttaaaatgggactatgccctgataaacccatcataagtcagaaacatcataaatcaaaaatgcacttaa

SEQ ID NO: 43626 - DNA, 201 bp, Homo sapiens
tcccccgtccccttgcacttcccaggtgaggcaacgccctgccctgtttcagctcaccgtccataggctgcacccactgtccaaccagtcccaatgagatraagcaggtacctcagttggaaatgcagaaatcacatatcttctgcatccatctcggtgggagctacagactggagctgttcctatttagccatcttggaa

SEQ ID NO: 43627 - DNA, 201 bp, Homo sapiens
tgaaaaaagtaccttttccccttgtcttcaataaatatttattacagtgtttattttatgccaacattataaactagatgttaggtctacaatggggttaatgagatgagatagacaacctgctttcaagaagcttccagtttagtgtgagagaaaggtgttgaaactgttattccggatttggaggatgctgtgaaggag

SEQ ID NO: 43628 - DNA, 201 bp, Homo sapiens
gaaaaaagtaccttttccccttgtcttcaataaatatttattacagtgtttattttatgccaacattataaactagatgttaggtctacaatggggttaatgagatgagatagacaacctgctttcaagaagcttccagtttagtgtgagagaaaggtgttgaaactgttattccggatttggaggatgctgtgaaggaga

SEQ ID NO: 43629 - DNA, 201 bp, Homo sapiens
aaaaaagtaccttttccccttgtcttcaataaatatttattacagtgtttattttatgccaacattataaactagatgttaggtctacaatggggttaatgagatgagatagacaacctgctttcaagaagcttccagtttagtgtgagagaaaggtgttgaaactgttattccggatttggaggatgctgtgaaggagaa

SEQ ID NO: 43630 - DNA, 201 bp, Homo sapiens
cgattctcctgcctcagcctcccgagtagttgggattacaggcatgtgccaccacgcccagctaatttttgtatttttagtagagacggagtttcaccacrttggtcaagctggtctcgaactcctaacctcaggtaatccacctgcctcggcctccagaagtgctaggattacaggtgtgagccaccgggcccgcctcca

SEQ ID NO: 43631 - DNA, 201 bp, Homo sapiens
taactgttttacatgcctcagctaaatttgaaaacaatgcacaagccagaactggaaatactgatcctggggagaaagatatatgagttggttatggggcyggggagcctattgcatcattattgggtacaccatgttattgttttgctggcaatagcagaagctgtgctgatagtcgcaagttttatggtagaccttttt

SEQ ID NO: 43632 - DNA, 201 bp, Homo sapiens
caatagtcttctaattatttgttgctcttacagaaaaatgcaactgagtttgcatcttgatcttaaatctagccattttgctagagatcctctcattaatkataatactttgtatagagattccttttggttttccttgtggacagctatgtgatctgccaatgacagttttgttttgtcctttctcatcctaatgccttt

SEQ ID NO: 43633 - DNA, 201 bp, Homo sapiens
attttgtaatgaaatgacattatttgaggacctgctgtatttttattttggttttaagtcctttcaataaattttaaaagtgttctctataaagggttttracatcttttattagattaattactaagtactttttgttagtatataggtcatatcttttttacaatagtcttctaattatttgttgctcttacagaaaaa

SEQ ID NO: 43634 - DNA, 201 bp, Homo sapiens
aaatacccaatatgcaaatagagttggaattataccatagttttgcaaattcatgttagcatgtagtgttccatcctttgtactgtgactattttcagatrttctatgcaagaatcagagatgcctttgcagattccagtgatgagaattttcattataggggctggatttctcttacataacacaaatgatcctgaatac

SEQ ID NO: 43635 - DNA, 201 bp, Homo sapiens
ttgttgatacaaatgtgaaaagaatcagaaataatcagctctagaacctattagaaatgtattgaaatttggaatttagtatttatgaatgaatatgttcyagatgcatgcttgacggctgatgagcaatgacattcagaatgtcttacccatttcagatatatatgccttgaaaaccaggagaatatggaataaaacttt

SEQ ID NO: 43636 - DNA, 201 bp, Homo sapiens
atggtgggttaaatcaaggaataaatgtttccatagtgaaaattgtgagaagtacctcctactaccatgcagctcaaaaacgagtaatacgtgcggcagayttgtttatcacttttgtgttacatcagtttattgtcatgcatttgtatgattatcacctgccttatgaatttttacttgacaatcatttgtattcactca

SEQ ID NO: 43637 - DNA, 201 bp, Homo sapiens
tatccagaaaaagaatattggctgaaatttagctagagcattttgcaactagagcccccacttgagagcagcattgattgttatgtacactatttattgasgtaccagatggtgtgactatgatatcattaaaaaaatgattaacctcaatgaacctgacatcagaggattgaataccagcattacaaatgtatttgtcac

SEQ ID NO: 43638 - DNA, 201 bp, Homo sapiens
gtttccatagtgaaaattgtgagaagtacctcctactaccatgcagctcaaaaacgagtaatacgtgcggcagatttgtttatcacttttgtgttacatcmgtttattgtcatgcatttgtatgattatcacctgccttatgaatttttacttgacaatcatttgtattcactcattttccaacccacttattccattttg

SEQ ID NO: 43639 - DNA, 201 bp, Homo sapiens
ggctgcagtgagctgttatcactgccactgcactccagcctgggtgacagatcaagagcctgtctcaaaaacaaaaaacaaaacaaaaaactgtatccagkgcttgtgtattatcctaatttctaaaaatcaatgaccccccaaaatatttccctcatcagaatgttctgttatcagccaaagatttctttctgtcagctc

SEQ ID NO: 43640 - DNA, 201 bp, Homo sapiens
aacccagatcatgaattgatgaaaataaattaatcaaaaacaaatttagagaaccacattgggactctgccttttctccttggttagatactaatctccargagaggactcatttaaagacaaggtattagggaagtatatacagctgtgaatagtatcttttgtggaatatttattagtactgttatcaataagttgcac

SEQ ID NO: 43641 - DNA, 201 bp, Homo sapiens
catatgggaagaaacactttcttctctttatagttagggaagtcagtgctttcctgtgaagagacttttacaggatttcagttccttggataaaaactatstaaaaatcctctctgttcagaataggggaggatcatatctcagactggtgtaacatctagtaattgaatattttaaaattttatatacttagaaattcaa

SEQ ID NO: 43642 - DNA, 201 bp, Homo sapiens
gaggtctttaaaaagcataaagaacatcaaggtcaaaaaatgattcttgtatcaaagtaaaagatacaaaagaccgtagaaagatgttttaattgaacagygtatgaaaattttaggtcatttcatttccaagtccaacacatagtttatattaataattacatctagaaataattttatgtgatttactttattgtattc

SEQ ID NO: 43643 - DNA, 201 bp, Homo sapiens
aaaaaatttgtaaagttttatctttaattgacaaataattgtatatatttgtattagggttctgtagagggagagaactaataggatagatgtatataagragtattgacttacatgatcacaaggtgaagtcccactgtaggctgtctgcacgctgaggggcaaggaagccagtctgaatcccaaaacctcaaaagtagg

SEQ ID NO: 43644 - DNA, 201 bp, Homo sapiens
cacttagtttgcttccagatcttggctattgtgaatagtgctgcaataaacatgggagtgcagctgtctcttcaatatactgatttcctttcttttgggcwtatatatatacctagcagtgggattgctagatcatgtgttagttctatttttagttttctgaggacctttaactcttatccataacagttgtactaactt

SEQ ID NO: 43645 - DNA, 201 bp, Homo sapiens
caaaatgagatgttttataggaatctggtgaaatgcttacatggtcactgtctgacaactctttttttctggggcaaatatctctttcctactcagggacrtggaatttggggttttaagctttagaccatcctgggcacttcaatatatcagaccttacttgtccacaaagtttttcccagactataagtaaccctagtt

SEQ ID NO: 43646 - DNA, 201 bp, Homo sapiens
tcagtgtcttatttcagtatctatcttagttcataactggttatcctatgccatcatgctatttgttcactatttgagggaaagaactctactccattgtrtattccctgccccactcaggatggcagtaagtacagctactaatataaattaaagtcattcagaaatgaaattattttcacatttatattacattgtttt

SEQ ID NO: 43647 - DNA, 201 bp, Homo sapiens
attggcttagaagaaattaatgaaagcagaaactttatatttttatgtaataatgtacatacattattatgtattatgtaatgaacgtatgtatgaatgtwtgtgtgtatgtatgaaagtatgtatgtatgtaatgaaagcagaagtttacatagtttactgcttctgttgcagtctctatcatattttatgaatatatac

SEQ ID NO: 43648 - DNA, 201 bp, Homo sapiens
cttttagtaataaaatcagctagaagaatatattgggtagtatcacacagactaggttttattgggtcccattggttacagtttaggaaacaaatgtttgmttatattattcttggatcacaggctccactgagacagaaattgtgcttgttctgcacaccttttatcccctattcctagtactaagtagatgtgcagtaa

SEQ ID NO: 43649 - DNA, 201 bp, Homo sapiens
ttagttactttaataaaagatatgtagtagaaaagtggctgccttttctactacatttttttttttttttttacagtggagaaagtaagtgtaagtgccarttctaccatttacatgctatacgaccatggaagagttacctctgttgtaagactattatggagaccaattaagttaaaatacatgaaagtgctttttaat

SEQ ID NO: 43650 - DNA, 201 bp, Homo sapiens
ccttcacattttttaacttgtttaacctatttttgctatatggtttatgttattttaaaaatgaaaaaatactaaacaagtattggctttgttttccttgsctaaaattatttcctttatacctttaaaatattacatagtatttaacctcatttagaaaatatcagtgatattttatttcaactaactagttaatagaaa

SEQ ID NO: 43651 - DNA, 201 bp, Homo sapiens
atttattattctaaaaataaataaattaattaattaatcacctttggaggatcctagaatgaatcctaatgatacttaaaatcaaaatatcattagtcacwtggaggttgaaaactgaaaaataaagatccaagcaggtatcctatcttttcaaataggtaacggggaagtttctctttatagaaatgttccagccaataa

SEQ ID NO: 43652 - DNA, 201 bp, Homo sapiens
tacacaccatcaaacatatgtctgttctttattattagattactctaaataagcttctactgtgtacaccacatagtgggtgatgtcctgggtacagattrtgccaattatgtgaaattcataaaatgagaaggaacactggatgttgtgggaagtggttagcataggctgtatggttttgtggaacgtgccctggaatat

SEQ ID NO: 43653 - DNA, 201 bp, Homo sapiens
tcagacagagagatcaaaggtaaagatgtaaatttgttgtgagacatttttgtgtacgtgattgggtgtggatgagatcatcttgacagacagtatggtgragaagattaatgttctgagactgaaccttaaaactgccaagatttcatagttgagtaagaagttaaggttgaaaaccaacaaaggaggtgtagccagaga

SEQ ID NO: 43654 - DNA, 201 bp, Homo sapiens
aatcagcattaaccaaataatcacatacagaaatgtgaaactgcagctatgacaagtcaatgaaggctatatgcaagatgttaggacaggctgtgatcctgatatgatctggtcaggaaggtcaggggaaggcttcccttagcaagtaacttttgagtgcctatctgaaggatgagtgtaagaaggaaggaagtatatttc

SEQ ID NO: 43655 - DNA, 201 bp, Homo sapiens
taaatatccagattttaaatttaaagaaattgctcccattatcttccagtattacattcaatgtagataaagtcagtaagagtctgattctcatcccttgyttaatgatgaattttttctttctctgaggcatttagaattttttaatccttattataaaattttcagcagaatgtttagatgtaaatcttttcttactaa

SEQ ID NO: 43656 - DNA, 201 bp, Homo sapiens
actatacaaaattatcttaagtttgaattatagaggcattttcacagtagcaaccagtaggtactgactccatcactgacaatagctataggtcacactcygtgtttctgagtgacagccacacatggtagatactcatgtcaccacctagtttatcttcaaatgtgaaggactccagtgacactcacatttagtcctttc

SEQ ID NO: 43657 - DNA, 201 bp, Homo sapiens
tcatttattcattcatccaacatgtactaagtgaatacctaacatatggcaggcactgagaatacaaaggaaccacagtttttgatttcatgaaagctatrtagtggagaaaatcagcattaaccaaataatcacatacagaaatgtgaaactgcagctatgacaagtcaatgaaggctatatgcaagatgttaggacagg

SEQ ID NO: 43658 - DNA, 201 bp, Homo sapiens
atataggtctaatgatgcttagatcctaggaaagggcctatggttcatgtttctgacaggagattatttaggtagttcatttagccatttcacatgaccartgtgttaatgtctgaatttaatctactcgttctgtgttgtcttaaaagtcaaacttttcagtaaaacgaaaccaaacaaaaaatacacccctagcagttt

SEQ ID NO: 43659 - DNA, 201 bp, Homo sapiens
ttttggtagagacggggtttctccatgttgataggctgctctcgaactcctgacctcagatgatctgcccgcctcggcctcccaaagtgctgggattacakgcgtgagccactgtgcctggcccagaatttatttttatacatgatatgagttaggaatctaatttcatatctttctatatggataatcaattgttttgta

SEQ ID NO: 43660 - DNA, 201 bp, Homo sapiens
cattttccactaatcttttatagacaatagctaatcttttactcaatagctacccccaggaaatcctccctgatcctaaaactgcatttgttcgttaggtrctcctggcctgtgttcccattgtacctagatcataacccagttataatcttattacattgttatcattaatgctttttaaaaagttttactattcatcac

SEQ ID NO: 43661 - DNA, 201 bp, Homo sapiens
gtagttcaatataaaaaatgttattccttttgaaaatattggaaagggaaagtgtcagacttacttactttgggtaatatatcttcttcatatatatatatatatatatatatatatatatatatatacaatctaaattcgaagagagtaatatttctattcatgtaaatgccatacacattttactcatcaaggccttca

SEQ ID NO: 43662 - DNA, 201 bp, Homo sapiens
ataaaatatctccttatgtgaaataactagatatgctggatcaagcataacaaacatccctttaggacattgctgaatctgtatttaaaacataagggaaraactgagggaacagatggaaaaaggaactggaaatggaagtgaattgactgctgcagctgccctctgggctcctgcagatcttggtaatcaaaaggattg

SEQ ID NO: 43663 - DNA, 201 bp, Homo sapiens
tagttcaatataaaaaatgttattccttttgaaaatattggaaagggaaagtgtcagacttacttactttgggtaatatatcttcttcatatatatatatatatatatatatatatatatatatatacaatctaaattcgaagagagtaatatttctattcatgtaaatgccatacacattttactcatcaaggccttcaa

SEQ ID NO: 43664 - DNA, 201 bp, Homo sapiens
agttcaatataaaaaatgttattccttttgaaaatattggaaagggaaagtgtcagacttacttactttgggtaatatatcttcttcatatatatatatatatatatatatatatatatatatatacaatctaaattcgaagagagtaatatttctattcatgtaaatgccatacacattttactcatcaaggccttcaaa

SEQ ID NO: 43665 - DNA, 201 bp, Homo sapiens
ttgttagagcatgtctcaataggatgtagtttgaggcattaacagggataagatatcagtttgaaaagagcttctatcagaacaacatgaattctgctaamaattaaagcgagaacaaacaccatatttatggtgaagcttgggtggaagagtggtgacatcattaatgctttatgaaaagtttcatgagacctcggaata

SEQ ID NO: 43666 - DNA, 201 bp, Homo sapiens
gttcaatataaaaaatgttattccttttgaaaatattggaaagggaaagtgtcagacttacttactttgggtaatatatcttcttcatatatatatatatatatatatatatatatatatatatacaatctaaattcgaagagagtaatatttctattcatgtaaatgccatacacattttactcatcaaggccttcaaat

SEQ ID NO: 43667 - DNA, 201 bp, Homo sapiens
aaatgttattccttttgaaaatattggaaagggaaagtgtcagacttacttactttgggtaatatatcttcttcatatatatatatatatatatatatatrtatatatatatacaatctaaattcgaagagagtaatatttctattcatgtaaatgccatacacattttactcatcaaggccttcaaataagtttcacatc

SEQ ID NO: 43668 - DNA, 201 bp, Homo sapiens
cttctaactctaaatggtattataatatgctttaccactacaaatcttattaaattattttagtttaccaagttaatacttttaaagaatacactgtcaaattattgattcttattgtgtgaaaaagccaaattgaacaataagtataaatactcttatctttcaaggtattggaaggcataggtttctacaaaataaaaa

SEQ ID NO: 43669 - DNA, 201 bp, Homo sapiens
ttctaactctaaatggtattataatatgctttaccactacaaatcttattaaattattttagtttaccaagttaatacttttaaagaatacactgtcaaattattgattcttattgtgtgaaaaagccaaattgaacaataagtataaatactcttatctttcaaggtattggaaggcataggtttctacaaaataaaaag

SEQ ID NO: 43670 - DNA, 201 bp, Homo sapiens
tctaactctaaatggtattataatatgctttaccactacaaatcttattaaattattttagtttaccaagttaatacttttaaagaatacactgtcaaattattgattcttattgtgtgaaaaagccaaattgaacaataagtataaatactcttatctttcaaggtattggaaggcataggtttctacaaaataaaaagt

SEQ ID NO: 43671 - DNA, 201 bp, Homo sapiens
aattgttttaacaattgtacaagtagatctatttattttcctcacattagacaattagattatctctatttttgtcagttatgaatacatacaaacaatawtacagtgaacagttttatacatgcctttttgagcacttgtatgtttcttgggtagatgcttaaaagaggaattgctgggtcatctagaccaatatacaca

SEQ ID NO: 43672 - DNA, 201 bp, Homo sapiens
gagctactcaagcctcagcaatggcagatgcccctccccctgtcaagccacaacgtcgcaggttgatctcagactgctgcgctagcagtgagcaaggctcygtgggcgtgagacctggtgagccaggcatgggagggtatctcctggtctgccggttgcaaagaccatgggaaaagtgcagtatttggtcaggagtgtact

SEQ ID NO: 43673 - DNA, 201 bp, Homo sapiens
ttcatttattcattcatccaacatgtactaagtgaatacctaacatatggcaggcactgagaatacaaaggaaccacagtttttgatttcatgaaagctaygtagtggagaaaatcagcattaaccaaataatcacatacagaaatgtgaaactgcagctatgacaagtcaatgaaggctatatgcaagatgttaggacag

SEQ ID NO: 43674 - DNA, 201 bp, Homo sapiens
gagacaagatcacgccactgcactccagcctgggcaacagaggaagactccatctaaaaagaaaatcaaactgaaactgttcagacctctagatctagatrccaatttacaagagaaaaagagaatagaggaacatgttaaacaccaccataggggtactgtcagcaaaatctagactgtgggaaactataggacaaatga

SEQ ID NO: 43675 - DNA, 201 bp, Homo sapiens
taattgtatggtttctttattctgttaatgtggtgaattacattgattggcttttgattattaaaccaactttgtattcctcaaaagctctaaatggtttrtataaccttggattgacttattaatagtttattaagaagttttgcatgtatatttatgggtgaaattggtctgtaatttttcttgtaatgttcttttcag

SEQ ID NO: 43676 - DNA, 201 bp, Homo sapiens
gtaatcccatttgagacagctcctttaacaatgctgtcacagttcagggagccttggcatgacacacgtaacccttctgtgcggtattctctctggcattrcattcttacattacattctctctggcattacattctttcactttccattttgtacttttctctattgctttatttgtatgtaatgttctgaagtccaaat

SEQ ID NO: 43677 - DNA, 201 bp, Homo sapiens
tgggattacaggcgtgggacaccgcacccggccccaatatgatgccttttgatgacaaaaaaagccttaactttaatgaagttgaaggtatcagtccttcyttttatgggtgaatgcttttgtgccttaaataggaaattatttcaatccctgaggtcttaaacatattctcctataattttttataaacattttaaagtt

SEQ ID NO: 43678 - DNA, 201 bp, Homo sapiens
ggacctttaactcttatccataacagttgtactaacttacgttcctaccagtagtgtacaagagttaccttttctccacatcctcaccagcatttgttatygcatgtcttttgaatatgtcattttgactggggtgagatgatatctcattgtaatttcgatttgcatttctctgatgatcaatcatgttgcacctgttca

SEQ ID NO: 43679 - DNA, 201 bp, Homo sapiens
aaggctgcctaaacatctactacaattcttactgtgtttttgcttacatgttacagcagaaacagactcactagcagacttttccatgtaaattaaaattyttcatttccaatgttaaatttcctttttttttgtgtacccaggattaatttgagataaatctagtagaccatgttgtctgttgttaggcgccgaatcatg

SEQ ID NO: 43680 - DNA, 201 bp, Homo sapiens
tgttagtatgaaataactacaggaatggagatgtgtggctaaggagaaaagtaaatctaaaacttcacctttctggaggggtcatgcaaggaggcgtgacttgagagaatttgccacggttaatgttacaattctggggcagcctacctttcattgcttgattattctgcatagacccattttttaggtctacaaacactg

SEQ ID NO: 43681 - DNA, 201 bp, Homo sapiens
acttcacccccaccgccccccgcccacctttccaaggagcaatggaaagaggtgcagggtaggagttgggtgtcagcaagaacaaggatataataggacaygtatctgtccctcctctcttgtctgagcctgcttctccaggggtgtcagggaattggcctcctcacgggaccctttaccccagtcaggccagtcaagctg

SEQ ID NO: 43682 - DNA, 201 bp, Homo sapiens
aaattccttcctttattggaccttgcaccattttagaagccgaagctgagattaacatcttctgcttgtctttgtacttcaacttcacccccaccgccccycgcccacctttccaaggagcaatggaaagaggtgcagggtaggagttgggtgtcagcaagaacaaggatataataggacacgtatctgtccctcctctct

SEQ ID NO: 43683 - DNA, 201 bp, Homo sapiens
attgttttaacaattgtacaagtagatctatttattttcctcacattagacaattagattatctctatttttgtcagttatgaatacatacaaacaatatwacagtgaacagttttatacatgcctttttgagcacttgtatgtttcttgggtagatgcttaaaagaggaattgctgggtcatctagaccaatatacacaa

SEQ ID NO: 43684 - DNA, 201 bp, Homo sapiens
aagtgaaggaatctctttttgggtactggtttttcgggctctgatattaggttctctaaagttctgggtgagggcttgttttcttaactcgggaaactggwtgttacctaaatttcattatagctatgagaagggtggttaggtttatagcacaaacacttatgcctttcttttgttaaataatttagtgacctgctgtta

SEQ ID NO: 43685 - DNA, 201 bp, Homo sapiens
ttgttttaacaattgtacaagtagatctatttattttcctcacattagacaattagattatctctatttttgtcagttatgaatacatacaaacaatattwcagtgaacagttttatacatgcctttttgagcacttgtatgtttcttgggtagatgcttaaaagaggaattgctgggtcatctagaccaatatacacaat

SEQ ID NO: 43686 - DNA, 201 bp, Homo sapiens
ttaaaaaaactcttagtgcatctgatttgaactttagattacttgtttagtaaggacaaaaagaaaaaacaaaaacacacacagcaaaaagaaaagacaaraacacccataaccaaccaaataaaaaaccacacacacaacacattaatacttacgttaataccattgattaaaataacctatacctttgctctctaaagg

SEQ ID NO: 43687 - DNA, 201 bp, Homo sapiens
attgtggagtgtctatcttaaaatattagggtttttggtattcttaactttaaccacaagaggtctccaaaggatttgatattttgtgaattactgtttartggttactaaaatcttcacatttctttttatatctgaaagtacaggtttatttactttgtatcatattgtgacttagaacaaatattagagatgatagta

SEQ ID NO: 43688 - DNA, 201 bp, Homo sapiens
tttacaaatgtaataaatataggattgttagattttctatttcttgtgtcgttttgtgatttttaaaaaaggagatagacatattaaaaaagagattaaaaagagattaaagagattaaaaagagatataaaatatttgatcatgccaatatttgattgttttatgacaggcttattttttaatctctgtagaattcattt

SEQ ID NO: 43689 - DNA, 201 bp, Homo sapiens
cctccataccaagtggattcagagagcccagaggtcagaaatcgtgcagagtcttatgttgacagaggaatggccctgccataagaaaggtgcctgagttrtacaaggtgttggcagctggagccaagttacacctggtttacttacctgatataattttaagtgcttcacaaataacgttttttaccttcatagttaaat

SEQ ID NO: 43690 - DNA, 201 bp, Homo sapiens
ttacaaatgtaataaatataggattgttagattttctatttcttgtgtcgttttgtgatttttaaaaaaggagatagacatattaaaaaagagattaaaaagagattaaagagattaaaaagagatataaaatatttgatcatgccaatatttgattgttttatgacaggcttattttttaatctctgtagaattcatttt

SEQ ID NO: 43691 - DNA, 201 bp, Homo sapiens
acagagaaaagaatcagatcaaggagcttagagaatgccaatagttgggaataggagcaagaatacaaacagaaggggaggaattaaagagctaggtggasaaccaggacaaggtagggatgtgtagttataatttgtcacacgtggtataaccaatgatgtgagctaattttttacattattgactctgttatagtttac

SEQ ID NO: 43692 - DNA, 201 bp, Homo sapiens
ttcagagagcccagaggtcagaaatcgtgcagagtcttatgttgacagaggaatggccctgccataagaaaggtgcctgagttatacaaggtgttggcagytggagccaagttacacctggtttacttacctgatataattttaagtgcttcacaaataacgttttttaccttcatagttaaatatttacttaaggtatat

SEQ ID NO: 43693 - DNA, 201 bp, Homo sapiens
tacaaatgtaataaatataggattgttagattttctatttcttgtgtcgttttgtgatttttaaaaaaggagatagacatattaaaaaagagattaaaaagagattaaagagattaaaaagagatataaaatatttgatcatgccaatatttgattgttttatgacaggcttattttttaatctctgtagaattcatttta

SEQ ID NO: 43694 - DNA, 201 bp, Homo sapiens
aattgaacctcactggttctcagttaactcccaaaagattatttgattggcctagtttgagaagcttttatgctagctaggcccattggctggttctggctttttttttttttttttgagatggagtctcactctcacccatgctggaatgcagtggtgctgtcttggctcactgcaacctccacctgctggattcaagtg

SEQ ID NO: 43695 - DNA, 201 bp, Homo sapiens
gatcacctgagcctggggaggttaaggcaacagtgagccgaggtcacaccattgcactccagcctgggcaacaaagtgagaccctgtctcaaagaaaaaamaaaaacaaaaacaaaaacagaaaaaaaacccacgttatttttattatgactgttaatactagaaaagacttaagagttaattttgtccaatagcttccaa

SEQ ID NO: 43696 - DNA, 201 bp, Homo sapiens
ttttaatttgcgtttctctgattagagatgttgagcattgtttcatttatctattggccatttgtatatcttttgggaatcgtctattcagaccttttgcmcatttttaaatagggttatttgttttcttgttattgagtagtttgagttccctgtatatttggtatattagccccttatccagtgtttgatttgcagata

SEQ ID NO: 43697 - DNA, 201 bp, Homo sapiens
atatatatgtgtatatatgtatatatgtgtatatatgtgtgtatatatgtatatatgtgtgtgtatatatatgtatatgtgtgtgtgtgtgtgtgtgtgtrtatatatatatataattttttttttttttgagacggagtttcgctcctgtcgcccaagctggagtgcaatgacacgatcccaggatcccagctcactgca

SEQ ID NO: 43698 - DNA, 201 bp, Homo sapiens
atataccataattgccttaatattttctctgttgtatctactctttgctgtcatgaataatcctgccatggtacctcacagaattgattctttaaaaaaamaaaacaaaaattgggggcacatagtaggtgtgtatatttatggattacatgagatattttgatacagacaccgaatgtgtaataatgttaccctcacatg

SEQ ID NO: 43699 - DNA, 201 bp, Homo sapiens
tttaaagacagttgtcaatatttatacctgtcaaggaagatagcacttttttttttttttttttttttttttttacagaaaattagcttttcaggtcttaraaattaacatgtgacagttttattttattttttttctgctgtacatctgctgacttcagggatattatgactgtccattattctagtgtactcaatgatg

SEQ ID NO: 43700 - DNA, 201 bp, Homo sapiens
ctgctgcttagggaaaccccagcgaacccactgcaatctcaactctcccaggattgtttgttaaaccaaatgactcttttttttttagtggatggattttsaacagcagttaaagtcggggttttcagttcatttgtagggtttttgtttttagtataaaaaatataaatttcaactaatggaggggaggggaaagagtgg

SEQ ID NO: 43701 - DNA, 201 bp, Homo sapiens
gagaaaaaacctgatgagaatttggtcaaggacatggggtaaaacggtatggtgatgggtcaaaaaatgaatatgtagggagtagttatgtgagagagaasgtatcagagaataaaatgcctgactttcagatatcaaatgtgctgtttttctggttgatggcaagatcttatgtatggctatggaaggtgggtagcagaa

SEQ ID NO: 43702 - DNA, 201 bp, Homo sapiens
agtctgttctagtatgctgaattcagatgtatttttgttcagtaacatttttatcttgtcatcatccaaaagctgagaatctgtcctgccggtctgtctcrtcaactctgtagccatctccatgataggaaataagtagtaggaataaagagacatttctcggctgaaggagtgctgatagcctgcagccagccctggcat

SEQ ID NO: 43703 - DNA, 201 bp, Homo sapiens
ctttcctctgccgggttgaatgagagtttaaaggaggaactgctgctgctaagaacaaaatgaacccgagtgcctcttactgtttgtcccgactgtcagtkcatagggattaactaacatccaggaacttttagctggcctctgctttgttcttcaacattcggaccttcagtgagctctagacctgcacaaacgacctgc

SEQ ID NO: 43704 - DNA, 201 bp, Homo sapiens
ataagatgacattattcaattaattatagtgtctttattataaaatattacagttactcaaatgtgttagactcttgggaaagctgaatgtcatacatatrtagcttgatttgaaaattaaattcatttcttgcttcctctgtcactgagtacaatgaaagcagatgttaaagtttatgtgggtgacatttttataaagtt

SEQ ID NO: 43705 - DNA, 201 bp, Homo sapiens
gaaagggttttattaattgacagcatgcagcatatccaaatacctgtttactggtttaaaatgtggaaaataatctgttacatctgagtactttttacttrgatttaaaatatagtaaaacatccttaaattattaagagaatgaaattgggggattggaggaatgggttaagtgtggtgctggagaaaacagcagtttct

SEQ ID NO: 43706 - DNA, 201 bp, Homo sapiens
ttgagttgacttgtttagtaaatgctttcacaaacgttgctgcatatttcataaaaatcatgatatacgtttatttaaaggtccttgtgccattagaatakaattttagatagtttgagaaaatataccatttcagaaattattcttaaggatgatttaagtgaagttttgttaagacacacttgaggttctaaagttatt

SEQ ID NO: 43707 - DNA, 201 bp, Homo sapiens
ccactgaactgtgtacctaagaaatgctaaaatggtaaattttatgttatatatatttatcataatttttaaaagcacttgaagtaagtcaaagaatcctmctgtaatagaaataatcattgcctctacttaacaattttagtatttaaactctagttattacattttaaatataattaaaatatatttttagtttaaata

SEQ ID NO: 43708 - DNA, 201 bp, Homo sapiens
tctctcccttgattattggctttgaagcaaatcctagggagcatcagtttatcctctaatatttcagtaggtacccttaaaaacaaaataagtacatgacrttgtcatataagtgtatcataatttatccattccatttttattatattcatttttccagtattataaatactgttatgatgaatatccatatacagaaat

SEQ ID NO: 43709 - DNA, 201 bp, Homo sapiens
aatatgatgccccccccccctacctttttttttttttttttttgagatggagtcttactctattgcccaggctggagtacagtgtctcaatcttggctcartgcaacctctgcctccagggttcaggcgattctcctgcctcagcctcctgagtagctggaactacaggcatgcgccaccacgagctcattattgtatttt

SEQ ID NO: 43710 - DNA, 201 bp, Homo sapiens
tagttttctgaggacctttaactcttatccataacagttgtactaacttacgttcctaccagtagtgtacaagagttaccttttctccacatcctcaccarcatttgttatcgcatgtcttttgaatatgtcattttgactggggtgagatgatatctcattgtaatttcgatttgcatttctctgatgatcaatcatgtt

SEQ ID NO: 43711 - DNA, 201 bp, Homo sapiens
tcaatctcgttacttgttattggtctgttcaggttttggatttcttcgtggttcaatcttggtggattgtgtgtgtttaggaatttatccatttcttctarattttcggatttattggcatatggttgctcatagtaaccactaatgatcctttgaattcctgtagtatcagtagtaatgtcttctttctcatctctaatt

SEQ ID NO: 43712 - DNA, 201 bp, Homo sapiens
actcaggtctcctgactcccattctgatgagggggcttgtgggcaaggggtgcgtcttttaacctccatcctttttttttttccttggtggtcgaagagtyttactgattttttaaaaaagtgctggattgggtgactagaagaaagctgcccttaggtctccagtttttaagactgcaacagcatggctcaatatttgaa

SEQ ID NO: 43713 - DNA, 201 bp, Homo sapiens
actatgttgcccaggctggtctcgtattcttggactccagtgatcctcttgccttggcctcccaaagtgctgggattacaggtgtgagccaccgctcctgrcctataaattttcttctatgcactgcttttggtgcggttccacaaattttgataaggtgtgcttcctgtttttacttagttccaaatattttaaatttct

SEQ ID NO: 43714 - DNA, 201 bp, Homo sapiens
taagtacgtttgtttgtttttaaaccagagatactgccacaggaaaagcccaagggtgacccctcacttgggtcacctgcacagtatttttcagattgagkctgtggaagggcattgaagactggtgtttagccacctaccgtgttttaatgtaggtggcagcttgggtgcttcaaaatcttgttcctttcgtatatattt

SEQ ID NO: 43715 - DNA, 201 bp, Homo sapiens
ggagtgcagctgtctcttcaatatactgatttcctttcttttgggcatatatatatacctagcagtgggattgctagatcatgtgttagttctatttttasttttctgaggacctttaactcttatccataacagttgtactaacttacgttcctaccagtagtgtacaagagttaccttttctccacatcctcaccagca

SEQ ID NO: 43716 - DNA, 201 bp, Homo sapiens
cgcctggctaatttttgtattctttttaaattaaagatggggtttcaccatgttggccaggctggtcttgaactcctggcctcaagtgatccatctgcctyggcctcccaaagcgctgggattgcaagtgtgagccacctcacctagcccctccatatatttttaatatgtagttatttttatatttaaggtgagtttctt

SEQ ID NO: 43717 - DNA, 201 bp, Homo sapiens
gtatgcttttggcaagttttctgccaagaaaaaattcataatcttgtcacatctttagtgatgaacataaaccttttaaacaggaaacacttaaattgcartgaacatgtcaaaaatgatactgttcttttattacctatcttttcccctctgtgcctttgctacataactgtttatttcttagaggtattttatttagca

SEQ ID NO: 43718 - DNA, 201 bp, Homo sapiens
ttgatttttcagttggttctactttttccttgtgatggagaggcaacctccaaccttcttatatgctaaactggaaaccagaaacttccctgacctttttrtggatgaaaatctttattttcatggttccttctgatctctggatagggaagagagatcagaaaggagcaataagggaggtcatgtgttgctgctgcaggc

SEQ ID NO: 43719 - DNA, 201 bp, Homo sapiens
taagtttccacatttttatggggctgttctgaactcttatttttcactggtcagtgtttgtgtgcaagccagaatcacacaagcttatttgctatagcatyataataactttttacatctgtagggaaagttctcccctcctattctcctaatagaattcctaatttctatttagcttttgctcctctctctattttagag

SEQ ID NO: 43720 - DNA, 201 bp, Homo sapiens
cagaaaggagcaataagggaggtcatgtgttgctgctgcaggccgagaacagccttgaggagcacagtgtcggatcccagacccttaggtcttccggctamaagtgcctatcagcttggagaaggagcaccatggagataggtggtcctaagatccctcggggcagattttaagcacagctttttaaagaaatcctgcctt

SEQ ID NO: 43721 - DNA, 201 bp, Homo sapiens
gagcacagtgtcggatcccagacccttaggtcttccggctaaaagtgcctatcagcttggagaaggagcaccatggagataggtggtcctaagatccctcrgggcagattttaagcacagctttttaaagaaatcctgccttaatacgtttatttgttattgttatcagaaagaaggcacacattcagacttttaataagg

SEQ ID NO: 43722 - DNA, 201 bp, Homo sapiens
gggcttccttgagtgacagaacattgaggggagacccgcagtgggtgcttctttctgcaggcagggcatcccatcaagtgagaagtgatgagccttcagcmgagaggggaccctggagtgggtagctcctctccgcaggcaggttgtctgcttgtctcttcaagtttggccgagtctggggatttgtatgggcttgagagg

SEQ ID NO: 43723 - DNA, 201 bp, Homo sapiens
cgcagtgggtgcttctttctgcaggcagggcatcccatcaagtgagaagtgatgagccttcagccgagaggggaccctggagtgggtagctcctctccgcmggcaggttgtctgcttgtctcttcaagtttggccgagtctggggatttgtatgggcttgagaggaggaagtgtgtgctgattggttcatgggctgccatg

SEQ ID NO: 43724 - DNA, 201 bp, Homo sapiens
ggcttgaaggtggggcttcacccggacctgaccctttctgctcaggagcctgtctgcctcctgccgtcatccatggcacccaggctgtttgtgccatgggrcacctgcaggacagctctgagctgccctcagccctctccttggcctccttcccatgttcatcagtgtccaaagtccagagggggccgaggcagcaggggg

SEQ ID NO: 43725 - DNA, 201 bp, Homo sapiens
aaagtccagagggggccgaggcagcagggggctggcatgttagcactgccctgagcatgtgcacacccagccaggttgcaacagttcctaggcttggcctyaactttgagatcagagtgggtgctgggagctgggagaggccaggcagtcggagcaggtacttctgagcctgcagagggagggggaattccctttctgggc

SEQ ID NO: 43726 - DNA, 201 bp, Homo sapiens
agggagggggaattccctttctgggcccttgagattgcagagatgcccgggtccacagccacagcttgggtggctgtggctgcagctgcacccaggagggyggggctcctgcctgctcccagcccccaagagcacagggatgcccaggtttgcagccacaactgggcagccacagctgtgcccagggagcgtgaggctctc

SEQ ID NO: 43727 - DNA, 201 bp, Homo sapiens
gccaactcagaagggggcgaggcttcttccacccatttctggctcctgtcggttctgtggagcatgcagccctggctgcgcctctcctactgcagctggcrttacggctgtggctgttccagatgggctgccattgccatcataatgacctggatttctcttgccaacctctccatgcctcaccgtcttcttattgctgat

SEQ ID NO: 43728 - DNA, 201 bp, Homo sapiens
agaagggggcgaggcttcttccacccatttctggctcctgtcggttctgtggagcatgcagccctggctgcgcctctcctactgcagctggcattacggcwgtggctgttccagatgggctgccattgccatcataatgacctggatttctcttgccaacctctccatgcctcaccgtcttcttattgctgatctttggag

SEQ ID NO: 43729 - DNA, 201 bp, Homo sapiens
gcgaggcttcttccacccatttctggctcctgtcggttctgtggagcatgcagccctggctgcgcctctcctactgcagctggcattacggctgtggctgytccagatgggctgccattgccatcataatgacctggatttctcttgccaacctctccatgcctcaccgtcttcttattgctgatctttggaggtttgctg

SEQ ID NO: 43730 - DNA, 201 bp, Homo sapiens
acttttaaacacagaaacacagagaagtattgttttgtcctgtgaataccaaaactttgatttggatttattagtgagaaaaaagcaggatcaaacgtttycctactttttaggagttctgtgcaatacctcaaattctatccagaatgttcctacaaagtacagtatgatgttagacactctttacatccaacatgtttt

SEQ ID NO: 43731 - DNA, 201 bp, Homo sapiens
ctgaatttaggatgagagatcttatttaattcaactccctgattttagaggggaggaaactgaagcctagagaggtgtattggcttgtccagagtccacastagaaaccacctttcttttgtgggccaattctttattcatgtttatacttttattttcacactctgttattttcttgcttatcaaggctctcatagaaat

SEQ ID NO: 43732 - DNA, 201 bp, Homo sapiens
ataaataacatttgtcaggattcatttttgctaagctttaggtcaagtagaatttagatttatccttgctatctctgagtccttctctggtcttccttgtstcatttgtcgtggcaacccttttctctttttttacaggaatagggtgtgggtggagggggcacttaggttttcctcttagtgccttgtactcttacatga

SEQ ID NO: 43733 - DNA, 201 bp, Homo sapiens
ctggtgaggttgtggagaaaaaggaatgcttatatgctgggtgagagtgtaaattagttcaactgttgtgtaaggcagtgtggtgattcctcaaagacctraagacagaattaccattcaacccagcaatcctgttactgggtatatacccagagaaatataaattgttgtgtcataaagacgcatgcacacgtatgttca

SEQ ID NO: 43734 - DNA, 201 bp, Homo sapiens
taacaaaatatcatagactgagtagctcataaacaacagaaatttattcctcagagttctagaggctggaaagtccaagatcaaggtaccagcagattcartttctggtgagggcctgtttcctggttcctagatgacacctcacatggtggaatgggtaaagggtctcttactcatgtattcacacagtggaagggataa

SEQ ID NO: 43735 - DNA, 201 bp, Homo sapiens
gtttgcaggcactggcttctagctgcatcttccctaatctgttcccacctacttccgcacctgtgtttctcaactttcatttgggggcaaaaggtactgtsagtgccttgcaacggaagtttaggtctgtgtttctgagtgagttggcattctttccacctcccacttcagcacccacccttggaaagctcttatctgtct

SEQ ID NO: 43736 - DNA, 201 bp, Homo sapiens
cccagttcttttaaagttttaagttcatgtgtatgtatatatatgacaggctgggtcctctaggaggcagattctgagatttgcattcaggaggttcattsggagtgctgggctgtgttatggtcaaaaggcttcagccagccctgcagagaactctgaggctagagtggtccttcagagttacctcaacttggggtgagg

SEQ ID NO: 43737 - DNA, 201 bp, Homo sapiens
tgggaggccaaggtgggtggaccacttgtgcccagaagttcgagagcagcctgggcaacatggccaaaaccccatctctacaaaaaaaaaattagctaggygtggtagtatgcacctgtagtttcagctactcgggaggctgagatgggataatcaccttgaacctggaagattgagactgccagtgagctgagattgcgc

SEQ ID NO: 43738 - DNA, 201 bp, Homo sapiens
cattactttaaagattcagtatgccaaaggttactgaagatattgagaacctacagaagatttcttttattcatagattttattcagatatgcaacgattrcatccagaaattctatcagagcattaatgaaaataatagtattacataacaggcaatcacagtcagtatccacatgtcacttattttgtagattgtgaca

SEQ ID NO: 43739 - DNA, 201 bp, Homo sapiens
ttattcatagattttattcagatatgcaacgattgcatccagaaattctatcagagcattaatgaaaataatagtattacataacaggcaatcacagtcartatccacatgtcacttattttgtagattgtgacaaatttttcattctaaacaggctgctgtcactttaaatgcttatgggaatactttccacctttacgc

SEQ ID NO: 43740 - DNA, 201 bp, Homo sapiens
tgagggaaaagtatctatgagaatttaaaaataaacttagccctcttcctctgcaaagtccagagacaaattaaactctttagttgccatattattattgktctttttctctgaaaaaaacctagaataaaactttactacaaaggatatatatacaagatagtaataaaatatgtcaatttctaaatttgctgtagaaat

SEQ ID NO: 43741 - DNA, 201 bp, Homo sapiens
cgatttaataaagttatgagaacttacatgtcctttttaatcctctaatttatttcagctttcaggcacagttttgatctcctttctttatttcacaggcrcagcagaacaagtccctgattttgtcaccttcctttaccaaataactagaggaattgcagcaaggagttatggattaaatgtggctaaactagcagatgt

SEQ ID NO: 43742 - DNA, 201 bp, Homo sapiens
ttaagcctgtgtttgctgcaggattttggtagctagccttgacctggttgaagaagttgtctaagggtcattttgttctctcactcactcaccacttagtrgtggatggtgtcgggaagaaacctgtttcccagctaaataaacatggtttaaatattagagctgtgaagtctaaatttttatatgatattttttctatat

SEQ ID NO: 43743 - DNA, 201 bp, Homo sapiens
agccttgacctggttgaagaagttgtctaagggtcattttgttctctcactcactcaccacttagtggtggatggtgtcgggaagaaacctgtttcccagytaaataaacatggtttaaatattagagctgtgaagtctaaatttttatatgatattttttctatatatacaaagaattgatttttgtatatcaattacct

SEQ ID NO: 43744 - DNA, 201 bp, Homo sapiens
cttttgaaaatattggaaagggaaagtgtcagacttacttactttgggtaatatatcttcttcatatatatatatatatatatatatatatatatatatayacaatctaaattcgaagagagtaatatttctattcatgtaaatgccatacacattttactcatcaaggccttcaaataagtttcacatctgacttttaca

SEQ ID NO: 43745 - DNA, 201 bp, Homo sapiens
tgacccagagtcacacagctacttgatggtggagcagtaattggaactcaggtactctagctccataccctaaatagtcaattgggttgctattctgcagraaaaaaaaaaaagtaagtctgtgttatgctggcgttttactctttaattagcttcattgttttcggttggtgttacttttcatcctgggaacacttcata

SEQ ID NO: 43746 - DNA, 201 bp, Homo sapiens
acttcttcaagtatttgcatttttgttgatacaaatgtgaaaagaatcagaaataatcagctctagaacctattagaaatgtattgaaatttggaatttartatttatgaatgaatatgttccagatgcatgcttgacggctgatgagcaatgacattcagaatgtcttacccatttcagatatatatgccttgaaaacca

SEQ ID NO: 43747 - DNA, 201 bp, Homo sapiens
ttataattagagaaagctgaaggctcattgaatcaagaccggtagcagccttggtttcaattaattctaaacacggcttgagttgctgaggctcctgactrtcagactctaccttgtcttttatggtgttaaaaacagttcacccatagggttttccagagctaaaagtagaggattctttgaagagtggatggcaaggaa

SEQ ID NO: 43748 - DNA, 201 bp, Homo sapiens
gataagccataaatctggttcaaaggtttccacaaagctaaatttgttcagttaaatagttcacagtgcccagaaagccaaatgaattaattagttaagarggcaacttaaaacaaatttttattgtgtttgacagcaatcttttagtaataaaatcagctagaagaatatattgggtagtatcacacagactaggtttta

SEQ ID NO: 43749 - DNA, 201 bp, Homo sapiens
taaaacatcaatgcccaatactgctgtggataagccataaatctggttcaaaggtttccacaaagctaaatttgttcagttaaatagttcacagtgcccaraaagccaaatgaattaattagttaagaaggcaacttaaaacaaatttttattgtgtttgacagcaatcttttagtaataaaatcagctagaagaatatat

SEQ ID NO: 43750 - DNA, 201 bp, Homo sapiens
atgagacattttatgaaaaagaacaccgttagccaatagcaatacatttaagtgccataagtaatacagtagactttagcatttttttttctgttcagtaktaattgttttaagccaccagcctgtagtcctgtggtggtttgcgcaattggtatgctgcaatggaaaatccatcatgcaagataccccagagtccagatt

SEQ ID NO: 43751 - DNA, 201 bp, Homo sapiens
ataggaaaattgttatgcaatccttggggtgttgcttcgccagctgtaaacctctgtggctggtggtgcctttgcccgagtttttacttgggcctgctggrctcattcctcccactcggcctggcaggctgtgcttggcttttgcttttggcctgaatctcgcagctgccaagggtgagccaggagtggagtggtgagggt

SEQ ID NO: 43752 - DNA, 201 bp, Homo sapiens
atcatactagctaaagaaacagttgctaacttgtttaccaaagtacagtagtgcagttaacttctctttctctacctccttctcctgtgcttccgccttgyactcctccacttcggtatactgtagttcaccaagtccagagtgctggactctacaaatggcacacagcctcctctagtgacactcttttctggctcattt

SEQ ID NO: 43753 - DNA, 201 bp, Homo sapiens
gaaaaaacaaaaacacacacagcaaaaagaaaagacaaaaacacccataaccaaccaaataaaaaaccacacacacaacacattaatacttacgttaataycattgattaaaataacctatacctttgctctctaaaggtctggggttgtgagctaacttaaaaaccagcttggttgttcacagttactggtttccttttg

SEQ ID NO: 43754 - DNA, 201 bp, Homo sapiens
aatcctgaagtttatagatagcttagattgaggacagacagtggtaaagccctaaagaagagcttctgaaccctgaaccctgaggtacatggtccatggtyggatgtggcagaaaggtcagcgcccaaatgagagagctgcaggggaataacaaacagccagccagttttcattttagtgtatgaaggaaatgttaagcaa

SEQ ID NO: 43755 - DNA, 201 bp, Homo sapiens
agcgataactgctgtaattaataaacttcgaatatgtatttgcatgttttgattttttagagttggggataaaactgaattatttaaagacctttctgacytccctttaataaaaaagaggaaggatgaaattcaaggtgttattgacgagatccgaatgcatttgcaagaaatacgaaaaatactaaaaaatccttctgc

SEQ ID NO: 43756 - DNA, 201 bp, Homo sapiens
caaacacataaacctttttttttaaagcactagtgaaacatttaaaaatttttgagcactgacagggtatctaatgatactgaagaattacttaaaaaaaygtttaagtgagataaacagtgcaatgcaatggttatgatttaatagaaaaatccttactttagtgatacatgctaaaatgtttacatattaaatgatttg

SEQ ID NO: 43757 - DNA, 201 bp, Homo sapiens
taaatgtgggaaacttttttggttgttattgtttcacattttttctgtcttcctgtctcttgtgtctccttctgagagtttattacagggatgttaactayttgatgttatctgttaagtcattgaggctcttttcatttgttttccaggcttatttctctttgtacttcattgtggatagattctactgctctgttttca

SEQ ID NO: 43758 - DNA, 201 bp, Homo sapiens
gcatacactgttgctattattattgtgaacaaaatgttatgctagatccactaaaaataagaaaaataaaagtttttcgccttcactggttccttcttcartgctgcacttttctttatgtagatacaagtttctgacccctgtcattttccttccttctaaagaactttccttaaacatttcaggatagatctgctggct

SEQ ID NO: 43759 - DNA, 201 bp, Homo sapiens
acttttttggttgttattgtttcacattttttctgtcttcctgtctcttgtgtctccttctgagagtttattacagggatgttaactacttgatgttatckgttaagtcattgaggctcttttcatttgttttccaggcttatttctctttgtacttcattgtggatagattctactgctctgttttcaagttcagtggtc

SEQ ID NO: 43760 - DNA, 201 bp, Homo sapiens
taataccgattctgaaacttaggtttagttccaaaactgatacttattaaagttgctaaaaatagtttttacttacaaaaattatatttccactgtagtastggaaatttaaaaaaaaaagtaaaacaacaaagctgggcatggtggcacatgcatgtaatctcagccacttgggaggctgaggaggaaggattgcttgag

SEQ ID NO: 43761 - DNA, 201 bp, Homo sapiens
ttgatctcagtcagtttggatcatcaaatacaagtcatgaaaatttacagaaaactgcttccaaatcagctaacaaacggtccaaaagcatctatacgccrctagaattacaatacatagaaatgaagcagcagcacaaagatgcagttttgtgtgtggaatgtggatataagtatagattctttggggaagatgcagagg

SEQ ID NO: 43762 - DNA, 201 bp, Homo sapiens
ggaggcttgttagactcttcactcttaactatttaagtgggtgtggcagatttgaaactgtagtaattctctataaatgagggcatcactagttcaaaacwgttttctaatgatgaaattttttagattagccactaattcttaatataattaatgtaaaagctacagtgtttctattaatgggaaaaataaactcaagaa

SEQ ID NO: 43763 - DNA, 201 bp, Homo sapiens
ccgcctgcctcagcctcccaaagtgctgggattacaggcttgaaccactgcacccagcccgaaagaaattcttaaaatctactgaaagttaagatgaccckctatacacccttcacctaggttcatcacatgttagcatttgccacatttgctttttatctctcatgtattttttttcctgaaacatttggaagtaagttt

SEQ ID NO: 43764 - DNA, 201 bp, Homo sapiens
catggcaatggttcctaaacttggatggtcttctgaatcatctgagggagcttttgtgttttagtttagttttcttacatccctggagattcgatttactrtgttttgggagggattaattggtttgtatgggaacaaaacaaaagccttccaggtaattctgaggtatttcctggatcaggagcccttgacttggaggga

SEQ ID NO: 43765 - DNA, 201 bp, Homo sapiens
ttacctagaatagtgggttctgaagtactgtcaggttctctgaggtcattcatggcaatggttcctaaacttggatggtcttctgaatcatctgagggagmttttgtgttttagtttagttttcttacatccctggagattcgatttactgtgttttgggagggattaattggtttgtatgggaacaaaacaaaagccttc

SEQ ID NO: 43766 - DNA, 201 bp, Homo sapiens
tagcagttatccacttctggtcttatttcctttttaatacccaggaatagctgtgtgtactgctaagaattcacttttctgcagtatcacacagttcaggytgaagacagaggaccgctttccttttgtgatatttatgctacaaagtaatgttttgcctaatgcatttccacttatgagataaattgtggatattatcaa

SEQ ID NO: 43767 - DNA, 201 bp, Homo sapiens
gcagtttcttctgaagattcgaaacgtcaaattaatcaaaaggtatgtaactgctatagatgagtatccagttacctagaatagtgggttctgaagtactrtcaggttctctgaggtcattcatggcaatggttcctaaacttggatggtcttctgaatcatctgagggagcttttgtgttttagtttagttttcttacat

SEQ ID NO: 43768 - DNA, 201 bp, Homo sapiens
ggctgatgttatttgtatatacttttttattcattgagctatgaactccagagttagtatggtttaaaaaaactttttttgttgttttgttttggaaacakctccttcttgggaaaataagagttagtatttctagagaaaaatgttagtttagaaagagtagttattttaggctaaggcagacctgagcttgttaatgaa

SEQ ID NO: 43769 - DNA, 201 bp, Homo sapiens
ctttaactctctgcaaagaccctatcttcaaataaagtcacattatatactgagggtgtggacttccacatttgaatgttatagggacataattcaactcrtaacatagggcgaggacattcttttccacctccctcctcagtccgtttgtgcctgtggtagttgcacagtaaagatttgtagatttgaaaaggaaatacc

SEQ ID NO: 43770 - DNA, 201 bp, Homo sapiens
tatcctttttggggttcactcagcttcttgaatctgaaagttgatgtctcttgccaaatttgtgaatatttcatctattatttcttcaaggtttttgttgktggtggtggtgttttttttgttgtttttttttttttttgcctttcttttctcctcttgggactttgatcacaagaatgttagatcttttgttatagtccc

SEQ ID NO: 43771 - DNA, 201 bp, Homo sapiens
tgtaaaagtgaaaaaagtctattttaaaggaaaaaataattcttgctaacctcctcacccatttcacttaaattagttttattataatgtgacttaaatayttataaactgaaaacttagtgctctaggttttatacctattttaacaggaataaagtccaagcaaaatttgagattaaagtaaatgtatgaaacaaataa

SEQ ID NO: 43772 - DNA, 201 bp, Homo sapiens
tgggaaggtgggactgggtagaaagagggcattccaggaagtgtggtcacaggatgagaaaagggaattgggaacatcgagttgactggagtgttaggaawatatgggtcaagagtagcctgcaacagaatgtagtgcagaagagctgttcagtgagtatttgctgaatgattatgtttaaggccagagaggaagactgga

SEQ ID NO: 43773 - DNA, 201 bp, Homo sapiens
tttgtgaacttgcattcctgctgcaaaatcacttttgtattctgtggtttttttttttttaactttacaattccccatttttaaaaactttattgcagaamatttcaaacatacacaaaattatacagaatagtgtcatgaactcctgtcactctattagccagcttcagcatttctcaggaccattctcatttttctaca

SEQ ID NO: 43774 - DNA, 201 bp, Homo sapiens
cagagaaaatgactgttaaacattttggcacattatttccatgtgtgtatatcacttttttccatttgtgaacttgcattcctgctgcaaaatcacttttstattctgtggtttttttttttttaactttacaattccccatttttaaaaactttattgcagaaaatttcaaacatacacaaaattatacagaatagtgtc

SEQ ID NO: 43775 - DNA, 201 bp, Homo sapiens
tatatgttcattcagaagacaaaaaaaaaaggataaattcataagttgaattctgtaacccagagaaaatgactgttaaacattttggcacattatttccrtgtgtgtatatcacttttttccatttgtgaacttgcattcctgctgcaaaatcacttttgtattctgtggtttttttttttttaactttacaattcccca

SEQ ID NO: 43776 - DNA, 201 bp, Homo sapiens
atagtatcatttagatatctgtgagtctgactcttcgtgtaagagtcctgaaaagcagacaggtttctaacactttagaaatagagtacatacatactccygagtgtatcatctttactttttccatgtttatgctgtgttatagccataactggggaaatacattttttctgtaacattatatttgtatttgtttttagg

SEQ ID NO: 43777 - DNA, 201 bp, Homo sapiens
cactatgttgcccaggctggtctcaaactgttgaattcaagtgatcctcctgccttggcctcccaaagtgctgggattacagggatgagctaccttgcctrgctgattttaatttttatcaatgaacataatttttaaaattcaatggtgctaaaaggctcctgctgacaagcttccatcccttcagttcacgtccttccc

SEQ ID NO: 43778 - DNA, 201 bp, Homo sapiens
ccactgcccttgttcaggccttatctcttccagcagctgttccaaaggcctactctgttttcctttcggagtgctcacctccaccgaagcctccacccagytgccaattctgccccatgcctgataatttgctcgtgcgttgacatacataaaatttctaagacaaaaattttttaataatggtaaatgaaccttgggaac

SEQ ID NO: 43779 - DNA, 201 bp, Homo sapiens
taaataaaaacccagcctgcctgagtgcctgagttcctggatttctagaggtggtgttgcatatagacagttgagcagatttttctctagttttatggtaycagagaatttgtgataagggaagacaggaaatccatctttattcattatcctcaggaaattaggtaaagagaatgagaaaaaaaaaaagttccaattcag

SEQ ID NO: 43780 - DNA, 201 bp, Homo sapiens
ttatttttttctttatttttatttttttattttgtagagacagcatcttgctttgttgcccagggtggtctctcaaactcctagccttaagtaatcctacyaccttggcctcctaaagtgctgggattacaggtgtgagccactgcgcctggctgtgaaccattattttaaaggagaaaatagttaatattattggaaatt

SEQ ID NO: 43781 - DNA, 201 bp, Homo sapiens
ataagtatagattctttggggaagatgcagaggtaagtcgtcttttcaggcactattttatatttttcttgtctagccttagatatttttcagtatttttrtttcattttctgaccttatataaaagctgatttgatcaatcaccttttaaaaaatactgttatgtaaagtaaaaactaaaaatgaacacaagaaacttgg

SEQ ID NO: 43782 - DNA, 201 bp, Homo sapiens
atacaagtcatgaaaatttacagaaaactgcttccaaatcagctaacaaacggtccaaaagcatctatacgccgctagaattacaatacatagaaatgaarcagcagcacaaagatgcagttttgtgtgtggaatgtggatataagtatagattctttggggaagatgcagaggtaagtcgtcttttcaggcactatttta

SEQ ID NO: 43783 - DNA, 201 bp, Homo sapiens
ggtggtgcctttgcccgagtttttacttgggcctgctgggctcattcctcccactcggcctggcaggctgtgcttggcttttgcttttggcctgaatctcrcagctgccaagggtgagccaggagtggagtggtgagggtgaggggtgtgtgagcaggtgaccatggggtctggcccctgtgcactgccaggcatgctggc

SEQ ID NO: 43784 - DNA, 201 bp, Homo sapiens
atatacctgcatttaatatagaatacatactatattccatgacataaaagtcatggaaacaaaataggaaactcatcaaaattaaaagcaaaggcattctyaggtataggaaaattgttatgcaatccttggggtgttgcttcgccagctgtaaacctctgtggctggtggtgcctttgcccgagtttttacttgggcctg

SEQ ID NO: 43785 - DNA, 201 bp, Homo sapiens
tgcttaatattcaagtatttagattgatttaattgttagcatcccataaggataaaacttttttttcctggaagcttatctcatttcctaaaagaataaartataaagtaagaataagtttttacaatgtaagaaatatattttctgtgttgattaacttttatactacatagtatatacctgcatttaatatagaataca

SEQ ID NO: 43786 - DNA, 201 bp, Homo sapiens
catgtccacatcacaggaaattagaagtaagtagacagagggggcacgtagaagcagtgccattattacaagtgataagctgtttgatggcatggatagaygtggatgaatggcaaaaagctactgagtgaacataaatgccccatggtccaggaccattagggtggggtcagcaatgccataactctcaataggttttga

SEQ ID NO: 43787 - DNA, 201 bp, Homo sapiens
attgctttatacatagaatgaccaacttggcatgtccacatcacaggaaattagaagtaagtagacagagggggcacgtagaagcagtgccattattacargtgataagctgtttgatggcatggatagacgtggatgaatggcaaaaagctactgagtgaacataaatgccccatggtccaggaccattagggtggggtc

SEQ ID NO: 43788 - DNA, 201 bp, Homo sapiens
cactgcactccagcctgggcgacagagcaagactccctcttaaaaaaaaaaaaaaaaaaagattctgagtcaaagtgctcaagttgaatgcattttgtcayccacaagacaaaacgtgttaaccccttgtggtttactttatctataaaatagagataacaatagttcctgcttctagggttgttgtgggaattaaagact

SEQ ID NO: 43789 - DNA, 201 bp, Homo sapiens
attattgctttatacatagaatgaccaacttggcatgtccacatcacaggaaattagaagtaagtagacagagggggcacgtagaagcagtgccattattrcaagtgataagctgtttgatggcatggatagacgtggatgaatggcaaaaagctactgagtgaacataaatgccccatggtccaggaccattagggtggg

SEQ ID NO: 43790 - DNA, 201 bp, Homo sapiens
tcacctaagtatagtggttattaagcatagaagtcataaagtttatccattaaagctcactttattgataggagcatttactccaaggtctcagaagagcrtatacattattgctttatacatagaatgaccaacttggcatgtccacatcacaggaaattagaagtaagtagacagagggggcacgtagaagcagtgcca

SEQ ID NO: 43791 - DNA, 201 bp, Homo sapiens
gaaattctaatgaaagctgttggcctttttcttcagaaaaattctcaagccaacaaaattttgcctataattttcaagatttcacacctttcccacaaagyccagatccatgaactcctccctcagccaggctaatattgattgacttatcttagatcatcaagaaaaaaaaggtgtttttgtttttagtctcttttaata

SEQ ID NO: 43792 - DNA, 201 bp, Homo sapiens
ttagagaaatggttctatatatgtatatgtatgtgtgtatgtatatatatgagtcattgaaattctaatgaaagctgttggcctttttcttcagaaaaatkctcaagccaacaaaattttgcctataattttcaagatttcacacctttcccacaaagcccagatccatgaactcctccctcagccaggctaatattgatt

SEQ ID NO: 43793 - DNA, 201 bp, Homo sapiens
tattttttaaaagtttacattttattttgtattttatttttattgatggagtcttgctctgttgtccaggctagagtacagttgtgcgattatagttcacwgtagtctcaaacttctggtctcaagcaatcctcccaccttagcctgcagatgaggtgagactaaaggaaaagcagtcattttaatctgtagctgtgattg

SEQ ID NO: 43794 - DNA, 201 bp, Homo sapiens
tcgcaaccttagctttacattggaatcacctggagaacttcaaacaaaaattgccattaagaaccttccctcagaatcttatctaattggttttcactgasaaatgggcatggatattttttaaaagtttacattttattttgtattttatttttattgatggagtcttgctctgttgtccaggctagagtacagttgtgc

SEQ ID NO: 43795 - DNA, 201 bp, Homo sapiens
aatcagggaatttaactcatgctccatcattgaaatctgtaattcagaatagtgattggttcgcaaccttagctttacattggaatcacctggagaacttmaaacaaaaattgccattaagaaccttccctcagaatcttatctaattggttttcactgacaaatgggcatggatattttttaaaagtttacattttattt

SEQ ID NO: 43796 - DNA, 201 bp, Homo sapiens
tgctttattgggaatctacctctttaaaaaattctatgctggttatgaattgacataatgagaccaaaattactattgttctgttttcttcttatttgctrcctaagagccaaagaaatgtctgaggaccaggaatgtttcaaagtctctggaaaaattgaaagaattctgctgcgattctgcccttcctcaaagtagagt

SEQ ID NO: 43797 - DNA, 201 bp, Homo sapiens
tgtatatacttccagattttaaaaatttgtacatgtgtatatgtgcatagtcataagctcaaaaattagtttaaatatattttacagattatattatattytatactaatttgctactatctttttctactattaatagaatttagaaaattttgaacaattttcagtatcaggacctgcagatctactctccccgctttt

SEQ ID NO: 43798 - DNA, 201 bp, Homo sapiens
ggtttcaggaatgagtgaaattgcatctgtgtttaatatgccatctttaccctgaacccagtgtttctttctttttttaaaaaaatcacattatagttagrttcattgctttattgggaatctacctctttaaaaaattctatgctggttatgaattgacataatgagaccaaaattactattgttctgttttcttcttat

SEQ ID NO: 43799 - DNA, 201 bp, Homo sapiens
tttgcctttccagggaagaaatctccagttggctgctgatgtggaggaaggacagttgtctttgagcttggagtatggtaggggtttagggaacaaattgytttgaaccaatcctctttattttagaacctccctttattcctttccagagctactggtactctaattcctgagtcttttgagcattttgtgttgtaatta

SEQ ID NO: 43800 - DNA, 201 bp, Homo sapiens
tctttccgcttgagctagtaagatttcccagtcaagagtcctcccagcttctgcctggaggggagtaggagtgctctggcttcctgggttctggagaggcygtggatctcagcatacattgtgtctgtgttcctaatcgtccttctgggttaggtacagtactccatcaactgtgcttgttttgcctttccagggaagaaa

SEQ ID NO: 43801 - DNA, 201 bp, Homo sapiens
ggaaacaaaaagtacactccacagggtgggagtgggccctagcaagcagcttgggagcaattttaaacttttagaaatgaacaaaacacaactcttgccckcagagtgtttttgctttaatagggaaggtaagaggtgataaatgtgtgcagtcccagttcctttacatttaatagcaccaacctaatagtagtgctctaa

SEQ ID NO: 43802 - DNA, 201 bp, Homo sapiens
tggaaacaaaaagtacactccacagggtgggagtgggccctagcaagcagcttgggagcaattttaaacttttagaaatgaacaaaacacaactcttgccytcagagtgtttttgctttaatagggaaggtaagaggtgataaatgtgtgcagtcccagttcctttacatttaatagcaccaacctaatagtagtgctcta

SEQ ID NO: 43803 - DNA, 201 bp, Homo sapiens
agggaaaattttaaactattttttttgaagcaacaaaagcagagatttattggaaacaaaaagtacactccacagggtgggagtgggccctagcaagcagyttgggagcaattttaaacttttagaaatgaacaaaacacaactcttgccctcagagtgtttttgctttaatagggaaggtaagaggtgataaatgtgtgc

SEQ ID NO: 43804 - DNA, 201 bp, Homo sapiens
gtatatttttgaagagcgatacaaatatacatttcaaaaaagagagtaatagtaaacaaggtgaatatacatttgagaaaagagtcaaatttaaatttttrtggctagaaaattcacaggagatctaatgaaagcctgtgaagaggtttaaatataaatagggaaaattttaaactattttttttgaagcaacaaaagcag

SEQ ID NO: 43805 - DNA, 201 bp, Homo sapiens
atgtcctttttaatcctctaatttatttcagctttcaggcacagttttgatctcctttctttatttcacaggcgcagcagaacaagtccctgattttgtcrccttcctttaccaaataactagaggaattgcagcaaggagttatggattaaatgtggctaaactagcagatgttcctggagaaattttgaagaaagcagc

SEQ ID NO: 43806 - DNA, 201 bp, Homo sapiens
tttcacaatactttttttttttttcccagcaaatacaactccaagatcttcatcccactttcattccaggcagtttttttttatgtctataggagggaaamtctttgtataacatacacacttatagtatatttttgaagagcgatacaaatatacatttcaaaaaagagagtaatagtaaacaaggtgaatatacatttg

SEQ ID NO: 43807 - DNA, 201 bp, Homo sapiens
tgccctagcagaggttctccatgagagctctgccctgtagcaaatttctgcctggacatccagttatttccatacatctctgcaatctaagcggaggttcscaaacctcagttcttgacttttgtgtacctgcaggctcaataccacatggaagctgccaaggcttggggcttgcatcctctgaagccacaacctgagctg

SEQ ID NO: 43808 - DNA, 201 bp, Homo sapiens
taacatatccccatcattaaatgatgcaagactgtcaacacctgtagtaagttttaggcagtgagtaagtatttattattcatctagtagcatctgccagmcataagagtccctgattatttcatctctgtttttaacactttggttttaaatactgtcaaagtcaaataaaatatagagacaaatctctaaaacatttta

SEQ ID NO: 43809 - DNA, 201 bp, Homo sapiens
tattgtgtgggagtcttagtctctttgtaggtgtctaaggacttgctttatgaatctggatgctcctgtattgggtgcatatatatttaggatagttaagycttcctgttgaattgatccctttaccactgtgtaatgcccttctttgtctcttttgatctttgttgctgtaaagtctgttttatcagagactaggattgc

SEQ ID NO: 43810 - DNA, 201 bp, Homo sapiens
atatttgggtcggggcacagtcaaactatatcacattggaaaagattcaaaaatatatttttagcataaaggaagtcatggtaaacaaggtaactgtataytggaaaagtcatatttagaagaaaagagtcactgtatttcttcggagattcttagcctttagcatataagacatcaaaggttttttatttttaattatag

SEQ ID NO: 43811 - DNA, 201 bp, Homo sapiens
atttcgactgctactcttccttgtatctcatgttattatcttccttgaatattcttttttttttctttgctctgttgcccaggctggagggcagtggcatmatctcagctcactgcaaactccgcctcccaggttcaagcaattctcgtgcctcaacctcccgagtagctgggattataggcacttgccaccacacccggc

SEQ ID NO: 43812 - DNA, 201 bp, Homo sapiens
ggagagctgattgtataccctctaaaaggatgaattttatgctatgtcacttatatcttaataaagctattatttttcaaaagtacatgccgtgtgttagrgatggcaaggataaattgttgtcatggtgacatgggatcctgtgttgtgcagaaggagaggagactggagagaggtgtaggatcagaccacacagagggt

SEQ ID NO: 43813 - DNA, 201 bp, Homo sapiens
gttagtatgaaataactacaggaatggagatgtgtggctaaggagaaaagtaaatctaaaacttcacctttctggaggggtcatgcaaggaggcgtgacttgagagaatttgccacggttaatgttacaattctggggcagcctacctttcattgcttgattattctgcatagacccattttttaggtctacaaacactga

SEQ ID NO: 43814 - DNA, 201 bp, Homo sapiens
aagatgattccagtataatggaaccatgagaacacacagaggaataaaggtgtgtcacatcagctctttgaatatgccacaaaaaaaaaaaaaaaaaaaargctctgaattagttttccctcagtatctgctggggactggtttcaggaccccccagtatgaaaatctgcagatgatcacatccctgatataaagtgggat

SEQ ID NO: 43815 - DNA, 201 bp, Homo sapiens
cgcaataagtacgtttgtttgtttttaaaccagagatactgccacaggaaaagcccaagggtgacccctcacttgggtcacctgcacagtatttttcagaytgaggctgtggaagggcattgaagactggtgtttagccacctaccgtgttttaatgtaggtggcagcttgggtgcttcaaaatcttgttcctttcgtata

SEQ ID NO: 43816 - DNA, 201 bp, Homo sapiens
actgtacaaggatatcgtaatctatatggaagcacaaaggaacatataaatttaaatccttttgctccatgatcagtcacttcttttcattttaaactttrattttggacattcacaaaattgttaactcttgagtgatgtggattgagtaagttgtattacaattgtaaaaacaaatgattcatttcaacttgtattgaa

SEQ ID NO: 43817 - DNA, 201 bp, Homo sapiens
tttttgtagtttagattataaagtctgaaatacagtttgggtggataaagtttcttaggatggtatagatgtgactaatcatggagtccttcctgttgccrtccttcaacgcaataagtacgtttgtttgtttttaaaccagagatactgccacaggaaaagcccaagggtgacccctcacttgggtcacctgcacagtat

SEQ ID NO: 43818 - DNA, 201 bp, Homo sapiens
tgccccccacctccctcccagaaatcttaagttggactggggcatggtctggaagtcacattttaaaagtgtcccagatgatttcaaagtgaagccaagaygtggaagcacttcctcaagccctcgctggagaaatcatgtgttgaattataaaaataataggtgcttattatgaaatgtaacaggtgtactagggtatga

SEQ ID NO: 43819 - DNA, 201 bp, Homo sapiens
gggaatgactgaagttaaggaaacatgttggagcaattgtaaaggcaatgtgtgtcacattttctgccacttgtcatttagattgtgtaagctaaatctartataagtgggaccattgtttgaatgaaaaaaaatccaaacttgagatgtagagaaatatagatgaatttgaagcccagaaaggacatttaagctctctta

SEQ ID NO: 43820 - DNA, 201 bp, Homo sapiens
ctgcccttaggtctccagtttttaagactgcaacagcatggctcaatatttgaaatcactacggttaaaagcagtcatattgtgcagttccccagtgaacwctttttgtagtttagattataaagtctgaaatacagtttgggtggataaagtttcttaggatggtatagatgtgactaatcatggagtccttcctgttgc

SEQ ID NO: 43821 - DNA, 201 bp, Homo sapiens
cttagttgctcagtctggactctggtccctaaagtgggaagtctcaggcaaatctgagtatcagaccatgccggcaattcagctctcttcacctgcttctytctctgcaagatgggataatcatgatacttatatttcagggtgttgtcatgtagtttaaataatgcatataaaacaatctagtacctgacatatagtagt

SEQ ID NO: 43822 - DNA, 201 bp, Homo sapiens
agggacttgagtgttctgatctaaatctgtggtcactgcagctatgtctgcattagggggcaccccaagtccagtaatactgtagctcttgtagactcttwgagttaccaccttggtggtcttgcataatattctggaaaattccctggatttctaggcagagactcttgttgtcctcctttactttcccccaaacaaacg

SEQ ID NO: 43823 - DNA, 201 bp, Homo sapiens
tgttagttctatttttagttttctgaggacctttaactcttatccataacagttgtactaacttacgttcctaccagtagtgtacaagagttaccttttckccacatcctcaccagcatttgttatcgcatgtcttttgaatatgtcattttgactggggtgagatgatatctcattgtaatttcgatttgcatttctctg

SEQ ID NO: 43824 - DNA, 201 bp, Homo sapiens
ggttgcagtgagctgagatcatgccactacactccagcctcggcgaaagagcgagactactacgtcgcaaaaaaaaaaaaaaaaaaaaaaaaaaaggaaawaaataaataaataaataaagtcgaagccagagcaggaataacaaggcaaagtcagtgggcacccactcgggtttagggtgactcttaactctaaacaccc

SEQ ID NO: 43825 - DNA, 201 bp, Homo sapiens
ggcggaggttgcagtgagctgagatcatgccactacactccagcctcggcgaaagagcgagactactacgtcgcaaaaaaaaaaaaaaaaaaaaaaaaaarggaaaaaaataaataaataaataaagtcgaagccagagcaggaataacaaggcaaagtcagtgggcacccactcgggtttagggtgactcttaactctaa

SEQ ID NO: 43826 - DNA, 201 bp, Homo sapiens
tgacataatgtgtgaatgattgttactttattacatatataatatatataatacatatatacaaaaaatataatacaaatatatatatatatatatatatwttttttttcttttttttaagacagagtctcttttcgtcagccaggctggagtgtagtggcgcaatcccggtctactgcaacctccgcctcccgggttcaa

SEQ ID NO: 43827 - DNA, 201 bp, Homo sapiens
tttgacataatgtgtgaatgattgttactttattacatatataatatatataatacatatatacaaaaaatataatacaaatatatatatatatatatatwttttttttttcttttttttaagacagagtctcttttcgtcagccaggctggagtgtagtggcgcaatcccggtctactgcaacctccgcctcccgggttc

SEQ ID NO: 43828 - DNA, 201 bp, Homo sapiens
cctttcttacccaattacatctattctaaagctgtcccacttcttttcctttgagcacatgactactgctatctatctcctattcttaaccagcattaatwacactgtgtattagatactgttttaaaggctttatgtttgttgaccgacttaatcctcataaacacccttgtgaggttgctgctgttattttattacggg

SEQ ID NO: 43829 - DNA, 201 bp, Homo sapiens
aacaagaccactctgttactttactgttttagaaagcacttaagtataatgcttaatctactgtattaaaactgtatacaacagccaggcatggtggctcwtgcctgtaatctcagcattttgggaggctaaggcaggaggatcatttgaacccaggagttcaacaacagcccaggcaacatagtgagaccttgactctac

SEQ ID NO: 43830 - DNA, 201 bp, Homo sapiens
tgcccttgcagcttatatgtcggaggggttatcattaacaatttggcatatatccttgtgtaaaactccacacatacacacataaacatacacatatagtwctctgtatttgtttaacataactgggatttattcgttcagctaattttttgaatgcctattatatgccaggcattgggcatacaataaggaataaaacag

SEQ ID NO: 43831 - DNA, 201 bp, Homo sapiens
cggtggctcaaacttgtaatcccaacactttgagaggctgaggcaggcggatcacttgaggcgaggagtttgagaccagcatggccaacataccgaaaccmcatctctactaaaaatacaaaatattagccaggtgtggtggcgtgcacctatagtcccagctgcttgggaggctgaggcgtgagaatcacttgaaccctg

SEQ ID NO: 43832 - DNA, 201 bp, Homo sapiens
gatgttttaactttaaattaaactaaattggctgggtgcggtggctcaaacttgtaatcccaacactttgagaggctgaggcaggcggatcacttgaggcraggagtttgagaccagcatggccaacataccgaaaccccatctctactaaaaatacaaaatattagccaggtgtggtggcgtgcacctatagtcccagct

SEQ ID NO: 43833 - DNA, 201 bp, Homo sapiens
cccactccatttgcctgagagacatctagaatattatctcaaaatagtaagatctcataaaaacaaactgtttttcaaatttccatgaaagtgttttttaytttagaaactgacccaaaaaagtactaatttcttttttccacaatgctttattaagctttgttgacctatataagggttataggcgaggaggggagtagg

SEQ ID NO: 43834 - DNA, 201 bp, Homo sapiens
aataggaataatcattgcctctacttaacaattttaatatttaagctctagttatcattcaatatgaaaagtcctcttttcctaattgcagtatttctccsttatactagcattttccttgcaaaaggcccagagattgtgatttgaagggacagaagcccactccatttgcctgagagacatctagaatattatctcaaa

SEQ ID NO: 43835 - DNA, 201 bp, Homo sapiens
caaggtcctccttactgtccgtccctgctcagtcaccaaagaatgacttttttgaaagtacaattccagagttaaatactggctaagtgtagaaaacaatrctggaattcagtcttcacctccaccagtcctcatggtgagatgaagtgtttatgggtttctttgttgtaacctcaaaagtggaatgcatttcctggttgg

SEQ ID NO: 43836 - DNA, 201 bp, Homo sapiens
atttacaaagttaatacatgtttgttgtaaaagtgaaaaaagtctattttaaaggaaaaaataattcttgctaacctcctcacccatttcacttaaattarttttattataatgtgacttaaatatttataaactgaaaacttagtgctctaggttttatacctattttaacaggaataaagtccaagcaaaatttgagat

SEQ ID NO: 43837 - DNA, 201 bp, Homo sapiens
ctctgagcaataaacttctgtttacaaactgcccattctgaggtattctgttataacccaaataaacaaagatgccagctaagcaccgttctagagtcgaygtctgattagggcactaacatgttaactagtcacccctaggatggacttagttaaacctaattgtcagaacagcggaagtaaggactcatatctaaacac

SEQ ID NO: 43838 - DNA, 201 bp, Homo sapiens
ttacagtttaagaatgttagtatatttttaaaagcacaaccagtggggaaaattctatcccttttcttggcaaattaacaatctaagcatacaaaaatttrtaggaaaattttgccagctctccatcagagtgctgtcatgatgattagttcatatttccttcttacgaagcttgccctttcttgtttatcacccacagaa

SEQ ID NO: 43839 - DNA, 201 bp, Homo sapiens
gaggaggacggccatttttgtggtgggtacaccaccaaatgaccttttaaaaatattgctgcattaactttggtagaggagctgggtcgttatctccatcrtccattctcatatcttccaacatggtcttgatagtcacagattgtttggcaatttccacatcaaatatctccgcatcaaaactcagcatcttaattgacg

SEQ ID NO: 43840 - DNA, 201 bp, Homo sapiens
ggaggtggagcctgcagtcagcccagatcccaccactgcactccagcctgggcgacagcgagactccgtcccaaaaaaaaaaaaaaaaatgtgtgtgtgtktgtgtgtgtgtgtgtgtgtatatatatatatatatataaagaattctgtcaaataaattgtattcatgatagctatttgatatattatagttttgactac

SEQ ID NO: 43841 - DNA, 201 bp, Homo sapiens
agttggttatggggccggggagcctattgcatcattattgggtacaccatgttattgttttgctggcaatagcagaagctgtgctgatagtcgcaagtttyatggtagacctttttgaagttgcaatgtgggtgccaaaccatttgttgtttttatccttggctcagagcctgaaaattgatgcatattaaccttctttaa

SEQ ID NO: 43842 - DNA, 201 bp, Homo sapiens
gaggacttttgagcaaaatagtctaatgatctgatatacattttaaaaagaattcctctggctgctctgttaagaataccctgtagggtgcaaggatgaarcagtgagaccagatggaaagctgttgcagtgtttgtggtgagacatgaaattgatcagacaacttttttccctcacttagcaacatgttatagatggcct

SEQ ID NO: 43843 - DNA, 201 bp, Homo sapiens
gactgtagagttcttagaagagtatggcctttcttgctttttctcaaaggcaaatataatgtcaggtaattttgctgttatgctattgaaaaaatacctcytgagtcacaggaagcataaattattttttaaagatttaccatgtgttaggatgattgtgtcatatattaaatatataatggatgacatttagactattat

SEQ ID NO: 43844 - DNA, 201 bp, Homo sapiens
tttcttgggggtgtgtacttctgtttaaagtttgatagtaatgtctgaatgagaaccagaaaaggaagaagtatgccttttaaatatggttgtgcttttcwgtcctattctgggtcttgaggcatgctactcctatatcttatgtttaataaaatatgaagattcaaactgagggagtttgagaaattctgttttattaaa

SEQ ID NO: 43845 - DNA, 201 bp, Homo sapiens
tttagatatagatgccaagccctagaaattaagagactgtggtcgtgatacagagatagacaaaaagaccagtggaacagcatggagaatccaaaaacatrtatagaaatgcaatatgcagtgaaagtaacattataaatcatcagggacgtatggaatgctaattgctgctttgatcattaattatatggaaaatgaaat

SEQ ID NO: 43846 - DNA, 201 bp, Homo sapiens
tgttatgctattgaaaaaatacctcctgagtcacaggaagcataaattattttttaaagatttaccatgtgttaggatgattgtgtcatatattaaatatrtaatggatgacatttagactattatcatctcgaagcatgtaaatatagaatatactttttgaagttagttttcttcaaaacgagagatatttctcaccat

SEQ ID NO: 43847 - DNA, 201 bp, Homo sapiens
cttggattaaagtaaaaagtaaaagtttcagaagtaatttaattttcggagaagccagtaaaattggaatcatttgtgttttatttgaaaaaattaaaatrtggtacaaatataagaatataatacagatatagaagaaggctgctgaaaccaccatctagtccaggatatagagttttggcagtcactctagaagctctc

SEQ ID NO: 43848 - DNA, 201 bp, Homo sapiens
gtataaattacatacggcaaatataaaaagttttatttttaatcaattttaatcaggtgtaatttatatgcaataaaatttatacattttaagtgtatgartcaatcaattttgacagatacacacatcaatataactaccacccaaattaagatctagaacatttcatcttcccaaaacgttctctttgcctttttgcag

SEQ ID NO: 43849 - DNA, 201 bp, Homo sapiens
aaaggtcgattcttaaaagaaaacttgttgaagtgctctaaatggaagtctttttttttatttctctcctgtgtcttttatgatagtatctgacaactatmttttttttgtttttgcagagattgggttttgctctgttgccaggcttgtctcaaactcctggcctcaagcgatcctcctgccacagcctcctgagtagct

SEQ ID NO: 43850 - DNA, 201 bp, Homo sapiens
taacattaagaatgtaaacacagccatatgctacctaatgacagtcagtgagggaccacctatacaacattaatctcataagattataataggtatttttrctgtaccatttctatgtttaaatatgtttagatacacagatacttaccattgtgttacagttgtctctagtattcagtacagtaacatgctatacaggtt

SEQ ID NO: 43851 - DNA, 201 bp, Homo sapiens
atttctatgtttaaatatgtttagatacacagatacttaccattgtgttacagttgtctctagtattcagtacagtaacatgctatacaggtttataaccygggagcaataaactataccatatagcctaggtgtgtaggaggctataccatcatctaggtttgtgtaagtacactctctgatgtgcacacaatgatgaaa

SEQ ID NO: 43852 - DNA, 201 bp, Homo sapiens
gtccctgattatttcatctctgtttttaacactttggttttaaatactgtcaaagtcaaataaaatatagagacaaatctctaaaacattttatttggggyggggcacggtggctcacgcctttaatcacagcactttgggaggcggaggcaggcggatcacctgagtgcaggagttcgagaccagcctggccaacatgat

SEQ ID NO: 43853 - DNA, 201 bp, Homo sapiens
tgaagtaggagaattacttgaatccaggaggcagaggttgcagtgagccaagatcgcgccattgcactccagcctgggtgacagagtgagactctgtctcaaaaaaaaaaaaaaaattttttatttgggaagcaagaattgcaatttgggacatacacacagaccaggtcgtctttggtatgtttgaagcacaaagagaaa

SEQ ID NO: 43854 - DNA, 201 bp, Homo sapiens
gaagtaggagaattacttgaatccaggaggcagaggttgcagtgagccaagatcgcgccattgcactccagcctgggtgacagagtgagactctgtctcaaaaaaaaaaaaaaaattttttatttgggaagcaagaattgcaatttgggacatacacacagaccaggtcgtctttggtatgtttgaagcacaaagagaaaa

SEQ ID NO: 43855 - DNA, 201 bp, Homo sapiens
cttgaatccaggaggcagaggttgcagtgagccaagatcgcgccattgcactccagcctgggtgacagagtgagactctgtctcaaaaaaaaaaaaaaaattttttatttgggaagcaagaattgcaatttgggacatacacacagaccaggtcgtctttggtatgtttgaagcacaaagagaaaattggaggttttatta

SEQ ID NO: 43856 - DNA, 201 bp, Homo sapiens
ttgaatccaggaggcagaggttgcagtgagccaagatcgcgccattgcactccagcctgggtgacagagtgagactctgtctcaaaaaaaaaaaaaaaattttttatttgggaagcaagaattgcaatttgggacatacacacagaccaggtcgtctttggtatgtttgaagcacaaagagaaaattggaggttttattaa

SEQ ID NO: 43857 - DNA, 201 bp, Homo sapiens
aattctatgctggttatgaattgacataatgagaccaaaattactattgttctgttttcttcttatttgctgcctaagagccaaagaaatgtctgaggacyaggaatgtttcaaagtctctggaaaaattgaaagaattctgctgcgattctgcccttcctcaaagtagagtccagacagaatctctgcaggagagatttg

SEQ ID NO: 43858 - DNA, 201 bp, Homo sapiens
tatttgttttgagacttttaatggttttcataactgcagaatcagggaatttaactcatgctccatcattgaaatctgtaattcagaatagtgattggttygcaaccttagctttacattggaatcacctggagaacttcaaacaaaaattgccattaagaaccttccctcagaatcttatctaattggttttcactgaca

SEQ ID NO: 43859 - DNA, 201 bp, Homo sapiens
acattggaatcacctggagaacttcaaacaaaaattgccattaagaaccttccctcagaatcttatctaattggttttcactgacaaatgggcatggatattttttaaaagtttacattttattttgtattttatttttattgatggagtcttgctctgttgtccaggctagagtacagttgtgcgattatagttcactgt

SEQ ID NO: 43860 - DNA, 201 bp, Homo sapiens
gctctcccaggcttcagttctcacaagtaacagtcaagtgcctgcagctttcccaggctggagctgaatgctggcagttctacagttctgagatctcagcraggttctgttctctctgctccactagacattaccccacttggggttgtctgtcctggctctggctctgaccccacatttttgcttggcattaatccacga

SEQ ID NO: 43861 - DNA, 201 bp, Homo sapiens
agataatagacattcaagtacttagtaacttatttgtttgcccaacttagtgtaattcagaaaatattgagcactgactgtggagtatttgtactctatayaaaatatattctttatggacagaaagaaaacatcttgaatcagtccacaccttctaattagttgtaaataccagtactaaaatccacatgataagtgagc

SEQ ID NO: 43862 - DNA, 201 bp, Homo sapiens
acgcttgttacaatatgtgaaaaagagccagttacaaagcctggcattcatttcacttttgtatgagtaattgtatgtataaatatatgcggagaaaaccrtctagatagaaggcttattccaaaataccatgggggatatggctttatggtcatttttcttttacttatgtaaatttttaaatttctaaaataaatgtgt

SEQ ID NO: 43863 - DNA, 201 bp, Homo sapiens
tgtggaaagatacgcttgttacaatatgtgaaaaagagccagttacaaagcctggcattcatttcacttttgtatgagtaattgtatgtataaatatatgyggagaaaaccatctagatagaaggcttattccaaaataccatgggggatatggctttatggtcatttttcttttacttatgtaaatttttaaatttctaa

SEQ ID NO: 43864 - DNA, 201 bp, Homo sapiens
gtgtatgggaaagaataggggctttagatctagaaaactcaagattctgtacaagttctccagcatcctggccatgtgcaagttacttcatccttctagarccctgagagaagtactgtgccatagtcaagagaatcagacatgttatacttgagcacaaatcttgcttttcccttttaacaactatgtgacctttttcaa

SEQ ID NO: 43865 - DNA, 201 bp, Homo sapiens
tgaagttgaaggtatcagtccttccttttatgggtgaatgcttttgtgccttaaataggaaattatttcaatccctgaggtcttaaacatattctcctatrattttttataaacattttaaagtttaattttcaaatttcagtcattaatcaatctactcagaatttatttatttacttatcttttgagacggagtttcac

SEQ ID NO: 43866 - DNA, 201 bp, Homo sapiens
ggttttgcacagattctaacactgttggtgggaatcgtattatttgttttgatgaactttaattcagtgagaaatagataagttatattcattatgttctrtctactcagtaaataagtatacagtatactgtgaatatatttttcggttcacaaaaaacagaaataaagctggatagttaaaatgttgtttctagtatct

SEQ ID NO: 43867 - DNA, 201 bp, Homo sapiens
ctaggggcctgtccgttttgtgtttgtggttttgcacagattctaacactgttggtgggaatcgtattatttgttttgatgaactttaattcagtgagaartagataagttatattcattatgttctatctactcagtaaataagtatacagtatactgtgaatatatttttcggttcacaaaaaacagaaataaagctgg

SEQ ID NO: 43868 - DNA, 201 bp, Homo sapiens
ttgcccaagctggtctcaaactcctggacttgatcaaaggttttgttttgaatttgactttgaaaaatgacctagatttttatgttcttatattagatatkttagactttgactttctaggatgtcatttaaaaatgtttttaggtctccctttttcttttttcgagacacagtctctgtcacccaggctggagtgtggtg

SEQ ID NO: 43869 - DNA, 201 bp, Homo sapiens
ttgacctgcttgttaactgagaatatgtgcacaggtctggggtatagtatgtgtagattcgtggtaaaaagacttgggattgtgaggggctgaaagattaygaaaggataggggttttaaaatattattactaaggagttctgtccttagaaaagatttctaggatcaagaaccaagagctggacgatgatgacaacaggc

SEQ ID NO: 43870 - DNA, 201 bp, Homo sapiens
gcaaaggtataatcaaaagtgtagaaaaaactagaaaaaaagttttagaacaacacgagtttacctagtatagactttctgccttatggtaatacctcctrtctctcttagccttttgaacagcccagctctcattgtgctagccttgagtctgaggccccatggagttcccatagtggggaaattctcaatcctcccttg

SEQ ID NO: 43871 - DNA, 201 bp, Homo sapiens
agcaggctgaggtgggaggatcatctgagcacaggaaggttgaggctgcagtgagctgtgttcatgccactgtactgcagcctgggcgacagagttagaayctttctcaaataaacaataataaaataaaagcttggtcctatacagcatcgaattttaatttcacccatacagtaaatttttcagtgatcatatttttaa

SEQ ID NO: 43872 - DNA, 201 bp, Homo sapiens
ttgtcctggtggttggttttagaattataatttcaaataatgcccttagtcttctaagaaagtggtggttgttccctactgtgagcactgataaaattaaygagtttcatagtaattctaatatggagatattaaagccaggttaccttgtctgtcctactcagtcaagaaccctgtttcattctgtcttcagaggagaga

SEQ ID NO: 43873 - DNA, 201 bp, Homo sapiens
cagctccacatggctggggaggcctcacaatcatggcagaaggcaaggaggagcaagtcacatcttatggggatggcagcaggcaaagacagagattgtgstgggaaactcccgtttttaaaaccatcagatttcatgagactcattcactatcatgagaacagcacaggaaagacctgcccccataattcagtcatctcc

SEQ ID NO: 43874 - DNA, 201 bp, Homo sapiens
ctgggaaactcccgtttttaaaaccatcagatttcatgagactcattcactatcatgagaacagcacaggaaagacctgcccccataattcagtcatctcycaccaggtccctcccacaacatgtgggaattacgggagctacaagaaaagatgtggctggggacacagagccaaatcatatcaccagtgaattgtatttt

SEQ ID NO: 43875 - DNA, 201 bp, Homo sapiens
ctccctcagccaggctaatattgattgacttatcttagatcatcaagaaaaaaaaggtgtttttgtttttagtctcttttaatacttagaagcagttcacstaagtatagtggttattaagcatagaagtcataaagtttatccattaaagctcactttattgataggagcatttactccaaggtctcagaagagcgtata

SEQ ID NO: 43876 - DNA, 201 bp, Homo sapiens
gtttgtgcagcaaataggttgtacctagctatggccctttttggcacaaccgttgttgttgttcctcctcctcctcttctttctcttcctcctcctcctcttttttttttttttttttttcttttttgaaatgggttcactctgtcactcaggctgcagtgcagtggcatgatcatggctcactgcagcctcgacctacct

SEQ ID NO: 43877 - DNA, 201 bp, Homo sapiens
gacgtggatgaatggcaaaaagctactgagtgaacataaatgccccatggtccaggaccattagggtggggtcagcaatgccataactctcaataggtttygaaatatattctgatcactctgaattgtccagacaaggttaaattgagttcagcatactgtctctgggaatatgaaatagaatgtaatgtatctgatgag

SEQ ID NO: 43878 - DNA, 201 bp, Homo sapiens
cttccacttcggcctcccgagtagctgggactacaggcacacaccaaccatacccagctaatttttgtattcttttaggaatggagtttcaccgtgttgcycaggctagtcttgaactttcaggctccagtgatccacctgccttggcttcccaaagttctgggattataggcatgagttaccatgcccagcctcccttct

SEQ ID NO: 43879 - DNA, 201 bp, Homo sapiens
tgtatctgatgagtatttctatccaaatcattttttttaaagttgcttattttgttacccaggtattaatatgtacaacaaaccctcatgacacaagtttwcctatataacaaacctgcacatgtacccctgaacttaaaatgaaagttaaaaaatagttgcttaatattcaagtatttagattgatttaattgttagcat

SEQ ID NO: 43880 - DNA, 201 bp, Homo sapiens
attccagtctgtgtgtatgtttgccaattcttttgaatttcctacataggcagtcatgtcagatacaaacagacagtttcacttctttcttccccatctatttttttttcttgtcttattgcagtaactaggactttcagtacagtgttgaaaaagcagtaagaaaggatatcgttgccttgtttctgatcttagtgggaa

SEQ ID NO: 43881 - DNA, 201 bp, Homo sapiens
ttgtgtgtggaatgtggatataagtatagattctttggggaagatgcagaggtaagtcgtcttttcaggcactattttatatttttcttgtctagccttaratatttttcagtatttttgtttcattttctgaccttatataaaagctgatttgatcaatcaccttttaaaaaatactgttatgtaaagtaaaaactaaaa

SEQ ID NO: 43882 - DNA, 201 bp, Homo sapiens
tacccaggtattaatatgtacaacaaaccctcatgacacaagtttacctatataacaaacctgcacatgtacccctgaacttaaaatgaaagttaaaaaawagttgcttaatattcaagtatttagattgatttaattgttagcatcccataaggataaaacttttttttcctggaagcttatctcatttcctaaaagaat

SEQ ID NO: 43883 - DNA, 201 bp, Homo sapiens
caatagatatagacctattcagaatttctgttttttttcttgtgtgagttttggctcattgtgtcttttaaggaattgtttttcaagaaattttcaccaargttaccaaatttgtggacatagagttggtcatagtattcctttattatccttttatttgtccacagcatccgtagtgttgtccttttcatttctgatatt

SEQ ID NO: 43884 - DNA, 201 bp, Homo sapiens
aaatttaaaaacaagtatgtaaaacattaagatatttagactttcaaaatttgcataaaaattctatgatagcttacttggttcataattttttttaaccytctactttgaaaatatttgtaacctatggatagtttgccggaatgctacaatgtgcttctataaacttttcatctagattcactaagtgttagctttttg

SEQ ID NO: 43885 - DNA, 201 bp, Homo sapiens
gaccagaactgtgtctcatggccatagttgcaaggaaaacagaaaataagaaggtagtttttgtccagcttttaaatagagttaagcacagtaattgggartacaatcagtggtaatcagaaaatagtttctgtcacagggtgtggaatcagtaataatagtaacagccaacctttatgatatatttacaatattagtgta

SEQ ID NO: 43886 - DNA, 201 bp, Homo sapiens
acggtcatttataaatgcagtgtgttatttgatgccaaataatttcaaaagcaaaattgtcagtttcaaaagccaaataattatatgtaaaattagaccagggtgcatttaaaaaaaattactatgggggtggaatcagttctctgataatggaagaatggagagataagaaggccttaaatgatactgtgtgaaagtatt

SEQ ID NO: 43887 - DNA, 201 bp, Homo sapiens
tgttaataataatagatttaatgaaatcaaatttaaaaacaagtatgtaaaacattaagatatttagactttcaaaatttgcataaaaattctatgatagyttacttggttcataattttttttaaccttctactttgaaaatatttgtaacctatggatagtttgccggaatgctacaatgtgcttctataaacttttca

SEQ ID NO: 43888 - DNA, 201 bp, Homo sapiens
aatagagttaagcacagtaattgggaatacaatcagtggtaatcagaaaatagtttctgtcacagggtgtggaatcagtaataatagtaacagccaacctytatgatatatttacaatattagtgtaatattcttatcaaggtacaggcactgttatgtgcaccttatatagagtactttatgtaagtacattcaatgagt

SEQ ID NO: 43889 - DNA, 201 bp, Homo sapiens
tactaaattaatattaggattatttacaatcagttttctagataaatgtaatttgtgaattatagttttatttatttatttctttgagacggagtttcacycttgtcacccaggctggagtgcaatggcgtgatcttggctcactgcaacctctgcctcctaggttcaagcaattctcctgcctcagcctcccgagtagct

SEQ ID NO: 43890 - DNA, 201 bp, Homo sapiens
ggaagttgaggtgggaggatcccttgagcccaggagtttgaggttatagtaaactatgattgtgccattgcaatctagcctggatgatagattgagacccygtctctaaaaaaaaaaaatttgttaattcatactgacactaacaaaaataaactttaaaatggtggaggtgagtggggaaaagtgaaacctctgctttac

SEQ ID NO: 43891 - DNA, 201 bp, Homo sapiens
gcactattataataataaatgttttcccaattttgatcttatagttcaaatttaacttttatactcaaggttttattctggacatatgttcttaaaatctrtgtttaaagttttgttttctgtcgtacaaacagagtactgaaatttttcatgctatcttagagttttttttttaaggctatttccatgcctagtaaattg

SEQ ID NO: 43892 - DNA, 201 bp, Homo sapiens
gagccgattcttccagtctacgggaagcctgaaatccacctcctcctccacaggtgcagccgaccaggtggaccctggcgctgcagcggccgcagcgcccscagcgcccgccttcccgccccagctgccgccgcacgtagtaggttctgtctgggactgggcagggccatcggggctgggggggcggggcttgtgggtaag

SEQ ID NO: 43893 - DNA, 201 bp, Homo sapiens
aatatttctatatatggatattcatcataacagtatttgtaatactgaaaaaatgaatatagaaatggaatggataaattatgataaattatgataaatgrataaattatgatttcctgtctttgatttagttcatttttctttatattttattaacttagtatatattttattaacttagtatatattttattaatttag

SEQ ID NO: 43894 - DNA, 201 bp, Homo sapiens
gaaaccccatctctactaaaaatacaaaaattagccaggcatggctaaagttttttgtaggtacataatagatgtatatatttatgggttacatgagataytttcatacaggcatacaatgcataataattacatcagggtaaatggggtatccatctcctcaagcatttatcctttgtgttacaaacaacccaattatac

SEQ ID NO: 43895 - DNA, 201 bp, Homo sapiens
gccataaaaaagaatgagatcctgtaatttgcaacaacatggatggattatggaggtcattatgttaagggaaataagccaggtgcagaaagacaaacttkgcgtgttgtcacttacttgtgggagctaaaaattaaaacagttgaactcacggagatacagaatagaatgatggttaccagaaactggtagtggtagtgg

SEQ ID NO: 43896 - DNA, 201 bp, Homo sapiens
gtccgcctcagcctcccaaagtgctgggattacaggtgtgagccatcgcgcccggcctgaatttggttgcaataatacagaaatgcaagcacactgagaaragataatacataactaaggctaaaaatgaatggtgtgatagaacttcacttgcttcctggctgatttcagagaaccttatttgcagagcacagttggatc

SEQ ID NO: 43897 - DNA, 201 bp, Homo sapiens
tccatgtcttcctcttcgtttatttcttcattttggtggagtatatatcctctagaaccttcctgagaaagcacgttggaagtaaatcttttgaaacattsatgtctgaaagtggtttttttgttgttgttattattgttactaccttcacatttgattggtagtttggattggtataaaattctaggttttagatgactt

SEQ ID NO: 43898 - DNA, 201 bp, Homo sapiens
acgtaaacactagtataacactaaatctaagtgcagagagtgggcagcctgattttgttcataatctcaggggaatcttttataatgggccaggaagcacrtgtctgtggtttctgcatagggcgtgttctgtggtgcccagccagctgtagtatgtcctgcgagatttggcctgcaggccacaatggtgggcttctggga

SEQ ID NO: 43899 - DNA, 201 bp, Homo sapiens
cctacaatttccagttgaggttctaatcttagctgtacattgggattacatgtggattttaaaaaatgccgatgcctgagtttttggcctgtgctagagcygcttgtagctgcttgtaagaattgactgttatagttccaggactttgtaccagacggtgaaagcattggtaacttgaaatcaactatgttgggaatattt

SEQ ID NO: 43900 - DNA, 201 bp, Homo sapiens
aacctaagattaatagcaagtcacagatgagtttaaagcagaggtgtgacatgaacagatttgggctttaggaaaaccactcaggctgcagtgtggagaaygagttggaaaaaggaatggaagtggggaggaaagttaggaggctgtttcaatataatttggacttagactatagtagtggctgtagaggtggagagtggt

SEQ ID NO: 43901 - DNA, 201 bp, Homo sapiens
caggcaaatacaagggctagttgattataaatcgttttgggaaaaacttctgagtaaggcagcagtctgtttttagaggtacaggtgaaaatatagtgtcyttagctgactgcagtattaattgataactgtagctctttttggagaatgaactgtacataatatttctctgggttttttggggggaatgatggagctgcc

SEQ ID NO: 43902 - DNA, 201 bp, Homo sapiens
gtaaattcccattgaagaagaaatacaattatgattaccattatgagaagggaaaagacggtagtatgggaaatgatagtaaagggattaagtctggtctrgtgaatctagaaaggcctttcagaggaagagagggtaggagttcgccagacgaagtgtagctgatgggtggtagggaagaggaaaataaccttctaggca

SEQ ID NO: 43903 - DNA, 201 bp, Homo sapiens
catttcaaaagaatttctgaataatttattctttggtaaccaaaaactataaacgatcccttttctgtgtaaaatgtcagtacttcattctgtatgtatgkattcatctgtcaaacattaaatgaacacctgttatgagccacattgtgctaggtatatatgacatttagaatcggggtatatgaaataacaatttggcac

SEQ ID NO: 43904 - DNA, 201 bp, Homo sapiens
ctatggttcatgtttctgacaggagattatttaggtagttcatttagccatttcacatgaccaatgtgttaatgtctgaatttaatctactcgttctgtgytgtcttaaaagtcaaacttttcagtaaaacgaaaccaaacaaaaaatacacccctagcagtttgtatttcagctccccacccccaccagacaactttttt

SEQ ID NO: 43905 - DNA, 201 bp, Homo sapiens
ggaaggattaataaatacgaaaaggtcagagtgattatgctgcattttttcatttgtaatgaaaccttctaagttgtccaagaaagagaggagcgtcctawaaatgaacatcaggtctacttttaagcacctcttcaaatattctgaaccatttaattatgatgaagtgaaaacagctcttgcaaagctcaggtgaattca

SEQ ID NO: 43906 - DNA, 201 bp, Homo sapiens
tatggtattatatctagatttggaggaggggatagttaaagagaaatgataattggctgatataaaataccatactaaattaatattaggattatttacartcagttttctagataaatgtaatttgtgaattatagttttatttatttatttctttgagacggagtttcactcttgtcacccaggctggagtgcaatggc

SEQ ID NO: 43907 - DNA, 201 bp, Homo sapiens
agaaattacctagaatgcagcacagggtggcaatgtcaggccttcagtgtttcttctctggatttttgaaacagctttctaactggtattcctgacactgytcttatgtgcatccagactattagccttggatcccagctcctgtgatcacattttcaaaccttcaccctccattttccactaatcttttatagacaatag

SEQ ID NO: 43908 - DNA, 201 bp, Homo sapiens
ctacccccaggaaatcctccctgatcctaaaactgcatttgttcgttaggtgctcctggcctgtgttcccattgtacctagatcataacccagttataatyttattacattgttatcattaatgctttttaaaaagttttactattcatcactagagtgtaaattgtttgtagactagcaaagctctgttaacaattatag

SEQ ID NO: 43909 - DNA, 201 bp, Homo sapiens
atgcattactgctcggaaatgggaagggagagtagcaggtggtgcgtaattgagagctgtgtttgattgggactgacctggtgcccctttcctctgccggkttgaatgagagtttaaaggaggaactgctgctgctaagaacaaaatgaacccgagtgcctcttactgtttgtcccgactgtcagtgcatagggattaact

SEQ ID NO: 43910 - DNA, 201 bp, Homo sapiens
ggcctcccaaaatgttaggattacaggcgtgagccaccacgcctggccaactcatagttttattgattttctggcagtttatgaataaatttgctcatttrcagacttacgtggactctgctaaaggtcttagactttttaaggcccttcagaacaatcagacaccccttttctgttgtaagttaagcacaaatggaactc

SEQ ID NO: 43911 - DNA, 201 bp, Homo sapiens
aatgttaggattacaggcgtgagccaccacgcctggccaactcatagttttattgattttctggcagtttatgaataaatttgctcatttacagacttacstggactctgctaaaggtcttagactttttaaggcccttcagaacaatcagacaccccttttctgttgtaagttaagcacaaatggaactctgtccaagtg

SEQ ID NO: 43912 - DNA, 201 bp, Homo sapiens
atagtatataattcctacttagtgcatttagaaataccatctggcttaccgccagagttaaccatgtgtgcgaactgggactcggaaaaatgaaaacagcygtttgcccttcaagcattttctttggggctgtcctttacttcagcaaccacttttgggctgatgacatcctgagctctgggtccaggctgcacctctctc

SEQ ID NO: 43913 - DNA, 201 bp, Homo sapiens
taacttgccatagtcactccgttaggtatattaactccaggccttgtattcagggcggctctcggaaatctgatttatagtatcatttagatatctgtgartctgactcttcgtgtaagagtcctgaaaagcagacaggtttctaacactttagaaatagagtacatacatactcccgagtgtatcatctttactttttcc

SEQ ID NO: 43914 - DNA, 201 bp, Homo sapiens
ggcgctcatccacagagccacatctgttaggtaagttggcacatcactggaatataataccgattctgaaacttaggtttagttccaaaactgatacttaytaaagttgctaaaaatagtttttacttacaaaaattatatttccactgtagtagtggaaatttaaaaaaaaaagtaaaacaacaaagctgggcatggtgg

SEQ ID NO: 43915 - DNA, 201 bp, Homo sapiens
ttggagatgctttgtctgtgctgcaagtttcaattcatggctgtgtccagtggttttgtttactggatctaagatcagaccacttacgtatgaagcagtgkgctaggcactgtgcgtacagaggaagaagatgtggttatgatatatgtctggcagagtttacaacctcacatgagagtcagatgtgtgcatacctaactg

SEQ ID NO: 43916 - DNA, 201 bp, Homo sapiens
gctttgtctgtgctgcaagtttcaattcatggctgtgtccagtggttttgtttactggatctaagatcagaccacttacgtatgaagcagtgtgctaggcrctgtgcgtacagaggaagaagatgtggttatgatatatgtctggcagagtttacaacctcacatgagagtcagatgtgtgcatacctaactggacttaaa

SEQ ID NO: 43917 - DNA, 201 bp, Homo sapiens
gacagcttggccaaaaccccgtttctactaaaaaaaaaaaatacaaaaattagctgggtgtggtggcagacacctgtattcccagctaccccggaggctgrggcaggataatcgcttgaacttgggaagcagaggttgcaatgagccaagatcacaccacttcactccagcctgggcgaaagagcaagactcttatctcaa

SEQ ID NO: 43918 - DNA, 201 bp, Homo sapiens
tataataattggtcgttgtacttttcttgtgacttttaggaagatttaaaatttttcaaaagaaagtggaagacagattttaattacaataaaatttaaaaatgaaataacatttattctgtcttattgctttaggtgaaatccttaaccctgtttgtcacccattatccgccagtttgtgaactagaaaaaaattactca

SEQ ID NO: 43919 - DNA, 201 bp, Homo sapiens
taataattggtcgttgtacttttcttgtgacttttaggaagatttaaaatttttcaaaagaaagtggaagacagattttaattacaataaaatttaaaaatgaaataacatttattctgtcttattgctttaggtgaaatccttaaccctgtttgtcacccattatccgccagtttgtgaactagaaaaaaattactcaca

SEQ ID NO: 43920 - DNA, 201 bp, Homo sapiens
aataattggtcgttgtacttttcttgtgacttttaggaagatttaaaatttttcaaaagaaagtggaagacagattttaattacaataaaatttaaaaatraaataacatttattctgtcttattgctttaggtgaaatccttaaccctgtttgtcacccattatccgccagtttgtgaactagaaaaaaattactcacac

SEQ ID NO: 43921 - DNA, 201 bp, Homo sapiens
gcttttgttatgttgaggtatgttccttctatacccagttgtttgagagtttttattatgaagcgttgttgaattttatcaaatcctttttcagcatcaawtgaaatgattatgtgtttttttttcttcattctgttaatatgatgtatcatagtgactgatttgcatatgttgaaccgtctttgcatctctgtgataaat

SEQ ID NO: 43922 - DNA, 201 bp, Homo sapiens
cgttgtacttttcttgtgacttttaggaagatttaaaatttttcaaaagaaagtggaagacagattttaattacaataaaatttaaaaatgaaataacatwtattctgtcttattgctttaggtgaaatccttaaccctgtttgtcacccattatccgccagtttgtgaactagaaaaaaattactcacaccaggtgggga

SEQ ID NO: 43923 - DNA, 201 bp, Homo sapiens
tatttgatatgaatttgtctcattctggtatcagggtaatactggcctcgtagaatgagtttggaagtattctcctttttttttttttttttttttcccaraatagtttgaggaaaatgggtctagttctttaaatgtttggtaggattcagcagtgaagctattgggtcctgggcttttctttgctgggagactttatta

SEQ ID NO: 43924 - DNA, 201 bp, Homo sapiens
aataaatgttgaattaggctactactaatatcaactaaaggaggtaaaagttttgagatttttcatgaatgaaaatgtttcacatgcttgttggccatgtrtatgttgtcttttgaaaagtatctgttcatgtcctttgcctattttttaatgggtttggttttttcttataaatgtaagttccttatagatggtggatat

SEQ ID NO: 43925 - DNA, 201 bp, Homo sapiens
cttttctttgctgggagactttattatggcttcaatctcgttacttgttattggtctgttcaggttttggatttcttcgtggttcaatcttggtggattgygtgtgtttaggaatttatccatttcttctagattttcggatttattggcatatggttgctcatagtaaccactaatgatcctttgaattcctgtagtatc

SEQ ID NO: 43926 - DNA, 201 bp, Homo sapiens
tgttggcatgccttaggctctcaccaactgttggtgggagacatcagtttctttccatgtgagcatctccacagacagcccacaacatggcggctggcttccctcagagcaggcaggcaacaaaatgagagtacccaagtcagaagccacaacctttctgtaacctaatctctgaagtgacatctcatcacttttgccgta

SEQ ID NO: 43927 - DNA, 201 bp, Homo sapiens
cttttgtattttctttgtttcagtttcatttatttctgctctgatttttatttttattttatattaattttgggtttggtttgctcttgcttttctagttyttcaaggtttatcatttggttatttatttgaaatgtttcctcttttttcatgtaggtgcttttagctataaacttccctcttagtacagccgtcactgta

SEQ ID NO: 43928 - DNA, 201 bp, Homo sapiens
tttttaaggctatttccatgcctagtaaattgaaacatatttcttttttgcagaccaactgtacaagaagaaagaaaaattgtaataaaaaatggaaggcwccctgtgattgatgtgttgctgggagaacaggatcaatatgtcccaaataatacagatttatcagtaagtaccttatgccaaaaaataagtcgatgataa

SEQ ID NO: 43929 - DNA, 201 bp, Homo sapiens; identical to SEQ ID NO: 9914

SEQ ID NO: 43930 - DNA, 201 bp, Homo sapiens
ctgctctgatttttatttttattttatattaattttgggtttggtttgctcttgcttttctagttcttcaaggtttatcatttggttatttatttgaaatktttcctcttttttcatgtaggtgcttttagctataaacttccctcttagtacagccgtcactgtatcacataggttttggtatgtgttttcattatcatt

SEQ ID NO: 43931 - DNA, 201 bp, Homo sapiens
atttttattttatattaattttgggtttggtttgctcttgcttttctagttcttcaaggtttatcatttggttatttatttgaaatgtttcctcttttttsatgtaggtgcttttagctataaacttccctcttagtacagccgtcactgtatcacataggttttggtatgtgttttcattatcatttgtttcaagaaatt

SEQ ID NO: 43932 - DNA, 201 bp, Homo sapiens
gagaaagaaagggtgaaggcctatgaaatccagcaaactggtatggattcctgtagaaggcagtaaggtttctgggaaaaggaatggcatgatagaagggaagagatgagtgtactgcctagatgggacagttgaattttaaaaataaatatttccctaaaggaaaaagcggatacagagaaaagaatcagatcaaggagc

SEQ ID NO: 43933 - DNA, 201 bp, Homo sapiens
gaaagaaagggtgaaggcctatgaaatccagcaaactggtatggattcctgtagaaggcagtaaggtttctgggaaaaggaatggcatgatagaagggaagagatgagtgtactgcctagatgggacagttgaattttaaaaataaatatttccctaaaggaaaaagcggatacagagaaaagaatcagatcaaggagctt

SEQ ID NO: 43934 - DNA, 201 bp, Homo sapiens
tatcagaggaattgttatgcaaattaggtatctgtgttatgactgaagtccaacttctttctaatgtcatttgaattaaacattagtataaaggtttcaattttttttttttttaaagaatgagagtaaaagaaacaacaggtcttactcattaatttggttaagaggaagtgcttcacacatacgaaatgttattaagtg

SEQ ID NO: 43935 - DNA, 201 bp, Homo sapiens
caaaaaaccaaacaccgcatgttctcactcataggtgggaattgaacaatgagaacacttggacacaggaaggggaacctcacacaccggggggcctgttrtggggtggtgggggggacggatagcattaggagatatacctaatgtaaatgacaagttaatgggtgcagcataccaacatggcacatgtatacatatgta

SEQ ID NO: 43936 - DNA, 201 bp, Homo sapiens
tcctgccccacatctactcagatcccactaggtaatcatggttattactttatcatgtatacttccagaaaccttttgtttaaaaaagcaaatatgaattwtatatatatatatatgaaatctcttcctcccttattacatagatggagccataatatacccagtactttgtacttggctgttttcccttagtagtataag

SEQ ID NO: 43937 - DNA, 201 bp, Homo sapiens
caaatgtctgcttgtttttcaaggaataggaagaaatgtttagtgaatacctagcagtctgttgccagagatggtttttgttgtttcaattccattgtacrttcttcttagcatttaaaaaattatttgaacttttgaacaggcaatatcttcacatactttaaaagtttgaaaatctgaaaagttacacagtaaaatgtt

SEQ ID NO: 43938 - DNA, 201 bp, Homo sapiens
aatccatggcctttccacattggggggtggggtgagactctcatcacataggcagttaggaaccccagaggctcttcagttttaaacgtgtagcttccaaygtcatcttgagaactgatattcagcagtggaaggagaaagaacagggaggatatacatttatggcttttatgtgaggcaggccttgcattggcacatacc

SEQ ID NO: 43939 - DNA, 201 bp, Homo sapiens
caatgcattggttagggaagctagctgttaacacaaagaccccaaaaagtctaatggctctaatgttgtgaaagttaatttcttctttttttttctttgcrtaaacaatccatggcctttccacattggggggtggggtgagactctcatcacataggcagttaggaaccccagaggctcttcagttttaaacgtgtagct

SEQ ID NO: 43940 - DNA, 201 bp, Homo sapiens
ggttagagatacaggtaggctggtgttttacatgtatttgcaatatttaatttttaaaaaattatacagaaaatacacacacatgaattttttataatgtrctgctatttgaccttcactaccatcataatcaggtgaaaatgagacccatgcacatctgtctagaaagcccatgttgaacttgagagcatctgttttcca

SEQ ID NO: 43941 - DNA, 201 bp, Homo sapiens
aggacaagcagaggacttaaagctctgagggatcaagggagtagaaagaaaatgtcagtctagtgaactaatctctaactgtgctttattttttatctgtrtttttttcagctatctttagagatagttattctgttttagagataagaataactaagtctcagtttttccaaggtcatccagccaagcacataggggacc

SEQ ID NO: 43942 - DNA, 201 bp, Homo sapiens
ttatttccagattttcttccttttggcacacatagactgattatacccatctctttactagaaacaagtgttttgattattatttaaatgttttgctcatytattcaacgtctgatgtgaggttgtaaataaccattgaattttgtaaaattgccaatcttgtgcaattttgtgtttgtagtacagttctctgaaaagtta

SEQ ID NO: 43943 - DNA, 201 bp, Homo sapiens
cttagtatatattttattaatttagattgagtaaagtcaatcaattttatcaacacattcatttttttgttttctgcttaattttataaaataacaatggygaaattcaataaaatatcaaaatatttcataatgacattgtcaaaagtgaatttttgtttgtcaagcagcattcattgactggtgatattcctaaatgtt

SEQ ID NO: 43944 - DNA, 201 bp, Homo sapiens
aacttgatcatactatgagaaactcagccataggtttggaatccgtattcacaccacacattcactgaggacaatattctgctcatacgattgatttgctrctgcatttcactgctgtttgtctgatattaacaattttaaacagagcagggcagctagtatttggaacaatccttacagtgtgacggcgtcaaggacgtt

SEQ ID NO: 43945 - DNA, 201 bp, Homo sapiens
aaattcaataaaatatcaaaatatttcataatgacattgtcaaaagtgaatttttgtttgtcaagcagcattcattgactggtgatattcctaaatgtttsttcatcacatgagatttaaaagcttgaatttggcatatcaaagataatttaggtgtcttatgtgggttttaccaaatttaatgcctgcttttgtcttatt

SEQ ID NO: 43946 - DNA, 201 bp, Homo sapiens
ttgtttgtcaagcagcattcattgactggtgatattcctaaatgtttgttcatcacatgagatttaaaagcttgaatttggcatatcaaagataatttagstgtcttatgtgggttttaccaaatttaatgcctgcttttgtcttattttaatttgaatttctctagttagcattgtaaataattttctctatgtttactg

SEQ ID NO: 43947 - DNA, 201 bp, Homo sapiens
aagagaataatgggtatctcctatttgtttttcttaacaaaactgatttgggttttttaaacatagaagggttgttgtaaggctgggcgtggtggctcatrcctgtaatcccagcactatgggaggacgagatgggtggatcacctgaggtcaggagttccagaccagcctggccaacatggtgaaaccccacctctacta

SEQ ID NO: 43948 - DNA, 201 bp, Homo sapiens
atttacattatacagatgtagccaattcatttactcttttggaaagatcatattgatttcttatcgttttttccccattatgtttatttctttaaaaaatkttttaatatcactgtaaattgattgaagcatcctgacatttccatagatattcctttacagcaaatattaatgggatctacatggctaagttactgttta

SEQ ID NO: 43949 - DNA, 201 bp, Homo sapiens
tcattatgtttattagacggtagtttcacttaactatttagataatctagaattagaaaataaattgtgggcctggcagggtggctcatgcctaaaatccsagcactttgggaggctgaggcgggtggatcacttgaggtccggagttcaaggtcagcctggccaacatggtgaaacctcatctctactaaaaatacaaaa

SEQ ID NO: 43950 - DNA, 201 bp, Homo sapiens
atgggcctagaaagacaggtaacacttaactagacagatttgggggaaaatacattcctcaatgaaagcaaagtttaaacaaggttgaaataatttatttaaaaaaaaaaatagctggctgggtgcagtggctcacgcctgtaatcccagtactttgggaggctgaggaaggtggatcgcttgagctcaggagtttgagac

SEQ ID NO: 43951 - DNA, 201 bp, Homo sapiens
tttccacactgtttatagaaaagacttttatatgcattgaattatgttgatgccaaaggcttcattttgtctttgtttttaattaatatttatttatttattttttttagagacagggtctcgctttttcgcccaggctggagtgcattggcacgatcatagctctctgcatccttgaactcctgggcccaagtgatcctc

SEQ ID NO: 43952 - DNA, 201 bp, Homo sapiens
aaaatgacctagatttttatgttcttatattagatattttagactttgactttctaggatgtcatttaaaaatgtttttaggtctccctttttcttttttygagacacagtctctgtcacccaggctggagtgtggtggcaggatcttgattcacttcaacctccgcctcctgggttctagcgattttcctgcctcaccgt

SEQ ID NO: 43953 - DNA, 201 bp, Homo sapiens
ttctcctgccttagccccctgagtggctgggactacaggcctgcaccaccatacccagctatttttgtatttttagtagagacagggtttcaccatgtggsccaggctcgtgttgaactcctgacctcaagtgatccacctgtctcggcctcccacagtgctgggattacaggtgtgagccaccacgcccggccagcacta

SEQ ID NO: 43954 - DNA, 201 bp, Homo sapiens
aaaaaaccagaaagaatgaataaaacctagtattgataacatggtaattataatcaataataatttaattgtacatttttaaataaaagagtataactggattatttgtagcacaaaagataaatgcttgaggagatggataccccatttaccctgatgtgattattacgcattgtatgtctgtatcaaactatctcatgt

SEQ ID NO: 43955 - DNA, 201 bp, Homo sapiens
gcaccaccatacccagctatttttgtatttttagtagagacagggtttcaccatgtgggccaggctcgtgttgaactcctgacctcaagtgatccacctgyctcggcctcccacagtgctgggattacaggtgtgagccaccacgcccggccagcactacactttctaatgagtttttattgaaaaaaattttagttgaaa

SEQ ID NO: 43956 - DNA, 201 bp, Homo sapiens
ccatacccagctatttttgtatttttagtagagacagggtttcaccatgtgggccaggctcgtgttgaactcctgacctcaagtgatccacctgtctcggsctcccacagtgctgggattacaggtgtgagccaccacgcccggccagcactacactttctaatgagtttttattgaaaaaaattttagttgaaaatgaag

SEQ ID NO: 43957 - DNA, 201 bp, Homo sapiens
tagtagagacagggtttcaccatgtgggccaggctcgtgttgaactcctgacctcaagtgatccacctgtctcggcctcccacagtgctgggattacaggwgtgagccaccacgcccggccagcactacactttctaatgagtttttattgaaaaaaattttagttgaaaatgaagctgttggctcgtaagtgaaaagctt

SEQ ID NO: 43958 - DNA, 201 bp, Homo sapiens
aaggatttttttcctcattctcgtgaatgagcctgcctgcagattggcagacatagggcgttgtcccaggaaagtgaggatagatgccttttgtggagggytttgaaggctagactgaggagttgatagccagagggagttcattcagtgattctgagcatggggctgatatcatcagagctgggcttgtgtgtaggaggg

SEQ ID NO: 43959 - DNA, 201 bp, Homo sapiens
gactggctctctagtattacaaggatttttttcctcattctcgtgaatgagcctgcctgcagattggcagacatagggcgttgtcccaggaaagtgaggakagatgccttttgtggagggttttgaaggctagactgaggagttgatagccagagggagttcattcagtgattctgagcatggggctgatatcatcagagc

SEQ ID NO: 43960 - DNA, 201 bp, Homo sapiens
agtcaaaggagttaaaactcttcagaaatatttattactattgcaaattaaagtaaacactgaatttattctcctgactcctgaatctgcatattattaastagtttctctcagtttcttcctgttccagtctgttctagtatgctgaattcagatgtatttttgttcagtaacatttttatcttgtcatcatccaaaagc

SEQ ID NO: 43961 - DNA, 201 bp, Homo sapiens
atctgagtcaaaggagttaaaactcttcagaaatatttattactattgcaaattaaagtaaacactgaatttattctcctgactcctgaatctgcatattrttaactagtttctctcagtttcttcctgttccagtctgttctagtatgctgaattcagatgtatttttgttcagtaacatttttatcttgtcatcatcca

SEQ ID NO: 43962 - DNA, 201 bp, Homo sapiens
cctgatatgagttaacactgttatactcttagaagaaaacataggtgtaaatctttgtaaccttgaatgaggcaatgatttcttaactatgacatcaaaarcacaagtgagaaaagcaaaaatagatacattggacttcatcaaagtaaaagcttttattcttcaaagaacaccatcaagaaagtgaaaagacaatccact

SEQ ID NO: 43963 - DNA, 201 bp, Homo sapiens
gtggagttctaactgatgtttcatttctgaatgtgggtattgtattaatctatacattttttagtgtggccaaaatgttttattttaaaaagtgtcagccyggcattataccctcattggattctactttaagctccaaaaataaacttattaaagagatcaatctgtatggttggttgtgttggggctttgtaaaaaaag

SEQ ID NO: 43964 - DNA, 201 bp, Homo sapiens
gttagagaataagtgaagacatgcaggggagtgatagaaaattcagaagcagggtttcttccagggggaagaagggaaagtagtaaaggttggggatggaygtggcatagtggagttctaactgatgtttcatttctgaatgtgggtattgtattaatctatacattttttagtgtggccaaaatgttttattttaaaaag

SEQ ID NO: 43965 - DNA, 201 bp, Homo sapiens
cccgccccagctgccgccgcacgtagtaggttctgtctgggactgggcagggccatcggggctgggggggcggggcttgtgggtaaggcgggcggaggcgkggaccctccgcccgatgatagggctggaggaggaaggggcgggctgaagaaggggaaggtgggaagagcccagccggggctacaaattgggtgaagcgct

SEQ ID NO: 43966 - DNA, 201 bp, Homo sapiens
tttatggtaccagagaatttgtgataagggaagacaggaaatccatctttattcattatcctcaggaaattaggtaaagagaatgagaaaaaaaaaaagtyccaattcagatagaggtatctgtccaatggagatatatgtaaaatattaatccttccataaaaggtaaaatttgaattttagggtcaacatgaaagtgtt

SEQ ID NO: 43967 - DNA, 201 bp, Homo sapiens
agttccaattcagatagaggtatctgtccaatggagatatatgtaaaatattaatccttccataaaaggtaaaatttgaattttagggtcaacatgaaagygttagtatgaaataactacaggaatggagatgtgtggctaaggagaaaagtaaatctaaaacttcacctttctggaggggtcatgcaaggaggcgtgact

SEQ ID NO: 43968 - DNA, 201 bp, Homo sapiens
gtgacttgagagaatttgccacggttaatgttacaattctggggcagcctacctttcattgcttgattattctgcatagacccattttttaggtctacaarcactgaatgagcacctatgatttttattctagaggctttttgtagctcatttatttttcctaagaatgctttttgccccttttttttttttttttttgag

SEQ ID NO: 43969 - DNA, 201 bp, Homo sapiens
attacagggatgagctaccttgcctggctgattttaatttttatcaatgaacataatttttaaaattcaatggtgctaaaaggctcctgctgacaagcttscatcccttcagttcacgtccttccccatcctagtcccaaggcaactactttcaacacttcccctttctgttgtatttctaagtaatatccgtattttcat

SEQ ID NO: 43970 - DNA, 201 bp, Homo sapiens
gccacggttaatgttacaattctggggcagcctacctttcattgcttgattattctgcatagacccattttttaggtctacaaacactgaatgagcacctmtgatttttattctagaggctttttgtagctcatttatttttcctaagaatgctttttgccccttttttttttttttttttgagatagggtctctcgctct

SEQ ID NO: 43971 - DNA, 201 bp, Homo sapiens
tcctggctactcaggcatgcaccaccccttacagctaattttttaaaaaaaattttgtagagatgggttctggctattttgcccaggctggtctcgaactyctggcctgaagtgatgctctcacctcagccttgcgagttcttggaattataggcatgagcgactgcatttagcatcttccagtctttttctttcttcaaa

SEQ ID NO: 43972 - DNA, 201 bp, Homo sapiens
taatttttggatttttttctgagacagattctcgctctcttgcccagtctggagtgcagtggtgcaacctcagctcactgtaacctctgcctcccgggctmaagcgattttcctgccttagcctcctgagtagctgggattacaggcatgcaccactacccttgcataatttctgtatttttagtagatatgtggttttgc

SEQ ID NO: 43973 - DNA, 201 bp, Homo sapiens
aggcacatacctgtagtcctggctactcaggcatgcaccaccccttacagctaattttttaaaaaaaattttgtagagatgggttctggctattttgcccmggctggtctcgaacttctggcctgaagtgatgctctcacctcagccttgcgagttcttggaattataggcatgagcgactgcatttagcatcttccagtc

SEQ ID NO: 43974 - DNA, 201 bp, Homo sapiens
ggacattttcctgtgctctgccatttgagtagctgttagtttatcaaccttcaggtcatgtttatagaagcactctgccacagggcctgtgtccctgcatrttcttactgagtatgccaagaaagcccctgattgctttttacatgggccacttatttgtcaaagttgtgcttgcagcaaacaacctggagggataagtta

SEQ ID NO: 43975 - DNA, 201 bp, Homo sapiens
tactgaaaatattccttaatgctggtagcttcttgacttcgtgcctttcttacccaattacatctattctaaagctgtcccacttcttttcctttgagcayatgactactgctatctatctcctattcttaaccagcattaattacactgtgtattagatactgttttaaaggctttatgtttgttgaccgacttaatcct

SEQ ID NO: 43976 - DNA, 201 bp, Homo sapiens
gagatcctctcacttcagcctcctgagcagcatactaatcaggcacatacctgtagtcctggctactcaggcatgcaccaccccttacagctaattttttwaaaaaaattttgtagagatgggttctggctattttgcccaggctggtctcgaacttctggcctgaagtgatgctctcacctcagccttgcgagttcttgg

SEQ ID NO: 43977 - DNA, 201 bp, Homo sapiens
tactttctagaagtgagattggtaataaataagcaagaaaattcaggtaatttcagagaaggttgaaaacaaaataaaatgggctgatgtgatagagaatsacagagcagaggggcttctgtagattgggtggtcaaggaaggtgtgtcctgggagttgatgtttgagtgtagacctgtagaaaggccttaaggcaggaat

SEQ ID NO: 43978 - DNA, 201 bp, Homo sapiens
tttataggtcttattaaatgtgggaaacttttttggttgttattgtttcacattttttctgtcttcctgtctcttgtgtctccttctgagagtttattacrgggatgttaactacttgatgttatctgttaagtcattgaggctcttttcatttgttttccaggcttatttctctttgtacttcattgtggatagattcta

SEQ ID NO: 43979 - DNA, 201 bp, Homo sapiens
tattgctgtaatatgctgtgtaaaggctcaaacctttcctgcatgatttttttaaagagtaggggtctcgctctgctgtccaagctggattgcagtggtgyggtcatagctcattgcagccttgaactcctgggctcaagagatcctctcacttcagcctcctgagcagcatactaatcaggcacatacctgtagtcctgg

SEQ ID NO: 43980 - DNA, 201 bp, Homo sapiens
agtagagacagggtttcaccatgtgggccaggctcgtgttgaactcctgacctcaagtgatccacctgtctcggcctcccacagtgctgggattacaggtrtgagccaccacgcccggccagcactacactttctaatgagtttttattgaaaaaaattttagttgaaaatgaagctgttggctcgtaagtgaaaagcttg

SEQ ID NO: 43981 - DNA, 201 bp, Homo sapiens
ttgagagtaaggtacagaataaaagtgtcatatcatcagtattctccaccagatcctgtgctatgatattgctgtaatatgctgtgtaaaggctcaaaccyttcctgcatgatttttttaaagagtaggggtctcgctctgctgtccaagctggattgcagtggtgcggtcatagctcattgcagccttgaactcctgggc

SEQ ID NO: 43982 - DNA, 201 bp, Homo sapiens
ttttttaggtctacaaacactgaatgagcacctatgatttttattctagaggctttttgtagctcatttatttttcctaagaatgctttttgccccttttytttttttttttttgagatagggtctctcgctctgtcacccaggctggagtgcacttgtgcaatctcagctcactgtaacctcctgggttcaatctctgct

SEQ ID NO: 43983 - DNA, 201 bp, Homo sapiens
ttaatttggttaagaggaagtgcttcacacatacgaaatgttattaagtggtcggtacttgatggtaccaatttcgtgattgcagtgttacagttctatcraagtttaataagctcaattctgtgggttcatatgaagtcatttcaatataattcttagatatttagagccaagtaaatgtggaatggcataccaaacagt

SEQ ID NO: 43984 - DNA, 201 bp, Homo sapiens
acctgagactgggtaatttataaagaaaagaggtttaattggttcagggttccataggctgcacaggaagcatggctggggaggcctcaggaaacttacartcgtggcagaaggtgaaggggaagcaggcaagtcctacatggctggagcaggaggaagagagagggggaggtgccatacactttcaaacaaccagatctc

SEQ ID NO: 43985 - DNA, 201 bp, Homo sapiens
gtgcataccactgtgtctgactttttataaaaatacgttttaaacctctttatctacaggttccctctccatctctttttattcctatcctcacctttggttttttttttttttttttgaagaaactcagttgtttttcttgtggagttttccaaagtctggattttgctgattacatatccatagagtttaagatattcc

SEQ ID NO: 43986 - DNA, 201 bp, Homo sapiens
acaaaatgaaaagcatgaaatgatacagttttttataaaacatgaaaacatgcatggtaatatacatcacattcaagataatgtttgcttcttttattaattttttttttaatttgagacgatgtttcactcttgctcaggctggagtgcagtggtgtgatcacagctcattgcagccttgactccctgggctcaagtgat

SEQ ID NO: 43987 - DNA, 201 bp, Homo sapiens
tgaggcgggagaatcccttgagtctggaaggtggaggttgtagtgagccgagatcgtgccactgcactccaagctgggtgacagagtgagattctgtctcaaaaaaaaaaaaaaagatacagttatgcaatatgattcacccatttagcatgcacaattcggtggcttttaggatattcccagagttgtgcaaccatcatc

SEQ ID NO: 43988 - DNA, 201 bp, Homo sapiens
tagctaggtcatttttatggagggactttcaagaattattaagtgaagagaacaagacacagaaatatgtttataaaatcatctcagttttataatgtagtaatataatatataatgagcatatattatatatgcttgtgtatgaccaaaatatgaacatgaaaaaatatggaaagattcattctaggctgttaacatgag

SEQ ID NO: 43989 - DNA, 201 bp, Homo sapiens
agctaggtcatttttatggagggactttcaagaattattaagtgaagagaacaagacacagaaatatgtttataaaatcatctcagttttataatgtagtaatataatatataatgagcatatattatatatgcttgtgtatgaccaaaatatgaacatgaaaaaatatggaaagattcattctaggctgttaacatgaga

SEQ ID NO: 43990 - DNA, 201 bp, Homo sapiens
gctaggtcatttttatggagggactttcaagaattattaagtgaagagaacaagacacagaaatatgtttataaaatcatctcagttttataatgtagtaatataatatataatgagcatatattatatatgcttgtgtatgaccaaaatatgaacatgaaaaaatatggaaagattcattctaggctgttaacatgagag

SEQ ID NO: 43991 - DNA, 201 bp, Homo sapiens
ctaggtcatttttatggagggactttcaagaattattaagtgaagagaacaagacacagaaatatgtttataaaatcatctcagttttataatgtagtaatataatatataatgagcatatattatatatgcttgtgtatgaccaaaatatgaacatgaaaaaatatggaaagattcattctaggctgttaacatgagaga

SEQ ID NO: 43992 - DNA, 201 bp, Homo sapiens
gctatttttgtatttttagtagagacagggtttcaccatgtgggccaggctcgtgttgaactcctgacctcaagtgatccacctgtctcggcctcccacaktgctgggattacaggtgtgagccaccacgcccggccagcactacactttctaatgagtttttattgaaaaaaattttagttgaaaatgaagctgttggct

SEQ ID NO: 43993 - DNA, 201 bp, Homo sapiens
tgaaatagagcattttggcagagaaactttagctctttctttctctctctttcttcaacttgggaaagaataaggaataaatctttatcttttttttttcytcttctggccaagacctaaataccagcatttcatgataatggataagttatctttgaaattttccttttttctttcagtgtgcaggatgacagaattcga

SEQ ID NO: 43994 - DNA, 201 bp, Homo sapiens
tgagaaactttctaaagtatcttaactcagttgtttatagtatagctttactttacagataacttttgatgttcttagatcattagatatacctacatcartatacataagataagcttccaaaggaaatactctttgctttgggaatactctttcctatcatctactaattttcattatagcagcagtcttttatttgta

SEQ ID NO: 43995 - DNA, 201 bp, Homo sapiens
cactatcacagtcgagatgtggaagaatacttttaccctaaaactttccatgtgcttttgcagttggtcccctcccttcacatctggccctaggcaattaytaattttccaccagtatattttaccttttacagaatttcaaatacaggatatcttacaatatatattaaaattttttggcttgatttctttcacaaaata

SEQ ID NO: 43996 - DNA, 201 bp, Homo sapiens
ctgcctcagcctctggagtagctgggattacaggcactcgccaccacgcctggttaatttttgtatttttagtagagatggggtttcaccatgttggccakgttggtcttgaactcctgacctcgtgatctacccgcctcggcctcccaaagtgctaggattacaggcatgagccaccgtgcccagctgcctttgtctggt

SEQ ID NO: 43997 - DNA, 201 bp, Homo sapiens
gtgaatgtttaaaagcattatatagactctatttcagaattgtgttgactaataaaaaatgctagttttccctaccccacacctatctttcaactgctttrtatttatttctttattagatagaaaattcctcagtaaacttttatttagagtaattcctctttatgatttttttgttctaaaggtcgattcttaaaagaa

SEQ ID NO: 43998 - DNA, 201 bp, Homo sapiens
atctgggtcaattatataatcatagataacttaatttttttgatgcagtggtatttactgtccacctctaataaagcaggtgaatcatagactaccattgkatacatgtctttggagcagatttccatccatttttactccagtcctatggtggctaccggtattgttcttgtcgcctgctattcttagtctgcagtttgc

SEQ ID NO: 43999 - DNA, 201 bp, Homo sapiens
gaaaatgtattgttttgaacgaaggttcattggtacttggaaaatttggagtaactggcaagctctgattagtgaatgactgcaatgggtaaaactagccwtagagtcacagcaggttgttttagcagctatcaggtaaaattggtttcaggttacagtaggcagtttcagcagctaggcttgcagagaattacatttttg

SEQ ID NO: 44000 - DNA, 201 bp, Homo sapiens
aaattatcaggaattcataagagatagtagactggttattcattatgagtgtggcattgaggtttaaaaagtacagcatggagatcaactaattgtattaraaattattaggaagatcagttatcttttatctttactaggttaagttgatgaatttgaggaacaaagtttcttcgttattgatagtaggatggattcttg

SEQ ID NO: 44001 - DNA, 201 bp, Homo sapiens
cttttttgaaatgggttcactctgtcactcaggctgcagtgcagtggcatgatcatggctcactgcagcctcgacctacctgggcccaggtgatccttccwcttcggcctcccgagtagctgggactacaggcacacaccaaccatacccagctaatttttgtattcttttaggaatggagtttcaccgtgttgcccaggc

SEQ ID NO: 44002 - DNA, 201 bp, Homo sapiens
cacctcctcctccacaggtgcagccgaccaggtggaccctggcgctgcagcggccgcagcgcccccagcgcccgccttcccgccccagctgccgccgcacrtagtaggttctgtctgggactgggcagggccatcggggctgggggggcggggcttgtgggtaaggcgggcggaggcgtggaccctccgcccgatgatagg

SEQ ID NO: 44003 - DNA, 201 bp, Homo sapiens
tgtgggaaacttttttggttgttattgtttcacattttttctgtcttcctgtctcttgtgtctccttctgagagtttattacagggatgttaactacttgrtgttatctgttaagtcattgaggctcttttcatttgttttccaggcttatttctctttgtacttcattgtggatagattctactgctctgttttcaagtt

SEQ ID NO: 44004 - DNA, 201 bp, Homo sapiens
cacattttttctgtcttcctgtctcttgtgtctccttctgagagtttattacagggatgttaactacttgatgttatctgttaagtcattgaggctctttycatttgttttccaggcttatttctctttgtacttcattgtggatagattctactgctctgttttcaagttcagtggtctttttttctgctatgtctaatc

SEQ ID NO: 44005 - DNA, 201 bp, Homo sapiens
ccttttgctcctttttgctcatgttttcctttacattcttaattatatggagcatatttataaattgtattttcttgttcttatatgctaattgcatcatmtctgtcatttctggggctgcatcccttgacagatttttcctattttttgcatgtctagtaactaattatttggatcatggatatgttgaatctgtgttgt

SEQ ID NO: 44006 - DNA, 201 bp, Homo sapiens
attaaattcctttggatcactttggtctttttaaggattgtttttaaacttcggtagagaataatagcccttactctagagcaactttagtcacattctayggcttgacctttttagagttagaaaggggtgcatagtagcagtagcacaccattatatcgtatttccacaatacagagacagtagacattagtaacatta

SEQ ID NO: 44007 - DNA, 201 bp, Homo sapiens
ccaactttaaaaggtcactaaagttaactggacaataatctaggcagacatcactttacaaaaaagagggaaagcccaaaatgccaccttctatagaaaaygcacagtacagttttattcagagcaaagaaaaaagaaacttgatcatactatgagaaactcagccataggtttggaatccgtattcacaccacacattca

SEQ ID NO: 44008 - DNA, 201 bp, Homo sapiens
gatttcagcctgtgtcttagggaatcagtcttactatcttgttacactttcttttgttgtaaaaatgtagagaaagaaacaaatggaaagcaatagtctcragccctttatcaattgcagttaaggttgctttagcttagaaatgttgtatgtttatagaaatggttgagaggaaagctttagaaagcgataaacaaataa

SEQ ID NO: 44009 - DNA, 201 bp, Homo sapiens
ccattgcactccagcctgggtgacagagtgagactctgtctcaaaaaaaaaaaaaaaattttttatttgggaagcaagaattgcaatttgggacatacacrcagaccaggtcgtctttggtatgtttgaagcacaaagagaaaattggaggttttattaaaaaggagaaataagccaggagcagtggctcacatctgtatt

SEQ ID NO: 44010 - DNA, 201 bp, Homo sapiens
gtagagttgtttgagctccttatatattgtggttattaatcccttgtcacatgggtggtctacatacattttcttccattccatgggttgtctcttcactktgttgattgtttctgttgctgtgcagaagctttttaacttcatgtgatcccatttgtccatctttgctttggttgccctattaagaaatctttgcccagt

SEQ ID NO: 44011 - DNA, 201 bp, Homo sapiens
taggtcatttttatggagggactttcaagaattattaagtgaagagaacaagacacagaaatatgtttataaaatcatctcagttttataatgtagtaatataatatataatgagcatatattatatatgcttgtgtatgaccaaaatatgaacatgaaaaaatatggaaagattcattctaggctgttaacatgagagat

SEQ ID NO: 44012 - DNA, 201 bp, Homo sapiens
tggagtgcagtggcatgatctcagctcactgcaacctccgccccccgggttcaagcagttttcctgccttagcctccctagtagctggtattataggcgcmtgccaccacgcccagctaatttttgtattttagtagagatggggtttcgccatgttggccacgctggtctcaagctcctgacctcaggagatccacccat

SEQ ID NO: 44013 - DNA, 201 bp, Homo sapiens
gaggcaggagaatgatgtgaacccaggaggtggagcttgcagtgagctgagattgctgccactgcactccagcctgggcaacagagcgagactccatctcaaaaaaaaaaaaaaaaaagataataaaaaaattaaaaagtactcattttaatattttatgaaatagagcattttggcagagaaactttagctctttctttc

SEQ ID NO: 44014 - DNA, 201 bp, Homo sapiens
ttatggtgttaaaaacagttcacccatagggttttccagagctaaaagtagaggattctttgaagagtggatggcaaggaaccttgtcattcagttgtaargtttaaattgcttcacatacgtcaggccttctcagagtagagataacacatcattttctaaccttcccgatataggctacagaaattgacagaagaaaga

SEQ ID NO: 44015 - DNA, 201 bp, Homo sapiens
ttccgggttgtcagctttttcagctccaagtctgggttttatgctacaaaaagtaaacctggggaactcaccgtcatactgttcctcacatcccaagttcmctagctggtctgctttctgctcacctttcagagtcgtcttatgtttgtttgacatgtaatatgcagggagtggtacttagagtaggagtggggaaacata

SEQ ID NO: 44016 - DNA, 201 bp, Homo sapiens
aaagaagtattaatgttgggataaggaaactaacttagaaatcaggccctgatgtgtttagaagcaaatgaatttggacctggaaagatgtgtcctcctcatatatatatatatatatatattttttttttttctttttttttttttagatggagtcttgttctgttgcccaggctggagtatagtggtgcgatctcagct

SEQ ID NO: 44017 - DNA, 201 bp, Homo sapiens
aagaagtattaatgttgggataaggaaactaacttagaaatcaggccctgatgtgtttagaagcaaatgaatttggacctggaaagatgtgtcctcctcatatatatatatatatatatattttttttttttctttttttttttttagatggagtcttgttctgttgcccaggctggagtatagtggtgcgatctcagctc

SEQ ID NO: 44018 - DNA, 201 bp, Homo sapiens
ataaggaaactaacttagaaatcaggccctgatgtgtttagaagcaaatgaatttggacctggaaagatgtgtcctcctcatatatatatatatatatatattttttttttttctttttttttttttagatggagtcttgttctgttgcccaggctggagtatagtggtgcgatctcagctcactgcaacttccgcctcct

SEQ ID NO: 44019 - DNA, 201 bp, Homo sapiens
cgccaccgcgcccagctaattttttgtatttttagtagagacagggtttcaccatgttggccaggctggtcttaaactcctggcctcaagtgatctgcccrcttggcctcccaaagtgctgggattacaggtgtgagccaccgtgtccggcctgtcttcctcatatttaattcgaaataagaataataccaaacaataaaa

SEQ ID NO: 44020 - DNA, 201 bp, Homo sapiens
tgaaaagccagttaagtacgtatttttgaaaaccaagggaataataataaagtaagagatgcatagtccattttcacactgctgataaagacataccagakactgggaagaaaaagaggtttaattggacttacagttccacatggctggggaggcctcagaaacattgtgggagttgaaaggcacttctttttttttttt

SEQ ID NO: 44021 - DNA, 201 bp, Homo sapiens
ccattttcacactgctgataaagacataccagagactgggaagaaaaagaggtttaattggacttacagttccacatggctggggaggcctcagaaacatkgtgggagttgaaaggcacttcttttttttttttttcttaatttaagttctgggatacatgtgtagaacatgcaggtttgttgaaaggcacttcttacatg

SEQ ID NO: 44022 - DNA, 201 bp, Homo sapiens
acactgctgataaagacataccagagactgggaagaaaaagaggtttaattggacttacagttccacatggctggggaggcctcagaaacattgtgggagktgaaaggcacttcttttttttttttttcttaatttaagttctgggatacatgtgtagaacatgcaggtttgttgaaaggcacttcttacatggcggtggc

SEQ ID NO: 44023 - DNA, 201 bp, Homo sapiens
taatttaagttctgggatacatgtgtagaacatgcaggtttgttgaaaggcacttcttacatggcggtggcaagagaaaatgaggaagaaggaaaggtggraacccctgataaacccatcagatttcatgagacttattcactatcatgggaatagcatgggaaagactggctcccatgattcctcccactgggtcctccc

SEQ ID NO: 44024 - DNA, 201 bp, Homo sapiens
ggttacagtaggcagtttcagcagctaggcttgcagagaattacatttttggagcaatgatatgtgctctcagtgctttttcccctggcctctctactccrtttcaattgagtatgacaagaatgacccaatttatatgatcaactttcacaatactttttttttttttcccagcaaatacaactccaagatcttcatccc

SEQ ID NO: 44025 - DNA, 201 bp, Homo sapiens
aacacagtggcgcccagaagcttggagattccaggaactgcagagccccagagagggtgtcatagacctggcttaggagcccctaggtctgagctccccaraggtccacagctcttctctcctgtcttctctccttcttgttgctgcaatgtggcaagcaagagatgggtttcaggcctgtttgtgttacagctcttttag

SEQ ID NO: 44026 - DNA, 201 bp, Homo sapiens
aaagatgtaactcagaaactttaatcattatagaaactacgtaggaaatgatgagttcatgtcctttatagggacatggatgaagctggaaacgatcattytcagcaaactatcgcaaggacaaaaaaccaaacaccgcatgttctcactcataggtgggagttgaacaatgagaacacatgggcacaggaaggggaacat

SEQ ID NO: 44027 - DNA, 201 bp, Homo sapiens
aggggaatttactccagtgtttattgtgagaaccaagtggaactcctgggagtaaaactcacaaaagtgtgcccccttcccccatgactcggttcccctgyactttttgactctcagacttgttgacactgagcctccagcaattgatcagttccagttccagttttcctaccctgatactggttccttcagaggtttctg

SEQ ID NO: 44028 - DNA, 201 bp, Homo sapiens
tgctggatcatgtggtagttctatttttagttttttggtagttttttttcaaactactctccatagtggttgtactaatttacattcccaccaacagtctrtgagggttcccttttctccacatcctcaccagcatttattattgcatgtctttggataaaagccattttaactgaggtgagatggtatctcattgtagtt

SEQ ID NO: 44029 - DNA, 201 bp, Homo sapiens
ttacatgtatttgcaatatttaatttttaaaaaattatacagaaaatacacacacatgaattttttataatgtactgctatttgaccttcactaccatcayaatcaggtgaaaatgagacccatgcacatctgtctagaaagcccatgttgaacttgagagcatctgttttccagcacatcttgcattagaaagacagaag

SEQ ID NO: 44030 - DNA, 201 bp, Homo sapiens
tgattcatctcagtacagatgacagtcacctgcagagtataattagtcatcttttaaaaacgcccaatattttccccaaaatatcatttaacttactaagrgccatatactgtactggacataggtttttattttaatattataaggaaactgaatctcagacaggtaaagtggtttgaccatgtcaaccacttagatggg

SEQ ID NO: 44031 - DNA, 201 bp, Homo sapiens
tgcttataatgaatcaaggcagactactcacatcaacacctaataaacaaagtcaggaactgtagaccaggaaaagttgctatgagagctttctaagattrctggaatgtatgctatttttctatgttagttttcttttctttagtaataaaattcttaaaccaaaggcctacctgttcattcttagaatgtttgaaaaaa

SEQ ID NO: 44032 - DNA, 201 bp, Homo sapiens
cttttcaccaccatgcaatcttgaaaaacacatcataaattctcttatggaagtagttttgtatctattaatctgcatccaggttgacaagaggagacttwagctaaaacccttgggacaaagagaatagagttcaccaacagggaagaagaggagtcagtgccgctaatacgcatttgatgtgaactgaaaactaaccca

SEQ ID NO: 44033 - DNA, 201 bp, Homo sapiens
ttatgaaatgtaacaggtgtactagggtatgaagtgaaacaaaaacaccccattctccccaggtctaccatgtttctttaggtaacatttcacaagtctasaagtatacatcttttcttttctaaaatggtatcatactaagcattactattgtataacttgcttttgtttcctaatatgtgggagacatatttctctatc

SEQ ID NO: 44034 - DNA, 201 bp, Homo sapiens
tcttcctgcctggccagctttattatcaggctagtgacaatgactgcagctcttcctggcatcatgtccagaatgtccaaaggaagaagagacaagcattkcctgttcactctttcttagaacaagggaactttttctcagatgccttccagtatctcatgattgcctcattgcattttcagaattgagtaacaggctcct

SEQ ID NO: 44035 - DNA, 201 bp, Homo sapiens
acattacttttgatcaaaatgttgtcagaaattaaggctgtagacactgctgtggattaaatcctcccttgaaacatgtctctcttttttttgttctagargatggactgtgtatattcagtaatcttctcaattgcaaattatttaaaaattgaattatatcataaaaaattatagaaattcatttgcaaatattttcaa

SEQ ID NO: 44036 - DNA, 201 bp, Homo sapiens
aggagggaggattgtttaaagccaggagttcgagaccagcctgagcaacatagcaagacctgatctctacaaaaaatattaaaaaattagctgagtgtggwggcatgaacctgtagtcctagctacttaggaggctaggcaggaggattgcttgagcccaggagtttgatgttacagtaaggtatgattgtgccactgcac

SEQ ID NO: 44037 - DNA, 201 bp, Homo sapiens
cagcctgggtgacagagtgagactctgtctcaaaaaaaaaaaaaaaattttttatttgggaagcaagaattgcaatttgggacatacacacagaccaggtsgtctttggtatgtttgaagcacaaagagaaaattggaggttttattaaaaaggagaaataagccaggagcagtggctcacatctgtattcctaacgcttt

SEQ ID NO: 44038 - DNA, 201 bp, Homo sapiens
gcaatttccacatcaaatatctccgcatcaaaactcagcatcttaattgacggcatggtgtttgagcttaaggagaccactggccagaggctcatgagagyagggcgacatcagcaaagaagaggaaggcagaggacaaggacactcaagacatggtttggatgatgataattaccaaatcttttcagatttagtgggtca

SEQ ID NO: 44039 - DNA, 201 bp, Homo sapiens
tggccatggtggcacttgcctgtagttccagctactcaggaggctgaggtgggaggatctcttgagcctgggaggtcaaggttggaaaaagaaaatgtatygttttgaacgaaggttcattggtacttggaaaatttggagtaactggcaagctctgattagtgaatgactgcaatgggtaaaactagccatagagtcaca

SEQ ID NO: 44040 - DNA, 201 bp, Homo sapiens
aaaacagttcacccatagggttttccagagctaaaagtagaggattctttgaagagtggatggcaaggaaccttgtcattcagttgtaaggtttaaattgsttcacatacgtcaggccttctcagagtagagataacacatcattttctaaccttcccgatataggctacagaaattgacagaagaaagaagagaccattg

SEQ ID NO: 44041 - DNA, 201 bp, Homo sapiens
aaagtaaagaaagtccaacaaaaggaaggaggaagtgatctgggaatgtctggcaactctggtgagttgtgggggattcttttttctcctcagtcatggcyctggtattctggaattctccagagggcagaagagcgtattagaattgtgtcttttttctttgtggagaaaggtcccttttgttcctgagcagagtggccc

SEQ ID NO: 44042 - DNA, 201 bp, Homo sapiens
gatctgggaatgtctggcaactctggtgagttgtgggggattcttttttctcctcagtcatggctctggtattctggaattctccagagggcagaagagcstattagaattgtgtcttttttctttgtggagaaaggtcccttttgttcctgagcagagtggccccctataggtgatggtgatgtgtataggaggttaagg

SEQ ID NO: 44043 - DNA, 201 bp, Homo sapiens
cttttttctttgtggagaaaggtcccttttgttcctgagcagagtggccccctataggtgatggtgatgtgtataggaggttaaggggatggtagagctasaattctgcaatttagctgtagttctcccaactttctcctttattccttctagctatttttgtcctggttataaaattaaaacattcttgctacagaaatt

SEQ ID NO: 44044 - DNA, 201 bp, Homo sapiens
gcagctgccaagggtgagccaggagtggagtggtgagggtgaggggtgtgtgagcaggtgaccatggggtctggcccctgtgcactgccaggcatgctggyttcggcagggtgggcagctccaggtgccagcgtgagtgagggctggaccaggcgtaccacaaacagcttccacagctggcaccagggaacacagtggcgc

SEQ ID NO: 44045 - DNA, 201 bp, Homo sapiens
cccagctactcaggaggctgaggcgggagaatcccttgagtctggaaggtggaggttgtagtgagccgagatcgtgccactgcactccaagctgggtgacrgagtgagattctgtctcaaaaaaaaaaaaaaagatacagttatgcaatatgattcacccatttagcatgcacaattcggtggcttttaggatattcccag

SEQ ID NO: 44046 - DNA, 201 bp, Homo sapiens
cccctgtgcactgccaggcatgctggcttcggcagggtgggcagctccaggtgccagcgtgagtgagggctggaccaggcgtaccacaaacagcttccacrgctggcaccagggaacacagtggcgcccagaagcttggagattccaggaactgcagagccccagagagggtgtcatagacctggcttaggagcccctagg

SEQ ID NO: 44047 - DNA, 201 bp, Homo sapiens
gaaggtggaggttgtagtgagccgagatcgtgccactgcactccaagctgggtgacagagtgagattctgtctcaaaaaaaaaaaaaaagatacagttatrcaatatgattcacccatttagcatgcacaattcggtggcttttaggatattcccagagttgtgcaaccatcatcaaagtcaattttagaacattttcatc

SEQ ID NO: 44048 - DNA, 201 bp, Homo sapiens
cttcttacatggcggtggcaagagaaaatgaggaagaaggaaaggtgggaacccctgataaacccatcagatttcatgagacttattcactatcatgggamtagcatgggaaagactggctcccatgattcctcccactgggtcctcccactgggttacctctcactgggtccctaccacaacacgtgggaattctgggag

SEQ ID NO: 44049 - DNA, 201 bp, Homo sapiens
acatggcggtggcaagagaaaatgaggaagaaggaaaggtgggaacccctgataaacccatcagatttcatgagacttattcactatcatgggaatagcaygggaaagactggctcccatgattcctcccactgggtcctcccactgggttacctctcactgggtccctaccacaacacgtgggaattctgggagataaaa

SEQ ID NO: 44050 - DNA, 201 bp, Homo sapiens
tatagagggttgtctttttctctggttgcttttaagattttctcttaatcactgattttcatgtttgattttctttctgccccatataatctgcaggaacmcatatttgattttggtggaccttgtctctttcccccacacccgagacagcctgtgctgtctagcacaggctggagtgcagtggcacaatctcagctgact

SEQ ID NO: 44051 - DNA, 201 bp, Homo sapiens
gggcatgatggcgggtgcctgtaatcccagctactcaggaggctgaggcgggagaattgcttgaaactgggaggcggaggttgcagtgagccgagatcgcrccattgcactccagcctgggtgactgagcgagactccgtccctcacccacccacccccctaaaaaagaaaaactactgttttaaaatgagctaaaagaca

SEQ ID NO: 44052 - DNA, 201 bp, Homo sapiens
gtgcctgtaatcccagctactcaggaggctgaggcgggagaattgcttgaaactgggaggcggaggttgcagtgagccgagatcgcgccattgcactccarcctgggtgactgagcgagactccgtccctcacccacccacccccctaaaaaagaaaaactactgttttaaaatgagctaaaagacactaagaaaatgata

SEQ ID NO: 44053 - DNA, 201 bp, Homo sapiens
gtttcatcatgttggttggccaggatggtctccatctcttgacctcgtgatccacccaccttggcctcccaaagtggtgggattacaggcgtgagccactrtgcctggccgcatgtgtgttgttaattacagagtaaataacacttgttgcatatgttagaatcttttttttttttttttgccgaggcgtagtctcactct

SEQ ID NO: 44054 - DNA, 201 bp, Homo sapiens
cctcccaaagtggtgggattacaggcgtgagccactgtgcctggccgcatgtgtgttgttaattacagagtaaataacacttgttgcatatgttagaatcttttttttttttttttgccgaggcgtagtctcactctgttgcccaggttggagtgcagtggcgtgatctcagctcactgcaatctccgcctccctggttca

SEQ ID NO: 44055 - DNA, 201 bp, Homo sapiens
ctgttgcccaggttggagtgcagtggcgtgatctcagctcactgcaatctccgcctccctggttcaagtgattcttgtgcttcagcctcccgagtacctgrgactacaggttcgtgccaccatgcctggctaatttttatgttttttagtagagacgaggttttgccgtgttggccaggctggtttcgaactcctcacctc

SEQ ID NO: 44056 - DNA, 201 bp, Homo sapiens
ccaagagttcttcttgattgtcaaaactttatatcacctaaagtcagaatttcaagcaataatacctgctgttaattcccacattcagtcagacttgctcyggaccgttattttagaaattcctgaactcctcagtccagtggagcattacttaaagatactcaatgaacaagctgccaagtaagtaccagaccctgaatt

SEQ ID NO: 44057 - DNA, 201 bp, Homo sapiens
ctctgccccgccaagtttaagcaattctcctgcctcagcctctggagtagctgggattacaggcactcgccaccacgcctggttaatttttgtatttttartagagatggggtttcaccatgttggccatgttggtcttgaactcctgacctcgtgatctacccgcctcggcctcccaaagtgctaggattacaggcatga

SEQ ID NO: 44058 - DNA, 201 bp, Homo sapiens
tgtttcatctccagaagttccattttgttcttttaaaatattttccagttctctatatgaattatatctcagtaaagctaaaaaaaattccttttgctccyttttgctcatgttttcctttacattcttaattatatggagcatatttataaattgtattttcttgttcttatatgctaattgcatcatctctgtcatttc

SEQ ID NO: 44059 - DNA, 201 bp, Homo sapiens
agaaaatttaaactttcctcaattctgattctaacttttaaaagtcactaattaaacttcattttcatgtatcttatgctatttcataaaaaatatttctrttttcagtgttctacccaagagttcttcttgattgtcaaaactttatatcacctaaagtcagaatttcaagcaataatacctgctgttaattcccacatt

SEQ ID NO: 44060 - DNA, 201 bp, Homo sapiens
gcaatccttggggtgttgcttcgccagctgtaaacctctgtggctggtggtgcctttgcccgagtttttacttgggcctgctgggctcattcctcccactyggcctggcaggctgtgcttggcttttgcttttggcctgaatctcgcagctgccaagggtgagccaggagtggagtggtgagggtgaggggtgtgtgagca

SEQ ID NO: 44061 - DNA, 201 bp, Homo sapiens
aaggcattctcaggtataggaaaattgttatgcaatccttggggtgttgcttcgccagctgtaaacctctgtggctggtggtgcctttgcccgagtttttmcttgggcctgctgggctcattcctcccactcggcctggcaggctgtgcttggcttttgcttttggcctgaatctcgcagctgccaagggtgagccaggag

SEQ ID NO: 44062 - DNA, 201 bp, Homo sapiens
aaaaagtaccttttccccttgtcttcaataaatatttattacagtgtttattttatgccaacattataaactagatgttaggtctacaatggggttaatgagatgagatagacaacctgctttcaagaagcttccagtttagtgtgagagaaaggtgttgaaactgttattccggatttggaggatgctgtgaaggagaag

SEQ ID NO: 44063 - DNA, 201 bp, Homo sapiens
tgcactgttcaaataaattgagttttttttgaaaagttagtatctttacctgatgtcccggtgaagctgaattgttttaaacatttgggaactacaaagtrtacatgtttctgggttttcttttggattggggttcccatttctgggccattttgcttctctctcactctcccctcttctttttggtcactagatttttag

SEQ ID NO: 44064 - DNA, 201 bp, Homo sapiens
aaaagtaccttttccccttgtcttcaataaatatttattacagtgtttattttatgccaacattataaactagatgttaggtctacaatggggttaatgagatgagatagacaacctgctttcaagaagcttccagtttagtgtgagagaaaggtgttgaaactgttattccggatttggaggatgctgtgaaggagaagc

SEQ ID NO: 44065 - DNA, 201 bp, Homo sapiens
ttgttttaaacatttgggaactacaaagtatacatgtttctgggttttcttttggattggggttcccatttctgggccattttgcttctctctcactctcscctcttctttttggtcactagatttttaggccatatttttcattgtagggggagctgggtaaatttttagaagttggcagtgacagagtggcaattaatt

SEQ ID NO: 44066 - DNA, 201 bp, Homo sapiens
tttagaagttggcagtgacagagtggcaattaattagaagttggatttagccaactataaatttgtctcatttacatttttctaaattaagtctaataagygaggaattttccctaagctgtgaattggaattaattatggttcctcacagaaaggtaagaatagtaggagtactaatgttgaaaatgtggccttgtgctg

SEQ ID NO: 44067 - DNA, 201 bp, Homo sapiens
tttccctaagctgtgaattggaattaattatggttcctcacagaaaggtaagaatagtaggagtactaatgttgaaaatgtggccttgtgctgtaaatttyttaacagctctttctcatgtttctttaccaagagaatcatggttctttctttctataagaatttatagaatgtgctgtcttttacagtgtgcttggaagt

SEQ ID NO: 44068 - DNA, 201 bp, Homo sapiens
gcagctttatctgttggcatgctttgctcaaagtggttttgccctactcctgagagagagccagatttgtccccattggccttttgtgcattacacacctkagaataaataataaaaagaaaataagtgttaataataatagatttaatgaaatcaaatttaaaaacaagtatgtaaaacattaagatatttagactttca

SEQ ID NO: 44069 - DNA, 201 bp, Homo sapiens
ctttcaaaatttgcataaaaattctatgatagcttacttggttcataattttttttaaccttctactttgaaaatatttgtaacctatggatagtttgcckgaatgctacaatgtgcttctataaacttttcatctagattcactaagtgttagctttttgccagatttgcattttccgtctctgggaacttattattgtg

SEQ ID NO: 44070 - DNA, 201 bp, Homo sapiens
tgggaaccagacttggtgggaaaaagtgaggggtctctattggaatgttagcgcttattctccgtggtactaggccagtactttttatccatccaaagttwattggatgagtcaattagtgaataaaccgtaatcatgtaaatatgttttctaatgaagactcaagcaagaaaacatttttgagatgtatagaagttcctc

SEQ ID NO: 44071 - DNA, 201 bp, Homo sapiens
ccgggtgtggtatcacgtgcctgtaatcccagctactcagaaagctgaggtgggagaattgcttgaacccaggaggtggaggttgcagtgagccaagatcrtgccactgcactccatccagcctgggcaagagagtgagactctgtctcaaaaaaaaaaattttttttcagacaaaactttcatacaagttgtatgtcttc

SEQ ID NO: 44072 - DNA, 201 bp, Homo sapiens
acacctttgttggaagtcatgaatgcttgtgatgattctatagtttgggacctggttggattgtacactagagagtgatgaggtagcatgtctgtgcttcytggatgggaagtaaagacttggccaactttttttcttcaagtttcctaaatcctctgtggcaggcaagcagcgttctcaaagtcagatgcattatgctat

SEQ ID NO: 44073 - DNA, 201 bp, Homo sapiens
tcctggatgggaagtaaagacttggccaactttttttcttcaagtttcctaaatcctctgtggcaggcaagcagcgttctcaaagtcagatgcattatgcwatgttctgtgatattaaattaggctctgagataatgtcaccatgttttctgagggcaggaacaaatatgtagttgtcatcccctaggcgaaggagagaaa

SEQ ID NO: 44074 - DNA, 201 bp, Homo sapiens
ctacatctattgagataatcatgtggtttttgtcattggttctgtttatgtttcggattacacttactgatttgtgtatgttgaagcagccttgcatcccrtagatgaagctgacttgatcgtggtggataagctttttgatgtgctgctggatttggtttgccagtattttattgaggattttcgcattgatgttcatca

SEQ ID NO: 44075 - DNA, 201 bp, Homo sapiens
ccctctttctctgttgattggaatagtttcagaaggaatggtaccagctcctctttgtacctctggtagaattcggctgtgaatccgtctgttcctggacwttttttggttggtaggccattaagtattgcctcaatttcagaacctgttactggtttattcagagtttcaacttcttcctggtttagtcttggcatggag

SEQ ID NO: 44076 - DNA, 201 bp, Homo sapiens
tgattggaatagtttcagaaggaatggtaccagctcctctttgtacctctggtagaattcggctgtgaatccgtctgttcctggacattttttggttggtrggccattaagtattgcctcaatttcagaacctgttactggtttattcagagtttcaacttcttcctggtttagtcttggcatggagtatatgtcctggaa

SEQ ID NO: 44077 - DNA, 201 bp, Homo sapiens
tggaatagtttcagaaggaatggtaccagctcctctttgtacctctggtagaattcggctgtgaatccgtctgttcctggacattttttggttggtaggcyattaagtattgcctcaatttcagaacctgttactggtttattcagagtttcaacttcttcctggtttagtcttggcatggagtatatgtcctggaattta

SEQ ID NO: 44078 - DNA, 201 bp, Homo sapiens
agtttcagaaggaatggtaccagctcctctttgtacctctggtagaattcggctgtgaatccgtctgttcctggacattttttggttggtaggccattaaktattgcctcaatttcagaacctgttactggtttattcagagtttcaacttcttcctggtttagtcttggcatggagtatatgtcctggaatttatccatt

SEQ ID NO: 44079 - DNA, 201 bp, Homo sapiens
tctctgatggtagtttgtatttctgtgggatcggtggtaatgtcccctttatcattttttattgcgtctatctgattcttctctcttttgttcgttattartcttgctagcagtctatcaattttgttgatcttttcaaaaaactagctcctggattcattgactttttgaaggattttttctatctccttcagttctgct

SEQ ID NO: 44080 - DNA, 201 bp, Homo sapiens
ccttcagttctgctctgatcttagttatttcttgccttctgcttgcttttgaatttgtttgctcttgcttctctagttcttttaattgtgatgttaaggtrtcgattttagatctttcctgctttctcttgtgggcatttagtgctataaatttccctctacacactgctttaaatgtgtcccagagattctggtatgttg

SEQ ID NO: 44081 - DNA, 201 bp, Homo sapiens
ttctggcattgttaacttagagaagcctgtgatttgctctttggctgccatcataaaatacctcaaagaattcaacttggaaaagatgctctccaaacctragtaagtgattcctccaaaattaaaaaaagggggagcttatattatgaacatttcttaaattgaatttggtagtactatacttagagaagcttgcctgct

SEQ ID NO: 44082 - DNA, 201 bp, Homo sapiens
tgtgggtaaccggacctttctctctgactgcccttaacattttttctttcatttcaaccttggtgaatctgacaattatgtgtcttggagttgctcttctygaggagtatctttgtggtgttctctgtatttcctgaatttgaatgttggcctgccttgctaggttagggaacttctcctagataatatcctgaagagtgt

SEQ ID NO: 44083 - DNA, 201 bp, Homo sapiens
catgataatggataagttatctttgaaattttccttttttctttcagtgtgcaggatgacagaattcgagtcgaaaggatggataacatttattttgaatrcagccatgctttccaggcagttacagagttttatgcaaaagatacagttgacatcaaaggtaaatattttccctgtatgtcctcaagttgaactgatttg

SEQ ID NO: 44084 - DNA, 201 bp, Homo sapiens
tttggatttttttctgagacagattctcgctctcttgcccagtctggagtgcagtggtgcaacctcagctcactgtaacctctgcctcccgggctcaagcrattttcctgccttagcctcctgagtagctgggattacaggcatgcaccactacccttgcataatttctgtatttttagtagatatgtggttttgccatgt

SEQ ID NO: 44085 - DNA, 201 bp, Homo sapiens
aaggatggataacatttattttgaatacagccatgctttccaggcagttacagagttttatgcaaaagatacagttgacatcaaaggtaaatattttcccygtatgtcctcaagttgaactgatttgaaatttggataaaggtattagtatgattctcaatttaatgatgactaggtagttattataaatatgtgggagaa

SEQ ID NO: 44086 - DNA, 201 bp, Homo sapiens
tacatttcttggtctttctcattgctgttctcagagatttctttgaatttatcttccaggtttaaaaacttggtctagggcagggcacagtggctcacgcytgtaatccaagtgctttgggaggctgaggctggtggatcacttgagcccaggtgttgtgaccagcctgggcaacatggtggaaccccatctctactaaag

SEQ ID NO: 44087 - DNA, 201 bp, Homo sapiens
gaaatccttgtaaggaagtgtttttgttcaattacaggttggtaaaagtggtttctaacacagtatctcttcttttaggtgttcagtggaatcacacttasaaaatttggagggattgtggtgttggcttttgccaaatctcaaattttccagatattctacttcaggatgtatttggccatggtcttactgggagccact

SEQ ID NO: 44088 - DNA, 201 bp, Homo sapiens
acctggccaagttgtagctgatggtctgtccgaaaatgctggttcactctccactggccaactgtctgtctgcactgcactgccagttgcctcttgcctgsgccattgcgctaacatctccacttactgttccacctgcttcctgtttctttgccgtttccagaccttccactttgccacgcaagctatctttgtaaaaca

SEQ ID NO: 44089 - DNA, 201 bp, Homo sapiens
tttctggtgaccatggtcctcctgggctgtgagctctggtctgcagtcatcatgtgtgccaccatcgccatggtcttggtcaacatgtttggagttatgtrgctctggggcatcagtctgaacgctgtatccttggtcaacctggtgatggtgagtcctcatacagtctcagtttgtccctagctcctgtttcacttgggg

SEQ ID NO: 44090 - DNA, 201 bp, Homo sapiens
agtgcagctgcctctcaccctttacctcgtgcctgggtcgctaacacagtgtcatgtatcacaccccccacaagatttaaagatagaagagcctttggtgycttttgttctgtctcagatatatagcccagtcccctgtagtgccccagctatttgggaggcagcctccctctgaggagttgaggcagtataggtctgcag

SEQ ID NO: 44091 - DNA, 201 bp, Homo sapiens
atatttctggtgaccatggtcctcctgggctgtgagctctggtctgcagtcatcatgtgtgccaccatcgccatggtcttggtcaacatgtttggagttaygtggctctggggcatcagtctgaacgctgtatccttggtcaacctggtgatggtgagtcctcatacagtctcagtttgtccctagctcctgtttcacttg

SEQ ID NO: 44092 - DNA, 201 bp, Homo sapiens
ttctgcagttaacatcctccttggccatggcaccagggtcggagccacgtacttcatgacctaccacaccgtgctgcagacctctgctgactttattgacrctctgaagaaagcccgacttatagccagtaatgtcaccgaaaccatgggcattaacggcagtgcctaccgagtatttccttacaggtaaagcctgccctt

SEQ ID NO: 44093 - DNA, 201 bp, Homo sapiens
ccagccatcccattactgggtatatacccaaaggattataaatcatgctgctataaagacacatgcacacgtatgtttatagcggcactattcacaatagyaaagacttggaaccaacctaaatgtccaacaacgatagactggattaagaaaatgtggcacatacacaccatggaatactctgcagccataaaaaatgat

SEQ ID NO: 44094 - DNA, 201 bp, Homo sapiens
caaaatggtagaatttatgtgtatccttaacccagtttccccgatgatacaacttacataactcatagtacatctagaactagaaataccatttgacccakccatcccattactgggtatatacccaaaggattataaatcatgctgctataaagacacatgcacacgtatgtttatagcggcactattcacaatagcaaa

SEQ ID NO: 44095 - DNA, 201 bp, Homo sapiens
tcaggtaactagttcatagtttctcccagtaagagaggtaactggtacatttatcctgctgtggctaatttagggggtgctgggagtgggaatggaggagsaaatgaattgccttcaggcattgctgtcataattgaaagaataagcagttaaaaagggggtgggaggcagcttttctagagctctgctatagtattagct

SEQ ID NO: 44096 - DNA, 201 bp, Homo sapiens
attactgataatagccaaactgtggaaacaactcagatatttatcacctgatatatggataaacaaaacatatgtccttgcaatgaaatgttgttcggccrtaaaaagaaatgaagtattgatacatgccacaatatgcatgaaccttgagaacattatgctaaatgaaagaagccggtcatgaaagaccacatattatat

SEQ ID NO: 44097 - DNA, 201 bp, Homo sapiens
tgcagtgagctgagatcacaccattggactccagcctgagggacagagactccatctccaaaaaaaaaaaaaaaaaaaaaactcttactactcaatgatarataaataacccaatttaaaatggcaaaagatctgaatagagtagacatttctctaaggaagatatacaaatgaccaacaagcacatgagagatgctcaat

SEQ ID NO: 44098 - DNA, 201 bp, Homo sapiens
aagaacacccactgtaacactattgtgattgtgaaaaattgaagacctcaagaacgagaagacaagacacagactgggagaaagtatttgcaaaagacatrttagtaaggactgttattcaaaatatacaaataactcctaaaactcaataagaaagcaaacagcccaattgaaaaatggacaaaacaacctgaacagata

SEQ ID NO: 44099 - DNA, 201 bp, Homo sapiens
tgggctgtgagctctggtctgcagtcatcatgtgtgccaccatcgccatggtcttggtcaacatgtttggagttatgtggctctggggcatcagtctgaaygctgtatccttggtcaacctggtgatggtgagtcctcatacagtctcagtttgtccctagctcctgtttcacttgggggaattggctgtcttagattcca

SEQ ID NO: 44100 - DNA, 201 bp, Homo sapiens; identical to SEQ ID NO: 9921

SEQ ID NO: 44101 - DNA, 201 bp, Homo sapiens
tcggtgagtcttgtagacagccagcaaggttttctgcaagggatgtttcccaaaggagtctgaccacttggcagtggtgacaggatgaacacgcagtgttygggagtgagagcgagctttaatgaggcctcccctctcccctccagtgtgttttatgtcttctacgaacagtacctgaccatcattgacgacactatcttc

SEQ ID NO: 44102 - DNA, 201 bp, Homo sapiens
ttgaagatgaactaaatcgtgaaagtgacagtgatgtcttcaccgttgtaattagctatgccatcatgtttctatatatttccctagccttggggcacatsaaaagctgtcgcaggcttctggtaagccggggggggggtggtgtatgttctagaggttaacagcagtgcacagtgtaacgtcatatttttgcctctttat

SEQ ID NO: 44103 - DNA, 201 bp, Homo sapiens
gacctggactctcttgacacccaggattctttcctcaggggacatgctgcctatagttctgcagttaacatcctccttggccatggcaccagggtcggagycacgtacttcatgacctaccacaccgtgctgcagacctctgctgactttattgacgctctgaagaaagcccgacttatagccagtaatgtcaccgaaacc

SEQ ID NO: 44104 - DNA, 201 bp, Homo sapiens
ctattcttctaacagtcctccctgcatgtctccgccagtggttgaccctgcctgcgttcgctgcaggcctctgactccggaaggcaaacagaggcctcagkggggagacttcatgagattcctgcccatgttcctttcggataaccctaaccccaagtgtggcaaagggtaagtgctgctgccattgcagataagcatcca

SEQ ID NO: 44105 - DNA, 201 bp, Homo sapiens
tacaaaaaatctggagacctattcttctaacagtcctccctgcatgtctccgccagtggttgaccctgcctgcgttcgctgcaggcctctgactccggaargcaaacagaggcctcaggggggagacttcatgagattcctgcccatgttcctttcggataaccctaaccccaagtgtggcaaagggtaagtgctgctgcc

SEQ ID NO: 44106 - DNA, 201 bp, Homo sapiens
tgtgaagggcatcagctctccagtcaaattgaactgcttgctagcaaaatcctgcccatcttccagggccccatttcacatgctacattatctacgacatycttgtcctgttcccctaactagaatgccttccctctgaagttctgaatctttatttaaactgctgcaacagcatttgctgcctcattaaaagaccttggt

SEQ ID NO: 44107 - DNA, 201 bp, Homo sapiens
ttcgtttcctcagtggggttgcagcagtgggtgaggtggtgtgccagtgccgaggacacggctgcgaccaaggcagacatggtccttgcctttgtggcccyaccatctagtcagggtggcacagcagaaccaagtaattaatcatagctggggaggcgcgaaagcagcaggacaagagtgggaatagcagggcagggttga

SEQ ID NO: 44108 - DNA, 201 bp, Homo sapiens
gacttcctccctgtggagcaggtcagtaaccctgtctgtcctctctagtacccgaataggcttcgccccctcgtcctggatcgacgattatttcgactggrtgaagccacagtcgtcttgctgtcgagtggacaatatcactgaccagttctgcaatgcttcaggtaccttctcctttaccaaatctttcctgttttgctg

SEQ ID NO: 44109 - DNA, 201 bp, Homo sapiens
aaaaatcggctagacatcttttgctgtgtcagaggtgctgaagatggaacaagcgtccaggcctcagagagctgtttgtttcgcttcttcaaaaactcctrttctccacttctgctaaaggactggatgagaccaattgtggtatgcgcttatctgtggtttttctctttcctctcactgaaacagattatcacatgcctt

SEQ ID NO: 44110 - DNA, 201 bp, Homo sapiens
agagcccttctctccccgacaggagcattgtccgtgatgccagccgtgcacaccttctctctctttgcgggattggcagtcttcattgactttcttctgcmgattacctgtttcgtgagtctcttggggttagacattaaacgtcaagaggtaagttggtgccaggattatagtctatttaatttgagtctagaatctaga

SEQ ID NO: 44111 - DNA, 201 bp, Homo sapiens
gatgtccatcctgtttttataacctactgaacctgttttgtgagctgacatgtagccctcgacagagtcagtttttgaatgttacagctactgaagattaygttgatcctgttacaaaccagacgaaaacaaatgtgaaagagttacaatactacgtcggacagagttttgccaatggtaagtaaacttttaattattcct

SEQ ID NO: 44112 - DNA, 201 bp, Homo sapiens
agaaatggcgttgttattgagaaattttaatgtcgcataatttttttttttttttttaagagagatgaacgtcttcaaggggaaaccctggatcagcagcygggcagggtcctaggagaagtggctcccagtatgttcctgtcatccttttctgagactgtagcatttttcttaggtaattatgctttcaatcctaccagt

SEQ ID NO: 44113 - DNA, 201 bp, Homo sapiens
atcatgcagtccttcctctccccccatgctttgctttgcacatcattcttgtccctccctctggtgaagggttgtgatagagtcaggtcctcagtagagcyggcctcggggagctgttaaaaattttgttctgctgtagctggctggttttgtcaaacttagttttttatctgttctgttggctatgaccctgagcagtga

SEQ ID NO: 44114 - DNA, 201 bp, Homo sapiens
tgtaactaattggtgattgtgtctgtcgcctctctcaggtggattcgaaggtctcactaggcatcgcgggcatcttgatcgtgctgagctcggtggcttgstccttgggtgtcttcagctacattgggttgcccttgaccctcattgtgattgaagtcatcccgttcctggtgctggctgttggagtggacaacatcttca

SEQ ID NO: 44115 - DNA, 201 bp, Homo sapiens
taagtaagtagtaaaaaaaagaaaaaaagtccgtctatacactgtaaagtgctgtgtaaatgttcataattactatcactgtcttcttcatagttgatggrgggaaggctggatacataaaaaaatggtaatacagtaagaagtgctcagataagaataaagataaaatgttatggagagtccatttttgagctgagctat

SEQ ID NO: 44116 - DNA, 201 bp, Homo sapiens
agacagactcttgctctgtcaccgaggctggagtacagtggcatgatctcagcttactgcaacctcctcccgggttcaagcgattctcctgcctcagcctscccagtagctgggactgcaggcacatgccaccacacctagctaagttttatatttttagtagaggtggggtttcaccatgttggccaggctggtctcaaa

SEQ ID NO: 44117 - DNA, 201 bp, Homo sapiens
aatctgaccatttccttcactgctgaacgaagtattgaagatgaactaaatcgtgaaagtgacagtgatgtcttcaccgttgtaattagctatgccatcakgtttctatatatttccctagccttggggcacatcaaaagctgtcgcaggcttctggtaagccggggggggggtggtgtatgttctagaggttaacagcag

SEQ ID NO: 44118 - DNA, 201 bp, Homo sapiens
tagtttaactaaaaatataacattttgcttaccttttaggtttattaattttgtgaaaaactacaagaatcccaatctgaccatttccttcactgctgaaygaagtattgaagatgaactaaatcgtgaaagtgacagtgatgtcttcaccgttgtaattagctatgccatcatgtttctatatatttccctagccttggg

SEQ ID NO: 44119 - DNA, 201 bp, Homo sapiens
acacttacaaaatttggagggattgtggtgttggcttttgccaaatctcaaattttccagatattctacttcaggatgtatttggccatggtcttactggragccactcacggattaatatttctccctgtcttactcagttacataggtaagagttctcatcttaaaagggtggcacaatagaaggacattactgaaagg

SEQ ID NO: 44120 - DNA, 201 bp, Homo sapiens
atccgcccacctcggcctcccaaagtgctgggattacaggcatgagccactgcacctggcctagaaggggcttttttttaacctttcctgaactgttcctrtcgttgaaagaagcttccctatccagtcattttcttagtaattaaactctagagcatgttgtgaaatatccatatgatctaacctttaaaaatagaaact

SEQ ID NO: 44121 - DNA, 201 bp, Homo sapiens
aggttttaaaattttcttttgagattgcctcggtgtttttccttaaagttagcacattctttgctttctacttcagcctcaaggacaggaagttcattctygctctttacattggggtgttgatgtttgtggttttgttgttttgttcttcatgttactcatgatgtattgatattaattaacctaaatacatatggaaat

SEQ ID NO: 44122 - DNA, 201 bp, Homo sapiens
catctgcaccagagacactgccgggtccgagtgagggcaggaggctgcacgagggagcctccctgggagtgagcgataggttcgctatgggaggtgggttygaaaggtgcctgagattttcatttgaaactctgttgaagaggaattggcaatagaggaggaaatacaaatagaggaaagattggtttcgtcttaagcact

SEQ ID NO: 44123 - DNA, 201 bp, Homo sapiens
taatagatcaggaatgggtttagcctgctggcctgacccctgattcagtcaccacactgtgaacattccatagggaaaaaactgcagacagtgtatactgrcacccactttcatagttttgttttagttttgtggctcctaaatgtctaagactaactagtaatatgaccttgggtgagtcacataaaaaaccagaagcta

SEQ ID NO: 44124 - DNA, 201 bp, Homo sapiens
agcaattatgtgccgtagagaaaatgtggctattctgtttccctagagttttttaaaatttatttttaaaatttatttattttagagacaggttcttgctstgttgcccaggcgtgggggcagtgtcgccatcatagctcactgcagcctggaactcctggcctcaagcagtccttccaccttggcctcccaaagcactgg

SEQ ID NO: 44125 - DNA, 201 bp, Homo sapiens
caactttttggtttatcttaaagtttatttcacataatccagttttttcttatttgtccagtccatcacctaagaatgcaaactcataacatgtgttgccsgagcagacctagaaatgtttacaagtcctctctgaaacacagaattgtacattcaactctaggtttaatacagccctgtaaagtaaaaaggaggaccttt

SEQ ID NO: 44126 - DNA, 201 bp, Homo sapiens
aagaagccagacagcctgggaaggagattcttaaagctgttaaaatgtatctaaaaaaaaagcaaaagcaaatgtggaacagtagataaaatgtttttccygtgagcttttatcagtccatataaacaagagttttaagttttttattttgaaatagtttcagattcacagaaagttgcaaagaaacttttatttttcctc

SEQ ID NO: 44127 - DNA, 201 bp, Homo sapiens
atgttctagaggttaacagcagtgcacagtgtaacgtcatatttttgcctctttattcttattccattatgtttaaaactgccataaattcccccatgttktaattgtatgtaacgtttctgttgcctacatctattttcttcattccaactttttggtttatcttaaagtttatttcacataatccagttttttcttatt

SEQ ID NO: 44128 - DNA, 201 bp, Homo sapiens
ctgttaaaatgtatctaaaaaaaaagcaaaagcaaatgtggaacagtagataaaatgtttttcccgtgagcttttatcagtccatataaacaagagttttmagttttttattttgaaatagtttcagattcacagaaagttgcaaagaaacttttatttttcctcttaataatgaggaaatagaagccaagagaggtgaag

SEQ ID NO: 44129 - DNA, 201 bp, Homo sapiens
cttattccattatgtttaaaactgccataaattcccccatgttttaattgtatgtaacgtttctgttgcctacatctattttcttcattccaactttttgktttatcttaaagtttatttcacataatccagttttttcttatttgtccagtccatcacctaagaatgcaaactcataacatgtgttgcccgagcagacct

SEQ ID NO: 44130 - DNA, 201 bp, Homo sapiens
ggacaggaagttcattcttgctctttacattggggtgttgatgtttgtggttttgttgttttgttcttcatgttactcatgatgtattgatattaattaamctaaatacatatggaaatattctttcattacttagagcttatatagttcctggtgcagatgtgcaaaaatagtgctttagtaattgctaagtcactatct

SEQ ID NO: 44131 - DNA, 201 bp, Homo sapiens
cacacttaaggaaacaccatctggggacacagggagaaggtgctgtctacaagccaggaagagagccctcaccaggaaccaaataagctccccatgctgawcttgaactctctaacctctagaactgtaacagataaattcctattgtttaagtcacaccagtctttggtattttgtgcaatggcctcagacgtcactaaa

SEQ ID NO: 44132 - DNA, 201 bp, Homo sapiens
tgcatagagtatctgagaaaatgaggcatgcagtcgatgtttggtatttttgtttcatttatttattttactgccatgcctcgagaacaatagatgttcaktaagtatttgaatatgttagttaatgctttaggatttcctaaaggcagtggaatagaattctcactgagttcagagcttttctgataataatgtgtgctt

SEQ ID NO: 44133 - DNA, 201 bp, Homo sapiens
ttcattaaactgtgaaagtgacatgtggctgaagcttttagataaggggaaagattatccctcactagtaaggaaagtaatcgatagagaagaaagtaatrcccctcactgtcagtattttaaaatgttttacaaaaaatctggagacctattcttctaacagtcctccctgcatgtctccgccagtggttgaccctgcct

SEQ ID NO: 44134 - DNA, 201 bp, Homo sapiens
cctgctccaggtgtgatcccaggtgcaatccagctcaacaagcacactgagcctcaggagctcttgggatcagaacccaggactcgatcccactccgtgcygccttctcacccacccctcttccaccaagtgggtggaaatagcacttgctttgaaataagtaacgaatgatctttgtgaaaaggaacctaaacagcagtg

SEQ ID NO: 44135 - DNA, 201 bp, Homo sapiens
acaaaataaataaaatcacagattgcatttaggtacttccatacattgctggctgcaatttctttggagggcaatttgacaacaatcaaaacttaaatacscatttcctttgatccaacaatataaaagtatttccaacagttctatttgcgcatgattgcaaagatttacatccaagaatgggccaggagtggtggctca

SEQ ID NO: 44136 - DNA, 201 bp, Homo sapiens
tctgtcctctctagtacccgaataggcttcgccccctcgtcctggatcgacgattatttcgactgggtgaagccacagtcgtcttgctgtcgagtggacartatcactgaccagttctgcaatgcttcaggtaccttctcctttaccaaatctttcctgttttgctgaaaaattttcaaattatcatttaaaaatcatttg

SEQ ID NO: 44137 - DNA, 201 bp, Homo sapiens
tctgggtggtcagtggccatgagaggtcaagtgagttgctttcggtgagtcttgtagacagccagcaaggttttctgcaagggatgtttcccaaaggagtytgaccacttggcagtggtgacaggatgaacacgcagtgttcgggagtgagagcgagctttaatgaggcctcccctctcccctccagtgtgttttatgtct

SEQ ID NO: 44138 - DNA, 201 bp, Homo sapiens
ctaacctttaaaaatagaaactctttagctgtgtaactactaaattctgggtagaagccaaaacaatcagcacttctcatttctgaacttagataatccarttgtactccctcagctcattgtgagttttgacaagttctgcatccatgaacaccagatgtaatacaatagggaatttcaaaggaaggattacacacctag

SEQ ID NO: 44139 - DNA, 201 bp, Homo sapiens
agcgggtataacctttgtttccctctgtcccctcagaaaaatcggctagacatcttttgctgtgtcagaggtgctgaagatggaacaagcgtccaggcctsagagagctgtttgtttcgcttcttcaaaaactcctattctccacttctgctaaaggactggatgagaccaattgtggtatgcgcttatctgtggtttttc

SEQ ID NO: 44140 - DNA, 201 bp, Homo sapiens
ctgtcccctttcctctccctccagcttttcctggactttttcacctgagggtcctgcagtaatggcaggtggcctgcccagaaccatgcccttacctgctkcttctccccattttgtttaaaggcagtgacagctaccagttactcaggcttgaggctttatccctgaattctgcctcgccctcgccttcctcatggggtt

SEQ ID NO: 44141 - DNA, 201 bp, Homo sapiens
tcagttagtttaactaaaaatataacattttgcttaccttttaggtttattaattttgtgaaaaactacaagaatcccaatctgaccatttccttcactgytgaacgaagtattgaagatgaactaaatcgtgaaagtgacagtgatgtcttcaccgttgtaattagctatgccatcatgtttctatatatttccctagcc

SEQ ID NO: 44142 - DNA, 201 bp, Homo sapiens
tcatttgtggagaacaaacatacagttaaaaaaacaaaactgggccgagagttattcatgcctgtaatcccagcaatttgggaggcagaggcgagcacatyacttgagctaggagtttgagaccagcctgagcaacatggagaaaccccgtctctgcaaaaaatacaaaaattagctgggcatggtggtgcatgcttgtag

SEQ ID NO: 44143 - DNA, 201 bp, Homo sapiens; identical to SEQ ID NO: 9946

SEQ ID NO: 44144 - DNA, 201 bp, Homo sapiens; identical to SEQ ID NO: 9947

SEQ ID NO: 44145 - DNA, 201 bp, Homo sapiens
ttcaccatgttggccaggttggtctcgatctcttgacctcgtgatcccgcccaccttggcctcccaaagtgctgggtttacaggcgtgagccaccgcgccyagcccagtagtgtgtttttaaaggacctaaaagttttaaataaaatgagggccacaaggtgaaattatcctttattaattgttctcttaacatcttctta

SEQ ID NO: 44146 - DNA, 201 bp, Homo sapiens
ttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgcc

SEQ ID NO: 44147 - DNA, 201 bp, Homo sapiens
atgttgatagttgaaaatggcatccttgagtagccactgaatccttctccacatgacactctaagcagcagctcccaaatccacaggcactcgcttacaaratgtttgccgttgttttcaaaggcagtctttctcttctgtgcacacaactcattggggaagcagccttgttaatgaccagaagctcttgactcaccacat

SEQ ID NO: 44148 - DNA, 201 bp, Homo sapiens
ccatgctgatcttgaactctctaacctctagaactgtaacagataaattcctattgtttaagtcacaccagtctttggtattttgtgcaatggcctcagaygtcactaaatgacattgattacattctattaccccaaaaccctagttctatcttcattttctgttattgaactttaggcttcaggttaggaactaggcaa

SEQ ID NO: 44149 - DNA, 201 bp, Homo sapiens
gttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgc

SEQ ID NO: 44150 - DNA, 201 bp, Homo sapiens
ggttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctg

SEQ ID NO: 44151 - DNA, 201 bp, Homo sapiens
tggttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcct

SEQ ID NO: 44152 - DNA, 201 bp, Homo sapiens
agtcctccctgcatgtctccgccagtggttgaccctgcctgcgttcgctgcaggcctctgactccggaaggcaaacagaggcctcaggggggagacttcakgagattcctgcccatgttcctttcggataaccctaaccccaagtgtggcaaagggtaagtgctgctgccattgcagataagcatccactgcaactttaat

SEQ ID NO: 44153 - DNA, 201 bp, Homo sapiens
atattagtatgcatggcagtcagcattttcttaataaataaagatctcatctcagcctggccaaaatgtgaaaccctgtctctactgaaaatacaaaaaawattagccacacgtggtggtgtgtgcctgtagtcccagctactcgggagactgaggcaggagaatcacttgaatcctggaggtggagtttgcagtgagcca

SEQ ID NO: 44154 - DNA, 201 bp, Homo sapiens
gataaatacatatatcaaacgcatggctcaaaaatgacaacgcgtcttctttatctgccttcacgtagaacttaaaacagaccctggtccccacctcgggrtttcctcgcgcccacgggctgcgctgcgcagctgggccagcaggtggcgaggctcccgcactttttttcccgggcctggccgcaccgccaccgcccaccc

SEQ ID NO: 44155 - DNA, 201 bp, Homo sapiens
tttactaagcagtctctgtcttatgattcatttgttgttccagatagcaatatttgtgggtgttctgtcattcagcatcgcagtcctgaacaaagtagatrttggattggatcagtctctttcgatgccagatgtaagatgacttccttttttttttttttttaacttctttagctgatgatgaatacatttttcaaaaca

SEQ ID NO: 44156 - DNA, 201 bp, Homo sapiens
actacacttcttccaaggggcagaacatggtgtgcggcggcatgggctgcaacaatgattccctggtgcagcagatatttaacgcggcgcagctggacaaytagtcagtaccaccttgtcttgtacttcagaagcagcggaggaggctctcagccaggcagtcagctcaggcctgaaatgtctcactgaaaatagactttc

SEQ ID NO: 44157 - DNA, 201 bp, Homo sapiens
gatcacgccactgcactccagcctgggctacagagcaagactctgtctcaaaataaaaaaaaaaagaagccagtctgggagagaacaagctaaacctttgstgttcccttatctgggggccttcttcatccctgaaatgtacagctgggtctgacctctgagtccagggtcaggtgattttgcttagcctcaagtgctcag

SEQ ID NO: 44158 - DNA, 201 bp, Homo sapiens
gctacagataatttagtcttgggtcaactttctcctctccctctacaagggaaatgttcaaaagtgtttagactttggtgatgcagcatgattgggaaagyagagggcacagaaagatgccaggctttgtggtctccaggcaagctcaggaatgtgacaaagcataccgaaaagaaaagcgggctgggagcagtggctcac

SEQ ID NO: 44159 - DNA, 201 bp, Homo sapiens
tggacctccgcttgacatacagatactgcaccaggtaacctgctgtttgaagaaataagtcactctagatgaccttgtggtttgctggcttttacatgttkactactgctagatggggatttggggctgaatgtcatggtatatcttgaaaatcttagcgtataatggcaaagctgcctttaagttaggtttcaagaaagt

SEQ ID NO: 44160 - DNA, 201 bp, Homo sapiens
gcctttcttccggacggagcagctcatcatccgggcccctctcactgacaaacacatttaccagccatacccttcgggagctgatgtaccctttggacctycgcttgacatacagatactgcaccaggtaacctgctgtttgaagaaataagtcactctagatgaccttgtggtttgctggcttttacatgttgactactg

SEQ ID NO: 44161 - DNA, 201 bp, Homo sapiens
gttcaattacaggttggtaaaagtggtttctaacacagtatctcttcttttaggtgttcagtggaatcacacttacaaaatttggagggattgtggtgttsgcttttgccaaatctcaaattttccagatattctacttcaggatgtatttggccatggtcttactgggagccactcacggattaatatttctccctgtct

SEQ ID NO: 44162 - DNA, 201 bp, Homo sapiens
cagtgggcttttctttgagtttaagtataatacaaaattttggatgtttttaattgagatttgtactcaacacaattcctttctgtagattttccagtccrtgggatggagcccatgaacaatgccaccaaaggctgtgacgagtctgtggatgaggtcacagcaccatgtagctgccaagactgctctattgtctgtggc

SEQ ID NO: 44163 - DNA, 201 bp, Homo sapiens
tatgtgtgagatcatgcagaatataatttacttttcctttagatgtccatcctgtttttataacctactgaacctgttttgtgagctgacatgtagccctygacagagtcagtttttgaatgttacagctactgaagattatgttgatcctgttacaaaccagacgaaaacaaatgtgaaagagttacaatactacgtcgg

SEQ ID NO: 44164 - DNA, 201 bp, Homo sapiens
tttaattgagatttgtactcaacacaattcctttctgtagattttccagtccatgggatggagcccatgaacaatgccaccaaaggctgtgacgagtctgkggatgaggtcacagcaccatgtagctgccaagactgctctattgtctgtggccccaagccccagcccccacctcctcctgctccctggacgatccttggc

SEQ ID NO: 44165 - DNA, 201 bp, Homo sapiens
atccatcagtcagtacctgcatgcgggtccgcctgtgtactttgtcctggaggaagggcacgactacacttcttccaaggggcagaacatggtgtgcggcrgcatgggctgcaacaatgattccctggtgcagcagatatttaacgcggcgcagctggacaactagtcagtaccaccttgtcttgtacttcagaagcagcg

SEQ ID NO: 44166 - DNA, 201 bp, Homo sapiens
ccagctttatcttacatattccctgtccctgccctgcaaggagctctggttccttttattggagaatggtatgtagaaacgaagatctgggcactaggtaygctcattgctgctggaaagagtagcatgtttttgtttgtttgtttgtttttttgagatggagtcttgctctgtcaccaggctggaatgcagtggcgcgat

SEQ ID NO: 44167 - DNA, 201 bp, Homo sapiens
tcagagtgttcacactctctcctattcttttatctttctttcaggactcctacatggtggattatttcaaatccatcagtcagtacctgcatgcgggtccrcctgtgtactttgtcctggaggaagggcacgactacacttcttccaaggggcagaacatggtgtgcggcggcatgggctgcaacaatgattccctggtgc

SEQ ID NO: 44168 - DNA, 201 bp, Homo sapiens
atattttgttcctcctgaaactcaaccactgattttagcattcattgttgggtcttgtctgcaacagttataactaaggtgtttgcctgatagtgattttyttctctttccctctcttcctctgcatttactaactggacttctgtacagaaagctatcccttctccctcatttatttactcagttatttacatcatggac

SEQ ID NO: 44169 - DNA, 201 bp, Homo sapiens
aatatcttgggggaagatgctttgagactatactaatattttgttcctcctgaaactcaaccactgattttagcattcattgttgggtcttgtctgcaacmgttataactaaggtgtttgcctgatagtgatttttttctctttccctctcttcctctgcatttactaactggacttctgtacagaaagctatcccttctc

SEQ ID NO: 44170 - DNA, 201 bp, Homo sapiens
agcaccctggggccctggggggaagactggtggtgttaggaatcatgagtccagctggaggcatctcagccaggaacctcctggcaccctcttattctccrtgatcctcgccttgcttagttactatcagagtgttcacactctctcctattcttttatctttctttcaggactcctacatggtggattatttcaaatcca

SEQ ID NO: 44171 - DNA, 201 bp, Homo sapiens
tacttagaaaattgcaccccgccccaggagctctccgaccagtgccttttgcctcctatgtggttatcaggtacttttaatcattaaagatgagagcactrgagaaggtattcatggaaaatagaacagtgtatccgtactctcagatatgagccctgcttcagataggggagcactgaggtccaagaaaagaagttgtga

SEQ ID NO: 44172 - DNA, 201 bp, Homo sapiens
gcaaaatatcgcaaggacaaaaaaccaaacaccgcatgttctcactcataggtgggaattgaacaatgagaacacatggacacaggaaggggaacgtcacrcaccggggactgttgtggggtgggggcctgggggagggatagcattaggagatatacctaatgctaaatgacgagttaatgggtacaacacatcaacatg

SEQ ID NO: 44173 - DNA, 201 bp, Homo sapiens
tggtgttggcttttgccaaatctcaaattttccagatattctacttcaggatgtatttggccatggtcttactgggagccactcacggattaatatttctycctgtcttactcagttacataggtaagagttctcatcttaaaagggtggcacaatagaaggacattactgaaagggaattctatcctgaggcattctttt

SEQ ID NO: 44174 - DNA, 201 bp, Homo sapiens
accatgcctgcatgcctgactaatttttgtatttttagtagagacggggtttcaccgtgttggccaggctgatctccaactcctgacctcaggtgatctgmccgccttggcctcccagagtgctgggattacaggagtaagccaccgtgcccagccggccactcattctttagaaagtcagagtcaaggccaggctcagtg

SEQ ID NO: 44175 - DNA, 201 bp, Homo sapiens
agctgccaagactgctctattgtctgtggccccaagccccagcccccacctcctcctgctccctggacgatccttggcttggacgccatgtatgtcatcakgtggatcacctacatggcgtttttgcttgtgttttttggagcattttttgcagtgtggtgctacaggtaagcagttttgtttgtcatccagggcaaaaag

SEQ ID NO: 44176 - DNA, 201 bp, Homo sapiens
ccagccaactagctccctttctcctgcagaaataagaaaaagtctctctctctcatagggccatcagtaaataaagccaaaagttgtgccactgaagagcratacaaaggaacagagcgcgaacggcttctaaatttctagccctctcgcagggcatcctgactgaactgtgtctaagggtcggtcggtttaccactggac

SEQ ID NO: 44177 - DNA, 201 bp, Homo sapiens
gactcaccacattacaaggagccagaataagctggaacaaagtcagcacttctgtgtttctttcacatagagaatcatcaaatagacccactagtggggckgtctgccccatgtctgaagtgtagtaagagcaaagtgactctgtccactataggggaggctggactggaatcactcagtccaaagaagaccatccacggg

SEQ ID NO: 44178 - DNA, 201 bp, Homo sapiens
ttctgtagattttccagtccatgggatggagcccatgaacaatgccaccaaaggctgtgacgagtctgtggatgaggtcacagcaccatgtagctgccaasactgctctattgtctgtggccccaagccccagcccccacctcctcctgctccctggacgatccttggcttggacgccatgtatgtcatcatgtggatcac

SEQ ID NO: 44179 - DNA, 201 bp, Homo sapiens
agtgattgttctaccttagcctcctgagtagctaggactacaggcatgcactaccatgtctagctaattttatttatgtttttctttatttttttttttttgagacagactcttgctctgtcaccgaggctggagtacagtggcatgatctcagcttactgcaacctcctcccgggttcaagcgattctcctgcctcagcc

SEQ ID NO: 44180 - DNA, 201 bp, Homo sapiens
agcaaagtgcttgctgcctttcttcatctcgagactgtccttgatccttttacttctatggccacttcaccttgcacaaaaatgacccacggttgaaagarcaatactgatttgcttcatttatagctttgtcactaaattgaagcactgaagtagaagattaagaaaatgaggggctttttatcatctccgggggataga

SEQ ID NO: 44181 - DNA, 201 bp, Homo sapiens
ttgtctcctttttcctttgggtttcctcttctagcaatgtacaatgcctgccgggatgtggaggccccctcaagtaatgacaaggccctgggactcctgtrtgggaaggacgctgacgcctgtaatgccaccaactggattgaatacatgttcaataaggacaatggacaggcaccttttaccatcactcctgtgttttca

SEQ ID NO: 44182 - DNA, 201 bp, Homo sapiens
cgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggcat

SEQ ID NO: 44183 - DNA, 201 bp, Homo sapiens
acctgccttggcttcccaaagtgctgggattataggcgtgagccaccacttccagccaggatgacttttttttttttttttttttttttttggtcttctcwgctgtgtctctagaagatgaccttttgagaagcaaacctgaatgttgattcaagcccaaatttcctgggctcaggtgttaattttttaagtctttggaac

SEQ ID NO: 44184 - DNA, 201 bp, Homo sapiens
ggccatggcaccagggtcggagccacgtacttcatgacctaccacaccgtgctgcagacctctgctgactttattgacgctctgaagaaagcccgacttayagccagtaatgtcaccgaaaccatgggcattaacggcagtgcctaccgagtatttccttacaggtaaagcctgccctttttcaatggggtttacccagca

SEQ ID NO: 44185 - DNA, 201 bp, Homo sapiens
tcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggca

SEQ ID NO: 44186 - DNA, 201 bp, Homo sapiens
ctggtcaggtattttgtagcatgtccttccatttggctttatctggtattttctcatgatgagattgaaataaggtgttttgacaagtacatcacagaagycatgttatgtctttctcggtgcatcatgtcagggatccctgatgttgatgcgtctctttcctggtgatgttaaccttgatcacttgctcaaggtgatgtc

SEQ ID NO: 44187 - DNA, 201 bp, Homo sapiens
tgctcaatactatgagtcatcagggaaatacaaatcaaaaccacaatgagataccacttcacacccaccaggatggctagaatcaaagtcacataacaagmagtgttgacaaggctgtggaaaataggaacctttattaaaaagaaatccaaaaaccaaaaacagctgggcacagtggctcatgcctataatccagcactt

SEQ ID NO: 44188 - DNA, 201 bp, Homo sapiens
accacttacaaccataatttggtacaatcgtttcaaaactacttgaaaaacaactttgcagtacgtagtaagttgaagctaaccctcctcccagaaatttsacttatagatgcctgccttagagaaactctaaatgcatataaacctggagacccatataagaacacccactgtaacactattgtgattgtgaaaaattga

SEQ ID NO: 44189 - DNA, 201 bp, Homo sapiens
ctcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggc

SEQ ID NO: 44190 - DNA, 201 bp, Homo sapiens
gagcgcgcggaagaggcacttgcccacatgggcagctccgtgagtaccctgagcagggccacgccggcagagtcgcaccacaaagtaatcctcctcagtgrctgaagagtctggatcctgtacttacaaagcagcttctaaggattgcaagctttcaggcaattcatgaattagctgccacatcgtggacagaacggacgt

SEQ ID NO: 44191 - DNA, 201 bp, Homo sapiens
tcagcctgggaagtggaggttgcagtgagctgagatcacaccattggactccagcctgagggacagagactccatctccaaaaaaaaaaaaaaaaaaaaaactcttactactcaatgataaataaataacccaatttaaaatggcaaaagatctgaatagagtagacatttctctaaggaagatatacaaatgaccaacaa

SEQ ID NO: 44192 - DNA, 201 bp, Homo sapiens
tgtgtgtgtgtaagtatttttttattttttggaagagacgggcctcactgtgttggtgaggctggtcttgaactcctggccttaagtgatcctcctgcctyggcctgccaaagtgttgggactgtaggtgtgagccaccacacctggcctatagtgcattattatttttatttagtttttaaattatgccatagccagttg

SEQ ID NO: 44193 - DNA, 201 bp, Homo sapiens; identical to SEQ ID NO: 9979

SEQ ID NO: 44194 - DNA, 201 bp, Homo sapiens
cctcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacagg

SEQ ID NO: 44195 - DNA, 201 bp, Homo sapiens
tgagatagcaactaatgctttccctgttccgactttcaggaacggcttggctcttaacctccaccttcccttcctctcccgttcttccaggagaggcgtcytgctgtgaccctgtcagcgcagcatttgagggctgcttgaggcggctgttcacacgctgggggtctttctgcgtccgaaaccctggctgtgtcattttct

SEQ ID NO: 44196 - DNA, 201 bp, Homo sapiens
accgcgaaggtctgcagcttcactcctgagccagcgagatcacgaacccaccagaaggaagaaactccgaaaacatctgaacatcagaagggacagattcyagacgcgccaccttaagagctgtaacgctcaccgccagggtccgcggcttcattcttgaagtcagtgagaccaagaacccaccaattccggacacaatgt

SEQ ID NO: 44197 - DNA, 201 bp, Homo sapiens
aggtcagtaaccctgtctgtcctctctagtacccgaataggcttcgccccctcgtcctggatcgacgattatttcgactgggtgaagccacagtcgtcttrctgtcgagtggacaatatcactgaccagttctgcaatgcttcaggtaccttctcctttaccaaatctttcctgttttgctgaaaaattttcaaattatca

SEQ ID NO: 44198 - DNA, 201 bp, Homo sapiens
ctgcttttatgagctgtaacactcaccgcgaagatctgcagcttcactcctgagcccagcgagaccacgagcccactgggaggaacgaacaactccagacrcgctgccttaagagctgtaacactcaccgcgaaggtctgcagcttcactcctgagccagcgagatcacgaacccaccagaaggaagaaactccgaaaaca

SEQ ID NO: 44199 - DNA, 201 bp, Homo sapiens
ctttgctgagcagataggtagctgagggcaggggtctcatatgtgtccccaggtgggcttgattcctgccatgagatagcaactaatgctttccctgttcygactttcaggaacggcttggctcttaacctccaccttcccttcctctcccgttcttccaggagaggcgtcctgctgtgaccctgtcagcgcagcatttga

SEQ ID NO: 44200 - DNA, 201 bp, Homo sapiens
aggattgtaaatacaccaatcggcactctgtatctagctcaaggtttgtaaacacaccaatcagcaccctgtgtttagctcaaggtttgtgagtgcaccartcgacactctgtatctagctgctctggtggggccttggagaacctgtgtgtggaaactctgtatctaactaatctgatggggacgtggagaacctttgta

SEQ ID NO: 44201 - DNA, 201 bp, Homo sapiens
cttgtgaataaatagtaaatgtgtagccttttaaaataattctataataactttgcaaatacaggatgtgtcttacccttttgtacttcaaaaggattacrtgaatgaatgtgtcttagttcactgaggaatgttgaccttactctaactgttgcctactcccgtgtctgtgctctttcacctgaaaggaactctgtccag

SEQ ID NO: 44202 - DNA, 201 bp, Homo sapiens
aaatacaccaatcggcagtctatctagctcaaggtttgtaaacacaccaatcagcaccctgtgtttagctcaaggtttgtgagtgctccaatcgacactctgtatctagctgctctggtgaggacgtggagaacctttatgtctagctcaaggtttgtaaacacaccaatcagcaccctgtgtttagctcaaggtttgtga

SEQ ID NO: 44203 - DNA, 201 bp, Homo sapiens
tgatggcagtgatcagctgcggccagccaggtttttcttcatctggactgtgcctctcactttcaaatttttggaacatttgctttggcaacaaaactttyaaaaaaccaactctctctggtgcaggtgttctgttggaggatttgagagaagctttaaaattttatcttattactgtcccttgcttaggtcacaagagga

SEQ ID NO: 44204 - DNA, 201 bp, Homo sapiens
actcgttaaaccaaatcaggatgagagtgcctccggggaattgtgtccttgtgcacattaacgcccctcacataggtgtggcgtcaataggaagtggtgartcaggggagagggggttccgtggactagaaaaaactctccttcgacttctatttagttctcagaaggggataggtgatgttgatccaataatggactaag

SEQ ID NO: 44205 - DNA, 201 bp, Homo sapiens
cctgccaaagtgttgggactgtaggtgtgagccaccacacctggcctatagtgcattattatttttatttagtttttaaattatgccatagccagttgttytgaatagtgcagtactacaaaacagagtcaaggtctcatgctgtcacccaggctggaatacagtgatgcaatcatggctcactgcagcctcaacctccta

SEQ ID NO: 44206 - DNA, 201 bp, Homo sapiens
taaatacaccaatcggcagtctatctagctcaaggtttgtaaacacaccaatcagcaccctgtgtttagctcaaggtttgtgagtgctccaatcgacactctgtatctagctgctctggtgaggacgtggagaacctttatgtctagctcaaggtttgtaaacacaccaatcagcaccctgtgtttagctcaaggtttgtg

SEQ ID NO: 44207 - DNA, 201 bp, Homo sapiens
aaacaattttgcatcataattacttagaaaatacccgggagggggtgggggaggaggaccctttgtcatactccatgtaactcaccatcgcataactctgstcggcatccaggtactttttatactcatggttgagtttatcaaaaacagtggctatcacgggcagcgatgctctgtctgactcacttaacactggaaagg

SEQ ID NO: 44208 - DNA, 201 bp, Homo sapiens
acataaggtttctcatcctgttctaactccagcgattgcctctcaggattggtatctggccttagcttctcagaggagggcttttctttatcactttaccytgtggttttgtaggagcgtcgaggttgccctggaattttcttaataaaaacatagaagccccgggctctgaccagtcaaggccatacttgaaggaggaga

SEQ ID NO: 44209 - DNA, 201 bp, Homo sapiens
attgtgtttaccttagggaaggggctactgtcagggaggggtaattggggagcttcaactgaatctatagagtgtgtgtgtgtgtgtaagtatttttttawtttttggaagagacgggcctcactgtgttggtgaggctggtcttgaactcctggccttaagtgatcctcctgcctcggcctgccaaagtgttgggactgt

SEQ ID NO: 44210 - DNA, 201 bp, Homo sapiens
ggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttgggact

SEQ ID NO: 44211 - DNA, 201 bp, Homo sapiens
ggctgtctggcattctgactgagcccctctgggcacagctgcagaacacgaataactagtcttatgaggttactttatgagatgctctcctgattgtgggkctagcaggaggagcaccctggggccctggggggaagactggtggtgttaggaatcatgagtccagctggaggcatctcagccaggaacctcctggcaccc

SEQ ID NO: 44212 - DNA, 201 bp, Homo sapiens
aggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttgggac

SEQ ID NO: 44213 - DNA, 201 bp, Homo sapiens
tgcgggtggggtgaccttaacgggttccagcaatttctcctggtcaacacaaacgtgccacagaaaaccaggcttttggctgtgtgtagagagggccccaraaagttcctggtacagtaagattggtgtgatggaggccttgtaagtccaatgggatgcttggcctcctctagcacccagggtgccctgggtaattagcac

SEQ ID NO: 44214 - DNA, 201 bp, Homo sapiens
tggtgaaatccccctcatcctcggagctctgggtctgtacagtctcttcctcttggctataattttgccttttagtgtttgctccctcctctgtgcctgcrtagcgccatgcaccatgtgccattgatggcactgggctgtatttgcctgcctcttgcccagtgattctgagctcccaaaggtgagtgctgagctgtatta

SEQ ID NO: 44215 - DNA, 201 bp, Homo sapiens
caggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttggga

SEQ ID NO: 44216 - DNA, 201 bp, Homo sapiens
tcaagaccagccggggcaacatggtgaaacaccgtcttaaaaacattttgtttttcttttcattgttgaggttgaggctgctgtgagctgtgatcacgccrgtgtactccagcctgggcaacagagcaagaccctgtgtcaaaacaaaaaagagagagaaataaataatagcaattatgtgccgtagagaaaatgtggcta

SEQ ID NO: 44217 - DNA, 201 bp, Homo sapiens
ttttttagagatgggatcttgctatgttgtccaggctggactcaaactcctgggttatagccatccttctgcctcagcttcctgagtacttgagattaggygtgccaccatacccggcatacaggacttgccaaaccaccatcttgctctcattccctctcactgttctctctccctccctttttcctcccacagttgtaa

SEQ ID NO: 44218 - DNA, 201 bp, Homo sapiens
tcaggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttggg

SEQ ID NO: 44219 - DNA, 201 bp, Homo sapiens
tggtgtgggctgtctggcattctgactgagcccctctgggcacagctgcagaacacgaataactagtcttatgaggttactttatgagatgctctcctgaytgtggggctagcaggaggagcaccctggggccctggggggaagactggtggtgttaggaatcatgagtccagctggaggcatctcagccaggaacctcct

SEQ ID NO: 44220 - DNA, 201 bp, Homo sapiens
tgagctgtgatcacgccagtgtactccagcctgggcaacagagcaagaccctgtgtcaaaacaaaaaagagagagaaataaataatagcaattatgtgccktagagaaaatgtggctattctgtttccctagagttttttaaaatttatttttaaaatttatttattttagagacaggttcttgctctgttgcccaggcgt

SEQ ID NO: 44221 - DNA, 201 bp, Homo sapiens
aaaaatgatgggggacagaggtgcgtgagccttgtgtttcctcaaagcggacgtggttcccaccagtgtggaagcggtacagggagtggcaggctcctggyggcagggacctgaattggtttgtagttatgcttgtgcgcgtcctcataaccccagtctcgccctagcgctgtcccctttcctctccctccagcttttcct

SEQ ID NO: 44222 - DNA, 201 bp, Homo sapiens
agaacatggtgtgcggcggcatgggctgcaacaatgattccctggtgcagcagatatttaacgcggcgcagctggacaactagtcagtaccaccttgtctygtacttcagaagcagcggaggaggctctcagccaggcagtcagctcaggcctgaaatgtctcactgaaaatagactttcttggaaaagttgtttttatgc

SEQ ID NO: 44223 - DNA, 201 bp, Homo sapiens
cagctctccagtcaaattgaactgcttgctagcaaaatcctgcccatcttccagggccccatttcacatgctacattatctacgacattcttgtcctgttsccctaactagaatgccttccctctgaagttctgaatctttatttaaactgctgcaacagcatttgctgcctcattaaaagaccttggtgtgggtcttgac

SEQ ID NO: 44224 - DNA, 201 bp, Homo sapiens
  misc_feature (1)...(201): n = A,T,C or G, or insertion/deletion polymorphism (see Tables 1-2)
actctaatcacatgaagtctcctcgttttcagcaacttccttgttttgagcattctcagtccagaagaggcggaaagctgcggcccaccttcttttccacnaaggctgacaggacatgggtgtacacatctgactggtccagcaccgcctgggtccgcaccggcctcttgaggagcgggctgcttcggctctgccctgctt

SEQ ID NO: 44225 - DNA, 201 bp, Homo sapiens
ctgtcccccaggctgaagtgtagtggtttgattgtggctcactgaagtgttgaccctgggctcaagctatccttccacctcagcctcccacgtagctgggrctgcaggtgcatgccaccatgcccaactaatttttaaattttttgtagacacaaggtcttgctgtgttgcccaaggtggtcttgaattcctgggctggag

SEQ ID NO: 44226 - DNA, 201 bp, Homo sapiens
agtgttcacactctctcctattcttttatctttctttcaggactcctacatggtggattatttcaaatccatcagtcagtacctgcatgcgggtccgcctrtgtactttgtcctggaggaagggcacgactacacttcttccaaggggcagaacatggtgtgcggcggcatgggctgcaacaatgattccctggtgcagca

SEQ ID NO: 44227 - DNA, 201 bp, Homo sapiens
tgtggaactgtacctgttggtacggctcctttttaggtggcagtgtgctgaagcaggaaaataacagacaagttaaacatgagacagctggcagtctttcycatttaaaatgcaggggagcccgggccagaacccagcgtgtgatgtgcggttggtgcctggagagtcgtcttggttcaactctacaccctggcttagcct

SEQ ID NO: 44228 - DNA, 201 bp, Homo sapiens
ggtggaccagtgttcccgtggcttgtgttgggaggctatgatggtaagtaagagaagctttgacttttccttttagataaagtcatctcggttttgtcatyagcatcaagtggtaattatgaagatttcataaattgggcagttttgttaatttcttacctcttgaatcccagaatagtatctcctttggctttgggtttg

SEQ ID NO: 44229 - DNA, 201 bp, Homo sapiens
taaatacccatttcctttgatccaacaatataaaagtatttccaacagttctatttgcgcatgattgcaaagatttacatccaagaatgggccaggagtgstggctcacgcctgtaatcccagcactttaggaggctgaggcaggcagattgcttgagcccagcagttcaagaccaatctgggcaacatggtgaaaccccg

SEQ ID NO: 44230 - DNA, 201 bp, Homo sapiens
cttctttcaggttcttgacttacaaatagccatcgaaaacattactgcctcttatgacaatgagactgtgacacttcaagacatctgcttggcccctcttycaccgtataacacgaactgcaccattttgagtgtgttaaattacttccagaacagccattccgtgctggaccacaagaaaggggacgacttctttgtgta

SEQ ID NO: 44231 - DNA, 201 bp, Homo sapiens
ctcaacacaattcctttctgtagattttccagtccatgggatggagcccatgaacaatgccaccaaaggctgtgacgagtctgtggatgaggtcacagcaycatgtagctgccaagactgctctattgtctgtggccccaagccccagcccccacctcctcctgctccctggacgatccttggcttggacgccatgtatgt

SEQ ID NO: 44232 - DNA, 201 bp, Homo sapiens
ctgctcctgctcctccgctcctcctgcgcggggtgctgaaacagcccggggaagtagagccgcctccggggagcccaaccagccgaacgccgccggcgtcmgcagccttgcgcggccacagcatgaccgctcgcggcctggcccttggcctcctcctgctgctactgtgtccagcgcaggtgagcggtcgccggccaccgg

SEQ ID NO: 44233 - DNA, 201 bp, Homo sapiens
cttgtctcctttttcctttgggtttcctcttctagcaatgtacaatgcctgccgggatgtggaggccccctcaagtaatgacaaggccctgggactcctgkgtgggaaggacgctgacgcctgtaatgccaccaactggattgaatacatgttcaataaggacaatggacaggcaccttttaccatcactcctgtgttttc

SEQ ID NO: 44234 - DNA, 201 bp, Homo sapiens
ggatcacctacatggcgtttttgcttgtgttttttggagcattttttgcagtgtggtgctacaggtaagcagttttgtttgtcatccagggcaaaaagagsaaaattgcccactggcactttgagctttcatttgtcagagcttggttacttaggacaagaaacaaatacctccatgaataccattgcatggattattgtg

SEQ ID NO: 44235 - DNA, 201 bp, Homo sapiens
ctggactctcttgacacccaggattctttcctcaggggacatgctgcctatagttctgcagttaacatcctccttggccatggcaccagggtcggagccaygtacttcatgacctaccacaccgtgctgcagacctctgctgactttattgacgctctgaagaaagcccgacttatagccagtaatgtcaccgaaaccatg

SEQ ID NO: 44236 - DNA, 201 bp, Homo sapiens
gatacagagaagctccagagggcccaggcctgggaaaaagagtgagtcactcatgggtgtgagcagactgtccttgcattgtgggaagctagacacttgcrgcaagcacttaaacttcattttctaaattaaccaatggcagatctgagttacgtagttttgttcacttggtactaatgatgctaagaagaaactgtaaac

SEQ ID NO: 44237 - DNA, 201 bp, Homo sapiens
cgggctttcaccatgttggccaggctagtctcgaactcttgacctcaggtgatctgccagcctcagcctcccaaagtgctggaattacaggcataagccaytgagcccagccctaaacttactttaattcagcatgtatggaaccttagctgtaatctgatagtctccagtgtggaagaccctaatgcagtggctgggcat

SEQ ID NO: 44238 - DNA, 201 bp, Homo sapiens
tttaccttagggaaggggctactgtcagggaggggtaattggggagcttcaactgaatctatagagtgtgtgtgtgtgtgtaagtatttttttattttttkgaagagacgggcctcactgtgttggtgaggctggtcttgaactcctggccttaagtgatcctcctgcctcggcctgccaaagtgttgggactgtaggtgt

SEQ ID NO: 44239 - DNA, 201 bp, Homo sapiens
agtatgcctaagatgaaaatggtatttcagattcattaaactgtgaaagtgacatgtggctgaagcttttagataaggggaaagattatccctcactagtraggaaagtaatcgatagagaagaaagtaatgcccctcactgtcagtattttaaaatgttttacaaaaaatctggagacctattcttctaacagtcctccc

SEQ ID NO: 44240 - DNA, 201 bp, Homo sapiens
tgaggctggtcttgaactcctggccttaagtgatcctcctgcctcggcctgccaaagtgttgggactgtaggtgtgagccaccacacctggcctatagtgsattattatttttatttagtttttaaattatgccatagccagttgttctgaatagtgcagtactacaaaacagagtcaaggtctcatgctgtcacccaggc

SEQ ID NO: 44241 - DNA, 201 bp, Homo sapiens
accacgaccatgccattattattacattattattagctaaaccagagatcttaatcagatttcaccagctttttctctaatgcccttccctgtttcaaggycccatattacatttttgtgttttatgagtcccctctaatctgtgacagaaagttcctcagtctttccttttctggccttaacactcttgatgatactggt

SEQ ID NO: 44242 - DNA, 201 bp, Homo sapiens
ccaaaggtttggagtcgctgaggacgtggtactgcaggaactgatgcagcatataaaagaggttgtgctggacaagggttttgataacaagttcatgtagrtaatgctgaggacaaaagtaaaaagtgaaagaacacttccaaatcattcagctacaacagactagaggctccccaaggactggctattctaaccaacaca

SEQ ID NO: 44243 - DNA, 201 bp, Homo sapiens
tagcattcattgttgggtcttgtctgcaacagttataactaaggtgtttgcctgatagtgatttttttctctttccctctcttcctctgcatttactaacyggacttctgtacagaaagctatcccttctccctcatttatttactcagttatttacatcatggacttttaattctgtgggttgtatccaacactgtcatt

SEQ ID NO: 44244 - DNA, 201 bp, Homo sapiens
cagggcagggttgaacctcacccttcagaggctcctgtgtcggcatctcctctgtggggtgggaatagcgctcattgagggcagccaacaaaggtggcttygctgagcagataggtagctgagggcaggggtctcatatgtgtccccaggtgggcttgattcctgccatgagatagcaactaatgctttccctgttccgac

SEQ ID NO: 44245 - DNA, 201 bp, Homo sapiens
ttgatgaacacataacatgtgctatcgtgccagctagagattagtgctatgaggagaaaaataaggctggacagagtggggggtgcattgcttaagcgtgragatgtgcacaaagggagaggaaaggacagctgggcacatcacagggatgagagttcccggcagaaccagcagcaagtgcagagccctggcaggaagctc

SEQ ID NO: 44246 - DNA, 201 bp, Homo sapiens
tggccctattatgtgtgagatcatgcagaatataatttacttttcctttagatgtccatcctgtttttataacctactgaacctgttttgtgagctgacaygtagccctcgacagagtcagtttttgaatgttacagctactgaagattatgttgatcctgttacaaaccagacgaaaacaaatgtgaaagagttacaata

SEQ ID NO: 44247 - DNA, 201 bp, Homo sapiens
cttcttttccacgaaggctgacaggacatgggtgtacacatctgactggtccagcaccgcctgggtccgcaccggcctcttgaggagcgggctgcttcggytctgccctgcttccaccgcctgaaagaaaaaaaccacaaactatgatcttcggcatcttagaggaagggtgctgtttacagttcatccacaaggactgaa

SEQ ID NO: 44248 - DNA, 201 bp, Homo sapiens
ggtttctaggtgatggcagtgatcagctgcggccagccaggtttttcttcatctggactgtgcctctcactttcaaatttttggaacatttgctttggcarcaaaacttttaaaaaaccaactctctctggtgcaggtgttctgttggaggatttgagagaagctttaaaattttatcttattactgtcccttgcttaggt

SEQ ID NO: 44249 - DNA, 201 bp, Homo sapiens
actaaagacttcctccctgtggagcaggtcagtaaccctgtctgtcctctctagtacccgaataggcttcgccccctcgtcctggatcgacgattatttcractgggtgaagccacagtcgtcttgctgtcgagtggacaatatcactgaccagttctgcaatgcttcaggtaccttctcctttaccaaatctttcctgtt

SEQ ID NO: 44250 - DNA, 201 bp, Homo sapiens
ggggcttcaccatgttgcctagcctggtctcaaactcctaggctcaagcaatccaccctcctcagccttcctaagtactgggagtacaggcatgagccacrgtacctgtcctcacttgctgctttcatcataattattaaaggtttcaactttccctggaattactaatagaaatagtaagtagcactctggttgaattga

SEQ ID NO: 44251 - DNA, 201 bp, Homo sapiens
ttggccatggtcttactgggagccactcacggattaatatttctccctgtcttactcagttacataggtaagagttctcatcttaaaagggtggcacaatrgaaggacattactgaaagggaattctatcctgaggcattcttttcaagtatttgaactcatactaatggtcatttgataatgataaatgatactgagtaa

SEQ ID NO: 44252 - DNA, 201 bp, Homo sapiens
agatcctctgtaattattccttaaatgttattgcagggtggaggtggagatgagactaacaggcttaagtcttatcccggactctcaaactctaacctgtrgcatacagtgcagagaaagaacaccgtaactccaaaggcttaatttttcaggggctgactttatacctctcataaagtttcccaatagcaggttgctatt

SEQ ID NO: 44253 - DNA, 201 bp, Homo sapiens
aaaacacaaaaattagccaggcatggtggcgtgcacctgtttaatcccagctactcaggaggctggggcaggagaatcacttgaacctgggagaaatcctygtaaggaagtgtttttgttcaattacaggttggtaaaagtggtttctaacacagtatctcttcttttaggtgttcagtggaatcacacttacaaaatttg

SEQ ID NO: 44254 - DNA, 201 bp, Homo sapiens
tgggctagtctgcctgtaatttgttattctttagagattgcacaagcctgtagcctgatgacagcaggatgttcactttttacttagaaaattgcaccccrccccaggagctctccgaccagtgccttttgcctcctatgtggttatcaggtacttttaatcattaaagatgagagcactcgagaaggtattcatggaaaa

SEQ ID NO: 44255 - DNA, 201 bp, Homo sapiens
tcccgggccgagccagactccataagtcccgcgcctggcccccggggattgcaggggctgaggagaagggcaacacggggaccttgaagcggggtcgcggsggcgccccagcccgggccagggagtcccggcagcggcacctcccagaaagggcggagccgacgacgccttcttccttcctgaccggcgcgcgcagcctgc

SEQ ID NO: 44256 - DNA, 201 bp, Homo sapiens
ctgacaggacatgggtgtacacatctgactggtccagcaccgcctgggtccgcaccggcctcttgaggagcgggctgcttcggctctgccctgcttccacygcctgaaagaaaaaaaccacaaactatgatcttcggcatcttagaggaagggtgctgtttacagttcatccacaaggactgaattcttcgatgtggaccc

SEQ ID NO: 44257 - DNA, 201 bp, Homo sapiens; identical to SEQ ID NO: 9949

SEQ ID NO: 44258 - DNA, 201 bp, Homo sapiens
gaatgctagggacctggcctagggacatttgttcagccagttgagcaaccacagtggctatttcttcagcatgggaacagagaaattattcctttttgccyttaaggacactgctcagccgactacttctcaagagctaaggactctcacttctggttctaaagaactttgaccttgagttctgtttgtttgttactggag

SEQ ID NO: 44259 - DNA, 201 bp, Homo sapiens
aggttttctgcaagggatgtttcccaaaggagtctgaccacttggcagtggtgacaggatgaacacgcagtgttcgggagtgagagcgagctttaatgagrcctcccctctcccctccagtgtgttttatgtcttctacgaacagtacctgaccatcattgacgacactatcttcaacctcggtgtgtccctgggcgcgat

SEQ ID NO: 44260 - DNA, 201 bp, Homo sapiens
ttattttgcatttgtctgtccattactcttcccagactggccccctccttcaggagcccccttggtgggcaccccatgctctaggacaggacatcttttcyttgaattattattattttttttttagagatgggatcttgctatgttgtccaggctggactcaaactcctgggttatagccatccttctgcctcagcttcc

SEQ ID NO: 44261 - DNA, 201 bp, Homo sapiens
aaccctccactcctaaaagggatgcagtattctaagcatggcagattacctacagcggaagcctggatcagtcatctctgatctcgggtgcccctttctgscctttgacctccagctctgtgaagggcatcagctctccagtcaaattgaactgcttgctagcaaaatcctgcccatcttccagggccccatttcacatgc

SEQ ID NO: 44262 - DNA, 201 bp, Homo sapiens
tttgacctccagctctgtgaagggcatcagctctccagtcaaattgaactgcttgctagcaaaatcctgcccatcttccagggccccatttcacatgctamattatctacgacattcttgtcctgttcccctaactagaatgccttccctctgaagttctgaatctttatttaaactgctgcaacagcatttgctgcctca

SEQ ID NO: 44263 - DNA, 201 bp, Homo sapiens
ggagatgactgtcaccctagttaacctgtctttccagaacaagggtaaaacaaaatgaatgtgtaagcatctccttgaagattagggaaagaagatcctgsgaagtttctagcaagcagagactggtaaatgagaatcgacagtacaggacccattccagctattttcttaggtgtaatacactgatactatccttatgta

SEQ ID NO: 44264 - DNA, 201 bp, Homo sapiens
aagatacaaaattttaaaatgtaatgtgcagaatagtattttactgtttgtgtggttaagagggaaaggggaagaatctgtgtgtttgcttgtgtgtgtgyggagtggctctggaaagattcgcagatggtcacagtatggggaggagaactaagacaatgaaacagatgttggagaaggagagaattttcgataaacact

SEQ ID NO: 44265 - DNA, 201 bp, Homo sapiens
gattcattttgcccaaaggtgccactaaaaaggcaaaaggtcaacacgtgtcccgctgctgtagaaggtggtctcagtcgtcctgtagacccgacgtgggyggagactcagtgcacgtgagagtgatgttcactggtccagtcccctgccgcctgtgttccgagtgttttcctgataatgtggctggctcagctttccctt

SEQ ID NO: 44266 - DNA, 201 bp, Homo sapiens
atagggtcttgcttttttgcccaggctggcctcaaactcctggcctcaggagatcttcccacagtgctgggattacaggtgtgagtcactgcacctggccragtccattatttttttaatgttgaggcaaatgttgtgaaatggtatgactgatagttaactgggtaatgaggaaatgagaattgtattattctccatgtg

SEQ ID NO: 44267 - DNA, 201 bp, Homo sapiens
tgaaaggaactctgtccaggattcttctttggcaatgtcagtctctgttgtgatgttcggcagcttcagacactaaaagacaacctgcagctgcctctacrgtttctgtccaggtaggttctgctggggaaacagaacaactgggctgtagatacttgtgaactggtaatgctcagctttccatttattctttgtttacat

SEQ ID NO: 44268 - DNA, 201 bp, Homo sapiens
caggcttctggtaagccggggggggggtggtgtatgttctagaggttaacagcagtgcacagtgtaacgtcatatttttgcctctttattcttattccatyatgtttaaaactgccataaattcccccatgttttaattgtatgtaacgtttctgttgcctacatctattttcttcattccaactttttggtttatcttaa

SEQ ID NO: 44269 - DNA, 201 bp, Homo sapiens
tgtgggaaggacgctgacgcctgtaatgccaccaactggattgaatacatgttcaataaggacaatggacaggcaccttttaccatcactcctgtgttttmaggtaggtataaagattccaagtttggtgtgtttatgatattgttttaaagccaaggaactggctgggcacagtggctcaccagtgcttggggagactga

SEQ ID NO: 44270 - DNA, 201 bp, Homo sapiens
tgcaccattttgagtgtgttaaattacttccagaacagccattccgtgctggaccacaagaaaggggacgacttctttgtgtatgccgattaccacacgcrctttctgtactgcgtacggtaagtggcaagagacaatcattggtagacaccattcttgggtctgacttagggtacatgggcaaaagcttgttttatgagc

SEQ ID NO: 44271 - DNA, 201 bp, Homo sapiens
cggctatactagtatacctgatggtgcctctgaccatggaaatgtgatttcctggcctagttctgggctagtctgcctgtaatttgttattctttagagaytgcacaagcctgtagcctgatgacagcaggatgttcactttttacttagaaaattgcaccccgccccaggagctctccgaccagtgccttttgcctccta

SEQ ID NO: 44272 - DNA, 201 bp, Homo sapiens
gttaaattacttccagaacagccattccgtgctggaccacaagaaaggggacgacttctttgtgtatgccgattaccacacgcactttctgtactgcgtayggtaagtggcaagagacaatcattggtagacaccattcttgggtctgacttagggtacatgggcaaaagcttgttttatgagcataacccagaggtgagc

SEQ ID NO: 44273 - DNA, 201 bp, Homo sapiens
atcacgccactgcactccagcctgggctacagagcaagactctgtctcaaaataaaaaaaaaaagaagccagtctgggagagaacaagctaaacctttggygttcccttatctgggggccttcttcatccctgaaatgtacagctgggtctgacctctgagtccagggtcaggtgattttgcttagcctcaagtgctcaga

SEQ ID NO: 44274 - DNA, 201 bp, Homo sapiens
tgctccttgggtgtcttcagctacattgggttgcccttgaccctcattgtgattgaagtcatcccgttcctggtgctggctgttggagtggacaacatctycattctggtgcaggcctaccaggtatacttccatattctcacagggctcagcatctgttcaagtttcagggactgtgaatggctcctgggctccgcattc

SEQ ID NO: 44275 - DNA, 201 bp, Homo sapiens
cggggttacatgaccagtaagtggcagggctgaggttgttcccagggcccttgccctttcctgcttcctattacacaacaggactgagtaaaccctgtacmtttgattatacatgaaaccaggtggagaaacagcagctatgtaccaaagaacccagagcaatcgagaaaagcccatctggccaggcgaagtggctcacac

SEQ ID NO: 44276 - DNA, 201 bp, Homo sapiens
ccctcttattctccatgatcctcgccttgcttagttactatcagagtgttcacactctctcctattcttttatctttctttcaggactcctacatggtggwttatttcaaatccatcagtcagtacctgcatgcgggtccgcctgtgtactttgtcctggaggaagggcacgactacacttcttccaaggggcagaacatg

SEQ ID NO: 44277 - DNA, 201 bp, Homo sapiens
gtagccaccgttcctggggagcctccagggtgccagcgtcatgccaggcactccctgacattattccatttctcatcacgcagcctatgagtaggtggtgktatacccatttacagaagaggagactggggctcagaggtggtcattttgctcggggttacatgaccagtaagtggcagggctgaggttgttcccagggcc

SEQ ID NO: 44278 - DNA, 201 bp, Homo sapiens
gaagggcacgactacacttcttccaaggggcagaacatggtgtgcggcggcatgggctgcaacaatgattccctggtgcagcagatatttaacgcggcgcmgctggacaactagtcagtaccaccttgtcttgtacttcagaagcagcggaggaggctctcagccaggcagtcagctcaggcctgaaatgtctcactgaaa

SEQ ID NO: 44279 - DNA, 201 bp, Homo sapiens
ccctgggcatgagaatgaacgcagattcctgtgcacattccaagcggggctgagggagaggacggcctgctggtaatccaggcctgaaggaacttggcctrttcacttgtactgatggcagctggggcgtgatcttagctttagtaacattatcccacattaaggttgcgattcttttagcctcgtcatgctccttgccag

SEQ ID NO: 44280 - DNA, 201 bp, Homo sapiens
cccccatccagccaggcagccagttacccacggaagccagatatatggcccaaaaatagtgatgatgaccggaagtctctggccttgatttggaagctttkggaggtggaagatgagtatccccatgtatgttaggtaaaccctgaacttaggtttttcataagaacatacatctgaccagagtcatatcagtgaatcatt

SEQ ID NO: 44281 - DNA, 201 bp, Homo sapiens
ttcgactgggtgaagccacagtcgtcttgctgtcgagtggacaatatcactgaccagttctgcaatgcttcaggtaccttctcctttaccaaatctttccygttttgctgaaaaattttcaaattatcatttaaaaatcatttgcatcgtgcctcagtttatacctatttgtatatcaaagctgggtctccctgtgtcatc

SEQ ID NO: 44282 - DNA, 201 bp, Homo sapiens
tggcttgctccttgggtgtcttcagctacattgggttgcccttgaccctcattgtgattgaagtcatcccgttcctggtgctggctgttggagtggacaayatcttcattctggtgcaggcctaccaggtatacttccatattctcacagggctcagcatctgttcaagtttcagggactgtgaatggctcctgggctccg

SEQ ID NO: 44283 - DNA, 201 bp, Homo sapiens
gagtgcagtggcatgatctcagctcgctgcagcctctgccttccaggttcaagtgattctcgtgcctcagcctcccaagtagctgggattacaggcacctkccaccacgcctggctaatttttgtatttttagtagagacgggctttcaccatgttggccaggctagtctcgaactcttgacctcaggtgatctgccagcc

SEQ ID NO: 44284 - DNA, 201 bp, Homo sapiens
catattatatgattggatttatgtgaactgtctgaaatagtcagataaatagagacagttcagtggttgcttagggcttagggaagtagggaggtagttgwgcatagctagaatacaggatttcttttgaggtgatgaaaatgttataaaattgactatggtgatagttgcatatatctatgaatatgctaaactccatta

SEQ ID NO: 44285 - DNA, 201 bp, Homo sapiens
ttgggtttgggtttcattccagatttaaaagaagtggattgggttagccatttttaggtcacacatgcctttgagaagctgtcgaaggctaagtacctttycccagaataatgcaattgcaaacctctgcattgttgttcagcttgaaggtcatgggcctccgaagttcatttatagaccctctagggagctcatggacct

SEQ ID NO: 44286 - DNA, 201 bp, Homo sapiens
cccagcactttgggaggcccagacgagaggctcacttgaggccgggagttcaagaccagcctaggcaatgtttgcatgtctctaaaaaaaagaaaaaagaraatttaaaaagaaaaaaaagcgtacaattcagtagctttactatattcacgtgtatgtgcagccatcaccacagtcaattttaggaacattttcattact

SEQ ID NO: 44287 - DNA, 201 bp, Homo sapiens
atagcgccaccacacctggctaatttttttttatttttttattttttgtagagacggggttttgccatattgcccaggctggtctggacctcctgagctcwggcagtccacccaccagggcctcccaaattactgggattaaaggtgtgcataaccacccctggcccaaagacaaatatcttaaaagcaaatagagacaag

SEQ ID NO: 44288 - DNA, 201 bp, Homo sapiens
tggagcaggtcagtaaccctgtctgtcctctctagtacccgaataggcttcgccccctcgtcctggatcgacgattatttcgactgggtgaagccacagtygtcttgctgtcgagtggacaatatcactgaccagttctgcaatgcttcaggtaccttctcctttaccaaatctttcctgttttgctgaaaaattttcaaa

SEQ ID NO: 44289 - DNA, 201 bp, Homo sapiens
gatcttgctatgttgtccaggctggactcaaactcctgggttatagccatccttctgcctcagcttcctgagtacttgagattaggcgtgccaccataccyggcatacaggacttgccaaaccaccatcttgctctcattccctctcactgttctctctccctccctttttcctcccacagttgtaattgtgtgagacacc

SEQ ID NO: 44290 - DNA, 201 bp, Homo sapiens
ttgttcaattacaggttggtaaaagtggtttctaacacagtatctcttcttttaggtgttcagtggaatcacacttacaaaatttggagggattgtggtgktggcttttgccaaatctcaaattttccagatattctacttcaggatgtatttggccatggtcttactgggagccactcacggattaatatttctccctgt

SEQ ID NO: 44291 - DNA, 201 bp, Homo sapiens
tcacttgaacctgggagaaatccttgtaaggaagtgtttttgttcaattacaggttggtaaaagtggtttctaacacagtatctcttcttttaggtgttcrgtggaatcacacttacaaaatttggagggattgtggtgttggcttttgccaaatctcaaattttccagatattctacttcaggatgtatttggccatggt

SEQ ID NO: 44292 - DNA, 201 bp, Homo sapiens
aatttggagggattgtggtgttggcttttgccaaatctcaaattttccagatattctacttcaggatgtatttggccatggtcttactgggagccactcayggattaatatttctccctgtcttactcagttacataggtaagagttctcatcttaaaagggtggcacaatagaaggacattactgaaagggaattctatc

SEQ ID NO: 44293 - DNA, 201 bp, Homo sapiens
tcaacaggaagagagccatcctaaaggaagtgctttatttcagagctgtggcatctccgtggagttctgcagccacataaccagagcgttcacggtgagcrtgaaaggcagccgcgtggagcgcgcggaagaggcacttgcccacatgggcagctccgtgagtaccctgagcagggccacgccggcagagtcgcaccacaa

SEQ ID NO: 44294 - DNA, 201 bp, Homo sapiens
gtcttcaaggggaaaccctggatcagcagctgggcagggtcctaggagaagtggctcccagtatgttcctgtcatccttttctgagactgtagcatttttyttaggtaattatgctttcaatcctaccagtcctgtagtctgctgagcctggagaaagaaggagctggctacctgaacatgtccctttgtgttgcttcctt

SEQ ID NO: 44295 - DNA, 201 bp, Homo sapiens
tgggaagtttctagcaagcagagactggtaaatgagaatcgacagtacaggacccattccagctattttcttaggtgtaatacactgatactatccttatrtaatgtgttgtgtgtatgtgtaagaaaataaaatccaaaaagataacagtattaggggttttttttgttttttttttttgtttttttgtgatggagtctt

SEQ ID NO: 44296 - DNA, 201 bp, Homo sapiens
cctcggcctcccaaagtgctgggattacaggcgtgagcttccatgcccagctggaagcttacatcttaatggagggagacggttgatgaacacataacatrtgctatcgtgccagctagagattagtgctatgaggagaaaaataaggctggacagagtggggggtgcattgcttaagcgtggagatgtgcacaaagggag

SEQ ID NO: 44297 - DNA, 201 bp, Homo sapiens
aacgtagaaaaggaagttaggttttaagaaaaagtactgaaactaaagacttcctccctgtggagcaggtcagtaaccctgtctgtcctctctagtacccraataggcttcgccccctcgtcctggatcgacgattatttcgactgggtgaagccacagtcgtcttgctgtcgagtggacaatatcactgaccagttctgc

SEQ ID NO: 44298 - DNA, 201 bp, Homo sapiens
cactgtcagtattttaaaatgttttacaaaaaatctggagacctattcttctaacagtcctccctgcatgtctccgccagtggttgaccctgcctgcgttygctgcaggcctctgactccggaaggcaaacagaggcctcaggggggagacttcatgagattcctgcccatgttcctttcggataaccctaaccccaagtg

SEQ ID NO: 44299 - DNA, 201 bp, Homo sapiens
ccacttggcagtggtgacaggatgaacacgcagtgttcgggagtgagagcgagctttaatgaggcctcccctctcccctccagtgtgttttatgtcttctrcgaacagtacctgaccatcattgacgacactatcttcaacctcggtgtgtccctgggcgcgatatttctggtgaccatggtcctcctgggctgtgagctc

SEQ ID NO: 44300 - DNA, 201 bp, Homo sapiens
tctgcagtcatcatgtgtgccaccatcgccatggtcttggtcaacatgtttggagttatgtggctctggggcatcagtctgaacgctgtatccttggtcarcctggtgatggtgagtcctcatacagtctcagtttgtccctagctcctgtttcacttgggggaattggctgtcttagattccatgtaaaccctaaagatg

SEQ ID NO: 44301 - DNA, 201 bp, Homo sapiens
gctgtaaatgtaatgagtgtcggaaaacatttactgggagctcaaaccatattgtccaccagaggatccacactggggagaagccctctgcctgtaacgaytctggcaaagcctttatgcagattgcaaatcttattgtacatcagcgaagccatactggtgagaagccatatgagtgtgagtttgggaaaacctttagtt

SEQ ID NO: 44302 - DNA, 201 bp, Homo sapiens
cttattatgtaccagataattcacactgcagagaaaccttatgactgcagtgaatgtgggcaagccttcagtcagctctcttgcctttttgtccaccagaraattcacagtggagatcttccttttgtgtgtaatgaatgtgggaaggccttcacatgtagctcatacctacttattcatcagagaatccataatggagaa

SEQ ID NO: 44303 - DNA, 201 bp, Homo sapiens; identical to SEQ ID NO: 9990

SEQ ID NO: 44304 - DNA, 201 bp, Homo sapiens
ccactaccactccctttatttcatatttccagaaagatgactatttgtcccatttgaaaattttccaggaaaacatttgattttcccattgtcatctgcaygcaaattttagtacaaaaaaatagttctcagatttaacccaaaatccatgtctatgtttatactgctgctaatcaattcaggacttaaatatctaattat

SEQ ID NO: 44305 - DNA, 201 bp, Homo sapiens
tgtcggaaaacatttactgggagctcaaaccatattgtccaccagaggatccacactggggagaagccctctgcctgtaacgattctggcaaagcctttaygcagattgcaaatcttattgtacatcagcgaagccatactggtgagaagccatatgagtgtgagtttgggaaaacctttagttgtttttcacaccttatt

SEQ ID NO: 44306 - DNA, 201 bp, Homo sapiens
agaaaactctgcttattaaattatatttcattcaccaggactccttatttatctcagtaatatttaatggaaaagtaaataaaacactattacatagatgyttagagagatgacagtaatcttattctaaattaaataaagaaaggttaagtaaatattacaatcttttagtatgaaccttaaaataataaatctacctcc

SEQ ID NO: 44307 - DNA, 201 bp, Homo sapiens; identical to SEQ ID NO: 9987

SEQ ID NO: 44308 - DNA, 201 bp, Homo sapiens
catgtatgtgtttctgatggcatgaccccactgccaattctccaaaatttcaaaagtaaaataaacaaacttacaactttctgcttcagataaagcaaaargacactttcatttagaacacaaagagagaaaactaatttttgagtcagaaagtaagctcccattcaccatgggagcttcgcattgagagcagttcatgta

SEQ ID NO: 44309 - DNA, 201 bp, Homo sapiens; identical to SEQ ID NO: 9988

SEQ ID NO: 44310 - DNA, 201 bp, Homo sapiens
atgtaattttattttcaatgcaagtattaaaagatatggccaacaaggcataaaaacattttccctgaagtcgtatcattgactaaatcatggagcttgtstattcagcttctctctcaatatacatttatagcaggacatgattagttttcacctaagaaaactctgcttattaaattatatttcattcaccaggactcc

SEQ ID NO: 44311 - DNA, 201 bp, Homo sapiens
tgggcgctgagctaggttctccagcaatttgaatcttgacaagaggtggactatgagacctcttggaagcaagtgcaggtcctgttcaggaggcgctgagktggagcagattagagaggaggttgggttcacttccttccaggtgtgcgtggttgggaccctcaggcaggcagcctgataataagcactcactgaactcct

SEQ ID NO: 44312 - DNA, 201 bp, Homo sapiens
ctcctactccacaccacactgtgctaggcaccacaggggacagagggaatacaaaggaaatagaagctaaagaactgagtataactggggagacaagacaygtgcataaagagctgagaactactgcaaggcagagagtctgcaaataacaaccccaagggggcacagagcaaacagaagggctcactctggtatgcgcaa

SEQ ID NO: 44313 - DNA, 201 bp, Homo sapiens
ccccccctaaaaaggtctgaaggataaagatctgaaggatctgggatctgaacgataaagaagaagccatgtaaatatctgggggaaaatcactgccggargaaggcacagcaagtgcaaagaccctatgacaggaacttgcttggcaattgcaaagaggctggcatagctgtgagaggggagtggtaaggggtgaggcag

SEQ ID NO: 44314 - DNA, 201 bp, Homo sapiens
ctccctccttcccagtactggggaccccattctgcctgccccgcacgcgaaggtccgcctcggaaaccacacgggccggggctgggcacccaaaggccacyctgataccatttaggtacacaggggctgtgagggtgcccagtcacaaaaaacaaatgggcacactcgagttcctgtgccctcagagcttcctgaaagcag

SEQ ID NO: 44315 - DNA, 201 bp, Homo sapiens
ggatacttgacctgcccctctctctgcttaaaaacatgccaggaggccaggagaggtgcgtgtatgtgtgtgtgtgtgtgtgtgtgtgtgtgtgtgtgtgygcgcgcgcgcgcgcgctcgcacgcaagttccaaagagtggcccctgttaatgtggcagtggctcaggggtcttaggctccctgctcagggccccagccct

SEQ ID NO: 44316 - DNA, 201 bp, Homo sapiens
atacttgacctgcccctctctctgcttaaaaacatgccaggaggccaggagaggtgcgtgtatgtgtgtgtgtgtgtgtgtgtgtgtgtgtgtgtgtgcgygcgcgcgcgcgcgctcgcacgcaagttccaaagagtggcccctgttaatgtggcagtggctcaggggtcttaggctccctgctcagggccccagccctcc

SEQ ID NO: 44317 - DNA, 201 bp, Homo sapiens
actgcaacctccacctcctgggttcaagtgattctcctgcctcagcctccccagcagctaggattaggattacagtcatgcaccaccacgcccagctaactttttttttttttttttgtatttttagtagagactagtagttcaccatattagccagcctgatctcaaactcctgacttcaagtgatctacctgcctcagc

SEQ ID NO: 44318 - DNA, 201 bp, Homo sapiens
aaccttttgtgagtattttttgttttgttttttgagacagggtctcgctttgtcacccaggctggagtgcagtggcgtgatctctgcttactgcagcctcracctcctgggctcaagtgatcctccctccccagccttccaagtagctgggactacaggcacgtgccaccacactcggctaatttttgtatttttgtagag

SEQ ID NO: 44319 - DNA, 201 bp, Homo sapiens; identical to SEQ ID NO: 9999

SEQ ID NO: 44320 - DNA, 201 bp, Homo sapiens; identical to SEQ ID NO: 10001

SEQ ID NO: 44321 - DNA, 201 bp, Homo sapiens
cagcctgatggtggggtccttcccttggacagtgggtttgaagtgccctgagcctgggctgtgggtaactcacctacacctgagagggaaatcttgagtasacaagccaggccctggccctcctgttcattcagcagagctcagggcatggcaaggggcaggaagctcacatctccctgtggctgcagcctgcttcagttc

SEQ ID NO: 44322 - DNA, 201 bp, Homo sapiens
acccactcccctgagttttatgcccctctcccagctctccacccccagtctcctctcttactgcaagaagagctgtccaaatctgccatgcctaaggggghagcatggaagatgtgtctaaggtgccaggcatggtggcgtgtgcctgtagtcccagctactccggaggctaaggccagaggatcacttgagcccccagga

SEQ ID NO: 44323 - DNA, 201 bp, Homo sapiens
attacaggtacttaccaccataccttgcttattaattttttttttaatagagacatggtctcgctatgttgtccagactagtctcgaactcctggggtcaraggatcttttagcctcagcctcctgagtagctgggactacaggtgcataccactgtgtccggctgcacggtgaggaattactgagtaggtactgcccact

SEQ ID NO: 44324 - DNA, 201 bp, Homo sapiens
agagtattgcaacagctgtgcaaaccttcctgacgaagaccaggtcagcactcctttggttatgaagccgctgcccccaacacctgtggaatttgtcttcrgggttctccttcctgttttgtaattataattatctcgagaggccgaggtgggtggatcacttgaggtcaggagttcaaaaccagcctgaccaacatggtg

SEQ ID NO: 44325 - DNA, 201 bp, Homo sapiens
gaactgagtataactggggagacaagacacgtgcataaagagctgagaactactgcaaggcagagagtctgcaaataacaaccccaagggggcacagagcmaacagaagggctcactctggtatgcgcaataaaagagtgaccagaaaaggggggcaatttgtgctgtgtgtgggagatgggatggaggtgggagggtggt

SEQ ID NO: 44326 - DNA, 201 bp, Homo sapiens
tctcgcacagccactgttcaccttcaaggtaggagggctggcagggaggaagggtggatgaggccaggggcattcccagcgagctgtccagcagttagaaycgttctgtgttccagctccccttgtggtcctgctgggatctagggagcaaggggttaattggcatagctcccattcctagtgggagcacctgagaccctg

SEQ ID NO: 44327 - DNA, 201 bp, Homo sapiens
ttagagaggaggttgggttcacttccttccaggtgtgcgtggttgggaccctcaggcaggcagcctgataataagcactcactgaactcctactccacacyacactgtgctaggcaccacaggggacagagggaatacaaaggaaatagaagctaaagaactgagtataactggggagacaagacacgtgcataaagagct

SEQ ID NO: 44328 - DNA, 201 bp, Homo sapiens
ctcttgctttggctactggcaagggtgccttctccactggccccagagtctgctgactgtgttcccatggagggtcacttgggaggaaggttggcagggarcagagagccaaggagactctcccttacttggattggttcctaggagagtttggttcagtgcgggaggcccagctgaagcaagaggatggctcctttgtga

SEQ ID NO: 44329 - DNA, 201 bp, Homo sapiens
caggtgagcagcctcagaagggggctgggagtggagaaggagctgggtcctggagggcactgaagctggcagtttcagccactgagcttgcggttgtgagygtccagagcaagccccagtgtctggggacgtgagctgcaccattactaagctcattagtcaggtgtgctaggctggctgggtgggctgattagtggtgat

SEQ ID NO: 44330 - DNA, 201 bp, Homo sapiens
tcgcacagccactgttcaccttcaaggtaggagggctggcagggaggaagggtggatgaggccaggggcattcccagcgagctgtccagcagttagaatcrttctgtgttccagctccccttgtggtcctgctgggatctagggagcaaggggttaattggcatagctcccattcctagtgggagcacctgagaccctgcg

SEQ ID NO: 44331 - DNA, 201 bp, Homo sapiens
tctgcattcttttaccaaattattaatttgactgatatgtctgaacatcagtgagccccaggcacacaaatctgcctgtgtggagttcaccaccccagccrtgggagacctaagctcatctctatgctctgagggcagagtctggggtataagaggctgggttttggctcaggaatcagagatccctctttcccacaaacc

SEQ ID NO: 44332 - DNA, 201 bp, Homo sapiens
gtgtgcctgtagtcccagctactccggaggctaaggccagaggatcacttgagcccccaggagttccaggccagcctgggcaacatagagagacctccccrcgaccaatctcaaaaaaaaaaaaaaaaaaaaaaaaattcctaaggagcctgaaaaagagaagcaccgcctacctctcaagctagatgcctgttctgctgt

SEQ ID NO: 44333 - DNA, 201 bp, Homo sapiens
gttggggatgccctggaccctcagagagactcaaggcttgactcccatgcctcctgctgcctctgctcatatccctactgggcactgattctgagtccccrtccacagcactgcctgcagcccccttcaacatcaccgtgacaaagctttccagcagcaacgctagtgtggcctggatgccaggtgctgatggccgagctc

SEQ ID NO: 44334 - DNA, 201 bp, Homo sapiens
attctgagtccccgtccacagcactgcctgcagcccccttcaacatcaccgtgacaaagctttccagcagcaacgctagtgtggcctggatgccaggtgcygatggccgagctctgctacagtcctgtacagttcaggtaggctctccgggccgggccatgctcgttctggctgcatggccagcactttgttgacagggat

SEQ ID NO: 44335 - DNA, 201 bp, Homo sapiens
agggaaatgggcgctgagctaggttctccagcaatttgaatcttgacaagaggtggactatgagacctcttggaagcaagtgcaggtcctgttcaggaggygctgaggtggagcagattagagaggaggttgggttcacttccttccaggtgtgcgtggttgggaccctcaggcaggcagcctgataataagcactcactg

SEQ ID NO: 44336 - DNA, 201 bp, Homo sapiens
agctcagagctgttcagcccaggaaaacaaagtgactaagaaagtaacaaagggccctgaatgggagctggggcctggcagcagaactctgctaaagctcycacccactcccctgagttttatgcccctctcccagctctccacccccagtctcctctcttactgcaagaagagctgtccaaatctgccatgcctaagggg

SEQ ID NO: 44337 - DNA, 201 bp, Homo sapiens
gggacagtatctgctatgcatgggggtagcttgggagcaaagatgcaaagatgtcctggctcttgtgggcctgtgagcatggcagaaggctgactctctcyctcaatgccccttgtaggctggcagaggacatgacagtgtgtgtggctgacttcggactctcccggaagatctacagtggggactactatcgtcaaggct

SEQ ID NO: 44338 - DNA, 201 bp, Homo sapiens
gatgagggggaattcctggaacctggaccccagccttggtgggggagcctctggaatgcatggggcgggtcctagctgttagggacatttccaagctgttrgttgctgtttaaaatagaaataaaattgaagactaaagacctaaggttttgtctctttttttttttctttttttttgagacagtctcactgtgttgccca

SEQ ID NO: 44339 - DNA, 201 bp, Homo sapiens
cctgccatcttcccacccgtcattccttttctttttttaatttgtatttattttattttatttgttctaccctagtgaatacaacctttgtcctggagacmccagctagtctaagaaaacttcctaggctgagctctcttgggaatctaagataaagaactgagatcctgggaagaagggaactgcctcctcttctttctg

SEQ ID NO: 44340 - DNA, 201 bp, Homo sapiens
ctcccagcatgctcttgctttggctactggcaagggtgccttctccactggccccagagtctgctgactgtgttcccatggagggtcacttgggaggaagrttggcagggagcagagagccaaggagactctcccttacttggattggttcctaggagagtttggttcagtgcgggaggcccagctgaagcaagaggatgg

SEQ ID NO: 44341 - DNA, 201 bp, Homo sapiens
accctgtgtattattggggtgggggcagatgggagggcgtgggttgcaagtgtttgctgatagaggaagcactcattcaagcacccataactatacccatyccatcttccatctctcacaggctctcccctacatcattagttttctgcttttctgtaggtgacacaggccccaggaggctgggaagtcctggctgttgtg

SEQ ID NO: 44342 - DNA, 201 bp, Homo sapiens
cagcatttgcaaaggtatgaagatgtggaaccctgtgtattattggggtgggggcagatgggagggcgtgggttgcaagtgtttgctgatagaggaagcaytcattcaagcacccataactatacccatcccatcttccatctctcacaggctctcccctacatcattagttttctgcttttctgtaggtgacacaggccc

SEQ ID NO: 44343 - DNA, 201 bp, Homo sapiens
ctctcagagctgtttagttcttgggagttgattccaaaggtctgcatggaattatgatggtgggaagggcaggggtcttagcaatcttctctctttggctrcagccccagccagcgctccccaaaacctccatgccatccgcacagattcaggcctcatcttggagtgggaagaagtgatccccgaggcccctttggaagg

SEQ ID NO: 44344 - DNA, 201 bp, Homo sapiens
agcaatcttctctctttggctgcagccccagccagcgctccccaaaacctccatgccatccgcacagattcaggcctcatcttggagtgggaagaagtgawccccgaggcccctttggaaggccccctgggaccctacaaactgtcctgggttcaagacaatggaacccaggtaagacagaaccctcccctctctccactc

SEQ ID NO: 44345 - DNA, 201 bp, Homo sapiens
tccccatccccatggtcatcttgcccttcatgaagcatggggacctgcatgccttcctgctcgcctcccggattggggagaacccctttgtgagtacctgstgtgggggtggccaggaggaaacgggtgggaacacagggcctggaaaggcatagagaccctggcagagaggggcttgctgggtagggctgatggagctgg

SEQ ID NO: 44346 - DNA, 201 bp, Homo sapiens
gcatgtacgaattctggaggactcgagggtgggagacagcagcaggtgccaagaggagctagctgatggtcggctcctgcctgggacagtatctgctatgyatgggggtagcttgggagcaaagatgcaaagatgtcctggctcttgtgggcctgtgagcatggcagaaggctgactctctctctcaatgccccttgtagg

SEQ ID NO: 44347 - DNA, 201 bp, Homo sapiens
ctgctctctggggtttggttgccccctgatgaggccctgagccccaggttgtgcttgtctcagagccatggctctctgcctggctcaggacacctagtgayagcttctcccccaacctcgattctgtcccagtgggcgttcggggtgaccatgtgggagatcatgacacgtgggcagacgccatatgctggcatcgaaaac

SEQ ID NO: 44348 - DNA, 201 bp, Homo sapiens; identical to SEQ ID NO: 9994

SEQ ID NO: 44349 - DNA, 201 bp, Homo sapiens
cacagggccttcgtggcagggagaggcaacctctctccacagcccaggcactctcccaggtgtgagcagctgtgccctactggttgcttatttgtgtactrctgtgatcctgggagtgctgagtagccgtctttaggttggggatgccctggaccctcagagagactcaaggcttgactcccatgcctcctgctgcctctg

SEQ ID NO: 44350 - DNA, 201 bp, Homo sapiens; identical to SEQ ID NO: 9996

SEQ ID NO: 44351 - DNA, 201 bp, Homo sapiens
tgccacccaatgcccctttccaactgtcttgtgaggctgtgggtccccctgaacctgttaccattgtctggtggagaggaactacgaagatcgggggaccygctccctctccatctgttttaaatgtaacaggtgagcagcctcagaagggggctgggagtggagaaggagctgggtcctggagggcactgaagctggcag

SEQ ID NO: 44352 - DNA, 201 bp, Homo sapiens
gtataagccttcagggttctaaggcctttaagaatttcaaaatgattgtctttggtgggcctgggtctcccgcagccccagggaatcctttcctcctcacsctcctctgcaagctccacttctcaaaggattatgtctcctgttagggttgcatcctgtgtgcactttgtaaataaagcaggaagcacattcctgcttgag

SEQ ID NO: 44353 - DNA, 201 bp, Homo sapiens
gagcagagagccaaggagactctcccttacttggattggttcctaggagagtttggttcagtgcgggaggcccagctgaagcaagaggatggctcctttgkgaaagtggctgtgaagatgctgaaaggtgagtgggggatagctgtagcctgagggcatcacttggaagggtaagaggggcgactgaccctgaagcaggct

SEQ ID NO: 44354 - DNA, 201 bp, Homo sapiens
gagggatttaaggatgttcagaccagagcctgagtattcccctttcccagtcccgcactgagtggggttgctgcttggggagctgactgaggttttctggmcccaggggtgacccagagcaccatgttttcctgtgaagctcacaacctaaaaggcctggcctcttctcgcacagccactgttcaccttcaaggtaggagg

SEQ ID NO: 44355 - DNA, 201 bp, Homo sapiens
gtgatctctgcttactgcagcctcgacctcctgggctcaagtgatcctccctccccagccttccaagtagctgggactacaggcacgtgccaccacactcrgctaatttttgtatttttgtagagacagggctccgccatatttgtcaagctggtcttgcgctcctgggctcaagggatccatctgccttggcctcccaaa

SEQ ID NO: 44356 - DNA, 201 bp, Homo sapiens
gccgcacatcctgggtacctgtggtccttggtgtgctaacggccctggtgacggctgctgccctggccctcatcctgcttcgaaagagacggaaagagacrcggtttgggtaaggggatggggatgtggagggagaggcaggtaatgatgaaagaccttggagctgaccccaaatcctgggttttcctttaggcaagcctt

SEQ ID NO: 44357 - DNA, 201 bp, Homo sapiens
gttggctcctagcacagccttgaggacgtgtcccagtctggccatgtacccacggccccagaccattcccattcccacgacctgttcagtgtctggcatgwttactgccattactggtggcccctgctgggggtgtgctggtgtgtgaggcagtgcttggggctcttgtcatgggcataggcaagagagtcaggcatttgc

SEQ ID NO: 44358 - DNA, 201 bp, Homo sapiens
cttactcctctggaatagagtatagctgcttctggttctgttctaaggacaggaactcctgggacagccactcccgcattaggtcaaaaacatttcctgtkgattttattagtttccttccaaacaatgcatttatggaagaagaagagcttttgcaggcatgcatttgcacaggcagccaacctcctccagtcacacaca

SEQ ID NO: 44359 - DNA, 201 bp, Homo sapiens
ggtgttggcgggcaaggccagaggccgtgcccctccttgggggcgtggtgggggagcctgtggtttccctgtttgttctggagatcccagccgcttccccraggagacagctgacggttcccaggccacagcccctcaggcggggccagaccacggctggccagcctgggagcactgcccgccagccacccgggctccgcc

SEQ ID NO: 44360 - DNA, 201 bp, Homo sapiens
tagaggcgggggcaccctgcttagtccagaaagctcaccctccacagcaaccctcagtgcccctgcctcagtctactcatcttcagagtaggtcactgctyggctggaggcctaatggagagcttggggagagaccctgtccacgtctctgatctccggggaaggagaagcctgtgtggtagccctgctaatgaagcccct

SEQ ID NO: 44361 - DNA, 201 bp, Homo sapiens
gtgggcagagagtccgggcttagactcaggcaggtctcatgcagatgctagctttgctgccggccagccgtgtgacctctgtgcacagctgggtcctgtcygtaaagtgggaataccagtgtggtgaggaggccatgccctcgggcctagaacgagggctcagcacagggcctggcatgtggtaggcccaatgagcgtcag

SEQ ID NO: 44362 - DNA, 201 bp, Homo sapiens
aaatgccactgccaccatatctgtccttttgggtcaagcattgcccagcgcagacccctcttgtaagatgccatcactcctgggaggtggagaggcctccrgtgcataagtggggctgtggatggttcctccgggccatttctcctgctggagtagctgggctgagtggaattagaagggaggctcagactgggcgcagtg

SEQ ID NO: 44363 - DNA, 201 bp, Homo sapiens
catcccttgccaatgaggcagctgcagctggtcagagcagagaggctggagcccacactgggctctttgtcttcggtgggaacccttcagcccccatggcycctctcaagggcccactgtcccagtaccagtggggcctcccgggggccaggcctggctgggaaacttgccacgttggcggccccttggctactctgccaa

SEQ ID NO: 44364 - DNA, 201 bp, Homo sapiens
gggactgctgcatggctatcatatgagcctaggggaagacagaagggcaccgctggactagcctgatcacaagcaacagccgccactgggcagccacggcsgcacccagcactccagctttaccgggcttctaccccaggacttcctgacccccaggcagcctctgccctccaccccactgcaggatccctacttcctcta

SEQ ID NO: 44365 - DNA, 201 bp, Homo sapiens
agtggcttatgcctgtaatcctagtgctttgggaggccaaggtgggaggcttatttgaggccaggagttccagaccagcctgggcaacacagcaagacacscatctcaacaacaacaacaaaaaatttatttttaattagccgagcacacacctgtagtcccagctactaggaggccgagggggaaggatcacttgagccc

SEQ ID NO: 44366 - DNA, 201 bp, Homo sapiens
cctgaggtcagggttgttgtcataaggattgaatgacatcacagtgcccgcatggcaaatagtccccctgccgctcctctaccccatcgccacgctccctytagagtcctaggagaggtcaacggtgcccagggaaaggggacacaggagcctcccgtgcctgtgcctgtctgcttaggctcccagtgggctggggaagag

SEQ ID NO: 44367 - DNA, 201 bp, Homo sapiens
actaaagaccttctttgtcattgctgtatagtattccatggtttgatatatttaactaatctccttgtaatggacattgaagtggcgtccagatgtttgcrgttgcaaaccctgcttcatgacttttttgttcatatatctttatgcattggtgttatatttctggagaataaatgcctagaaatggggttgctggaccaa

SEQ ID NO: 44368 - DNA, 201 bp, Homo sapiens
cactgaagcctcaacctctcaggctcaatcagtcttcccacctcagcctcctgagtagctgggactacaggcatgcaccaccatacccggctaatttttgkggttttttttttttttttttttggtagagatggggttttgctatgttgcccaggatggtcttgaactcctggctccaagagatccgcctgccttggcctc

SEQ ID NO: 44369 - DNA, 201 bp, Homo sapiens
aagcgagagaatcgcttgaaccctggaggcagaggttgcagtgagccaagatcgtgccattgcactccagcctgggtgacagagcgagactgtctcaatawatatatatagctgagttggaacccactctgtccagccctcttgagcctgtgcccttcctcactggctcacactgccctgctctgtatccaggctgtgtag

SEQ ID NO: 44370 - DNA, 201 bp, Homo sapiens
ctggccttgtttccaaaagccccatgctcagcctcacccactcccctggcccccacctcccactgcaggagcatttcaattactactcactggacgctgcyctcggccaccttgtcttctcactcaagtacgatgtcatcggggaccaagagcacctgcggctgctgctcaggtgagggtggtgggggagtcctgagatgg

SEQ ID NO: 44371 - DNA, 201 bp, Homo sapiens
ccaccaccttcatgggggtcccacgtggggctgctgggagcagcagcaggagattcctgagactgactcctgttttctctgtctgggcaacagcccaagaytggggcatgtggatccggggcttggcaggaagggagagactcaatggcagccctcacttgacagctgggttcatgaatgaagctcccagtccctcttccc

SEQ ID NO: 44372 - DNA, 201 bp, Homo sapiens
aacaccgtgtccaccagccacagcgggagcttcgcgcccaacaaccccgacctggccaaggcggctggaatagtgagtgccctccccctccccaggcccckgcccctccctggggggccctcagctctcctctgcctcctgaggcctgactccaactctctctgttgccctgctgcccacatgcccatcctaggctctgga

SEQ ID NO: 44373 - DNA, 201 bp, Homo sapiens
ggtcccaaagtctcattgtatgccagggcagctgggctcccctaactgcaaccggggcctggcttttccattcatcttgaaaacaccttttttttttttttcacaaggtcacaggataaactacacgattgttttacactttccatagtagactggcctctcctcatttctgttctctttctgacagttccagtctctttc

SEQ ID NO: 44374 - DNA, 201 bp, Homo sapiens
agtggtgaggtctgggatattagtgtaccctcatcacctaaagagtgtacgttgttccaaacaggccatttttcaactaaaatagttttaagacaagtttytttgctacattattttggggaaagcaaatccttagatgtgccctctgactaccccaaaccctcctaaacccccgtgggcacccctctcccccatgggccc

SEQ ID NO: 44375 - DNA, 201 bp, Homo sapiens
agaatcgcttgaacctgggaggtggagattgcagtgagctgagatggtgccactgtactccagcctgggcgacagagcaagactccatctcaaaaaaaaaagaagaggcttcatgtccaggatcagattagcagtaatgagggagaagccccagggctggcagaatggcagggccccttcctgactccaggtggggtaatg

SEQ ID NO: 44376 - DNA, 201 bp, Homo sapiens
catgtgtcatcctgttagaaacggtttagctccgagcctataatcacatctacccggggaggaactaacacagcgtttctttaaattgggctctaattgcrgcttttagtggagtcacatgcaccccatcccccagccggtctgaattagggcggctgtcccagcctgccctgccaagtacaggaatcccccaggattgct

SEQ ID NO: 44377 - DNA, 201 bp, Homo sapiens
gtgacagatgaaggtaggaacagatgaaggtagtggacctcgagtgcagcaggctctgaagaagtgcagactggagggtcagaagaggcagctgggcgccstggcttatacctgtaatcccagcactttgggaggccgaggtgggcagatcacttgaggtcagaagttcaagaccagcctgagcaacatggcagaacccca

SEQ ID NO: 44378 - DNA, 201 bp, Homo sapiens
ggggtcctcccctacccacccccagctggggtgttcttggacctccatggccaaccctggggcaactttgccaaggagatgaccgcaggcccgggccggcygtgccaggggactgggagctggacgttctctgctgctcaggccacagggggtgctcagccagggaccctggaatgtggaggtccctcccttcttccctgc

SEQ ID NO: 44379 - DNA, 201 bp, Homo sapiens
aacatatacgtggtgcagtgggactttaaatattggtgtgcaggcttctgtgtgtgtgagcaggaggggagggagaaagatggagagagagagagagagagtgtgcgtgcttcctggtgtacaactccatagcacatgtgtcagcaggagccgcctgagctgagccttggaggggcagggggagggtcaccatcctggagg

SEQ ID NO: 44380 - DNA, 201 bp, Homo sapiens
gggtttgaggagcggaaaggagtctggagaaggaggaaagaagccctggatgaggccagagacagtgggcgggtgggaggggggccggggatggggagcasacacgcagggcctcgtgggccacgtgaggcgggcgtctggatcctgcttgcggcgggaagccattggggccttctaggcaggtgggtggtgtgatcagat

SEQ ID NO: 44381 - DNA, 201 bp, Homo sapiens
aaacatatacgtggtgcagtgggactttaaatattggtgtgcaggcttctgtgtgtgtgagcaggaggggagggagaaagatggagagagagagagagagagtgtgcgtgcttcctggtgtacaactccatagcacatgtgtcagcaggagccgcctgagctgagccttggaggggcagggggagggtcaccatcctggag

SEQ ID NO: 44382 - DNA, 201 bp, Homo sapiens
ggagcggaaaggagtctggagaaggaggaaagaagccctggatgaggccagagacagtgggcgggtgggaggggggccggggatggggagcagacacgcasggcctcgtgggccacgtgaggcgggcgtctggatcctgcttgcggcgggaagccattggggccttctaggcaggtgggtggtgtgatcagatccaaacat

SEQ ID NO: 44383 - DNA, 201 bp, Homo sapiens
gaaacatatacgtggtgcagtgggactttaaatattggtgtgcaggcttctgtgtgtgtgagcaggaggggagggagaaagatggagagagagagagagagagtgtgcgtgcttcctggtgtacaactccatagcacatgtgtcagcaggagccgcctgagctgagccttggaggggcagggggagggtcaccatcctgga

SEQ ID NO: 44384 - DNA, 201 bp, Homo sapiens
aggggggccggggatggggagcagacacgcagggcctcgtgggccacgtgaggcgggcgtctggatcctgcttgcggcgggaagccattggggccttctakgcaggtgggtggtgtgatcagatccaaacatgcgacacaagcgctttccctcccacacccattcacgctcctgccggggcctcccatctccattctcacc

SEQ ID NO: 44385 - DNA, 201 bp, Homo sapiens
cgaaacatatacgtggtgcagtgggactttaaatattggtgtgcaggcttctgtgtgtgtgagcaggaggggagggagaaagatggagagagagagagagagagtgtgcgtgcttcctggtgtacaactccatagcacatgtgtcagcaggagccgcctgagctgagccttggaggggcagggggagggtcaccatcctgg

SEQ ID NO: 44386 - DNA, 201 bp, Homo sapiens
acccctgccctcccacctgtgctgagtgaccctgggctgtgtgcctgtcccctctgtgcctggtgtcatctcatctggaagatgggtataataatcatagygataagataattcaggtaaaggcacgtagagcagtgcccggtgcagagtgaacgtgcacccgatgatgttagtgtcgctaaccgctgctgtttttgaaca

SEQ ID NO: 44387 - DNA, 201 bp, Homo sapiens
ggaaggaaggaagttcctcccttctcaggcaaacttcagtgctctcaggacccacccctcaggagcctgccctggtgtgattcctccccccaggactctayagcactgcccagagcagaaggggcccagtccaggctccagagcaccttgcaaggggaagccacaccctcctctgaggactgaaaaccaagggacatagtt

SEQ ID NO: 44388 - DNA, 201 bp, Homo sapiens
ggagcccacaagactgctccagggctggccctgagtataggggcgtgggtatgaggcaggaggcaccgtgactcccctcaccgcctgggcctcacgctacscctgatgccaggcctggtgctgaatccccccgctgcccccgtgtgccccgcagggagagccctccggctggtcagaagaccccagacagcgggcacgtct

SEQ ID NO: 44389 - DNA, 201 bp, Homo sapiens
gagcctaggagtttaaggctgcagtgagctttgatcacgccactgcacaccagcctgggcagcaagagcaagatcctgtctcaaaaaacaaaaaaaaaaaagggaaaaagaaaaaagtatttattgagcaactactatttactaagtgtcagtggtatagtgttaagggcactgcaaccagatgttgggggaggtcaaatc

SEQ ID NO: 44390 - DNA, 201 bp, Homo sapiens
ggaggaaggaaggaaggaaggaaggaaggaaggaaggaaggaaggaagttcctcccttctcaggcaaacttcagtgctctcaggacccacccctcaggagyctgccctggtgtgattcctccccccaggactctacagcactgcccagagcagaaggggcccagtccaggctccagagcaccttgcaaggggaagccacac

SEQ ID NO: 44391 - DNA, 201 bp, Homo sapiens
attgtccttgccattcatctacaggctcacatgctatgatgcagaagataaattcttggaagtggtcttgcaggttaacaggatgcatttaaattcagccrtcaccaaaggaccaggagctggtcagggactgtcctgctgcaaccctggccaagggaacgtgaccccccactaaccacccccactcccacccccaccccc

SEQ ID NO: 44392 - DNA, 201 bp, Homo sapiens
tcttggttcactgcaacctctgcctcctgggttcaagcgattctcctgcctcagcctcttgagtagctgggattacaagcatgcgctaccatgtccggctrattttgtatttttaatagagatggggtttcaccatgttggtcaggctggtctgaaactcctgacctcaagtgatccacctgacttggcctcccaaagtgc

SEQ ID NO: 44393 - DNA, 201 bp, Homo sapiens
gggagtgaagagggtgaccccaggccccagcagagcatggttcaggagctgcagcctctgcctcgttggggttccgacccttgtttatgtgtcatctcaayttcccttccttatctcctccacactgggagtttacaggggcctgagttccaggaatttttgctgacaaagctgatcaatgctgaatatgcctgctacaag

SEQ ID NO: 44394 - DNA, 201 bp, Homo sapiens
gatcagacccaaacagacccaggcatgacctgaagaaaccccatttctagcaggagagactgacagtggcttaatggtcacaccatgaaatgtgcaaacgmaacaggtaaatccatgaaggcccaagacaggcttctgggaaagctggtcaggttcggagcagcttctcctggtctggggagggggctctggaagactgaa

SEQ ID NO: 44395 - DNA, 201 bp, Homo sapiens
cattcattcatgcagcagatcagacccaaacagacccaggcatgacctgaagaaaccccatttctagcaggagagactgacagtggcttaatggtcacacyatgaaatgtgcaaacgcaacaggtaaatccatgaaggcccaagacaggcttctgggaaagctggtcaggttcggagcagcttctcctggtctggggaggg

SEQ ID NO: 44396 - DNA, 201 bp, Homo sapiens
cttcacgcatgttatcctccagtgcaggagacagacagctaaggtagcttcagatgggtaatgtgtagtacggatggggtgggtgcaaggcctggctttgycaagggtatcagggaggggcctctctgaggcctgaatgggaaggagctggctgtgggaagagtagtccaggcagagggtagagaaaatgtaaaggattgg

SEQ ID NO: 44397 - DNA, 201 bp, Homo sapiens
gccaaggcctgaaaccagggcctggcacagagcacgtactccgtcgatgccagctattgcggttactgccatcatcgcggtcatggttacctgctgcgccygcagtgggtgcggaattgcgcttggtgtgtagactctgtcctctggaagcttgctgcctgccagggggtgacctgactgcctacacgtgactgtacaccc

SEQ ID NO: 44398 - DNA, 201 bp, Homo sapiens
ggcagaaccagcacttccctcaggcactagacctgtcacgagtgaacttagttccctcctatactccttcactctaccctaaggtaagtgtccccctccayacctacggcccctggtctgccccctacctccgacacatgcccagggctgggaaaggcccaagaatgacttttgggcaaaggtaaaatgttcaggcagatg

SEQ ID NO: 44399 - DNA, 201 bp, Homo sapiens
atgtggaggagaaaagtgtgtggtggcacatgctggattcaagactgagttgggcctgacaggtgaagggaagagagacagccaccagatcatgtccctgyaggccctgctgggacttctgtgggctacgctggaaggctctgaaccccccagccaccatgggaagaggcctgctagggtgccagtcgcccatcctcctcc

SEQ ID NO: 44400 - DNA, 201 bp, Homo sapiens
aaggagaggtgcttggtcgctttttgtttttttggagacagggtctcactctgtcgcccaggctgtagtgtagttgtgcagtctcggctcactgcaacctycacctcctgggttcaagtgaatctcttgcctcagcctcctgagtagttgggaccacaggtgcatgccatcactcctgggtaattatttttgtatttttag

SEQ ID NO: 44401 - DNA, 201 bp, Homo sapiens
gctcccatttcatgtgtcagaggaggcagcgtgcaggtgtccaggccagacagagcagagccggagctgggcctagggaaggcgcttggcggtggctgcasgagccagggccgtgatgggaggtcatggggcaggaggccaggtgacgggactgagggcctgggctgaggacagtgggatgcacgctgtggaagggacact

SEQ ID NO: 44402 - DNA, 201 bp, Homo sapiens
gtggccggctggtgcagcggggctggctggggtgggtcacagttcagccccattcgaggtgggcctgggagggagcagaacccatgggccagggctgggtracagtcctagagccctgagtgaatgtgctcccaccacacacactcccagtccccagggaacatgcatggcagaatcacttgttcattcaacattgattgc

SEQ ID NO: 44403 - DNA, 201 bp, Homo sapiens
tttcatgtgtcagaggaggcagcgtgcaggtgtccaggccagacagagcagagccggagctgggcctagggaaggcgcttggcggtggctgcaggagccasggccgtgatgggaggtcatggggcaggaggccaggtgacgggactgagggcctgggctgaggacagtgggatgcacgctgtggaagggacactggactgg

SEQ ID NO: 44404 - DNA, 201 bp, Homo sapiens
gcatggttcaggagctgcagcctctgcctcgttggggttccgacccttgtttatgtgtcatctcaacttcccttccttatctcctccacactgggagtttmcaggggcctgagttccaggaatttttgctgacaaagctgatcaatgctgaatatgcctgctacaaggcagagaagtttgccaaactggaggtgaggatgg

SEQ ID NO: 44405 - DNA, 201 bp, Homo sapiens
gggcccccagccagctagcaccctgccctgggagtacccctaccttcgcgggccgcctcctagggctttccccttgcacgccttggggaggggaggcagcrcctggcggcaggcctgggagggtgtaacagtgctgccttctcttacagggaagcaggatggatgaacaacgctgctccttcccgccgcccctcaaagtag

SEQ ID NO: 44406 - DNA, 201 bp, Homo sapiens
tgtgtgccagatactttcccaaggttctctcatttaatcctcacaataaccctgtgaagtccacaatttgcagaagaggagccaccgaaagggcctgtgcsttcccccagggtgcacagcagataggagggcctgcgtttaagcctcggtttgtctgccttagaggctggcctcacatctggaacctctgtgatgtttggg

SEQ ID NO: 44407 - DNA, 201 bp, Homo sapiens
ttagccttggccattcccagcatggctcctccccagaccttgaccagggaggcccaggcagccccatcctctcctccctggccccacacctcacacccctsccttatctcctcctgcagttggtgtgtgaagacgtcaatgtggatcggttctatcctgtgctctaccccaaggtatggctggatctgggcacagctcact

SEQ ID NO: 44408 - DNA, 201 bp, Homo sapiens
gctttctggccttgtttccaaaagccccatgctcagcctcacccactcccctggcccccacctcccactgcaggagcatttcaattactactcactggacrctgccctcggccaccttgtcttctcactcaagtacgatgtcatcggggaccaagagcacctgcggctgctgctcaggtgagggtggtgggggagtcctga

SEQ ID NO: 44409 - DNA, 201 bp, Homo sapiens
tcactgaactgagccaagcacttcatccctttcagtcctggctgccaccaaagtacagggttccctcctatttggcagactaggaaagtgaggcacagagmggccaagtgacctcctcaggctgcccagctggtcagtggcagagtggggctttgagtgcaggtctgtctgatgtggggtctgctatcagccgtgacacct

SEQ ID NO: 44410 - DNA, 201 bp, Homo sapiens
tggaggatggacagatggagagacccttgccctgtttgtgttttgcagacagaggaggactacattccatacccgagcgtgcacgaggtactcagctagamccccgcgcccacccttactcaagcccaggaggcacttacacagggcttctggataccaggtcctcctccttaggagcctgacctgcaggccttgctgcgg

SEQ ID NO: 44411 - DNA, 201 bp, Homo sapiens
gagcttcccgggctggctccgcagatgggcacctgtggggcttcagcttgccttggcgcgtccccttcagctgtaggccctagccctggcctgccgccctrtcctgaggctgtctctcacttgttcccatcgtgtcttgggctgccacgtgttctcctaggcccccgtcccctgcctgtgtgcttttggttttctctatag

SEQ ID NO: 44412 - DNA, 201 bp, Homo sapiens
ggaaacctgcctggccagccaccctgtgtgttgtgagatgtttcgcttcctgtttctcatgggccctggcttcaggggccacagagtcacaggttgggcartcagcttttgctcattgagcacctgctgggtgcccagccctgagaaggaccagggctgaagacaggcatgcaggtccgaatatggtccagactcgatgag

SEQ ID NO: 44413 - DNA, 201 bp, Homo sapiens
tcacacacacgcacacatggctgcacgcatatgtgcacacaccttccatgccacctggcacacagccatctccagtgctgtgagcaggtctcgcctccccsgggggcagtgtgggaatggatgtttctctggctggatttcgatgggtgcccggaagcattcaggcctggaagtggctgcataaatcaatatttgctgttg

SEQ ID NO: 44414 - DNA, 201 bp, Homo sapiens
ggcagctagggcgggggaagggacggagcaggccagccactgtgaggcatgggaagcaggatggaggagaggaggaggaaaagggacagaccccaaagagyagcaccaggcctttctctggattccactttgacttcttcctgactgtgtggtctcgggcaagctatttcacctcttggaaccggcttctcatctgtataa

SEQ ID NO: 44415 - DNA, 201 bp, Homo sapiens
aggaaaagggacagaccccaaagagtagcaccaggcctttctctggattccactttgacttcttcctgactgtgtggtctcgggcaagctatttcacctcytggaaccggcttctcatctgtataatggagatgacatttgtacctcctgggctgtgacgagattacgacacatgcgaagggcccagcattaagtaggtgc

SEQ ID NO: 44416 - DNA, 201 bp, Homo sapiens
aggcagaagttggaatgagctgagatctcaccactgcactccaccctgggcgacaaagtgagaccctgcccccaaccaccaccaaaaaaaaaaaaaaaaargaaaaaaaagaatttcaaatgtgggaggcaccttgaggtcctccagtcaaaccccccaccgctcctcccgttcccacaccttcagatctccctggctgca

SEQ ID NO: 44417 - DNA, 201 bp, Homo sapiens
ggcggaggcagactataagtaaatagacaaggaaacaacctctgatgggtacactgaatttctttctttctttcttttctcttttttttttttttttttttgagacagggtctcactctgttacccaggctggggtgcagtggcgcgatctcggttcactgcaacctccacctccgtggttcaagcaattctctgcctcag

SEQ ID NO: 44418 - DNA, 201 bp, Homo sapiens
tggcggaggcagactataagtaaatagacaaggaaacaacctctgatgggtacactgaatttctttctttctttcttttctcttttttttttttttttttttgagacagggtctcactctgttacccaggctggggtgcagtggcgcgatctcggttcactgcaacctccacctccgtggttcaagcaattctctgcctca

SEQ ID NO: 44419 - DNA, 201 bp, Homo sapiens
aactgtaaaattgggaatggcggaggcagactataagtaaatagacaaggaaacaacctctgatgggtacactgaatttctttctttctttcttttctctyttttttttttttttttttgagacagggtctcactctgttacccaggctggggtgcagtggcgcgatctcggttcactgcaacctccacctccgtggttca

SEQ ID NO: 44420 - DNA, 201 bp, Homo sapiens
ttttttttttttttaataggatcttgctctgttactcaggctgaagtacagtggtgcaatgttggcccactgaagcctcaacctctcaggctcaatcagtyttcccacctcagcctcctgagtagctgggactacaggcatgcaccaccatacccggctaatttttgtggttttttttttttttttttttggtagagatgg

SEQ ID NO: 44421 - DNA, 201 bp, Homo sapiens
gggtgggaggcacacagggtgcctcagctaagctcccagcctgcctttctatttccctttgatgctctccatgcaacctcaggctgcttcctctccctttstgggcatcatctcctgctgctgtgcctagtccatttgagcccctccttctgcaagatggtgtgctatgctcagagcaggggtagactgaggggggataaa

SEQ ID NO: 44422 - DNA, 201 bp, Homo sapiens
ctgggaagccaggcctggggtgggaggcacacagggtgcctcagctaagctcccagcctgcctttctatttccctttgatgctctccatgcaacctcaggstgcttcctctccctttctgggcatcatctcctgctgctgtgcctagtccatttgagcccctccttctgcaagatggtgtgctatgctcagagcaggggta

SEQ ID NO: 44423 - DNA, 201 bp, Homo sapiens
tggggctctgctttgggactggggaggcctggttcaccccactctgatcccagcacccagcaccattgtccactccagagcagacctcaggacatgtgttytgaatgaatgactgagcagaggaatgaagggcagatgggggagtgggtagatgaccgagtgggtgagtgagcgaaggaatgcctggagctcagagaaggg

SEQ ID NO: 44424 - DNA, 201 bp, Homo sapiens
ctctaggctgccaacctgttatttgttcaggaggcctctgcctggcccagctccgggatccgggtgtctcggcatgcagccagcatggggcgagggtggcrgccccatgtgccaccttcctgcccatccctctgcccagcttggggcctgagtctcccacccacacccccagggggaccctgccagctctgtcacttggta

SEQ ID NO: 44425 - DNA, 201 bp, Homo sapiens
gggcttccctggcatcagcatcacgtgggcctggctggctgctcctgctgctgcttcacctccagcaggagagccccccgacggctctggctgctgcttcstgcccctgctcagggctgtctggggtccgtgggtcctgcagtaccccccagctgctgggcgactcccatctggcaccatcgtccccgcagagccctcctg

SEQ ID NO: 44426 - DNA, 201 bp, Homo sapiens
cgccgccgccgggagccgggagcgcggagctcagcgctgcggggcccggacccgggcgcgcgcgggccaggagccggctgggccagctgaagtgccgcccsggcgggggccgggccgggccgcgctcaggatggcacagctgcggcccgcggtgccacccggccgtccgcggaggggctcgctgcccgcgggggccagctg

SEQ ID NO: 44427 - DNA, 201 bp, Homo sapiens
tgcctccgggcttccctggcatcagcatcacgtgggcctggctggctgctcctgctgctgcttcacctccagcaggagagccccccgacggctctggctgstgcttcctgcccctgctcagggctgtctggggtccgtgggtcctgcagtaccccccagctgctgggcgactcccatctggcaccatcgtccccgcagagc

SEQ ID NO: 44428 - DNA, 201 bp, Homo sapiens
cttccatatggggtcttgctagctgtcaggtgatgagaggagcctgggctaggccctgagcttcctggccagccaacacgggcagctcacaggctgggtcstgttctatgaccttgggcaagtcctggcttctctgacctcactgtctgcagagtcggccttccccatcagctgtccctgggagcccccagccctgccctg

SEQ ID NO: 44429 - DNA, 201 bp, Homo sapiens
gctgctactacttaggaaggagggagggaggaagggagggaggaaggttgttgctgctactacttaggaaggagggagggagggaggaaggaaggaaggarggaaggaaggaaggaaggaaggaaggaagttcctcccttctcaggcaaacttcagtgctctcaggacccacccctcaggagcctgccctggtgtgattcc

SEQ ID NO: 44430 - DNA, 201 bp, Homo sapiens
gtgttttctttcttgatccccacacccccattccctctttagaatgcctcctctgctgctacagagcatgcattcgtgaatgttcctggggtaggggaaaragcatggcaggtgtggacttgagtctgacaggtgtggacttgaatctgcctctgccacattctagttgtgtgactttggcaagtcattttccctctctgg

SEQ ID NO: 44431 - DNA, 201 bp, Homo sapiens
aacttcagcaattccttaatgtctctgaacctcaattttctcatctgtgaaatggggattaaaatgcctattcatagggtgtaaggtaaaaagaacaaaamcaaaaactggccctggcatattttaggccctttttgcttaaatgcttccttccttttttttcttctctatttcttcccacctcagggtggcccctcgctg

SEQ ID NO: 44432 - DNA, 201 bp, Homo sapiens
gtttgcagcatgggggctgatgttcatgtgagcctgtctgcatgcatttgatcttgatgtgatctctacaggcatgagttagatgactctttgcatgtgcrtggcacggtactaggccaagtgcatgtgtgacctgggaaagtttgtgtgcagttgtgcacacaggtctaccagagaccttgtctgtcttgttcagactct

SEQ ID NO: 44433 - DNA, 201 bp, Homo sapiens
ggtggaggtggctgatggagggtgaccttgggaacttcttcctgcctgcaagctcggtgccagaactgccagggcagccctgattcttcttgctcaaaagytggcagcgtcagggaccctcgagaggctgccaggacaaggcctgagctgatgtcaccatcaccagcctcttgcgtcttcccctgtgttggaggtccagag

SEQ ID NO: 44434 - DNA, 201 bp, Homo sapiens
aactgcctggtgcttcccactcagtggaccctcctctcctgcctcccctctgtgtacatacccagcgggttgccacgggagcctctccccaggctgctccwttgctgtctctgaaggtgttgttctgcaggtccttcccaagacaggacaggacccagtgcaggctccaagcggctctggggttccctttcctttccactt

SEQ ID NO: 44435 - DNA, 201 bp, Homo sapiens
gggaggttaggatgactttgggcgttgacttcctgggaccctgagcccgctctcccactgtgtcccgggggctcctctgggcttgggggtgtccaaggaamctccccactctctggacttccctgccaggggcctccttatcaagtgcctgccactccctctctgctggatgatgtcaagcatttgggggtttctgccact

SEQ ID NO: 44436 - DNA, 201 bp, Homo sapiens
gaggcccccgaccgtccccagcaaagcctccccttcctccctcttttctgattcatgtggacccagcttgactggccccaagaatcctgggaaactgcctrgtgcttcccactcagtggaccctcctctcctgcctcccctctgtgtacatacccagcgggttgccacgggagcctctccccaggctgctcctttgctgtc

SEQ ID NO: 44437 - DNA, 201 bp, Homo sapiens
aggtgagggtgcctgtggctggaagctgggtcaggttgaggagagggtccagagtcctaggcttgccttgccaccccttcccatggagggagggttgtccmgtggagcaccataatggtgctttcaccctgggaccttcccagcttgcttgggcaaagccctctcctcttctcttcttcccaaggtgcctgcctggcaggg

SEQ ID NO: 44438 - DNA, 201 bp, Homo sapiens
acattgattgcaaaggcagcattatggcatggtggttcatggcagagactctaccagggcttgaatcctggctctgccacccactacacaggacatcgggyaaatcgcttaacttctctgtgcctcatttcctaatctgtgaaaatggtggttggtggtaatgatacccacctcctgaggttgctgtgaggctttagtgag

SEQ ID NO: 44439 - DNA, 201 bp, Homo sapiens
acattccatacccgagcgtgcacgaggtactcagctagaaccccgcgcccacccttactcaagcccaggaggcacttacacagggcttctggataccaggycctcctccttaggagcctgacctgcaggccttgctgcgggctggagacttaatttgcaggcccaaggcctcagagcccatttgaacccttaggccttctg

SEQ ID NO: 44440 - DNA, 201 bp, Homo sapiens
ggagagacccttgccctgtttgtgttttgcagacagaggaggactacattccatacccgagcgtgcacgaggtactcagctagaaccccgcgcccaccctyactcaagcccaggaggcacttacacagggcttctggataccaggtcctcctccttaggagcctgacctgcaggccttgctgcgggctggagacttaattt

SEQ ID NO: 44441 - DNA, 201 bp, Homo sapiens
agctctggcctggaataaaggccacgtaccttgcctaggctgggagggcagatggccaaggaatggtgtccatatgtggggccaccaccttcatgggggtsccacgtggggctgctgggagcagcagcaggagattcctgagactgactcctgttttctctgtctgggcaacagcccaagactggggcatgtggatccggg

SEQ ID NO: 44442 - DNA, 201 bp, Homo sapiens
ttctcttccaggaggagcgatgggcagaaccagcacttccctcaggcactagacctgtcacgagtgaacttagttccctcctatactccttcactctaccmtaaggtaagtgtccccctccatacctacggcccctggtctgccccctacctccgacacatgcccagggctgggaaaggcccaagaatgacttttgggcaa

SEQ ID NO: 44443 - DNA, 201 bp, Homo sapiens
cttactactgtccatccccattttacagatgagggaactgacgctcagagaggggaagtggtggcccaggggcatgcagtcagtgaggggtgaaccaagaytgacagtaatgccactctgagcccatgcctttagccctcgatctcctggatgctgcttgtgctgagtggtgggctggggtgggtggccctgtcctcaggt

SEQ ID NO: 44444 - DNA, 201 bp, Homo sapiens
agatggagagacccttgccctgtttgtgttttgcagacagaggaggactacattccatacccgagcgtgcacgaggtactcagctagaaccccgcgcccayccttactcaagcccaggaggcacttacacagggcttctggataccaggtcctcctccttaggagcctgacctgcaggccttgctgcgggctggagactta

SEQ ID NO: 44445 - DNA, 201 bp, Homo sapiens
gctgggaaacttgccacgttggcggccccttggctactctgccaactgggcatgcagaaaccactcaggaatcattcccactgaaaagactggcgaggtayaggtccatgtcgaaggggatgcagcagcccagatgtggctggagtccaggccccagcccaagcactgtgcacatcctcatagcccaggcctagctcttca

SEQ ID NO: 44446 - DNA, 201 bp, Homo sapiens
gtagctgggtgccaccacgcccagctaatttttgtatttttaatagagacggggtttcaccatgttgatcaggctgatctcgaactcctgacctcatgatycacctgcctcagcctcccaaaatgctgggatcacaggcgtgagccaccgcgcccagcccactgttaggtctttaacccagcaaagtgagaataggggttt

SEQ ID NO: 44447 - DNA, 201 bp, Homo sapiens
tgcagcctgcagccccttcccaagctccttggccctcccctcctcctggccctttatgcattgaggtgtgacttcctgcaggtcagccctgggacagcctstgtgtctcattccttattgagtatctatctgtttgctggggactgggctgctgtgtgggcacctactgtcaagccttgggtttctgggagcacctactgt

SEQ ID NO: 44448 - DNA, 201 bp, Homo sapiens
aggcaaagtaaggataatgatactttcagagctagcagaattctctcaaggcaaatgtatctttccgttgttaggtctttttttttttttttttttttttktttttttttttagatggagtcttgctatgtcacccaggctgcagtgcagtggtgtgatctttggtcactgcaacttctgcctcctgggttcaagcgattc

SEQ ID NO: 44449 - DNA, 201 bp, Homo sapiens
tagcatcctgaggtcagggttgttgtcataaggattgaatgacatcacagtgcccgcatggcaaatagtccccctgccgctcctctaccccatcgccacgytccctctagagtcctaggagaggtcaacggtgcccagggaaaggggacacaggagcctcccgtgcctgtgcctgtctgcttaggctcccagtgggctggg

SEQ ID NO: 44450 - DNA, 201 bp, Homo sapiens
aggctgcagatcccacagagccctggggggcggggagcggtagccattctgaggactcggcctcctcccaccctagccccctcaggatgctgtcctaatcstgggccagtattgacgtgcagtcctgccgtgtgagctcgggagagccccttgccctcctggggactgtttccctttcgtaaactgggaggctgtctctgg

SEQ ID NO: 44451 - DNA, 201 bp, Homo sapiens
gttcttatgacggccaattggtggcgcccgagaccgcggcggactcccggacccattagagaacacgttttaaaaagcgttcttcggccgggcactgtggytcacgcctgttatcccaacactttgggaggctaaggcgggcgcatcacctgaggtcgggagttcgaggccagcctgaccaacatggaaaaaccccgactc

SEQ ID NO: 44452 - DNA, 201 bp, Homo sapiens
agaacagtaatgtcatgggttgatgcagcccctgccccaccaccagcacagagcagggaccctgcccagcaacaacttgtcagagtgttgtgggagccaargggaggtcccatgccgggaatgtgtgtgtcaggttgcaggccgggtgctgtctcttcgtcagcatagagccaaaatggggaagtgtgtcgtgggctctgg

SEQ ID NO: 44453 - DNA, 201 bp, Homo sapiens
cactgattgtccctgggaagagccccacgaggaagaagtcgggcccgttcggctcccgccgcagcagcgccattggcatcgagaacatacaggaggtgcasgagaagaggtgggtgagtgggggacagtgccccattcccctgcacccccatccctgagccccattcggtggcaaagcaaggcaggcagaagggagtgccc

SEQ ID NO: 44454 - DNA, 201 bp, Homo sapiens
gaggtcagggttgttgtcataaggattgaatgacatcacagtgcccgcatggcaaatagtccccctgccgctcctctaccccatcgccacgctccctctakagtcctaggagaggtcaacggtgcccagggaaaggggacacaggagcctcccgtgcctgtgcctgtctgcttaggctcccagtgggctggggaagagggg

SEQ ID NO: 44455 - DNA, 201 bp, Homo sapiens
ctgcagttcttatgacggccaattggtggcgcccgagaccgcggcggactcccggacccattagagaacacgttttaaaaagcgttcttcggccgggcackgtggttcacgcctgttatcccaacactttgggaggctaaggcgggcgcatcacctgaggtcgggagttcgaggccagcctgaccaacatggaaaaacccc

SEQ ID NO: 44456 - DNA, 201 bp, Homo sapiens
ttagtcaaggtcacacaatgactaagcctgggaattgaaccagctttggctgaccttccattaaggtgcatgggagagatcatgctcctagtcattgtatrtgtgtgtgtgtgtgtgtgtgtgtgtgtgtgtgtgtgtgtgtgtgtgttgggaagagggggtgactccttgggggttcggaagatgtgtgacctcagtctg

SEQ ID NO: 44457 - DNA, 201 bp, Homo sapiens
ggctggaatgcagtggtaccatcatggctcactgtagcctggaacttctggctcaagtgatcctcccacctcagcctcctgagtgcctgagactataggtstgagccactgcagtgggctgggtttttaatttttttgtaaagatgagggctcactttgctgcccaggctggtctcgaacccctggcttcaagtgttcctc

SEQ ID NO: 44458 - DNA, 201 bp, Homo sapiens
ccacagccagtccatgatgggcttgggcggcgacgaggacaagatggagaatggcagtgggggcggcggcttctttgagtctttcaaggtgaagggccccrggtctaactggccggggagcagggacgtggctagggcggaatcccgggctgaggctgatagactgatggacacggcgtgggggtggagtctggcagaagg

SEQ ID NO: 44459 - DNA, 201 bp, Homo sapiens
agctagtatcatctccattttccagattggaaactaaggctgacggtcacagctcaagactgagtcggggctgggtgcagtggctcttgcctgtaatcctrgcactttgggaggctgaggcgggaggaccacttgaggttgggagttgaagaccagcctggccaaaatggtgaaaccccatctctactaaaaatacaaaaa

SEQ ID NO: 44460 - DNA, 201 bp, Homo sapiens
cacagggccctgagggctgtggctgagtggggaggcagtgatcaggtccagctggccatgggggccccccattcccttctccatgacctcagcctcactckgagagcccccagcagctggaaggtctggtaaggggtgcgtgttccttgatggccttgggaagggttccagggtaatgattaatcctcaggtggcacgagc

SEQ ID NO: 44461 - DNA, 201 bp, Homo sapiens
gtcgcctcccctggctcggcaggatctgaggactcggtgggaattcacggggcggtttccgtgccctgcagggtttggtgccagctgcggggcgcctgggyttggggaagaaaccttgtgtacgcacacctgcacacacacacagtctccggaggtgagcggccccctccctaccataacagaccccagcctgtgcatgcc

SEQ ID NO: 44462 - DNA, 201 bp, Homo sapiens
gctgagcccagggagatacccttttgggagtgaagagggtgaccccaggccccagcagagcatggttcaggagctgcagcctctgcctcgttggggttccracccttgtttatgtgtcatctcaacttcccttccttatctcctccacactgggagtttacaggggcctgagttccaggaatttttgctgacaaagctgat

SEQ ID NO: 44463 - DNA, 201 bp, Homo sapiens
gccacatgatctgcatggagatgagaaacacatcctcaggggtagggcctgagtgggggcaggtattctggccaggccagattttcctggtccctgatggrgtccctttaagtaggcaggggtttcagaaacccattgaatagagcaggagtctcagagccagggcagaggctggctcagtaacctcactggccagctgcc

SEQ ID NO: 44464 - DNA, 201 bp, Homo sapiens
ttgtgggtgaggaaactgaggttcatagaggcaaggagatggacctaggggcacacagttgaccttggtacaggtctcttccttctgagacccagcacctrtgtgacgtggctctggggctgcaccctgcattggagtggggctggtcctgagaggtctgtatggggccagggcaagtatcagatgaggttctgagattcc

SEQ ID NO: 44465 - DNA, 201 bp, Homo sapiens
atggggggaggcatgatggggcctgagcaattggatgcaggtgggggcattcattgagcacttgcagtgtgctgggccctatgtaagcacttttcatggayctatctcatttaatcctcttagcaaccctcaagggctcagagaggttaaatagcctgccccaggtcacccagctggtgagtggctggggctgagatttga

SEQ ID NO: 44466 - DNA, 201 bp, Homo sapiens
atcagcaataacttcaagtttggcgtcatttatcagaagcttgggcaggtgtgctcacctcctccctgccgcccctccccacctggccccatatctggagsctcacaccttttccagggcagcacaccggccaagggactcaggagcccaggggctgccagaggtcctccctccggccctctctgggtccaagtagggaca

SEQ ID NO: 44467 - DNA, 201 bp, Homo sapiens
ggcagtcagggtgggaagtgggcagctagctcaggaattctaggaagattctggatggggggaggcatgatggggcctgagcaattggatgcaggtggggscattcattgagcacttgcagtgtgctgggccctatgtaagcacttttcatggatctatctcatttaatcctcttagcaaccctcaagggctcagagaggt

SEQ ID NO: 44468 - DNA, 201 bp, Homo sapiens
tacacttggggacatagtctgccttgggtagagtttgaaggagcagcatgtaaggtggggccctggcttggggaggagtaactgttggaggtggggcctasgtggggaattcacctgggaattctgctgaagggtggaggattctgggagacagcaagggctgctggtacaaaggctgctaggtcagcaggaagagaagag

SEQ ID NO: 44469 - DNA, 201 bp, Homo sapiens
ccacagccctccctggctggagaggtgtgggctctgtagtcctccgaagggcagagaagcctgggtcctgcacaaactctacaatgctgggcccacccaayggcagtcagggtgggaagtgggcagctagctcaggaattctaggaagattctggatggggggaggcatgatggggcctgagcaattggatgcaggtgggg

SEQ ID NO: 44470 - DNA, 201 bp, Homo sapiens
ctgttggaggtggggcctaggtggggaattcacctgggaattctgctgaagggtggaggattctgggagacagcaagggctgctggtacaaaggctgctakgtcagcaggaagagaagagaggaagaggctctgtcttgactgagggaaagttctcagaagaggtgtgtgaaccatgatcattggagagggacttggcctg

SEQ ID NO: 44471 - DNA, 201 bp, Homo sapiens
gtcctcgggctttgcccggaacaccctttatcattcttcattctgcaaaccatcagtgggcccctgttccttgccaagcgctgccccagatacaacagatrcagctgggaacagtgcagacccaggccctgcctgctggggcacagagtctagaattgcaatggtctcttcacagcctgccttgcctcccagatatcaggc

SEQ ID NO: 44472 - DNA, 201 bp, Homo sapiens
ggctggagtgcagtggcacaatctcggctcactgcaagctccacctcccgggttcacgccattctcctgcctcagccccccaagtagctgggactacaggkgcccgccaccatgcccatctaatttttgtatttttagtagatacggggtttcaccgtgttagccaggatggtcttgatctcccgatctcgtgatccgccc

SEQ ID NO: 44473 - DNA, 201 bp, Homo sapiens
tccttgtttttttgttccctcctcccttccctttccccgtcctgtggcctctctgccctttggctctctgtttctccttccttcttgcacctgtcttttttgctccctctcctccttcccttctccgctcttctcaccctcgctttttcctttcggccttcccctggcttccttctctgtctctgaccctccctgggcctg

SEQ ID NO: 44474 - DNA, 201 bp, Homo sapiens
gagccgcagccagtccatggatgccatggggctgagcaacaagaagcccaacaccgtgtccaccagccacagcgggagcttcgcgcccaacaaccccgacstggccaaggcggctggaatagtgagtgccctccccctccccaggcccctgcccctccctggggggccctcagctctcctctgcctcctgaggcctgactc

SEQ ID NO: 44475 - DNA, 201 bp, Homo sapiens
tttgtaaagatgagggctcactttgctgcccaggctggtctcgaacccctggcttcaagtgttcctcccacctcagcctaccaaagtgctgggattacagrcatgaaccactgagcctgggctgaccctgctgttttgcagagtatggaactctcttgagatcttcccaccctggactggtggaaggcctgtgttcttatc

SEQ ID NO: 44476 - DNA, 201 bp, Homo sapiens
ggtggggcctaggtggggaattcacctgggaattctgctgaagggtggaggattctgggagacagcaagggctgctggtacaaaggctgctaggtcagcasgaagagaagagaggaagaggctctgtcttgactgagggaaagttctcagaagaggtgtgtgaaccatgatcattggagagggacttggcctgtgtgacct

SEQ ID NO: 44477 - DNA, 201 bp, Homo sapiens
gatcacacagccagtgatgggcagagctaggatctgagccctgatctgtctagggccagcatccgtgctcttcccacggccccagcgcatgtgggagggcmtagtgctggttttcagggtggccacagatgggcctggggggtccatgagtgtgggcagcatgagggcagtgagcccaggccagcagcagggctgcccccg

SEQ ID NO: 44478 - DNA, 201 bp, Homo sapiens
tgggctgaccctgctgttttgcagagtatggaactctcttgagatcttcccaccctggactggtggaaggcctgtgttcttatccctgatctgctgctcamggccttattggctgactttgaggtcgtgttttcacctctccaagcctcagtttgccctgctggcaattggggatcctagtgactgccttatctccattcc

SEQ ID NO: 44479 - DNA, 201 bp, Homo sapiens
ggtggggccctggcttggggaggagtaactgttggaggtggggcctaggtggggaattcacctgggaattctgctgaagggtggaggattctgggagacarcaagggctgctggtacaaaggctgctaggtcagcaggaagagaagagaggaagaggctctgtcttgactgagggaaagttctcagaagaggtgtgtgaac

SEQ ID NO: 44480 - DNA, 201 bp, Homo sapiens
aggctgttgccggatcatggtgataggaggaacccgaagcagggttggggggatgaagagggactgggggcagaggtgttttagatgggtcctcggggagrcacctccatggggtgacatttgaattgggaactgaaccagccctgctaggactggcatggcagaggagctcggccagtgcagaggcctggggcacactcc

SEQ ID NO: 44481 - DNA, 201 bp, Homo sapiens
agataaagaaggcttttgaaaagtacaaagaactgcactcacgatggtgcgattattattgttacctcgatgcagagataagggagggggaggaggtgcastgacagttgccaagaaaccggggagctgtcagcagcggcttccggccgggcccatcccacttaggagctgggcccttcccccacacccttgcttcaccct

SEQ ID NO: 44482 - DNA, 201 bp, Homo sapiens
tcagattagcagtaatgagggagaagccccagggctggcagaatggcagggccccttcctgactccaggtggggtaatgggggaagcagccaggtgctcakgcactgggccctatcctggcagagaggggaggttaggatgactttgggcgttgacttcctgggaccctgagcccgctctcccactgtgtcccgggggctc

SEQ ID NO: 44483 - DNA, 201 bp, Homo sapiens
gaacaggatttacttctaggatgattcctggggcgggtgtggccgggcagccagctccactcccagaacttgggctagggctggggctgaggttggcaggrggagcccggggccaggctgggtggtgtctccctgaacttccagccctcggctttgggacttccccacccggaggtgccagccctgggctcctctctgggg

SEQ ID NO: 44484 - DNA, 201 bp, Homo sapiens
tggagtaggggtgggcttggcatggcaggaccggggctcacagcaaaactcaggagcgatgaacttaagctttggaatccaacagacctggggtcaaatcycaagcctgcatgtgcttgcaagccattgaccctaggtgagtcacttaaggtctctgaacctgagtttcagaggggacagctggactgtctccctcccagg

SEQ ID NO: 44485 - DNA, 201 bp, Homo sapiens
ggggaggggaggcagcgcctggcggcaggcctgggagggtgtaacagtgctgccttctcttacagggaagcaggatggatgaacaacgctgctccttcccrccgcccctcaaagtaggtgggcctggcagtctgcctccctctctagggggtggagggggtccgggaagtgctgccaccactgcccatcaagcaggaaatc

SEQ ID NO: 44486 - DNA, 201 bp, Homo sapiens
gggctggagggcagtgtgctctggggtcagggctagtaacccggtgtctgctgacacagctccacttgggtgggggaaacagcttactctgaggaagagcrctggactgtgagctctgggcgagctgggtgcagaagagcgacttggagtgtttagtgagcgaatgagtacctgctgcagaactcagagcccagttccctc

SEQ ID NO: 44487 - DNA, 201 bp, Homo sapiens
ctgtctgtccatctctcccccgtctcccttgtcctctgtctctccttgtgcttctcgccttcctttccccggccctatctctcccattgcctcctgcaccrttctcttcctttttctgtctgtcttcctcctttccctgcctctcctcctctctgtgtctccctcccaccatctctcttgctctctgactctctctctgtc

SEQ ID NO: 44488 - DNA, 201 bp, Homo sapiens
aatatcgccggtctgcatggagcgccatccctctcctctgccctgactcctcctccccgccacgaagtgacctggggtcctaccccttcctgcctccagaraagctgggggcgggcttctggggcctggggcatcccagcacagtgtgtgggaagctgggggagtcttccagctgctgggccagaacctcccccagccaat

SEQ ID NO: 44489 - DNA, 201 bp, Homo sapiens
cccctgcccccgactctgcctgacacacaagcactgagagtcacaccatccagatgctggcacgtgtgtacacacagagagacggaggttgtcagcaaggrgaagagccttttcagaagccctcgtcttctgtcgtctgcctccattatctcctccagggtgcacacatggtacacgcgcatgcaggaagaacacgaggat

SEQ ID NO: 44490 - DNA, 201 bp, Homo sapiens
agaactcttcagcaccaatgaggaaagtcccgctttcgtggagttccttgaatttcttggccagaaggtcaaactgcaggactttaaggggtgagtattakggtgggctgagcagagtgtaatctgacttgtgctcctgggcagggagggagcccctgtcctggccccatggaggcctggccagggctggagactgaggcg

SEQ ID NO: 44491 - DNA, 201 bp, Homo sapiens
tgggcgggtcacctcctctctggctgctcccatttcatgtgtcagaggaggcagcgtgcaggtgtccaggccagacagagcagagccggagctgggcctakggaaggcgcttggcggtggctgcaggagccagggccgtgatgggaggtcatggggcaggaggccaggtgacgggactgagggcctgggctgaggacagtg

SEQ ID NO: 44492 - DNA, 201 bp, Homo sapiens
ccaatgaggaaagtcccgctttcgtggagttccttgaatttcttggccagaaggtcaaactgcaggactttaaggggtgagtattagggtgggctgagcasagtgtaatctgacttgtgctcctgggcagggagggagcccctgtcctggccccatggaggcctggccagggctggagactgaggcgtggcctggggggcc

SEQ ID NO: 44493 - DNA, 201 bp, Homo sapiens
gaggaggctgcagggggagtctggggggctcagaggcccaaggatctgtaaggggtcctcaaaggtgcttggctgctaccagctgggcctcccgggttggrgagggcaagggagtgagggcctggcccaggaggggctcggggtggacaccggctaatggggcactgtctgtggcagagcggagaccgcagcgcagagagc

SEQ ID NO: 44494 - DNA, 201 bp, Homo sapiens
agtgtaagctccagggtgctgcacagatgtgaccacggtcatggcagggggaaggaggagaggggagagcgccccatgtcccggcatgctctgggctcccsgcagctgctgccgcccaggaggaatgcaaagcattttaagctgagccaggccagggggttggatggtttttggagacgtggggaagggatagagaccagg

SEQ ID NO: 44495 - DNA, 201 bp, Homo sapiens
aacaaggagatcatgtttcacgtgtccaccaagctgccatacacggaaggggacgcccagcaggtagcctgggcacccccacctgcctcctgtcttccacstgtcctccccctccacctgtctgttcagcctccatcacgccaggctcagcgctgggccctgggatggagatggaaatgatcagcgcccccacttgtgggc

SEQ ID NO: 44496 - DNA, 201 bp, Homo sapiens
ctcccttcctctctagtctcctctcttaccacttcagacattctgtactccgttgcagtcccccaagcctcccaggctcactgcacccctggccctttgcrcatgtgccatctcttctgtctggaacactcttcctgccgcctcctcctttctttgccaggctggctctgactcatcctttttgactgagtctcacacacc

SEQ ID NO: 44497 - DNA, 201 bp, Homo sapiens
gatggacaggcagtgcccagagcctccagtttccttctctgtccccatcctggagcccctcccttcccctgccccttacggcctcagcagtggctttttasgtggagttgccttcgggggacaggactgtggccagccaggaactggagagccaagggccctgggatggggtcccaggtgcaagccagagcaccctggcct

SEQ ID NO: 44498 - DNA, 201 bp, Homo sapiens
cactgcaagagatgatgtgcccttctttggaccccccctcccggaccccgctgtgttcaggaaggtgaggggcacccccccagtcatgggcagagcaggasaaatgggtgggggcctggggggtgcatacacattctgccttatgaggtcccaaagtctcattgtatgccagggcagctgggctcccctaactgcaaccgg

SEQ ID NO: 44499 - DNA, 201 bp, Homo sapiens
aatagtgaaacttggggagccagagtttaccatgaacaaatgatgtgaaagttttcattgagtgaattcccatgagctgcccaggctctgcgatgaatgtktttggaaactgaggctgagagaggctgtgtcactaacccaagctcacctagccagtcagtgtctgagactatctcccccacactgatgccacaggcttga

SEQ ID NO: 44500 - DNA, 201 bp, Homo sapiens
ccagtcagtgtctgagactatctcccccacactgatgccacaggcttgaaatgccactgccaccatatctgtccttttgggtcaagcattgcccagcgcasacccctcttgtaagatgccatcactcctgggaggtggagaggcctccagtgcataagtggggctgtggatggttcctccgggccatttctcctgctggag

SEQ ID NO: 44501 - DNA, 201 bp, Homo sapiens
tactcagacaggtgcctcggtcactgatcagagctggtgggacccggagggccggggcgggtggagactcctctggggcttggcgggatcagctgacctcsctctcccctgtctctgttgcagaacacagatctatttgagatgattgagaagatgcaggtgaggatggctctgtggcctgttctggggagccacagagct

SEQ ID NO: 44502 - DNA, 201 bp, Homo sapiens
tcacgtgtccaccaagctgccatacacggaaggggacgcccagcaggtagcctgggcacccccacctgcctcctgtcttccacctgtcctccccctccacstgtctgttcagcctccatcacgccaggctcagcgctgggccctgggatggagatggaaatgatcagcgcccccacttgtgggctctcgttgggtcagggg

SEQ ID NO: 44503 - DNA, 201 bp, Homo sapiens
ttaggccttctgagccaaatgttccagcctcctgggccaaggtcatgctccagctctacctgcccccacaccccctgttagagacttgggtctcggcgctstctgggtctggctgagggaaagggctggagcagaaccctggggcccacacaggctctggcctgtcccctcataccccttagccacgacagaagcggctcc

SEQ ID NO: 44504 - DNA, 201 bp, Homo sapiens
gtgtccaccaagctgccatacacggaaggggacgcccagcaggtagcctgggcacccccacctgcctcctgtcttccacctgtcctccccctccacctgtstgttcagcctccatcacgccaggctcagcgctgggccctgggatggagatggaaatgatcagcgcccccacttgtgggctctcgttgggtcaggggagac

SEQ ID NO: 44505 - DNA, 201 bp, Homo sapiens
ccatgccctcgggcctagaacgagggctcagcacagggcctggcatgtggtaggcccaatgagcgtcagttatggtcacggtcactgtcattcgtaatagyggtagccctggtagcccctcaatgccaaggcggctactcccagaggctcagggaggggtccattgtagaggcgggggcaccctgcttagtccagaaagct

SEQ ID NO: 44506 - DNA, 201 bp, Homo sapiens
ctgtcctccccctccacctgtctgttcagcctccatcacgccaggctcagcgctgggccctgggatggagatggaaatgatcagcgcccccacttgtgggstctcgttgggtcaggggagacagaaagccttggtttctacagtcagaatggcacccacttcctaggtgagcataaatgcgtgggtgcatagagggactag

SEQ ID NO: 44507 - DNA, 201 bp, Homo sapiens
tcttcagagtaggtcactgcttggctggaggcctaatggagagcttggggagagaccctgtccacgtctctgatctccggggaaggagaagcctgtgtggyagccctgctaatgaagcccctcctctccctcctcttggggaacccatgaccctctcctccgtgaagtctatcctccctcacatcccccagctctgagagt

SEQ ID NO: 44508 - DNA, 201 bp, Homo sapiens
gctcagtgcttggcacgggggaagagcacgtcgaatggcagcttgcacacgcagcctcttcacccggcgtcctctcctgcaggcttcccggctcatcgtcrcctttgacgagcatgtcatcagcaataacttcaagtttggcgtcatttatcagaagcttgggcaggtgtgctcacctcctccctgccgcccctccccacc

SEQ ID NO: 44509 - DNA, 201 bp, Homo sapiens
accacgccccctgtcgtccccaaagctcaccccctcagagaggacagtttccctcctctgcctcctggcctggtatcactgtcctccacctcccgtagcckcctctgccttcaccatcccgatgattcctaaggcccctacccatctccaccactaaaattcagggcaaaagatagagggcagaaatctctggaagaaaga

SEQ ID NO: 44510 - DNA, 201 bp, Homo sapiens
ctcttctcttcttcccaaggtgcctgcctggcaggggtctcaggaggcccctctcctggctctaactaccttccacccttaggagacaagaaggattcttyctttggcctcttggagggcagcagggagagaggtctctgccacttaggcctcaggctcccacagcagggcctccacctccctctcacctggccctgcccc

SEQ ID NO: 44511 - DNA, 201 bp, Homo sapiens
ggtcaggggagacagaaagccttggtttctacagtcagaatggcacccacttcctaggtgagcataaatgcgtgggtgcatagagggactagaacagtgcmtagtacattgcaagagttcagcagatctgagctggtgttttatggggagtggagagcatcatggggtcatgtggggacatgtagtcttggcagaggtggg

SEQ ID NO: 44512 - DNA, 201 bp, Homo sapiens
tcatggggtcatgtggggacatgtagtcttggcagaggtgggagtcaggaaaagctttcaagagaaagtgacttttagtccgtgaaggagctgggagaagraagggaaatgttccaggtggcgagaacagcttctacaaaggcctggactcgaggacatgcaaggcatgtgccaggaactgaactcagaagcgtgtcccct

SEQ ID NO: 44513 - DNA, 201 bp, Homo sapiens
ctttcaagagaaagtgacttttagtccgtgaaggagctgggagaaggaagggaaatgttccaggtggcgagaacagcttctacaaaggcctggactcgagsacatgcaaggcatgtgccaggaactgaactcagaagcgtgtccccttgtcctgagcctcctacagggctatctgccttcccagtcaggtccccagcccag

SEQ ID NO: 44514 - DNA, 201 bp, Homo sapiens
accggggcctggcttttccattcatcttgaaaacaccttttttttttttttcacaaggtcacaggataaactacacgattgttttacactttccatagtaractggcctctcctcatttctgttctctttctgacagttccagtctctttctttcttctaaaatgtttggggaggggcacacttcaagcctgggcttcagc

SEQ ID NO: 44515 - DNA, 201 bp, Homo sapiens
gcggcgacgaggacaagatggagaatggcagtgggggcggcggcttctttgagtctttcaaggtgaagggccccaggtctaactggccggggagcagggaygtggctagggcggaatcccgggctgaggctgatagactgatggacacggcgtgggggtggagtctggcagaaggggcgtggctgagggggtggagtcccg

SEQ ID NO: 44516 - DNA, 201 bp, Homo sapiens
ctttccgtgtccggtctcccagcctgtgtgcagtgggtggctgtcctcagggtgggctcctcctgctcttgctccaggcactgtcacctgtccagatcccyattcccctgctcccggtcccagccttcttgccttgatggtcctgtaccacctgccctggccaccagagtttcacctggttgagttgaatttcaaagcatc

SEQ ID NO: 44517 - DNA, 201 bp, Homo sapiens
tactgttgttatgtgaccctgccggggcaggcagggcttgtagccatgagtggggctgcatctgggtctccctggacacacctgcccgcctctgtggctgygtgttgtcatgcctcttgttctcacacgagagtggtttgtggtgttaccatagctttgtgtgcagttactggtgtgcagacctgcacaggtgtgggtttg

SEQ ID NO: 44518 - DNA, 201 bp, Homo sapiens
tgccagcttgcaattgggtgaaagtactttggaaagtagaaattaggaagctgagctcttatcagcgtcattacattcccagggctggacagggcacccaraagggacattctcctcccttcaggccccacatttgtacaggcatcgagctacccaggaccctccttccctcctccctacaggggtttctccactcgggga

SEQ ID NO: 44519 - DNA, 201 bp, Homo sapiens
caggccagacagagcagagccggagctgggcctagggaaggcgcttggcggtggctgcaggagccagggccgtgatgggaggtcatggggcaggaggccasgtgacgggactgagggcctgggctgaggacagtgggatgcacgctgtggaagggacactggactggagtcacatctcagccctgccctttcccattgtgc

SEQ ID NO: 44520 - DNA, 201 bp, Homo sapiens
actggtggaaggcctgtgttcttatccctgatctgctgctcacggccttattggctgactttgaggtcgtgttttcacctctccaagcctcagtttgcccygctggcaattggggatcctagtgactgccttatctccattccagttccggtgagagtcccaggagtgagcagataaagaaggcttttgaaaagtacaaag

SEQ ID NO: 44521 - DNA, 201 bp, Homo sapiens
aaaaaagggaaaaagaaaaaagtatttattgagcaactactatttactaagtgtcagtggtatagtgttaagggcactgcaaccagatgttgggggaggtmaaatcttcagactttcatttactgtgtgtgaccttggacaagttacttaacctctctgtgtcttagttccctcctttgaaaaatgcaaattaaatgagtt

SEQ ID NO: 44522 - DNA, 201 bp, Homo sapiens
ccctcacatcccccagctctgagagtgactctcccagagttcccaaatttcctggcttggggctctccctgacctcagactctttctcttccaggaggagygatgggcagaaccagcacttccctcaggcactagacctgtcacgagtgaacttagttccctcctatactccttcactctaccctaaggtaagtgtccccc

SEQ ID NO: 44523 - DNA, 201 bp, Homo sapiens
gcttacacttggggacatagtctgccttgggtagagtttgaaggagcagcatgtaaggtggggccctggcttggggaggagtaactgttggaggtggggcmtaggtggggaattcacctgggaattctgctgaagggtggaggattctgggagacagcaagggctgctggtacaaaggctgctaggtcagcaggaagagaa

SEQ ID NO: 44524 - DNA, 201 bp, Homo sapiens
agaccactccctctttccgtgtccggtctcccagcctgtgtgcagtgggtggctgtcctcagggtgggctcctcctgctcttgctccaggcactgtcacckgtccagatccccattcccctgctcccggtcccagccttcttgccttgatggtcctgtaccacctgccctggccaccagagtttcacctggttgagttgaa

SEQ ID NO: 44525 - DNA, 201 bp, Homo sapiens
gggtgcggaattgcgcttggtgtgtagactctgtcctctggaagcttgctgcctgccagggggtgacctgactgcctacacgtgactgtacaccccagccrtgggcactggccttaggcactggccctgagaacactggctttggagtctgatgggcctggtgccaggtcctggccagtgaccttgaggagtccgtcacct

SEQ ID NO: 44526 - DNA, 201 bp, Homo sapiens
caggctcctccctgagagctctggcctggaataaaggccacgtaccttgcctaggctgggagggcagatggccaaggaatggtgtccatatgtggggccascaccttcatgggggtcccacgtggggctgctgggagcagcagcaggagattcctgagactgactcctgttttctctgtctgggcaacagcccaagactgg

SEQ ID NO: 44527 - DNA, 201 bp, Homo sapiens
gatctgggtggatttgggggagacaaagtctggggtacccctgaagtcttagggagcagggtacgtgtgttggggtgagggtggggggaagctcctcctaratctcctcccagattcgcagacatttgcttcctgggtggatatgagtgaacagcttcaggattgaggcaggctacgggccttgggggtgatgttctttct

SEQ ID NO: 44528 - DNA, 201 bp, Homo sapiens
tatggggccagggcaagtatcagatgaggttctgagattcccagtgatgcctgcctcctccctgtcacgggaacaccacgcccttcagtggcgtggtctgsaagagacagactggtgggcagagctgtttccaagagacttctctgcccaccatgcacatgggggctatgctgccccagaaaatcagattgagaagggccc

SEQ ID NO: 44529 - DNA, 201 bp, Homo sapiens
aaggtcccactgggattccagcctttcctactgcaagaaaggaagcaaaacatgatactcctgctttgcaccagcacaatgggagcagcctcgtgtgcctrctcactaagcatttaatgagcatgtagtggatcccagggactgtgacaggcactggggcacagagatgagctgggtcctgtggtccctgccacagcccgg

SEQ ID NO: 44530 - DNA, 201 bp, Homo sapiens
ggatctggggtgtctcctttgaggagggctccgatggtcccacatctggtaggtgctggacggtggacctagattaggtcaaagaatttctcagaagcagyggagtccagagttgagggcatgggtcctggcatgccgggctcacccctgcctcagttggcatgaaatgggcatgattgctagtccccatcttgcaggggg

SEQ ID NO: 44531 - DNA, 201 bp, Homo sapiens
tcagttggcatgaaatgggcatgattgctagtccccatcttgcagggggatccagtgatagagtgattgtaaagcgctggtcccatagcaagcatttggtrtagattggtctgaaaaaaacaaggaaagagggtgggagggaagaaaagaaagaaggcaggagagctctaagaggccctaacaggaatgaaactgaggtgt

SEQ ID NO: 44532 - DNA, 201 bp, Homo sapiens
agagtggcattgctggggagagaccagatgcctgggctcctgggtttccccaaggggacggcccttaggaatcctgtgcctcctccactgccacccccttyacagcgggtcatccggagccgcagccagtccatggatgccatggggctgagcaacaagaagcccaacaccgtgtccaccagccacagcgggagcttcgcg

SEQ ID NO: 44533 - DNA, 201 bp, Homo sapiens
aggcagccttataacagcagctggaatggctgcttgaattccaaatctgcgttagtgctgccaggcgaggcaggccctcagccacaggaagtggggcacgsactccagggaggccaggaggccgacgcagccactgcctgggttggattgttgcctgctggcacactggcctctgcacaattctatctgggttttcctttc

SEQ ID NO: 44534 - DNA, 201 bp, Homo sapiens
aacgcggcctcataggctgttgccggatcatggtgataggaggaacccgaagcagggttggggggatgaagagggactgggggcagaggtgttttagatgsgtcctcggggaggcacctccatggggtgacatttgaattgggaactgaaccagccctgctaggactggcatggcagaggagctcggccagtgcagaggcc

SEQ ID NO: 44535 - DNA, 201 bp, Homo sapiens
atgggcagtaagcctgatgctctctttggggcagaggccctcacaccagcagcgtcggtgccacctgggagcctgtgaggaatgtacattctcagacccckcccagaccgctgcatccaaagctctagggtggggtgcagcaagccctccaggcagtccagcggtttcttctggggaggcagtgagccctcctttctccag

SEQ ID NO: 44536 - DNA, 201 bp, Homo sapiens
gcccacactgggctctttgtcttcggtgggaacccttcagcccccatggcccctctcaagggcccactgtcccagtaccagtggggcctcccgggggccasgcctggctgggaaacttgccacgttggcggccccttggctactctgccaactgggcatgcagaaaccactcaggaatcattcccactgaaaagactggcg

SEQ ID NO: 44537 - DNA, 201 bp, Homo sapiens
caccccacagacatacactgcctctcacccagtgagagacaccgcaggctttgtggtggggggcccaggtggaatggaactggaggaggggacagatgctsggggcctgtcagccagagactgtgctgcaggagtgggaggtattacccctccaccctccaccccacagccccgtctgcgtttcacataggtatgcatggg

SEQ ID NO: 44538 - DNA, 201 bp, Homo sapiens
tttggttttctctatagcaccttcagatctcaggggacctccgttccctgagcaacagtgaaccccgagtcctgctttagccttggccattcccagcatgkctcctccccagaccttgaccagggaggcccaggcagccccatcctctcctccctggccccacacctcacacccctgccttatctcctcctgcagttggtg

SEQ ID NO: 44539 - DNA, 201 bp, Homo sapiens
ccccaaggggacggcccttaggaatcctgtgcctcctccactgccacccccttcacagcgggtcatccggagccgcagccagtccatggatgccatggggmtgagcaacaagaagcccaacaccgtgtccaccagccacagcgggagcttcgcgcccaacaaccccgacctggccaaggcggctggaatagtgagtgccct

SEQ ID NO: 44540 - DNA, 201 bp, Homo sapiens
ccccttcacagcgggtcatccggagccgcagccagtccatggatgccatggggctgagcaacaagaagcccaacaccgtgtccaccagccacagcgggagyttcgcgcccaacaaccccgacctggccaaggcggctggaatagtgagtgccctccccctccccaggcccctgcccctccctggggggccctcagctctcc

SEQ ID NO: 44541 - DNA, 201 bp, Homo sapiens
cggctggaatagtgagtgccctccccctccccaggcccctgcccctccctggggggccctcagctctcctctgcctcctgaggcctgactccaactctctstgttgccctgctgcccacatgcccatcctaggctctggatttggtctagccactactttccatgggaggggggtgaagtgcccaggccaggacactgcgg

SEQ ID NO: 44542 - DNA, 201 bp, Homo sapiens
agtggcagtgggtggcgtgtgcctgggtctgtgcctgccctgactctgccctcctgtggtctccctggggcagacatggctaggcccgtcctcctcgcagrgggtacgggtggggggttgtggaatgcagtgagggagaggggctgggagggagccctagccagtgccaagggcataggctaacctccctccctctttcca

SEQ ID NO: 44543 - DNA, 201 bp, Homo sapiens
gctgcagctggtcagagcagagaggctggagcccacactgggctctttgtcttcggtgggaacccttcagcccccatggcccctctcaagggcccactgtsccagtaccagtggggcctcccgggggccaggcctggctgggaaacttgccacgttggcggccccttggctactctgccaactgggcatgcagaaaccact

SEQ ID NO: 44544 - DNA, 201 bp, Homo sapiens
aggtgacaagcgggagagctgagattttagccttcaacggtgaggatataagcacatgcctcaatgtccattgtccttgccattcatctacaggctcacakgctatgatgcagaagataaattcttggaagtggtcttgcaggttaacaggatgcatttaaattcagccgtcaccaaaggaccaggagctggtcagggact

SEQ ID NO: 44545 - DNA, 201 bp, Homo sapiens
agaggccctttgaggactcctcgggcagatctgtcctccatgctgccatctgtctacggaggcctttgtcctggctgtcagaggctgctgagcagccgcaygtgctgtgcaaacaaccgagacctgagcacggccagacacaaacgcaaatacagttagactgacagataccctgagacccagacacaggaacacacgggc

SEQ ID NO: 44546 - DNA, 201 bp, Homo sapiens
gagacggaggttgtcagcaaggagaagagccttttcagaagccctcgtcttctgtcgtctgcctccattatctcctccagggtgcacacatggtacacgcrcatgcaggaagaacacgaggatgccctacgcccttaaaaatgaacctggcagacacgcacatgcacccacccacacccaggccatcatgggtgcacacac

SEQ ID NO: 44547 - DNA, 201 bp, Homo sapiens
ttcagaccttggccttagcggggacacctggggctggatggattgatggacgagtaggaggtcggggagaggaagccggagggatactgaggagttcccasgagatgctgggaggcggttaggctgacagggacaccttgggacctgtcaggtgggggggtggacctggggggtggggacatgaagccagatcttgaaggg

SEQ ID NO: 44548 - DNA, 201 bp, Homo sapiens
ttttcctggctctttaacccctatgccttcccatgtccctaatctgacagtcaggcgactgcagcctaagggtgatagtgactgcatcaggcatccttagraacaggaccttctccagcccctctgggagggtggtgcagtgcaggtgggtgtgatatgctgggccaagctggtgagaagggatgtcccctcacctatggc

SEQ ID NO: 44549 - DNA, 201 bp, Homo sapiens
tctgtggcctgttctggggagccacagagctggctgggctggggctggggggcccttgctgcatctccagcccttcacctccctgaggacaggccacgccrgtagaagatggtggctattggttgtccagggtcctctgtctggaggtcagggtagaggatgcccaaccccatctctgatgccggagtccatctaggctcc

SEQ ID NO: 44550 - DNA, 201 bp, Homo sapiens
caccctccaccccacagccccgtctgcgtttcacataggtatgcatgggaggtgggccgggggtgctgggatgggagtgccttaaataccctctgatcttygatgcctcctgtttctctttctgtctctctctccaatgcctcctatttctctgtctttctgtctcgtctctgcctctccctccccctctctccctcaaca

SEQ ID NO: 44551 - DNA, 201 bp, Homo sapiens
aaaaatgaacctggcagacacgcacatgcacccacccacacccaggccatcatgggtgcacacacgcatgaattacatcagcttcctgcgtgtgggatgtkaatgcttcatcacccggggaggggagtggaggcccccgaccgtccccagcaaagcctccccttcctccctcttttctgattcatgtggacccagcttgac

SEQ ID NO: 44552 - DNA, 201 bp, Homo sapiens
tgcctctgagagactggcgctgtggagaggtgcttctgtgggcttaggtgaggcctccagggcagacatgctagatggggaggggctcccagctccaccaygctccctcggcactcacaccaagcctgccagagtgctgattccctgtccaagcctggccctgcctcttgctggctgtgtggcccggacaagtcattttcc

SEQ ID NO: 44553 - DNA, 201 bp, Homo sapiens
cttctgtgggcttaggtgaggcctccagggcagacatgctagatggggaggggctcccagctccaccacgctccctcggcactcacaccaagcctgccagrgtgctgattccctgtccaagcctggccctgcctcttgctggctgtgtggcccggacaagtcattttccctctctgggcccagctccagctctgggaggca

SEQ ID NO: 44554 - DNA, 201 bp, Homo sapiens
cccagcactttgggaggctgaggcaggtggatcacttggatccaggagttcagaccagcttgggcaacatggtgaaaccctgtctctacaaaaaaaaaaaattagccggatgtggtggcatgcacctgtggtcccagctacttgggaggctgaggtgggaggcttgctggagcccaggaggcagaagttggaatgagctga

SEQ ID NO: 44555 - DNA, 201 bp, Homo sapiens
cccaactgggcttcatcccactcaaaattctgagggcttttgggcctcagggtcccatacgcagcaagccccttttctctctctcttttttttttttttttgagacagagtcttgctctgtcgcccaggctggagtgcagtggtgcaatcttggttcactgcaacctctgcctcctgggttcaagcgattctcctgcctca

SEQ ID NO: 44556 - DNA, 201 bp, Homo sapiens
aggctctgtcttgactgagggaaagttctcagaagaggtgtgtgaaccatgatcattggagagggacttggcctgtgtgacctaccctgcctgtccctggkttagcttagcattaagagcacggacacttcaaatttcagctctgttacttaccagcttgggcattctgtgagcatcagtttctttatctgttgagtaggg

SEQ ID NO: 44557 - DNA, 201 bp, Homo sapiens
ggccgaggtgggtggatcaccagaggtcaggagtttgagaccagcctggccaacatggtgaaaccctatctttactaaaaatacaaaaaaaaaaaaaaaaattagctgggcgtagtggtgcatgcctgtgatcccagctactcaggagactgaggcaggagaatcgcttgaacccaggaggtggagattaccatgagccga

SEQ ID NO: 44558 - DNA, 201 bp, Homo sapiens
caggtgtccaggccagacagagcagagccggagctgggcctagggaaggcgcttggcggtggctgcaggagccagggccgtgatgggaggtcatggggcasgaggccaggtgacgggactgagggcctgggctgaggacagtgggatgcacgctgtggaagggacactggactggagtcacatctcagccctgccctttcc

SEQ ID NO: 44559 - DNA, 201 bp, Homo sapiens; identical to SEQ ID NO: 10033

SEQ ID NO: 44560 - DNA, 201 bp, Homo sapiens
ttgaggttgcacagcaagttagtacccgagtcagcctgacacccatcatcacctctggtcctcgctgtggtccacccccttctggccttactttgtggggkgtggggttcccattttcctgtcctgctgcccaggccttcatcgtgtgactttctcttctcaggaccaagtgccggacataccatgatgtcatccccatct

SEQ ID NO: 44561 - DNA, 201 bp, Homo sapiens
tccaggccttgcctcccccgaccgccatggagggggcagcccggcacagctgctgggagcccttgtgtgtctggtcacactttttaggcgtcacgccaaargccagcctcctggccccaatacccattttggaagcccctgtggccgtgtggatgtcggtaacagttgtataaaataaattctatttatcgctattgtacc

SEQ ID NO: 44562 - DNA, 201 bp, Homo sapiens
ctgctttgaaaaatataaagctgcactcagagaaacacagagagacacactgaaggaaaagcaaacacaaatctggagaaaaatcttttctaaaaacatcmaatacttctctacagccagaaaaaaaaataataagccttttcttcagtgttttgagagtagtgagaattttttccgtaacttcgcatttccaaagtagtt

SEQ ID NO: 44563 - DNA, 201 bp, Homo sapiens
acagagagacacactgaaggaaaagcaaacacaaatctggagaaaaatcttttctaaaaacatcaaatacttctctacagccagaaaaaaaaataataagscttttcttcagtgttttgagagtagtgagaattttttccgtaacttcgcatttccaaagtagttggcatggctatcaccaggtgagctgggtaagtttcc

SEQ ID NO: 44564 - DNA, 201 bp, Homo sapiens
gggctggagcagaaccctggggcccacacaggctctggcctgtcccctcataccccttagccacgacagaagcggctccaggtctgagttgggagggtgtyctggggcgcccagtggggtacagtgtggggtggctctcagctgagtccctcttcaggtcttggggcgagaaggacccttccccctcatcctgctgcccca

SEQ ID NO: 44565 - DNA, 201 bp, Homo sapiens
ggccccctacgtctgtgtaaattcccagcttggaaacccaagaaatccccagcttcagagctgggaaggagcccacagagatcagctggtccaaccccctygttttacagatagtaattatcatgattatgcctgatgggagcaattcacaaaggactttcacatctgggttgctgctgagtgtgccggagcccttggggc

SEQ ID NO: 44566 - DNA, 201 bp, Homo sapiens
ctgacagttccagtctctttctttcttctaaaatgtttggggaggggcacacttcaagcctgggcttcagctctgtacgtagcgtgttctgctaccctagmctgaagcagtaggttgagaccccaacccagaccctaacatctgtggagtttgctctcccgaaggcgtgggcagccatgaagggcactggggccccttgaa

SEQ ID NO: 44567 - DNA, 201 bp, Homo sapiens
tgtgccagatactttcccaaggttctctcatttaatcctcacaataaccctgtgaagtccacaatttgcagaagaggagccaccgaaagggcctgtgcctwcccccagggtgcacagcagataggagggcctgcgtttaagcctcggtttgtctgccttagaggctggcctcacatctggaacctctgtgatgtttgggga

SEQ ID NO: 44568 - DNA, 201 bp, Homo sapiens
gatttgaaccttgatcttccagactctgtgcagagcccaaaacctcgcctactctgtcccagggccaccaggccacagggagggtctgaacgaaggatgcrcttgagggaagactcagagacaggggccacccagaaggcccaccccagggagccctaagccaagagttagagacgagggcccaggactgattgtaactgg

SEQ ID NO: 44569 - DNA, 201 bp, Homo sapiens
cccaatttttagtagagaaactgaggcttggagaggttatggtgacttaatcctgcacacactgtgatctgggggcagagctagggcttccccatgtcacstttggttaggagatggtgaccttgtctatccccgtgggggtttcgccttggcctgggtggtcaccccgcctggggagttgtgaggggcagggacttctgc

SEQ ID NO: 44570 - DNA, 201 bp, Homo sapiens
tctccctttctgggcatcatctcctgctgctgtgcctagtccatttgagcccctccttctgcaagatggtgtgctatgctcagagcaggggtagactgagsggggataaaagcagaggtgaggaagatgccatcctttccttcagggagttcagtaataacaccactgacaactgccacttgttgggcacctgctatgcac

SEQ ID NO: 44571 - DNA, 201 bp, Homo sapiens
ggggtggagggggtccgggaagtgctgccaccactgcccatcaagcaggaaatccatcccctttcagcaagtagtcttacagtgtgccaggtgcgggggtmgggggggaggcacagcttctagcagggtagacccagcccctgccctctaggagttctgtgatggggagaacccctctcttgctagagggctggggcctct

SEQ ID NO: 44572 - DNA, 201 bp, Homo sapiens
ctgggcaggaggcgagttgtttgttgtcccaacagctgctcagcccctgcccccagcggcaccaaggtgccctcagagggcagtaggagaatctgggcggrgcgggagtgctacccacacatgcgtcctggggctggatctgggtggatttgggggagacaaagtctggggtacccctgaagtcttagggagcagggtacg

SEQ ID NO: 44573 - DNA, 201 bp, Homo sapiens
gaacccttaggccttctgagccaaatgttccagcctcctgggccaaggtcatgctccagctctacctgcccccacaccccctgttagagacttgggtctcrgcgctgtctgggtctggctgagggaaagggctggagcagaaccctggggcccacacaggctctggcctgtcccctcataccccttagccacgacagaagc

SEQ ID NO: 44574 - DNA, 201 bp, Homo sapiens
cttacctctgggcaggaggcgagttgtttgttgtcccaacagctgctcagcccctgcccccagcggcaccaaggtgccctcagagggcagtaggagaatcygggcggggcgggagtgctacccacacatgcgtcctggggctggatctgggtggatttgggggagacaaagtctggggtacccctgaagtcttagggagca

SEQ ID NO: 44575 - DNA, 201 bp, Homo sapiens
ggggctactggattgagggcaccaaccacgaaatcaccagcatccccgagacagagccactgcagtcgcccacaaccaaggtgaagctcgagtgcaacccyacagcccgcatctaccggaagcactttctcggcaaggtgggtggccggctggtgcagcggggctggctggggtgggtcacagttcagccccattcgaggt

SEQ ID NO: 44576 - DNA, 201 bp, Homo sapiens
agggcaccaaccacgaaatcaccagcatccccgagacagagccactgcagtcgcccacaaccaaggtgaagctcgagtgcaaccccacagcccgcatctaycggaagcactttctcggcaaggtgggtggccggctggtgcagcggggctggctggggtgggtcacagttcagccccattcgaggtgggcctgggagggag

SEQ ID NO: 44577 - DNA, 201 bp, Homo sapiens
tgaccttggtacaggtctcttccttctgagacccagcacctgtgtgacgtggctctggggctgcaccctgcattggagtggggctggtcctgagaggtctrtatggggccagggcaagtatcagatgaggttctgagattcccagtgatgcctgcctcctccctgtcacgggaacaccacgcccttcagtggcgtggtctg

SEQ ID NO: 44578 - DNA, 201 bp, Homo sapiens
cattgcactccagcctgggtgacagagcgagactgtctcaataaatatatatagctgagttggaacccactctgtccagccctcttgagcctgtgcccttyctcactggctcacactgccctgctctgtatccaggctgtgtagttatgcatttagagccctggttcctggaaggcagggcttcagccaagcaacgggtta

SEQ ID NO: 44579 - DNA, 201 bp, Homo sapiens
cttatctcctccacactgggagtttacaggggcctgagttccaggaatttttgctgacaaagctgatcaatgctgaatatgcctgctacaaggcagagaartttgccaaactggaggtgaggatgggctgtgagggctgggtgaccctcttctcaccttccaacctataacttcagccctgtccctgggaagggaaaagcc

SEQ ID NO: 44580 - DNA, 201 bp, Homo sapiens
gatgggcttgggcggcgacgaggacaagatggagaatggcagtgggggcggcggcttctttgagtctttcaaggtgaagggccccaggtctaactggccgsggagcagggacgtggctagggcggaatcccgggctgaggctgatagactgatggacacggcgtgggggtggagtctggcagaaggggcgtggctgagggg

SEQ ID NO: 44581 - DNA, 201 bp, Homo sapiens
ggcacactccagggacagaaagaagggtggctgggagtggtgacgtatgcctggagtccacctacctgggaggctgaagcaggaggatgattttagcccakgagttggaggctgcagtgagctatgatcatgcctgtgaatagccactgcactctagcctggacatcatagcaagactccattgcttaaaaaaaaaaaaaa

SEQ ID NO: 44582 - DNA, 201 bp, Homo sapiens
cgttcggctcccgccgcagcagcgccattggcatcgagaacatacaggaggtgcaggagaagaggtgggtgagtgggggacagtgccccattcccctgcayccccatccctgagccccattcggtggcaaagcaaggcaggcagaagggagtgcccgcccctctgcctctccatccccactagtgacagctgtgtggtcaa

SEQ ID NO: 44583 - DNA, 201 bp, Homo sapiens
agcagcctgtgtgtcccagagagtgagagaactgaagtggtgtccccaaggccacccggcaagttggtggcagagccaatacctgagctacccttaggccycgtatgtacctgcttctcatgtgacgcacagggaaattgaggcctggccccacctccctctgttgccctgctggccacatgcccaggggaagggatttcc

SEQ ID NO: 44584 - DNA, 201 bp, Homo sapiens
ggacgtgtcctgttctgggaggatgatgtgggtttacagaggagccgaggagtgagttgggagttagagtggagtaggggtgggcttggcatggcaggacyggggctcacagcaaaactcaggagcgatgaacttaagctttggaatccaacagacctggggtcaaatcccaagcctgcatgtgcttgcaagccattgacc

SEQ ID NO: 44585 - DNA, 201 bp, Homo sapiens
agcagtgtgaggtggtgtggtccaggaaaggtatcctgaaggggcttcagaaatcagggcccccctcctgcttatgggagaggaaactgaggcctaaggtraggaggagaacttgctcaatgcccacagcaaattggtgggacgtgtcctgttctgggaggatgatgtgggtttacagaggagccgaggagtgagttggga

SEQ ID NO: 44586 - DNA, 201 bp, Homo sapiens
agccactgcagtcgcccacaaccaaggtgaagctcgagtgcaaccccacagcccgcatctaccggaagcactttctcggcaaggtgggtggccggctggtkcagcggggctggctggggtgggtcacagttcagccccattcgaggtgggcctgggagggagcagaacccatgggccagggctgggtgacagtcctagagc

SEQ ID NO: 44587 - DNA, 201 bp, Homo sapiens
acttctgaggtgaccccagcagagggtggggtggggtgggaggccagaggctacccttccatatggggtcttgctagctgtcaggtgatgagaggagcctrggctaggccctgagcttcctggccagccaacacgggcagctcacaggctgggtcctgttctatgaccttgggcaagtcctggcttctctgacctcactgt

SEQ ID NO: 44588 - DNA, 201 bp, Homo sapiens
ttttttgtttttgtttttgttttttgagacagagttttgctcttgttgcccaggctggagtgcaatggcgcaatctcggctcactgcaacctccgcctccygggttcaagcgattctcctgcctcagcctcccaagtagctaggattacaggcgcgtggcactactctcagctaatttttgtatttttagcagagatgggg

SEQ ID NO: 44589 - DNA, 201 bp, Homo sapiens
tatctggagcctcacaccttttccagggcagcacaccggccaagggactcaggagcccaggggctgccagaggtcctccctccggccctctctgggtccamgtagggacagagggcaggggcttctcaggaactccagctcaatgaccttggcccctcatccccagacctccgaggaagaactcttcagcaccaatgagga

SEQ ID NO: 44590 - DNA, 201 bp, Homo sapiens
gcctgccggtaactatttctatggacctctctttagtccccaccctcccactccagactctccccatgtcagtgtaccctgcaatatgcaggaacctgtgygtagggatgttcctttgctcacaacccttcagtgactcccaaccttcattcattcattcagtcattcaacaaatagtgaaacttggggagccagagttta

SEQ ID NO: 44591 - DNA, 201 bp, Homo sapiens
atcctgtgcctcctccactgccacccccttcacagcgggtcatccggagccgcagccagtccatggatgccatggggctgagcaacaagaagcccaacacygtgtccaccagccacagcgggagcttcgcgcccaacaaccccgacctggccaaggcggctggaatagtgagtgccctccccctccccaggcccctgcccc

SEQ ID NO: 44592 - DNA, 201 bp, Homo sapiens
aatacagtgtcagccacacagtgggtgctcaatactgaatgaatgggggaaggaatgaaagaccgtacacctgggtgctgcctccagaagggctttgcttycagggcctttcaagccacatgatctgcatggagatgagaaacacatcctcaggggtagggcctgagtgggggcaggtattctggccaggccagattttcc

SEQ ID NO: 44593 - DNA, 201 bp, Homo sapiens
ggcccctctcaagggcccactgtcccagtaccagtggggcctcccgggggccaggcctggctgggaaacttgccacgttggcggccccttggctactctgycaactgggcatgcagaaaccactcaggaatcattcccactgaaaagactggcgaggtataggtccatgtcgaaggggatgcagcagcccagatgtggctg

SEQ ID NO: 44594 - DNA, 201 bp, Homo sapiens
catgtcgaaggggatgcagcagcccagatgtggctggagtccaggccccagcccaagcactgtgcacatcctcatagcccaggcctagctcttcagtcctstgccccaaccgcctcccacctctctgagaggccctgctgctgctgctgctactacttaggaaggagggagggaggaagggagggaggaaggttgttgctg

SEQ ID NO: 44595 - DNA, 201 bp, Homo sapiens
gaaagggctggagcagaaccctggggcccacacaggctctggcctgtcccctcataccccttagccacgacagaagcggctccaggtctgagttgggaggstgtcctggggcgcccagtggggtacagtgtggggtggctctcagctgagtccctcttcaggtcttggggcgagaaggacccttccccctcatcctgctgc

SEQ ID NO: 44596 - DNA, 201 bp, Homo sapiens
cctcgagtgcagcaggctctgaagaagtgcagactggagggtcagaagaggcagctgggcgccgtggcttatacctgtaatcccagcactttgggaggccraggtgggcagatcacttgaggtcagaagttcaagaccagcctgagcaacatggcagaaccccatctctaacaaaaatacaaaaattagccaggtgtggtg

SEQ ID NO: 44597 - DNA, 201 bp, Homo sapiens
cacgccatcactctgtgagctaagagctagtatcatctccattttccagattggaaactaaggctgacggtcacagctcaagactgagtcggggctgggtrcagtggctcttgcctgtaatcctggcactttgggaggctgaggcgggaggaccacttgaggttgggagttgaagaccagcctggccaaaatggtgaaacc

SEQ ID NO: 44598 - DNA, 201 bp, Homo sapiens
gccaacacgggcagctcacaggctgggtcctgttctatgaccttgggcaagtcctggcttctctgacctcactgtctgcagagtcggccttccccatcagstgtccctgggagcccccagccctgccctgcggaggacgtcctcttgctggcagagttgggctgggctccctcctcatccccttcttacctctgggcagga

SEQ ID NO: 44599 - DNA, 201 bp, Homo sapiens
cgtcctggggctggatctgggtggatttgggggagacaaagtctggggtacccctgaagtcttagggagcagggtacgtgtgttggggtgagggtgggggraagctcctcctagatctcctcccagattcgcagacatttgcttcctgggtggatatgagtgaacagcttcaggattgaggcaggctacgggccttggggg

SEQ ID NO: 44600 - DNA, 201 bp, Homo sapiens
ctcccatctggcaccatcgtccccgcagagccctcctgggaagccaggcctggggtgggaggcacacagggtgcctcagctaagctcccagcctgcctttmtatttccctttgatgctctccatgcaacctcaggctgcttcctctccctttctgggcatcatctcctgctgctgtgcctagtccatttgagcccctcctt

SEQ ID NO: 44601 - DNA, 201 bp, Homo sapiens
ctgtctctctctccaatgcctcctatttctctgtctttctgtctcgtctctgcctctccctccccctctctccctcaacacatatctgtgtagataacagyccccccacccgccagctcgcacaccggcatgtgcacctcccctgcccccactcccagcggcacgtgcgttcccgcagagtccccagccctccctgaggct

SEQ ID NO: 44602 - DNA, 201 bp, Homo sapiens
tgctcaatgcccacagcaaattggtgggacgtgtcctgttctgggaggatgatgtgggtttacagaggagccgaggagtgagttgggagttagagtggagkaggggtgggcttggcatggcaggaccggggctcacagcaaaactcaggagcgatgaacttaagctttggaatccaacagacctggggtcaaatcccaagc

SEQ ID NO: 44603 - DNA, 201 bp, Homo sapiens
gggaggtattacccctccaccctccaccccacagccccgtctgcgtttcacataggtatgcatgggaggtgggccgggggtgctgggatgggagtgccttraataccctctgatcttcgatgcctcctgtttctctttctgtctctctctccaatgcctcctatttctctgtctttctgtctcgtctctgcctctccctcc

SEQ ID NO: 44604 - DNA, 201 bp, Homo sapiens
agatgcaggtgaggatggctctgtggcctgttctggggagccacagagctggctgggctggggctggggggcccttgctgcatctccagcccttcacctcyctgaggacaggccacgccagtagaagatggtggctattggttgtccagggtcctctgtctggaggtcagggtagaggatgcccaaccccatctctgatgc

SEQ ID NO: 44605 - DNA, 201 bp, Homo sapiens
ggaggctctgggggcttcccaggcccagcccccagccgggccagccggcagggatgccgccttccaggaaggctcgcagggagttggcgctggagaggccrgggctgccaagcgcagctggcagacaccggattaactctgcgtgtgccctggctcacccgggagagggtagctcgagtgtgcgagggttcaggtggctca

SEQ ID NO: 44606 - DNA, 201 bp, Homo sapiens
agcacatgtgtcagcaggagccgcctgagctgagccttggaggggcagggggagggtcaccatcctggaggctctgggggcttcccaggcccagcccccarccgggccagccggcagggatgccgccttccaggaaggctcgcagggagttggcgctggagaggccggggctgccaagcgcagctggcagacaccggatta

SEQ ID NO: 44607 - DNA, 201 bp, Homo sapiens
atagcacatgtgtcagcaggagccgcctgagctgagccttggaggggcagggggagggtcaccatcctggaggctctgggggcttcccaggcccagccccsagccgggccagccggcagggatgccgccttccaggaaggctcgcagggagttggcgctggagaggccggggctgccaagcgcagctggcagacaccggat

SEQ ID NO: 44608 - DNA, 201 bp, Homo sapiens
actcaagcccaggaggcacttacacagggcttctggataccaggtcctcctccttaggagcctgacctgcaggccttgctgcgggctggagacttaatttrcaggcccaaggcctcagagcccatttgaacccttaggccttctgagccaaatgttccagcctcctgggccaaggtcatgctccagctctacctgccccca

SEQ ID NO: 44609 - DNA, 201 bp, Homo sapiens
atatgggcttgtgacccttcccagagctctgtgtgtgtgtgcgggtgagggctgtgtgaggtttagaccgtggccctcatccttggggattagctacccckgcagttgctggataccttttgagtctcatttactgttgttatgtgaccctgccggggcaggcagggcttgtagccatgagtggggctgcatctgggtctc

SEQ ID NO: 44610 - DNA, 201 bp, Homo sapiens
cttggctggaggcctaatggagagcttggggagagaccctgtccacgtctctgatctccggggaaggagaagcctgtgtggtagccctgctaatgaagccyctcctctccctcctcttggggaacccatgaccctctcctccgtgaagtctatcctccctcacatcccccagctctgagagtgactctcccagagttccca

SEQ ID NO: 44611 - DNA, 201 bp, Homo sapiens
gcagtcacaaacgttgaacctaggtctgtagactgtggcagggaggggcttagggcgaatctaagcaaaacagctgggaataaaccagccccccagctatyttcatcatctccacaatcaacgtcaccatcagtctccttatctgtaaaccaggtgcaatgagaggacccacttcacagggtcattgtgaagattgctgca

SEQ ID NO: 44612 - DNA, 201 bp, Homo sapiens
gttcggagcagcttctcctggtctggggagggggctctggaagactgaatacagacatagcacctgaaatgtgatccaagcggacgggaagggggtaacasgcagggggcacagcgtgtgcagtggcctggaggtgggaaggagcacctcgggtttgaggagcggaaaggagtctggagaaggaggaaagaagccctggat

SEQ ID NO: 44613 - DNA, 201 bp, Homo sapiens
ctggggagggggctctggaagactgaatacagacatagcacctgaaatgtgatccaagcggacgggaagggggtaacaggcagggggcacagcgtgtgcastggcctggaggtgggaaggagcacctcgggtttgaggagcggaaaggagtctggagaaggaggaaagaagccctggatgaggccagagacagtgggcggg

SEQ ID NO: 44614 - DNA, 201 bp, Homo sapiens
cgtgtgcagtggcctggaggtgggaaggagcacctcgggtttgaggagcggaaaggagtctggagaaggaggaaagaagccctggatgaggccagagacastgggcgggtgggaggggggccggggatggggagcagacacgcagggcctcgtgggccacgtgaggcgggcgtctggatcctgcttgcggcgggaagccat

SEQ ID NO: 44615 - DNA, 201 bp, Homo sapiens
cagtatttcatctcatccttggactatgtgatagctactataatcagtcccattttgcagatgagaaaattgaggctcagagaggttcagtcacttgcccraagtcactcaggttggatgtggtggggccacgaccggatgcaagctgtctgaccagagggcctggtgttagggcctctctgatgcaggggtgacaagctc

SEQ ID NO: 44616 - DNA, 201 bp, Homo sapiens
ctagtggtgcagctactcaattctttttttaattataatttttattttaagttccagggtacatgtgcaggatgtgcaggttacataggtaaacatgtggycatggtggtttgctgtacctatcaactcatcaggtattaagcccggcatgcgttagctatttttcctaatgctgtcccgcccccccacccaacgggcccc

SEQ ID NO: 44617 - DNA, 201 bp, Homo sapiens
gtttttgttttttgttttgtagttgatattcactgatggactccaaagaatcattaactcctggtagagaagaaaaccccagcagtgtgcttgctcaggaraggggagatgtgatggacttctataaaaccctaagaggaggagctactgtgaaggtttctgcgtcttcaccctcactggctgtcgcttctcaatcagact

SEQ ID NO: 44618 - DNA, 201 bp, Homo sapiens
tgttaaatatttgtcttaatatcaagcttttgcatatcggggccctcttttataagctttataagcaatcttttgttttctctgcttgctcaaagtagctrtgtttgttgtatctgttagtatttgctctataacaaacatactgggtgccttcccacttagatttggcaattatcactcctgtaaatgagatattacata

SEQ ID NO: 44619 - DNA, 201 bp, Homo sapiens
gcctagagtctggcaaggtgatgtgttgaatctagtgtctgcctgcatgccagcatccctttactgatgagatttgtggttttcatcacttcatggtaatyatcccaagttataagatggagtctctagaaaatcagtagagtatgaaggcccaagtaaaatacatgtgagtgcatgtatgtgtgcatacaaattacttct

SEQ ID NO: 44620 - DNA, 201 bp, Homo sapiens
ccccaacttttatgttaaaagttgcaacaaggtttaagggcttatgtttgataggccagatggtgaccagctgtgataaaacacagggaacccttgcaaargatttcaaaatttatgcagtagtccgccttatctgcagttttgctttccaaggtttcagttacccgcagtcaactgtgttctgaaaatattaagtgaaaa

SEQ ID NO: 44621 - DNA, 201 bp, Homo sapiens
tcagatagggattgcattgaacctgtagatcagtttggggaatattgccatcataacaattagtaggtcttccaacccatgaatacaagacttctttccayttctgtagatatttagtttctttcattaatattttgtagttttcaatataaaagtcttgtacttcgattaaatttattcttgaatattttgggttttgat

SEQ ID NO: 44622 - DNA, 201 bp, Homo sapiens; identical to SEQ ID NO: 10142

SEQ ID NO: 44623 - DNA, 201 bp, Homo sapiens; identical to SEQ ID NO: 10143

SEQ ID NO: 44624 - DNA, 201 bp, Homo sapiens
tattctttgaagattgtgggcaccctgaagtctctgtttgttagtttagtggtcacctaataattaacagagatttcattaaatgcctagaagcaaaataycttccagtctttgcccatggcctctgtgtatgcattagggcaggccttgaactcttacccagggagtttacaaccctgccttagcctttactaccagctt

SEQ ID NO: 44625 - DNA, 201 bp, Homo sapiens
caggggttatagaggtagctcagagagttgggtgcaagtagagaaatccacccggcttgcattacacatcttatttctagagaagctttcctttgaagaargagttctaaggtttaaaaaattaccttgaatgccacttatattgcattttaattttattttagagaaatcaatggaaagtagaaaaattaaggcactgat

SEQ ID NO: 44626 - DNA, 201 bp, Homo sapiens
gaattctttttaaatgtttgtagaattatttttcacttattaggtaaaacgtgtattttttgattttctccaatttcagctttctcatgttgctatgctcmattttgtataccatatatagttttgttaaattgacaaagtggtgttttttgttcttctttttcccattggttaaaatttaaagagaaagtggaagctaga

SEQ ID NO: 44627 - DNA, 201 bp, Homo sapiens
cgcaaaacatctgatggtttaaatatggcagtttcccctgtgctttctctctctcctgccaccatgtaagactttccttgcttcctctttgccttctgccrtgattgtatgtttcttgaggcctccccagctatgcagaactatgagtaaattaaacctcccttataaattacccagtctcagatattctttatagtagtg

SEQ ID NO: 44628 - DNA, 201 bp, Homo sapiens
aaaatatttctcccatcttaatagttttagaaagtaaaaatacttcttgaataaactgtgtagcgcagaccttcccattacagttcatttctatgtatttktttaaatacccacagctcgaaaaacaaagaaaaaaataaaaggaattcagcaggccactacaggagtctcacaagaaacctctgaaaatcctggtaacaa

SEQ ID NO: 44629 - DNA, 201 bp, Homo sapiens
cctcacagtgcttgcctttcattcaggtgccaggaaacgtctgcctgaatgaatgggtgtaatttacctgcacattttacatgcttctctaggtgtgtgawtaactcataatccatccatgactttcacccataatcctccttgtagcaattgctttgcttgcaacaaaactaagtagacatatctagctttatgcatggt

SEQ ID NO: 44630 - DNA, 201 bp, Homo sapiens
ttgtttaaatacccacagctcgaaaaacaaagaaaaaaataaaaggaattcagcaggccactacaggagtctcacaagaaacctctgaaaatcctggtaasaaaacaatagttcctgcaacgttaccacaactcacccctaccctggtgtcactgttggaggttattgaacctgaagtgttatatgcaggatatgatagct

SEQ ID NO: 44631 - DNA, 201 bp, Homo sapiens
cagttgaggtcaggagttcgagaccagcctggccagcatagcaaaaccccatctctactaaaattacaaaaattagccgggcatggtggtatgaatctgtmttcctagctacttgggaggctggcactgagaatcacttgaacccgggaggcggaggttgcagtgagccgagatggcaccattgcactccagcctgggtga

SEQ ID NO: 44632 - DNA, 201 bp, Homo sapiens
ctgttgataagaatctgtgtagacttttttctccttccttcctttgatctttgatcatgggaagacatggaaaaagaaagctaactacagtgattttgtcyactacactgttatttggttaaaaattttagtttcctaatgagtattagcatgtatgagaaattatgggagaaaaaggcgcatcctagaaaaggtgtgctt

SEQ ID NO: 44633 - DNA, 201 bp, Homo sapiens
aatagacaaatacagagaaacagccaagatcagcttactgggaaaagatgccactgaagccaggaagactatggcaatttgggaaaagatgccactgaagycaggaagactatggcaattttgatgaattgctggaggctgagtgaggactagcttcagagttaaaaactcccagggacccagtcttagtgggggtttcct

SEQ ID NO: 44634 - DNA, 201 bp, Homo sapiens
acagtgagaccctatctatctcaaaaaaaaaaaaaaaagaaaagaaaagaaaaagaaaatcctttaactgacttcatcttaaccttttagttcctaaggayggtctgaagagccaagagctatttgatgaaattagaatgacctacatcaaagagctaggaaaagccattgtcaagagggaaggaaactccagccagaact

SEQ ID NO: 44635 - DNA, 201 bp, Homo sapiens
aaaatgcggaagtgactttggaactgggtaacaggcagtggttagaacagtttggagggctcagaagaaaactggaagatataggaaagtttggaacgtcstagagacttgttttgaatacttttgaccaaaatgctgatagtgacgtggacaatgaagtccaggctgaaatggtcccagagatgaggaacttattgggaa

SEQ ID NO: 44636 - DNA, 201 bp, Homo sapiens
aatagtgccaagtaatggtgaggttatacctgtattctgattataatctcataaatatttaccatgttagctgtctcagagttcttttgcaaaacagatamagatagaaagtataaataagaaaaataagtgaacatatactgaactttgtacaagatgctggcgatatggagagacccaagacatgggccctacctaaaa

SEQ ID NO: 44637 - DNA, 201 bp, Homo sapiens
ggctccctgatgaaccacctgccacggcccgtatgaccgcatccaggggtgatgatgtcattttcacagggttattgagagctaaaactacgaagtactayaaactattatttaaaatataaatacatactatatatgcatatgtgtgtatatataattaatggggtaaacattacagaatactgtcctaacctttaaaca

SEQ ID NO: 44638 - DNA, 201 bp, Homo sapiens
ttcacattgacctttccaaggttatcagtgacctgcttgtccttaaattcagtgggcactttccagtaacctactgttggcaccagccctgtgctagacamcaggatcctgtttgtaaaggcatctgccagtggtttctgtgacacaattctgtttctagttttcctccttctacttctctagcctcttggcaagttcttc

SEQ ID NO: 44639 - DNA, 201 bp, Homo sapiens
caattactgatgtttataagtagatttattacaccaaagcacctagcaaattcttgaatggatcaggtcttatttttcagtcttactttgcaaatttaagycaaataattaaggatttgttaaatatttgtcttaatatcaagcttttgcatatcggggccctcttttataagctttataagcaatcttttgttttctctg

SEQ ID NO: 44640 - DNA, 201 bp, Homo sapiens
tttccattatatgcaaagcccatgaaaggctaaatatcagttaagaggggagaggagggtggctcctaggtcctctaatgggcaggaaagtatttaaaacracaatacaaaaagatctagaataaaatagaaaagtacaagttgatgtctgggagtttggtcagggagcataaggtaacactataagaaagtgctatcata

SEQ ID NO: 44641 - DNA, 201 bp, Homo sapiens
gagagaaaaattattcagatgttttcctttgtcaataatacaaggagcatttgtagggaaaaatatttacaaatacagtaagacctattctctttctatayttatgggaaaattttaagttgtgcccttgtttcatgtgtgtttctatttaaagataccatacttaatatatattgttgattcattaacattgaactcatg

SEQ ID NO: 44642 - DNA, 201 bp, Homo sapiens
gtcagagatgttgactagagttaatgcctcttttaggagaggtaccaggtaagtgttctcaaagaactggaaactgagaccaccacctctggcattatctrtttgtgaacacaagcaagtctgaatttttccgcaccatagctacctttcatgtaagcttcttttcttagaagaaaagaaggtaacatttgggtgtaattt

SEQ ID NO: 44643 - DNA, 201 bp, Homo sapiens
tctttctatatttatgggaaaattttaagttgtgcccttgtttcatgtgtgtttctatttaaagataccatacttaatatatattgttgattcattaacaytgaactcatggctaacagcactataaatcatgtctgatcaaaacttatgatacatgtactttcttcgtaaggtacatcatagtcttctcgtacatgggaa

SEQ ID NO: 44644 - DNA, 201 bp, Homo sapiens
tcacacaaatgatacttatcccttggtgtttgatctaaatttctacaatgagaatgtgattttatagtctttactggggaaggaagtaggtttttcaggcygaaattcttgtgtagcaaaaattaacacttaagttagcccttggcaatctccagttctataatggtaaaatggatttcccagaaagtcactctctatccc

SEQ ID NO: 44645 - DNA, 201 bp, Homo sapiens
ccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagt

SEQ ID NO: 44646 - DNA, 201 bp, Homo sapiens
ttctgagcttaaatgtcctcattcataaaatggggctagtaataatgcataaggtttttgtaagaattagaattaataaagtacttagaccataataactmattagtattagttgttgtctttgctattattttgatgtggtggttgtttggtttcacctgtgtactatcaggacatgctgaaataaaatttaagaattgg

SEQ ID NO: 44647 - DNA, 201 bp, Homo sapiens
aagtaaccagaaggaaagaaattttaattcttaaaatgtaatagtttcttggtttttttttttctgtgaaacacctgcatggcacctttttgttattcatmctgttttgactgtggctgtcgtagattcttgttgaaagtctgagagactgagacttgtcattttgaacatggcatcagtggaacagcttatgattcaata

SEQ ID NO: 44648 - DNA, 201 bp, Homo sapiens
ttgcttccaggccacaaacttacagcatgttactgtactgaacactgcaggcacctctaatacatcggtaagtatttatgtatctaaacatagaaaaggtmcaataaaaatacaatataaaagaggaaaaaaatagtacacctgtataggtgcttactgtgaatagggcttccaggattggaagttgctgtgagtcattga

SEQ ID NO: 44649 - DNA, 201 bp, Homo sapiens
acttcagttttgtagacatttttcctaaggccaattatgaaatatcctttcacctagtcatgtgtatataaaatcaccatgttattacagaatttagtaayactgtttttaaaaagtatgattaatccattaaattagaataatgcacccttcatatattatggtactacagtgattcatgaaataattctatataattct

SEQ ID NO: 44650 - DNA, 201 bp, Homo sapiens; identical to SEQ ID NO: 10149

SEQ ID NO: 44651 - DNA, 201 bp, Homo sapiens
tctgctttttggacatttgtgtattttctttgaagaaatgtctttaacattctttgcccattttaaaattaggttgtctttttattgttgagttgtcggtktgtgtgtgtgtgtgtgtgtgtgtgtgtgtgtatctagaatatatgtgtatgtatatatgcagatatattctaaacactagacccttatgaaatatataat

SEQ ID NO: 44652 - DNA, 201 bp, Homo sapiens
taggtacaagtaagtttatgattattatatcttcttgatagattgattcttttatcattatacagtgccctataagaacaatttttatcttaagtctattkgtctatattagtatagccacttcagctttcttttgtttactgtttgcatggaatattttcttcttttactttctatttgtgttcttgagtctaaggtgaa

SEQ ID NO: 44653 - DNA, 201 bp, Homo sapiens
tttgctgctatactttgttaacatattttaggaatatttcattttagtcacaactaggatataaacattattttggtggcgatctccttgtaatcacgacrtcaaccaaatttgggaaattttgatttgttagatttataaattttacagtaacacaaaagtctaatttcctatatattttcaaggcccctatacctttgt

SEQ ID NO: 44654 - DNA, 201 bp, Homo sapiens
gcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtg

SEQ ID NO: 44655 - DNA, 201 bp, Homo sapiens
gaggcaggagaatcacttgaacccgggaggcagaggttgcagtgagccgagatcacaccactgtactccagcttggcgacagagcaagactccgtcttggaaaaaaaaaaaaaaaaagaaacctgaaactagttataagttagagtttcatatccctgtttatataacaagttgtataattaacactgatctcagcattaa

SEQ ID NO: 44656 - DNA, 201 bp, Homo sapiens
atccaaaagtctccttggggtaggattccctgtgattcatgggttgagaggtgtaacattagacacagtcccagtctagattttttttttaaagaattgtrgtccatcctatacacactgggtgccttaatactatatgtggcaattatcactcctataaatcaggttttacataagataggaaaaagaacagtatcattc

SEQ ID NO: 44657 - DNA, 201 bp, Homo sapiens
tccatgtactagttacattataataaagccaaaagcagcaggcctacctgactttctcctgaggtctatcatgagcttagagagaaggaacgtggacatayagaggtagctctagatggagaagggcactaggtgtcatggaaagaatcatgtgcaagaagtaaagaggtgctctgaatgtcctagccctgcttaggtgtc

SEQ ID NO: 44658 - DNA, 201 bp, Homo sapiens; identical to SEQ ID NO: 10140

SEQ ID NO: 44659 - DNA, 201 bp, Homo sapiens
taggccagataattttttcaaaatagaggacaacaaacatgagatgttcccactgaccaatttggaagcctgatcattaccatatcttctcttgcaggtgrttgaaaatctccttaactattgcttccaaacatttttggataagaccatgagtattgaattccccgagatgttagctgaaatcatcaccaatcagatacc

SEQ ID NO: 44660 - DNA, 201 bp, Homo sapiens
gagtacaaaaagaaattgaaacagctggtacagatatttggcattggagagcagctctgaacaaaggtgaattatagtctagtggtcaattttgtggcctrttctttacaaagaattgaacctgatacagttaaccatctaccccaaactattatttgtttaaaacacaatctattggctgggcgtggtggctcatgcctg

SEQ ID NO: 44661 - DNA, 201 bp, Homo sapiens
gcaccaacaaggcagtcactaggtataaaatgaataaaatagtgcctgtattcaagtagtttatctgctagttaggttgcagagtcagtcacaaaatagcrtggcacaccatagagggcatagggccacaggaacaagaggaaggtcacctaattctgtcttggaagtcaaggaagaagtaacattgaattttaaatctat

SEQ ID NO: 44662 - DNA, 201 bp, Homo sapiens
gaccaggctatttaaacttaactgcagagtgtcagcatgttaaacattgatttacataaaatgatagctgcccactttcttgtaaatgttataaaaactgyagagattaactaaaaaatgcacacagaagtttgctttcagttccacaagggtagtttatttttgttataaaaacagtattccccactttcttagatacca

SEQ ID NO: 44663 - DNA, 201 bp, Homo sapiens
ccacaaacttacagcatgttactgtactgaacactgcaggcacctctaatacatcggtaagtatttatgtatctaaacatagaaaaggtacaataaaaatmcaatataaaagaggaaaaaaatagtacacctgtataggtgcttactgtgaatagggcttccaggattggaagttgctgtgagtcattgagtagtgagtga

SEQ ID NO: 44664 - DNA, 201 bp, Homo sapiens
aggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttcca

SEQ ID NO: 44665 - DNA, 201 bp, Homo sapiens; identical to SEQ ID NO: 10145

SEQ ID NO: 44666 - DNA, 201 bp, Homo sapiens
tacagggagtaataaataggatgtggaagatgggttagaattggcaaaatctctgcatgtaagtctgggttactaaatatagtgagagaaattcaaatctstctttaagaatcgaataaaatatttagaaataagttactgttgtatttgaggtgaacacaaatggcatttcaaagatgctcgagataccttgttggaaaa

SEQ ID NO: 44667 - DNA, 201 bp, Homo sapiens; identical to SEQ ID NO: 10147

SEQ ID NO: 44668 - DNA, 201 bp, Homo sapiens; identical to SEQ ID NO: 10148

SEQ ID NO: 44669 - DNA, 201 bp, Homo sapiens
tagcctcggggagtgggggtggggggctggcaagggccgggcgacggtgacgaaagggcagcgcgcgggtgacagcgctggcctcttcctctccctccgcmggcgtcccctggccgggccgagggggaggaacctgacctcggacggcgagcggagccctgtcgaactgccgggggcttcgagcctctcattcctcgcggg

SEQ ID NO: 44670 - DNA, 201 bp, Homo sapiens
aacacccttttctatgtaccctttacaaatagcaactttttttctaaatataaatgctatggtttggctctgtatccccacccaaatctcatcttgaattrtaatcctcacatatcaggggaggggcctggtgaaaggtgattgaatcctggaggcagacttctcctctgctgttctcatgatagtgagttctcatgagat

SEQ ID NO: 44671 - DNA, 201 bp, Homo sapiens
cctagtggagccgtgagaagagggataccatcctccagactccagagtggtagatccactgacagctttcaccatgtgcctggaaaagctgtaggcactcratgctagcctgtgaaagcagctgcagggtctgtacccagcagagccaccagggcagagctgtccaaggccttgggagctcaccccttgtgtcagcgtggc

SEQ ID NO: 44672 - DNA, 201 bp, Homo sapiens
agacctaatttctcttcctttaaactttcttttcctcagttgctatttgattgaaatattgagtcattaaaaatttccaagtgggaatttttgtgtttctkcatctatcatgaagctgctcaaataagtaggtgtttgaataggagtagaaacagtaataggctgaagccagaccaatacagcttcagctaaatgccgacc

SEQ ID NO: 44673 - DNA, 201 bp, Homo sapiens
atttgctgtatttgaaagagcatagtgatagaggtcatgataaaatctaggcccagtgccacaactaaatccctgtaggaactctcaaggttttgatttcwtctctgaatgggaataacaccttccaagaatattatgaagattaaaaagttacgtatcataaatacacacagagtaacaatactgggaatattgcaactt

SEQ ID NO: 44674 - DNA, 201 bp, Homo sapiens
gcattgtacttttaaatgtggcatgctgaatgggagcaggggacatggctttttattctggaagatagaaactactcttctggtaacaaagaatttgattyggagttaactaaaaggttcatttaacaagctgcctcttactaatcggatcaggaagataatgtgactttagagcttatgatgttttccccccgtttttgt

SEQ ID NO: 44675 - DNA, 201 bp, Homo sapiens
ttaacttctctgagtttgcatttttctttgtctatataatggggataataatagtacctacctcacacatagtgttaatttctattagtggttctcattargatagtattgttgttcatccctggttgttagccatcatgtatctgagttagagagtcattgattttagaaagtcccgaggagactatcaggtcaagcaac

SEQ ID NO: 44676 - DNA, 201 bp, Homo sapiens; identical to SEQ ID NO: 10151

SEQ ID NO: 44677 - DNA, 201 bp, Homo sapiens
actatgcgatcaaaaagtttttagtctttcttcttaccatactggttcttggtattctgtttaccattcaatgtactattattgcttctgcttaaaactcrcatcccctaatgcaagcctgagcaaacagaactgataacacacagcctgagaagggagtgcttggggtctcaagacttattctgtttttctccatctttg

SEQ ID NO: 44678 - DNA, 201 bp, Homo sapiens
catttatctatgatgctggtttatttaatctctataatttgctgtatttgaaagagcatagtgatagaggtcatgataaaatctaggcccagtgccacaastaaatccctgtaggaactctcaaggttttgatttcatctctgaatgggaataacaccttccaagaatattatgaagattaaaaagttacgtatcataaat

SEQ ID NO: 44679 - DNA, 201 bp, Homo sapiens
actgaacactaaaacttatttcttctaactgtatttttgcacccgtcaaccattcccgcttcatccccatcaccactatctttcccggtcactggtaaccrccaagccaagaattttggctattttactatttagttcatgtttacttaagcagacagaggtgacaaaactggctttttttttttttttttacattaaaag

SEQ ID NO: 44680 - DNA, 201 bp, Homo sapiens
ccctcctttttctggtaggagtagagggaaggtaaaatttggaaatacgtagcagagtgttcacaacaaaaggcctgccctgtaaggaaaactaattcaayaggcccttatgtgacctgggggaaaggcaaatagaggattctagcccttccttagccttcttgtctcatttctgaaagtcacagcccagggattcagacc

SEQ ID NO: 44681 - DNA, 201 bp, Homo sapiens
aataataattagggcaggcttgctgagcatttttaaactgcactgtttattgtcatgcatttgaatgattatcgcagactttatgaattttcattttatawtaatttgtaggccaggcacagtggctcacgtctgtaatcccggcactttgggaggccaaggcaggcgggtcactggaggtcaggagttcaacaccagcct

SEQ ID NO: 44682 - DNA, 201 bp, Homo sapiens
ttgaacattactggtgtatagaaatgctactgatttttgtacattgattttaaatcctgaacctttaccaaagttgtttatcagctccaggagccttttgrcagagtcttcagggttttctaggtatagaatcataagtgaaaagagatcgtttgattatttattttcctatttggaagccttttatctctttctcttacc

SEQ ID NO: 44683 - DNA, 201 bp, Homo sapiens
atcagaagacttctctgacacctctctatgtctaaaggtcctttgatattctcacatggcggcatgaatcacagtgtattttaactggccttttccttgtrtgtctcctacaatgagctgttgaagcttcatgaaaacacaatctgttttactcagggcagttataattccaattacaaagcacatttcctggctcctggc

SEQ ID NO: 44684 - DNA, 201 bp, Homo sapiens
gggagtttacaaccctgccttagcctttactaccagcttctgcagagcattaaggtcaacaggtggtgagagtttggagcctactccatctttcctgagcrtatacacagccctactcatgcatgtggccctctagatttccaggagtatgttggaccctttcaaagcccttacagactccccagcttttcctctcaatct

SEQ ID NO: 44685 - DNA, 201 bp, Homo sapiens
catgtaaaatatctattgacataggagttttatcaaaatgtgaagtatacagatgaatagtaccacacataaaaagcaaggtgcaaattagccatttataytgttatccccaaaataaatagatgcagtttttttaaaagatgcaggctatatatggaagtgtttgctggttttctgtcaaaagaatggcgactttatttt

SEQ ID NO: 44686 - DNA, 201 bp, Homo sapiens
cgagcggctcctctgccagaggtaagaagcgaggcgggagggggccggggcgcgctcgctcccccgaggtgccgctgggaccggagacaactcgggggccrccgcgggagcctacaaacttttattagcctcggggagtgggggtggggggctggcaagggccgggcgacggtgacgaaagggcagcgcgcgggtgacagc

SEQ ID NO: 44687 - DNA, 201 bp, Homo sapiens
cagatgtaccactatgacatgaatacagcatccctttctcaacagcaggatcagaagcctatttttaatgtcattccaccaattcccgttggttccgaaarttggaataggtgccaaggatctggagatgacaacttgacttctctggggactctgaacttccctggtcgaacagttttttctaatggctattcaaggtaa

SEQ ID NO: 44688 - DNA, 201 bp, Homo sapiens
taccactatgacatgaatacagcatccctttctcaacagcaggatcagaagcctatttttaatgtcattccaccaattcccgttggttccgaaaattggartaggtgccaaggatctggagatgacaacttgacttctctggggactctgaacttccctggtcgaacagttttttctaatggctattcaaggtaagatcag

SEQ ID NO: 44689 - DNA, 201 bp, Homo sapiens
ccacaactcacccctaccctggtgtcactgttggaggttattgaacctgaagtgttatatgcaggatatgatagctctgttccagactcaacttggaggawcatgactacgctcaacatgttaggagggcggcaagtgattgcagcagtgaaatgggcaaaggcaataccaggtaagatgcaaaacataaaagagcaacta

SEQ ID NO: 44690 - DNA, 201 bp, Homo sapiens
tcgtctgagacgcaccttgtcacgtttctgccgccaggaatcatgtaggaatgattccagtcgcttaaacctgagcccttttcctttcttctgtcttgctactgccatctttctagtggtgcagctactcaattctttttttaattataatttttattttaagttccagggtacatgtgcaggatgtgcaggttacatagg

SEQ ID NO: 44691 - DNA, 201 bp, Homo sapiens
gcattaaggtcaacaggtggtgagagtttggagcctactccatctttcctgagcatatacacagccctactcatgcatgtggccctctagatttccaggartatgttggaccctttcaaagcccttacagactccccagcttttcctctcaatctttagactagtgtgttgttttcttcaacagttatctgtcaggcagca

SEQ ID NO: 44692 - DNA, 201 bp, Homo sapiens
cactttccagtaacctactgttggcaccagccctgtgctagacaccaggatcctgtttgtaaaggcatctgccagtggtttctgtgacacaattctgtttstagttttcctccttctacttctctagcctcttggcaagttcttctttcagagtttctcagagctttgtgctaggccctcttctcattttctccttctcta

SEQ ID NO: 44693 - DNA, 201 bp, Homo sapiens
ccaatttggaagcctgatcattaccatatcttctcttgcaggtggttgaaaatctccttaactattgcttccaaacatttttggataagaccatgagtatkgaattccccgagatgttagctgaaatcatcaccaatcagataccaaaatattcaaatggaaatatcaaaaaacttctgtttcatcaaaagtgactgcctt

SEQ ID NO: 44694 - DNA, 201 bp, Homo sapiens
taaagataatctgaaaatgcggaagtgactttggaactgggtaacaggcagtggttagaacagtttggagggctcagaagaaaactggaagatataggaargtttggaacgtcctagagacttgttttgaatacttttgaccaaaatgctgatagtgacgtggacaatgaagtccaggctgaaatggtcccagagatgagg

SEQ ID NO: 44695 - DNA, 201 bp, Homo sapiens
cctcccaaagtgctgggattaccgtgccagcctgatgttactattttaattgttttcaggcaccataaacctcacctgtataaggcaccgtacttaattgrtaaatattgcgcatgatctgactgctcttccaactggccattccctgtctgtctccctcttcctgggactctcaaatccctgagagacaataatattaaa

SEQ ID NO: 44696 - DNA, 201 bp, Homo sapiens
tcttatggacaaatgagcaaataaatttttttcttgagatggaatctactcctggtgaagattctgtgaaccttgttgaaataacaacaaaggatttagartattacataaacttaattggtaaagcagcagcatggtttgagtggattcattccagttttgaaagagtttctactgtgggtaaaatgctatcaaacagca

SEQ ID NO: 44697 - DNA, 201 bp, Homo sapiens
tacagtaagacctattctctttctatatttatgggaaaattttaagttgtgcccttgtttcatgtgtgtttctatttaaagataccatacttaatatataytgttgattcattaacattgaactcatggctaacagcactataaatcatgtctgatcaaaacttatgatacatgtactttcttcgtaaggtacatcatagt

SEQ ID NO: 44698 - DNA, 201 bp, Homo sapiens
aacgagccaactctacacagacagtggccctggacagagctgggcaggcatcagttttttttcttttttttgtggggggtgagggtggggcatggagtctyactctgtcacccaggctggattgcagtgcagtggtgtgatctcagctcactacaacctccacctcccgggttcaagagtttctcctgcctcagcctccca

SEQ ID NO: 44699 - DNA, 201 bp, Homo sapiens
tgaggcaggggaatctcttcaacccaggaggcggaggttgcagtgagccaagattgtgccattggactccagcctgggcgacagagcgagactctgtctcaaaaaaaaaaaaaaaaaaaaaaaatcatctttaaagagataactaacccttccccagaaggcagggccaaagtctaaggttcttccaggtcctttgtattc

SEQ ID NO: 44700 - DNA, 201 bp, Homo sapiens
tttggaacgtcctagagacttgttttgaatacttttgaccaaaatgctgatagtgacgtggacaatgaagtccaggctgaaatggtcccagagatgaggarcttattgggaactggagcaaaggttatttttgctatgctttagcaaaaagactggcagcattttacccctgccctagagaactgatgaactttgagatga

SEQ ID NO: 44701 - DNA, 201 bp, Homo sapiens; identical to SEQ ID NO: 10134

SEQ ID NO: 44702 - DNA, 201 bp, Homo sapiens
aaatttgctgttctggtattaccaaaccacacatttgtaccgaattggcagtaaatgttagccatttacagcaatgccaaatatggagaaacatcataatwaaaaaatctgctttttcattatgtgactccaacatgcttttgtagaacttgtacagttccgattgtccaatctgatttttgtttactgaaagtagagtta

SEQ ID NO: 44703 - DNA, 201 bp, Homo sapiens; identical to SEQ ID NO: 10137

SEQ ID NO: 44704 - DNA, 201 bp, Homo sapiens
tttaaaatgccacctaaaattgtttttatcagaatacttaaaaaaaaatcctcactttattctctgggggtgggaagaggcaattccttccttccaccacracattgaattatcacataaaattgtaaaattatgaatattatgattgagcttagtaaagcattttctaagttcatttatagtaaaacaagagaaacctta

SEQ ID NO: 44705 - DNA, 201 bp, Homo sapiens
ttttccctgtctcagcaacccgagtagctaggattacaggtatgccaccatacccgctaatttttgtatttaatagaaacagggtttcgccatgttgacargctggacttgaactcctcacttgaactcctcacgtcaagtgatctgcctgctttagcctcccaaagtgctgggattacaggcatgagctaccgcgcctgg

SEQ ID NO: 44706 - DNA, 201 bp, Homo sapiens
gagtcatggaaaatatacattgatgattcctgttgcataaagagttttcaagaaaattttgttgaattaagctataactacaaaaaaaaatccattacatrttgacctttagaaaggatttttaaaagcccatgctgtccttatttctgcagcttcagagagccgactgctcttattttcttctggcatattctattaata

SEQ ID NO: 44707 - DNA, 201 bp, Homo sapiens
gggagctgaaataaaagcatgtgttaaatataccatctttaaccagaactacatttgactggtcattttattttcaagctcacatacacttcaaacagagrtatggctaaaggaattatcatgtgaacaacagccagggctctgaacatcacagattatatcatcatacttgaaatatttgaaattttgattcaaaatgag

SEQ ID NO: 44708 - DNA, 201 bp, Homo sapiens
tctggcatattctattaatacttgggttttgtatttttcaagtaaataaaatattcctattgagaatttcaattttaaaaaagaaaaggtctactaagtgytcctttccctgttgaattatgtgtgatcatttctatgctaaactagattagggtgtgacttgtgatggtgatttttgttcattttacatattaagaaaga

SEQ ID NO: 44709 - DNA, 201 bp, Homo sapiens
aaattaatttttgcaatacttttatgaagatacaaactctgacaaagcttttaaaacaagtttgagagaatacagtattgatttcacttgtaaatctgacrattattttagaaaaaaggaaaatattatttactattattttgcttataaatgtttatcaattttaaagcttccacattgcacatctcccactacaacagt

SEQ ID NO: 44710 - DNA, 201 bp, Homo sapiens
tgatagcccaggttatcttccccagatagaaataagccttaagactgacaggtgtatatgaatacagagagtatacataaagaagatgtattttcaattgwcagtctctaaatttgctttaagacttcgaaatggattgcttttcataatttcttagaataactctggtctgtttaccattgaaaaattagagtagccaat

SEQ ID NO: 44711 - DNA, 201 bp, Homo sapiens
ttagtaaagccctccaaatgtttctggtattgcttctaagaacaattgataacataatagctgtggccattataggggtattctgtcatatttagatatargcataccttgttttattgtacttcccaaatattgcgtgtttattttgttttgtttcacttacaaattgaaggtttgtggcaaccctatattaagcgagtc

SEQ ID NO: 44712 - DNA, 201 bp, Homo sapiens
gtgatgcttagtggttaagttctgatttgtgttttcttgaagttattaaggaactttatgataacagtttatatattccctcttcttggcatagtaatgargtaatagagactattcacctctaagcctgattttttaaataagtgtttattttatgtttaagtaaggtaggtctgcttttggcttggacttgaatttggc

SEQ ID NO: 44713 - DNA, 201 bp, Homo sapiens
catgattcatgatcaaaatgaacattataaggctatccctcttcagaattaaatacgttactcctgtggaaaacttgcttttaatgtagaagttgtcccaragcctttcttcctttctcatgtcctcttatgtccactgctgagctaacatgggtctcactgaatgattaagaaaaaacatcttaggtggggagttctgta

SEQ ID NO: 44714 - DNA, 201 bp, Homo sapiens
ttctaatctttctcgagtgaggaaaatgtcagcagatagtgaatatcactgagagagagatgatagcccaggttatcttccccagatagaaataagccttragactgacaggtgtatatgaatacagagagtatacataaagaagatgtattttcaattgtcagtctctaaatttgctttaagacttcgaaatggattgct

SEQ ID NO: 44715 - DNA, 201 bp, Homo sapiens
tatcgagtattatgtactgtacacagttgtatttgctgtacttttctataactggtagcacggtaggtttgtttataccagcatcaccacaaacataagcwtggtgttgtattacaatgcacagctgcagctaagtgataggactttttcagctccattataattttatgggaccatcactataaatgctgtccatcattg

SEQ ID NO: 44716 - DNA, 201 bp, Homo sapiens
cctactgaaaacttttttcagtcttaaattttttatctaactggctgtattgcagatgtctgctatataacttttatataattttaaaaactatttctttyctccttgatcttctaggggtaaggttaccaatgttttcattatttactaaatatagcagcccccaccccttattcatggaggataggttccaaaacccct

SEQ ID NO: 44717 - DNA, 201 bp, Homo sapiens
aaaaccatttaacagaaatattgtgaaaggtttcccctaaagcatttttctatttgatttgaaaactattccatagcttattatcaaacaaatcagtaatyctttagctaatgcagagataaatgggcagtcagaaaatataatcacctggtgtgtgcagctgagtatttacatttttcctaatgaacaaagataagaaaa

SEQ ID NO: 44718 - DNA, 201 bp, Homo sapiens
gggagctggggcgggggcttcccgcacgggcacccctcgccccacggccctctcctttctcaggacggaccacgagttcccttccccttggactgaggggraagctcctaacaggaacatctgtagggagttgaacgctggcattttaaagctgcctgtattttgttttatttgtaggggcaggggtcctatgaacgtgat

SEQ ID NO: 44719 - DNA, 201 bp, Homo sapiens
atcgagtattatgtactgtacacagttgtatttgctgtacttttctataactggtagcacggtaggtttgtttataccagcatcaccacaaacataagcakggtgttgtattacaatgcacagctgcagctaagtgataggactttttcagctccattataattttatgggaccatcactataaatgctgtccatcattga

SEQ ID NO: 44720 - DNA, 201 bp, Homo sapiens
aatagcatggcacaccatagagggcatagggccacaggaacaagaggaaggtcacctaattctgtcttggaagtcaaggaagaagtaacattgaattttamatctataagctgagtaggaattagatagatgaaaaataagggcagagacatgatcagatttgtattttacaaagactaatcttacatggagagaccaatt

SEQ ID NO: 44721 - DNA, 201 bp, Homo sapiens
tttcccttcactgcagtatgataattactttcaagcacaaaggtttagaattaagatttcttactcctgggctaggtatggcttaccgtatttgtttctcytttcctagggatcataatcatgtattgcttgttgtccagttttccagtaggaggggaattccaggctgtacttacttcctgcagccaaaagaggaagtaa

SEQ ID NO: 44722 - DNA, 201 bp, Homo sapiens
tcgagtattatgtactgtacacagttgtatttgctgtacttttctataactggtagcacggtaggtttgtttataccagcatcaccacaaacataagcatkgtgttgtattacaatgcacagctgcagctaagtgataggactttttcagctccattataattttatgggaccatcactataaatgctgtccatcattgac

SEQ ID NO: 44723 - DNA, 201 bp, Homo sapiens; identical to SEQ ID NO: 10146

SEQ ID NO: 44724 - DNA, 201 bp, Homo sapiens
ggacatttattatatgaagtctactgtagtgtaaactctgtagacttaggctacactaaatttatagaaaaattttcttcaataataaattaaccttagcstactgtaacttttttactttgtaaacttttaatttttttaacattttgactcctttttagtaacacttagcttaaaacacacacattgtacagctgtaaa

SEQ ID NO: 44725 - DNA, 201 bp, Homo sapiens
gagcaactatataaacctttgtgttttcttcagcaaaaacactttggcttttatatcatcgtgagcccatggcttatcttgtttctcttagttctggggaytatgaaggggagagtcaggtgaatacaggtgatagggagtttataataaaacatttacattactccctgcttttcaaatcattatgcacaggatggtaat

SEQ ID NO: 44726 - DNA, 201 bp, Homo sapiens
cccacccaaatcttatcttgaattgtaatccccatatattgagggagggacctggtgtgaggtgtttggatcatggaagtgatttcctccatgctgttctygtgatagtgtgggagatcgcaaaacatctgatggtttaaatatggcagtttcccctgtgctttctctctctcctgccaccatgtaagactttccttgctt

SEQ ID NO: 44727 - DNA, 201 bp, Homo sapiens
tattatcccagcaatttgggaggccaagatgggaggattgcttgaggcctggagtttgagaccagcctgagcaacataacgagaccccgtctctacaggaaaaaaaaaaaaaaaaaaaacgttatccaggcatcgcacctgtagtctcagctactcaggaagctaaagcaggagattcaggctgcaaagagctatgacaca

SEQ ID NO: 44728 - DNA, 201 bp, Homo sapiens
aatgatgtttcccttgtagaataagttagggatgaggccctctttctagattgcttttttagaatagttttagtaggattagtaccagctcttctttgtayatctggtagaatttggctgtgaatccatctggtcaagggctttttttaattggtaggttttttattattgattcaatttcagaactcgttattggtctgt

SEQ ID NO: 44729 - DNA, 201 bp, Homo sapiens
ttcatggcagcccttcctatcacaggcctggaggtctaggaggaaaaaatggtttcgtgggccaggcccagggttgcgctgctctctgcagcctcaggacrtggtgccctgcatcccagctgctctagctccagctgtggctaaaaggggccaggagataatcttgggctgttgcttcagagggggtaagcctcaaacctt

SEQ ID NO: 44730 - DNA, 201 bp, Homo sapiens
cactaaaataacttcaggagtatgaataagtctactaaaaagtctacaggatccatgttgtagtttgagtagatggttccataccaagtcaaggtaaaagwtaatttatatataatatgaaaatggctgctttaggtttatagagtaatcaatataaatcttccttataaaagggaaatttcccacttataatttatgtaa

SEQ ID NO: 44731 - DNA, 201 bp, Homo sapiens
ggaggcggaggttgcagtgagccgagatggcaccattgcactccagcctgggtgacagagcaagactttgtctcaattaaaaaaaaaaaaaaaaaaaaaamcacaagagggtttgtgagtcttaaagtgtcagatgacagaagaaaactgtgtctacctagtatttaatttccattttctgttaggggtgcccttgttttg

SEQ ID NO: 44732 - DNA, 201 bp, Homo sapiens
tccagggttcaagtgattctctgcctcagcctcccgaatagctgggattacaggcgcactccaccacacttggctaattttttgtatttttagtagagacrgggttttgccatattggccaggctggtcttgaactcctgacctcaagtgatccacccactttggcctcccaaagtgctgggattacaggtgtgagccacc

SEQ ID NO: 44733 - DNA, 201 bp, Homo sapiens
cacttggctaattttttgtatttttagtagagacggggttttgccatattggccaggctggtcttgaactcctgacctcaagtgatccacccactttggcmtcccaaagtgctgggattacaggtgtgagccaccgcacccagccctccacccttttttcttagcccactatgtttccatactgctctggtgtctgtgaca

SEQ ID NO: 44734 - DNA, 201 bp, Homo sapiens
ttttgttttttgttttgtagttgatattcactgatggactccaaagaatcattaactcctggtagagaagaaaaccccagcagtgtgcttgctcaggagargggagatgtgatggacttctataaaaccctaagaggaggagctactgtgaaggtttctgcgtcttcaccctcactggctgtcgcttctcaatcagactcc

SEQ ID NO: 44735 - DNA, 201 bp, Homo sapiens
gcctccaagagagcatggtaaactaattagcatggttctatcatgattctgtttctattttgaactattaataaaaatttttgcaattctcagttaccccatttagtatagaacacaataagaatggaaccattctattctaacattgtacattgagatatcgttcccaccaccatatctgtcctccatagactatatggt

SEQ ID NO: 44736 - DNA, 201 bp, Homo sapiens
actaaaataacttcaggagtatgaataagtctactaaaaagtctacaggatccatgttgtagtttgagtagatggttccataccaagtcaaggtaaaagataatttatatataatatgaaaatggctgctttaggtttatagagtaatcaatataaatcttccttataaaagggaaatttcccacttataatttatgtaat

SEQ ID NO: 44737 - DNA, 201 bp, Homo sapiens
tacacctggaatgcagtaagaaaaatacggatttctgtacatcatcttccctccctgctcttacccccatttaagagttacagggtcagaacccaagagtstgagtttttgaaagtccctaaaaattttggatgatcacctacatttagaaccactgcactaagaaggacaacaaatatgccaataaattctgttgccaag

SEQ ID NO: 44738 - DNA, 201 bp, Homo sapiens
attgatctcattgctccttggcaattcccacagagatgatcttctgaagagtgttgcctcatacctttatttctcttaattcaggtttcaggaacttacayctggatgaccaaatgaccctactgcagtactcctggatgtttcttatggcatttgctctggggtggagatcatatagacaatcaagtgcaaacctgctgt

SEQ ID NO: 44739 - DNA, 201 bp, Homo sapiens
tgtcagatttataaccaaatattactgaaactaatttttttaagttcaaaaacccaatctagtagtttctctcttattttcaacttttattttagattctrggggtacatgtacaggtttgttactaagatacattgtgtgatgccggtgtttggagtatgattgaacctttcatctaggaagtaagcacagtacctaaca

SEQ ID NO: 44740 - DNA, 201 bp, Homo sapiens
gacacttcaaaagaaatgacctcattcttaattttgtttaaagaagaatataacatgatttgaatatatttagctaggatattttagtgcctgctagcacytgaagccagagttcactgtgagcattctgactatgaagtgagaagctaagagaactgtattttgatattcctttgacagttaaatcataacactgttctt

SEQ ID NO: 44741 - DNA, 201 bp, Homo sapiens
atggcagaaacagagaggtatatgagctgcatagggatctctgttgataagaatctgtgtagacttttttctccttccttcctttgatctttgatcatggraagacatggaaaaagaaagctaactacagtgattttgtccactacactgttatttggttaaaaattttagtttcctaatgagtattagcatgtatgagaa

SEQ ID NO: 44742 - DNA, 201 bp, Homo sapiens
gaataatgcacccttcatatattatggtactacagtgattcatgaaataattctatataattctacatacaatcaaagaaatataaaatgtgttttgtacrgaagtgcttatttttcatctggggaattccagtgagattggtatattctaggccagataattttttcaaaatagaggacaacaaacatgagatgttccca

SEQ ID NO: 44743 - DNA, 201 bp, Homo sapiens
acacctataatcccagcactttgggaggctgtgggcagatcacttgaggtcaggagttcgagaccagcctgaccaacatggcgaaaccccgactctactamaactataaaaagccgggtgtggtggtgcatgcctgttatcctagctactcgggaggctgaggcacaagaatcatttgaacctgggagatggaggttgcag

SEQ ID NO: 44744 - DNA, 201 bp, Homo sapiens
ttgagttaatgctggaaggagttaagacttccggggactattgagaatgcaagattgtgttttgaaatgtaagaacatgagatttaggaggggccgggggyagaataatatggcttggctgtgtgtccccacccaaatctcaatcacttgtaatccccacatgtcaggggaggggcctagtgggaggtgactgaatcacaa

SEQ ID NO: 44745 - DNA, 201 bp, Homo sapiens
aggtatatgaaaaatctctgtaccttcctcccaattttgctgtgaacttaaaactgctctaaaaaaagtcttttttaaaaaaagctctatgaactagttgstattataaaccttaggccatttcaagtaaaaattacatatcaatgtttattaaatactgagttaatagctgaatacctctttcatatacaaataagtaca

SEQ ID NO: 44746 - DNA, 201 bp, Homo sapiens
gtatatgaaaaatctctgtaccttcctcccaattttgctgtgaacttaaaactgctctaaaaaaagtcttttttaaaaaaagctctatgaactagttggtattataaaccttaggccatttcaagtaaaaattacatatcaatgtttattaaatactgagttaatagctgaatacctctttcatatacaaataagtacatt

SEQ ID NO: 44747 - DNA, 201 bp, Homo sapiens
tgcatagtataacccaagacatggccaactttttctgtaaagggccagatggtaaatgttgttagctttgcacagtctctgtcacagctactaaactctgyccttgtggcaggaacatagtcattgacggtactcaaatagaacaggcatggctgtgttccaataaaactttatttacaaatacaggctgcaagtaggatt

SEQ ID NO: 44748 - DNA, 201 bp, Homo sapiens
ctcgacctcataatggcaatgtaggcaagaacattccctcaaggcaatacctgtgggtgtcttggttatattccaccggaaacaaagacagaggctgtccktataaaatatgtttgaagacctgtgaaactttaatagtgccttttattccatataggacagcacaattacctatgtgctggaaggaatgattgcatcatc

SEQ ID NO: 44749 - DNA, 201 bp, Homo sapiens
taatgtgtaaaattaacccattgttaatatagaatgccgttatcactcctgattaagcggtcttcattttcatgttaatactgatgtcttgtaatgctttmtggaatcaaacattttcatacatattcattagtctaattctaatcataatccaatgaaaaagagcaggaaagatgctcaaggaggttatattcaagtcca

SEQ ID NO: 44750 - DNA, 201 bp, Homo sapiens; identical to SEQ ID NO: 10135

SEQ ID NO: 44751 - DNA, 201 bp, Homo sapiens
ttcttctgtcttgctactgccatctttctagtggtgcagctactcaattctttttttaattataatttttattttaagttccagggtacatgtgcaggatktgcaggttacataggtaaacatgtggccatggtggtttgctgtacctatcaactcatcaggtattaagcccggcatgcgttagctatttttcctaatgct

SEQ ID NO: 44752 - DNA, 201 bp, Homo sapiens
tgttgtagtttatagtttcattgggcattttcagtagttttatctgaagtcacatttcaaattttgtaattgaagctccaaagtatgctaccggaaacacragctgatgctgtgagacaaaatcaacaggtaatccaccatcacaactgtgggctagaatgctcaagaaaccttggaggcccagagagctgagatgaatac

SEQ ID NO: 44753 - DNA, 201 bp, Homo sapiens
ggccatagccccccacctcatctgatggtatcctctggcagccacagaccacacagttctttctacctaaattagtcattagcacatagtaggtacccagwaaatgtttgttgaattaatactgtttatatatttctaatttatctccaagtaaatccagtctccttaaggacaaggaacgttttcactataacacctagc

SEQ ID NO: 44754 - DNA, 201 bp, Homo sapiens
tctagcacacactgtgtgtagacatcttgttaaatagaaaatagatttatgggtatgactatgaagagtctaattccccaaaccacacacacaactctatmtacgtttgaccaggctatttaaacttaactgcagagtgtcagcatgttaaacattgatttacataaaatgatagctgcccactttcttgtaaatgttata

SEQ ID NO: 44755 - DNA, 201 bp, Homo sapiens
actaaaaatacaaaattagccaggcgtggtggcacatgcctgtaatcccagctactcgggaggctgaggcaggagaatcgcttgaacctgggaggcggagratgctgtgagccgagattgcaccattgcactccagcctgggcaacaagagtaaatctccgtctcaccaaaaaaaaaaaaaaaaagaaaagaaaaaaaaaa

SEQ ID NO: 44756 - DNA, 201 bp, Homo sapiens
agtccacatgtccctgcaactttaccctgtactacgaggtggctgcacggggcaatattgtgctatcgggccagcagcctgcccacaccacccagcagcgmagcaagcgggcggcccctgccctggagaaaccgattcgtttaacacacctttctgagacaggtgagccgggcagcagggagaaggttcctgttcttcctt

SEQ ID NO: 44757 - DNA, 201 bp, Homo sapiens
ctcctgcaaggagggacaaggcaagacccagcagagaggggagcatgccttgggtcagaggggacacatccttaacaataccagactgggtccaggaagamagtgatcagctgctggaagtggagaggttcaggccccagactcttctcactctgtgtgtgcaggggacagggaaagccagccacagactaggctcttgca

SEQ ID NO: 44758 - DNA, 201 bp, Homo sapiens
tccacagtatgatgacctaaagagtctccagatattgccactatccccagggggcagagtcacttccaggtgaggacactgagataggtaggtagatagayagaatgatgggtggatagatagataggcaggatctctcaggcgaaggcaaggtttctcaaccttggcactatcaacatttgggcaagatcattctctgtg

SEQ ID NO: 44759 - DNA, 201 bp, Homo sapiens
ctctactaaaaatacaaaattagccaggcgtggtggcacatgcctgtaatcccagctactcgggaggctgaggcaggagaatcgcttgaacctgggaggcrgaggatgctgtgagccgagattgcaccattgcactccagcctgggcaacaagagtaaatctccgtctcaccaaaaaaaaaaaaaaaaagaaaagaaaaaa

SEQ ID NO: 44760 - DNA, 201 bp, Homo sapiens
tccccagggggcagagtcacttccaggtgaggacactgagataggtaggtagatagacagaatgatgggtggatagatagataggcaggatctctcaggckaaggcaaggtttctcaaccttggcactatcaacatttgggcaagatcattctctgtggtggaggcactgtaggatattgagcagcatccctggcctccac

SEQ ID NO: 44761 - DNA, 201 bp, Homo sapiens
aaggtaacttgggggtgactgtgctgcctcccgcccaaggaccaccgtgaaaccaccaccactagccactagctctgcagtggtgactcagctgaaaacgratcccctgacataacctttgcggagagtggagagggctggtgttccaggtgaggggcaggggacattttcctccacgggaaaggacaatctactctattc

SEQ ID NO: 44762 - DNA, 201 bp, Homo sapiens
atcccatgcactgtaggatgctgaatagcatctctggcttctattcaccggaagccagtagcatcccctccagcagtgatgaccaaaaaacatccgcagayattgccagcatcccctgggtagcagaattgccttggctgagaactgctggccagagtcctgctttgggcatggtgcaccttcaccctcttggtcttctct

SEQ ID NO: 44763 - DNA, 201 bp, Homo sapiens
tgcactgtaggatgctgaatagcatctctggcttctattcaccggaagccagtagcatcccctccagcagtgatgaccaaaaaacatccgcagatattgcyagcatcccctgggtagcagaattgccttggctgagaactgctggccagagtcctgctttgggcatggtgcaccttcaccctcttggtcttctcttctctt

SEQ ID NO: 44764 - DNA, 201 bp, Homo sapiens
atggtgaccctagagctgagtcaatagaaagagtcagcattgactgaggatgtagcctgggaagggcatctcaaaaccaaagatgcagactgtctcaatgygtagacaggagcatagcgcagggcaaattggggcagagcctgaatggctgaggttgcatgtcggatgcggagaattcaccacctctctctacttttgctc

SEQ ID NO: 44765 - DNA, 201 bp, Homo sapiens
gctgcgaccacgactgcggcgcccaggggaacccggtgtgcggctccgacggggtggtctacgccagcgcctgccgcctgcgggaggccgcctgccgccargccgcgcccctggagcccgcgcctcccagctgctgcgccctcggtgaggaccctaccccccgcctagcctcggggacaccatcgctgctgctctgggcca

SEQ ID NO: 44766 - DNA, 201 bp, Homo sapiens
aggactgggaaaatccttacattgggcacatgctaggctagcctgagttcactccgtgtgtctgtccccctccaccaccaacaggacccccgaggctctcrgatgatagagtggagacacttaaagccgttctgctgcggtaagtttcttcctctgcggcttgggggctgcagatgtgataaaccttccaggaaaacagaa

SEQ ID NO: 44767 - DNA, 201 bp, Homo sapiens
ccagactcttctcactctgtgtgtgcaggggacagggaaagccagccacagactaggctcttgcactggcccacattgtgctgttgcctctttgcccaggyggttctgcctatgagtcctcttcctcttctctttttgacaccatgtgctcctcataaggccctcctcccaggggacttccttagtcccctcctcttcaaa

SEQ ID NO: 44768 - DNA, 201 bp, Homo sapiens
gttcttccttctgaacaattgagactgagatgggtgctcctgcaaggagggacaaggcaagacccagcagagaggggagcatgccttgggtcagaggggayacatccttaacaataccagactgggtccaggaagacagtgatcagctgctggaagtggagaggttcaggccccagactcttctcactctgtgtgtgcagg

SEQ ID NO: 44769 - DNA, 201 bp, Homo sapiens
cctagagcatcaatgccagccaggtgtggtcagcaaaaggcaggagtctgctgcgaggagagccctgacctagctgtggtggcagcgagaccaggggtctkgggtgagaacttcacctcggatctcctttcctgcaggggttacttgattgcagctccctctgtttttcgcgcgggcgtggaggaagtcatcagcgtgacc

SEQ ID NO: 44770 - DNA, 201 bp, Homo sapiens
cacgtagtagtagatgaagggatccacgcagctgttgagggtgctcagcgccaggctgggcacgtaggcaccatagaggttgccccaggcgctggggctcrggtccgagtaatgcagcagcagcagcaggttgctgggcacgaagaaggccacggcggaggccagcaccactgcggtcagcctcagcgcgtggccgtagcg

SEQ ID NO: 44771 - DNA, 201 bp, Homo sapiens
catcttctgtcccgattccaggctgcagggagggctgtcaggacaggatgcagggtgtggagggagctgcatccatcactgtactagtggccacactatgycaacctggccttcctgaggctgggccctccctgccatcttggctgtgaaattgagcatgctttatccttttgttccaggtatacctttgggaaacctgtg

SEQ ID NO: 44772 - DNA, 201 bp, Homo sapiens
tgtcggatgcggagaattcaccacctctctctacttttgctcacctcagagcccccaccagccccagaagctgaggtcgacgtgtgtgtgacctctcttcrtctggccgtgacccccagcatggtcccccttggtcgcctgctggtcttctacgtcagggagaatggagaaggggtcgccgacagccttcagtttgcagtc

SEQ ID NO: 44773 - DNA, 201 bp, Homo sapiens
atctggaggcttggtgcagaggatcggagggccttggcatcttctgtcccgattccaggctgcagggagggctgtcaggacaggatgcagggtgtggaggragctgcatccatcactgtactagtggccacactatgccaacctggccttcctgaggctgggccctccctgccatcttggctgtgaaattgagcatgcttt

SEQ ID NO: 44774 - DNA, 201 bp, Homo sapiens
atgggaacatgagttgcatctttactgaagcatctccaaaagtcacacaaaaggagattgcattcaaaacacatggggaaagccatcaattattctctgcstttgttgaattcaggatttaagggacagcacttgtttccattggcaccctcagcctcctctccccctccctgcaacaactttattattattattattatt

SEQ ID NO: 44775 - DNA, 201 bp, Homo sapiens
tcacacaaaaggagattgcattcaaaacacatggggaaagccatcaattattctctgcctttgttgaattcaggatttaagggacagcacttgtttccatyggcaccctcagcctcctctccccctccctgcaacaactttattattattattattattttgagacggagtcaagctctgtcacccaggctggagtgcagt

SEQ ID NO: 44776 - DNA, 201 bp, Homo sapiens
aggaacttggggactatgataggacccaactcattgagttcatatcctaagagaaggcccagcccacttgtggcattagcacgttcaaagttaggaaacartattttatttttatttttttttggagacagggtctcactctgttacccaggctggagtgcagtggtgcgatcatggctcactgcagccttgacttcctag

SEQ ID NO: 44777 - DNA, 201 bp, Homo sapiens
ccctcagcctcctctccccctccctgcaacaactttattattattattattattttgagacggagtcaagctctgtcacccaggctggagtgcagtggcaygatctcggctcactgcaacctctgcctcccgggttcaagcaattctccggcctcagcctcccgagtagctgagactacaggcatgtgccaccatgtctgg

SEQ ID NO: 44778 - DNA, 201 bp, Homo sapiens
gaatagatggatggatagtggggtgggtggatgagtggatgatggatggatgaacagatggatggatgaacagatggatagatgattggatggtggatggrtgggtggatgatggatggataaatggatggatggtgggtgggtggatgatggatgatgaatagagggatgggtggatggttggatgggtggatgatggat

SEQ ID NO: 44779 - DNA, 201 bp, Homo sapiens
tcgccgcagttgataagagtgtctacctgctcaggtctgggttccggctgactcctgcccaggtgagcagacccctcgggcttgggttctagacctccacrgggctttaccttctcttgctctccctttcccatctctcattccaataaatgaagagtggcatttgaatccagattcgctttctccgtcgggttcattttt

SEQ ID NO: 44780 - DNA, 201 bp, Homo sapiens
tccaatttgcaaagccgtggagagcagaatgttatgcatgtcaatggtcaggttcaaatgggtaacttgaacttgtgatgggacgtgttatgacattgacrtgctttgctgcgaggaaaaccttctcattgggagctgtgggtgccagtagctcttagctctgcctcggctttggttaacttggttgtgtgtctggcagct

SEQ ID NO: 44781 - DNA, 201 bp, Homo sapiens
aagcaattctccggcctcagcctcccgagtagctgagactacaggcatgtgccaccatgtctggctaatttttgtatttttagtagagatggggtttcacyatgttggccaggctggtcttgaactcctggcctcaagtgatccacatgcttcagcctcccgaagtgctgggattacaggtgtgagccactgcgcctggct

SEQ ID NO: 44782 - DNA, 201 bp, Homo sapiens
ctgcataggtgatcctcgtgccccagcctccctagtcgctgggattagaggcatgagccactgtgcccagctccagtttacccatcttaaaaagggctaakggggcgcctgtagtcccagctactcgggaggctgaggcaggagaatggcgtgaacctgggaggcggagcttgcagtgagccaagattgcgccactgcact

SEQ ID NO: 44783 - DNA, 201 bp, Homo sapiens
ctgcctcagcctcctaagtagctgggattacaggcacctgccaccatgcccagctaaattttgtatttttagtagagatggggtttcaccatgttggccargctggtctcgaactcttgacctcaggtgatccacccgcctcggcctcccaaagtgttgggattacaggcgtgagccaccactcacagccaactgaaccaa

SEQ ID NO: 44784 - DNA, 201 bp, Homo sapiens
gcctcagcctcctaagtagctgggattacaggcacctgccaccatgcccagctaaattttgtatttttagtagagatggggtttcaccatgttggccaggmtggtctcgaactcttgacctcaggtgatccacccgcctcggcctcccaaagtgttgggattacaggcgtgagccaccactcacagccaactgaaccaagt

SEQ ID NO: 44785 - DNA, 201 bp, Homo sapiens
ccgcagcctctcaaagtgctgggattacaggtgtgagtcactgtacctggcctggaagaaaattttaactaaataacaggtgtctttctctctttctttcttttttttttttttttttgagacagagtcttgctctgtctcccaggctggagtgcagtagtgcgatctcagctcactgcaagctccgcctcccaggttcac

SEQ ID NO: 44786 - DNA, 201 bp, Homo sapiens
tcctgggcttaaacgatcctcccacctcagcctccagagtagctggggctacaggcatgcaccaccacgcctggctaattttttctatcttttgtaggggyggggtcttgctatgttgcccaggctggtctcgaactcctttgcacaagccagcctcctgtttcagcctccccagtaactgggattagaggcatgggccac

SEQ ID NO: 44787 - DNA, 201 bp, Homo sapiens
ctccatccccacgtcagcccagcacgtgtggctggaggtgggtgagtcccgtggacccttgttattcagccagcaggtatggacttggggcctcccccagrctgggtgcaggcacctgatcagtgggcctggagcccgtcccagccctgcaggagtacacattccactagacagtgggatggacaacacagccatcctggg

SEQ ID NO: 44788 - DNA, 201 bp, Homo sapiens
gtgctgggattacaggtgtgagtcactgtacctggcctggaagaaaattttaactaaataacaggtgtctttctctctttctttctttttttttttttttwttgagacagagtcttgctctgtctcccaggctggagtgcagtagtgcgatctcagctcactgcaagctccgcctcccaggttcacgccattctcctgcct

SEQ ID NO: 44789 - DNA, 201 bp, Homo sapiens
ggtattttattatctttgtagcaattgtgaatgggatttcactcatgatttggctctctgtttgtctgttaattggtgtataggatttttgtgatttttgyacattgattttgtatcctgagactttgctgaagttgcatatcagctgaaggaggttttgggctgagatgatggggttttctaaatatacaatcatgtcat

SEQ ID NO: 44790 - DNA, 201 bp, Homo sapiens
ctccagatattgccactatccccagggggcagagtcacttccaggtgaggacactgagataggtaggtagatagacagaatgatgggtggatagatagatvggcaggatctctcaggcgaaggcaaggtttctcaaccttggcactatcaacatttgggcaagatcattctctgtggtggaggcactgtaggatattgagc

SEQ ID NO: 44791 - DNA, 201 bp, Homo sapiens
atggtggtggttccactgtgtccatctgcagatgaatgggctgtgacttgggggtgggggtttcagggactttcccattgcctagtaggggccagagccargatttgaaccccaaggccgattgggtacccacttcctcctgttgcccatgagtttccttgtgtccccgctttcccctaccatccctgtccactggctgct

SEQ ID NO: 44792 - DNA, 201 bp, Homo sapiens
acttgggggtgggggtttcagggactttcccattgcctagtaggggccagagccaagatttgaaccccaaggccgattgggtacccacttcctcctgttgsccatgagtttccttgtgtccccgctttcccctaccatccctgtccactggctgctctgagctctgcacagaaccagctgacagatggcccattctggaac

SEQ ID NO: 44793 - DNA, 201 bp, Homo sapiens
tgtgtcgcagcatgatgtaaggaattatgggaacatgagttgcatctttactgaagcatctccaaaagtcacacaaaaggagattgcattcaaaacacatrgggaaagccatcaattattctctgcctttgttgaattcaggatttaagggacagcacttgtttccattggcaccctcagcctcctctccccctccctgca

SEQ ID NO: 44794 - DNA, 201 bp, Homo sapiens
gctcctctgtcttcccgtggccttggggcatcaccaaggactctgggtttgccttcaccgtaaggagaggtggtctcagatccctctgcccccttctaagktcctcttgcctagaaataagagtcttggagattcagaaatgggttggaaacagaattggaagcttttctttctttttttcgagatggggtctcgctctgt

SEQ ID NO: 44795 - DNA, 201 bp, Homo sapiens
ttcccaccctcagaccctccattcccttcttcagaagggaaagctgaataattttttttttttgaggaggagtctcactctgttgcccatgctggagtgcrgtgatgggatctcagctcactgccttccatgttcaagtgatactcctgtctcagcctcctgagtagctgggattacaggcctgcaccaccaaacccggct

SEQ ID NO: 44796 - DNA, 201 bp, Homo sapiens
agtgcagtgatgggatctcagctcactgccttccatgttcaagtgatactcctgtctcagcctcctgagtagctgggattacaggcctgcaccaccaaacscggctaacttttgtatttttagtagagagggggtttcaccatgttggccaggctggtcttgaactcctgacctccagtgatccacccacctcagtctccc

SEQ ID NO: 44797 - DNA, 201 bp, Homo sapiens
aagacactccaaccctgagtgagcacgggctgtgtttttcctccctccagatcctcggctcccgggacttcgacatctgcgtgagggacatgatcccagcrgacgtccctgagcacttccggggcagggtcagcatctgggccatagtgaccagtgtggacgggagccagcaggtcgcgttcgatgactccacccccgtgc

SEQ ID NO: 44798 - DNA, 201 bp, Homo sapiens
atgcctgtaataccaccactttgagaggctgaggtgggtggatcacaaggtcaggagttcgagaccagcctggccaatatggtgaaaccccatctctactraaaatacaaaaattagccggacatggtggtggacgcctgtaatcccagctactcaggaggctgaggcaggagaattgctcgaacctgggaggcggaggct

SEQ ID NO: 44799 - DNA, 201 bp, Homo sapiens
tcagtaggccaaggtaggaggattgcttgagtccaggagatcgaggttgcagtgagacgtgatcgcaccacagcactctagtctgggcaacagagcaagascctgtctttaaacacggaaagaaggctggaggtccttcttgccttctctccctgtgggaggcatcctcttccctgggaaggtgtgaagctctaggggctg

SEQ ID NO: 44800 - DNA, 201 bp, Homo sapiens
ccagtaggtgctccatatatgctggttggacaaatggatgtggagcaaagatttcctcttagatggaggggttgcaaacgtgcttgcatatgcacccacartgcacatgcacacaccctgcaaaatgcacacacatgcacacagagaccagtatgtgtgagcatgcacatgatgcacccacacaagtcgtcatggtataca

SEQ ID NO: 44801 - DNA, 201 bp, Homo sapiens
tgaggattttgggattggagtagtgggtgaggtttattgctttggttggtcttgacggggaaactgcagtcagaagagacctcacaggtccagaaggctgstcctgcgggtggcaggtaggagaggtccctctgaggctgttcagagcagacaggaggtgggtggctggagagagggctgggacggaccccgtgtggcttc

SEQ ID NO: 44802 - DNA, 201 bp, Homo sapiens
agtaggtgctccatatatgctggttggacaaatggatgtggagcaaagatttcctcttagatggaggggttgcaaacgtgcttgcatatgcacccacaatrcacatgcacacaccctgcaaaatgcacacacatgcacacagagaccagtatgtgtgagcatgcacatgatgcacccacacaagtcgtcatggtatacata

SEQ ID NO: 44803 - DNA, 201 bp, Homo sapiens
tgctccatatatgctggttggacaaatggatgtggagcaaagatttcctcttagatggaggggttgcaaacgtgcttgcatatgcacccacaatgcacatrcacacaccctgcaaaatgcacacacatgcacacagagaccagtatgtgtgagcatgcacatgatgcacccacacaagtcgtcatggtatacatatgcaca

SEQ ID NO: 44804 - DNA, 201 bp, Homo sapiens
caacctctgcctcccgggttcaagcgattctccttcctcagcctcccgagtagctgagactacaggcgtatggcaccacacccagctaatttttttttgtrtcttttttagtggaaatgggggtttcaccatgttggccaggctggtctcaaactcctgacctcaggtgatccgcccaccttggcctcccaaactgctggg

SEQ ID NO: 44805 - DNA, 201 bp, Homo sapiens
acatgcccacatgtgtagacatgcattcacacacacaaatccacacacatgcccacatgtgtagacatgcatatacacacacacaaatccacacacacacmcccccacgtgtagacatacatacatatacaaacaaatccacacacgcacatgcctgcatgtgtagacatgcatcacacacacgaatccacacacacacat

SEQ ID NO: 44806 - DNA, 201 bp, Homo sapiens
gtaaatacgtagatgggaactgaggacactgtggtcactttgtcctctgtgggcaccatgtcctaaaggttttaaccactgaagccactgccttgccactygacattcacagccagatgggttcacgctttcttgtgttggacctgctgctcaacacacagcacagctgtttggtcacctgggccactgttctgttgtttt

SEQ ID NO: 44807 - DNA, 201 bp, Homo sapiens
gaacaattgagactgagatgggtgctcctgcaaggagggacaaggcaagacccagcagagaggggagcatgccttgggtcagaggggacacatccttaacrataccagactgggtccaggaagacagtgatcagctgctggaagtggagaggttcaggccccagactcttctcactctgtgtgtgcaggggacagggaaag

SEQ ID NO: 44808 - DNA, 201 bp, Homo sapiens
acacacatgcccacatgtgtagacatgcatcacacacaaatccacacacacagacacatgcctgcacatgcagacatgcacacacacacacaaatcatacwcacacacatgcccacatgtgcagatatgcattgcacacacgaacctgtacaaacacatgcacacacatacacacatgcatatacacatacaaacttgtac

SEQ ID NO: 44809 - DNA, 201 bp, Homo sapiens
tccagagtagctggggctacaggcatgcaccaccacgcctggctaattttttctatcttttgtaggggcggggtcttgctatgttgcccaggctggtctcraactcctttgcacaagccagcctcctgtttcagcctccccagtaactgggattagaggcatgggccactgtgcctggctcctgtttgcccatcttaaaat

SEQ ID NO: 44810 - DNA, 201 bp, Homo sapiens
ccagccaatggtcagccagaggcacagtgcatccttgttgtattagttcgttcttacattgctataaagaaatacctgagactgggttatttatttattartttatttatattattactagttttggggatggagtctcactctgtcgcccaggctggagtgcagtggtgcaatctcagctcactgcaacctccacctccc

SEQ ID NO: 44811 - DNA, 201 bp, Homo sapiens
gcaccaccacgcctggctaattttttctatcttttgtaggggcggggtcttgctatgttgcccaggctggtctcgaactcctttgcacaagccagcctccwgtttcagcctccccagtaactgggattagaggcatgggccactgtgcctggctcctgtttgcccatcttaaaatgggctgatgctaccagtgcccatctc

SEQ ID NO: 44812 - DNA, 201 bp, Homo sapiens
cagtggctcatgcctgtaatcccagcactttgggaggccaaggcaggtggatcacctgaggccaggagttcgagaccagcctggccaacatggtgaaaccscgtctctactaaactatacaaaaaattagccaggtgtggtggcaggcacctgtaatcccagctacttgggaggctgagacaggagaattgcttgaacctg

SEQ ID NO: 44813 - DNA, 201 bp, Homo sapiens
gcagatcacctgaggtcaggagttcgagactagcctggccaacatagtgaaaccctgtctctactaaaagtacaaaaattagctgggcctggtggtggtgmctgtaatccctgctactcaggaggctgaggcaggaagatcatttgaactcaggaggcggaggttgtagtgaaccgagatcgcgccattgcactccagcct

SEQ ID NO: 44814 - DNA, 201 bp, Homo sapiens
gccctgacctgcctgttcctactccctggagctgcctgggggaagtggggggaagtggactgtctcctttggcttagggtgaggcctgtgagtccccttgyagggtgggatccacggcactgtcccgctgacagcctacgtggtggttgctctcctggaaacaggcacagcctcagaggtgagtacagaaggggtttgggg

SEQ ID NO: 44815 - DNA, 201 bp, Homo sapiens
aggcggaggttgtagtgaaccgagatcgcgccattgcactccagcctgggcaacagagtgagactccatctaaaaaaaaacaaaaacaaaaacaaaaaaamcccaaaacaacaacaacaacaacaaaaaagctaaagacccagtaaagccagtggtgtagctggaaggcctgagagctggagaaccaatggtgtagattcc

SEQ ID NO: 44816 - DNA, 201 bp, Homo sapiens
gatcgcgccattgcactccagcctgggcaacagagtgagactccatctaaaaaaaaacaaaaacaaaaacaaaaaaaacccaaaacaacaacaacaacaamaaaaaagctaaagacccagtaaagccagtggtgtagctggaaggcctgagagctggagaaccaatggtgtagattccagcccaggtctgaaggcctggga

SEQ ID NO: 44817 - DNA, 201 bp, Homo sapiens
gggacaaggcaagacccagcagagaggggagcatgccttgggtcagaggggacacatccttaacaataccagactgggtccaggaagacagtgatcagctrctggaagtggagaggttcaggccccagactcttctcactctgtgtgtgcaggggacagggaaagccagccacagactaggctcttgcactggcccacatt

SEQ ID NO: 44818 - DNA, 201 bp, Homo sapiens
cctccctgcaacaactttattattattattattattttgagacggagtcaagctctgtcacccaggctggagtgcagtggcacgatctcggctcactgcarcctctgcctcccgggttcaagcaattctccggcctcagcctcccgagtagctgagactacaggcatgtgccaccatgtctggctaatttttgtattttta

SEQ ID NO: 44819 - DNA, 201 bp, Homo sapiens
ctgaggtaggaggatcgcttgagactgggaggttgaggctgcagtgaactatgatcgcaccactgcactccagcctgggcaacagagtgaggccctatttaaaaaaaaatgagagaataatgaaatttagaaaaggagaaatccaccgataatccagttttcatacttttcactttttcatgttttccacacattcttgtt

SEQ ID NO: 44820 - DNA, 201 bp, Homo sapiens
gagaagagaaaaaggactttcttccccgaaacatggatttggcattgtctcaacatcaggtacattaagatttcttttctgcgctgactttgccggttgastgaaagacactcatgcgggtccagagagcctccggtgagatgggcaggcctgataccaacatctgagcaagacactgtgcatctttttctaacacacaaa

SEQ ID NO: 44821 - DNA, 201 bp, Homo sapiens
tgtaatatataacgaaataatgatataactcaccataactgaagaaacagtgcaagccctgagcttgttttccttcaactagatggtcccacctgggggtsatgtgagacagtaacagatcatcaggcattagattgtcataaagagcatgcaatctagacccctcccatgcacagttcacaatagggttcacactcctat

SEQ ID NO: 44822 - DNA, 201 bp, Homo sapiens
accattaggaagctcaaagaagcattgtcatgggttcaggggcctccagggagtgagtggtggagctgtgtgttagaatcaatgtctacgggtgccgggacagcccagaaaaggggaagtccccctgaacctgagagtctgcaggtgatgtttgagtcaggcatcggggcgggaagggcattcgcaaagagggaacagcat

SEQ ID NO: 44823 - DNA, 201 bp, Homo sapiens
cctgggggtgatgtgagacagtaacagatcatcaggcattagattgtcataaagagcatgcaatctagacccctcccatgcacagttcacaatagggttcwcactcctatgagaatctaatgccaccactgatctgatgggaggcggagcttaggcagtaatgtgagtgatggggagcggctgtaaatacagatgaaggtt

SEQ ID NO: 44824 - DNA, 201 bp, Homo sapiens
tgaggcaggagaatcacttgaaccggggaggcggaggttgcagtgagccgagatcacgccattgcactccagcctgggtgacagagcgagactccaactcaaaaaaaaaaaaaaaaaaaagtatgaagttagccaggtgtggttgtgtgtgcctgtaatcccagctacttgggaggttgagacagcagaatctcttgaacc

SEQ ID NO: 44825 - DNA, 201 bp, Homo sapiens
aacagactaatacaggaggcattacttttgtttgttttaagcatgaaaggagcttttatagtgcatgactcacatgccagggcgttctgcccatctgcttaaaaaaaaataagaggacggccaggtgccatggctcacacctgtaatcccagcactttgggaggctgagtcgggaggatcacatgagcccaggagtttgag

SEQ ID NO: 44826 - DNA, 201 bp, Homo sapiens
tcattgctgtgggagagccagctgctccgctgagctgaccatccccctcaccgccccagcactcagttctccttgtttctttgtttcaggcggaaggagtyccccgggcgtacacctacagcgcattcttctgtcccagtggtgagtcccccgtgcccattctgctaaggtgtggccacctggctgggtcaggactttggc

SEQ ID NO: 44827 - DNA, 201 bp, Homo sapiens
tccaatcttttgaatttgctttcatagaggaagactttttcctgaagatctatctgtggtgttggttgggtacagcatttagattgattctgaatgtgtayagtagtgtagtctccatatgatttctttagctataaacagcatcagtggtgtctgtgatttcctgagtggcttagggtgcagttattagtggaggctgtg

SEQ ID NO: 44828 - DNA, 201 bp, Homo sapiens
tgtgagcagggaatgtaagtggggctccagagatgtgaagatgcaggagctgtttggcccccaggcagaatgcagcctggcagtggctaggatctcgatayggtgccctgctgtagctgcttagggctcaagggtgtgtgagacccagccttagccccctctctggaacagtatctttgcacaatctctgggtatctccct

SEQ ID NO: 44829 - DNA, 201 bp, Homo sapiens
ctgacctcaggtgatccgcccaccccagcctccccaaagtgctgggattacaggtgtgagccattgcgctcagcctgtgctgcgattttagagtgaggcaracacagacacatatacatgatagatatatctggacatgtacatatgtatatcaagggatccaggtctccttccaccgctcacaggctgtgaattcacttg

SEQ ID NO: 44830 - DNA, 201 bp, Homo sapiens
tcttttttttttcttttttttttgagatggagtttcactcttgtcgccgatgctggagtgcagtggcacgatctcagctcactgaaacctccacctcctgrgttcaagtgattctcccacctcagcctcctgagtagccgggattacaggcacctacccccacgcccgactaatttttgtctttttagtagagacggagtt

SEQ ID NO: 44831 - DNA, 201 bp, Homo sapiens
tttttgagatggagtttcactcttgtcgccgatgctggagtgcagtggcacgatctcagctcactgaaacctccacctcctgggttcaagtgattctcccrcctcagcctcctgagtagccgggattacaggcacctacccccacgcccgactaatttttgtctttttagtagagacggagtttcaccatgtgggtcaggt

SEQ ID NO: 44832 - DNA, 201 bp, Homo sapiens
ggctctggagtgagagccccagattcggatggaagcgttggatggttaaatgagagtgttggtggaaagcctctcatggtatctggcctgtctactaaagwcccacgtgctgttgtcacacaggcatttataacagtcaactggggaatcccaaaccaaagtcagggatacactttctattttaggaaatgtccatcagct

SEQ ID NO: 44833 - DNA, 201 bp, Homo sapiens
acaccattctcctgcctcagcctcctgagtagctgggactacaggcgcccgccactatgcccggctaattttttgtatttttagtagagacagggtatcaycgtgttagccaggatggtctcgatctcctcaccttgtgatctgcctgcctcagcctcccaaagtgctaggattacaggcgtgagccaccgtgcccagccc

SEQ ID NO: 44834 - DNA, 201 bp, Homo sapiens
gagtgttggtggaaagcctctcatggtatctggcctgtctactaaagacccacgtgctgttgtcacacaggcatttataacagtcaactggggaatcccaraccaaagtcagggatacactttctattttaggaaatgtccatcagctgatgaattagagaaatgaatgtgggtcaatgaaatgcaattcctcaatgcaat

SEQ ID NO: 44835 - DNA, 201 bp, Homo sapiens
ttcagtggggagttgggactgcattggtgctataaggtaggcaggggtgggacagtgtcagcttgggggatttaggagggcgagagcctctatgatgttgrggaggcagggatgggtgggctcagcctggggggctttggggaggatgcgtcatctgtgctgtcagggaggcaggagtgggatgagatcagcctctgattc

SEQ ID NO: 44836 - DNA, 201 bp, Homo sapiens
tctcatggtatctggcctgtctactaaagacccacgtgctgttgtcacacaggcatttataacagtcaactggggaatcccaaaccaaagtcagggatacrctttctattttaggaaatgtccatcagctgatgaattagagaaatgaatgtgggtcaatgaaatgcaattcctcaatgcaatggaatattattcagctgt

SEQ ID NO: 44837 - DNA, 201 bp, Homo sapiens
tttcctcctaaccatttgaaaaagatgaaaaccatctttagcttgtgggcccaaaagacaggtggtggatccggtttggcctatgggtcttaattcacagrctccccacaaagtaccaggaaatcctggtggtgaacagagagggtgcttgggatcccggtttatactcatagagctgctgatcttgggcacgttattcaa

SEQ ID NO: 44838 - DNA, 201 bp, Homo sapiens
agttttgttgttgttgttcttgttgttgttttgagatggagtctcgctctgtcgccacgctggagtgcaatggcatgatctcagctcattgcaacctccarcctccttgttcaagcgagtctcctgcctcagcctcccgaatagctgggattgcaggcacctgccaccatgcccggataatttttatatttttagtagagg

SEQ ID NO: 44839 - DNA, 201 bp, Homo sapiens
agtttcaatgagctgagatcactcacaccactgcactccagcctgggcgacagagtgagactctgtccatagatagatagatagatacatagatagatagwtaaataaataaataaataaataaataaataaataaataaaattgaccatcctaatggggaaaggggctgccaggccttctggttgcagctgccccatgtt

SEQ ID NO: 44840 - DNA, 201 bp, Homo sapiens
gtggtggctcacacatgtaatcccagcactttggaaggccgaggtgggtggatcacctgaggtcaggagttcgagatcagcctgggcaacatggtgaaacsgcatctctactaaaaatacaaaattagccaggcgtggtggcacatgcctgtaatcccagctactcgggaggctgaggcaggagaatcgcttgaacctggg

SEQ ID NO: 44841 - DNA, 201 bp, Homo sapiens
ggggtggatcacgtcaggcgcagtgtgatggttgaggtaaggccgtgtcctcatctctggtgcttagccagggcctcattccttcagccatgaagctgggsccagctggagtgtgtggtctgaggctgagccagggcctgggcagccttcacgggttgtgcttgagagctcaggtgcctggactttcgggtacttccttgt

SEQ ID NO: 44842 - DNA, 201 bp, Homo sapiens
gaagccgcccccataattcagttatctcccaccgagtccttcccacaacatgtgggaattatgggagctacaattcaagacaagatttggttggggacacrgccaatccatatcaggatgcctctagtagcccaggtgctggaggggctgtgattgatccagggctaggagttgggcagaagggtggtgagagtttgggat

SEQ ID NO: 44843 - DNA, 201 bp, Homo sapiens
tatcaggatgcctctagtagcccaggtgctggaggggctgtgattgatccagggctaggagttgggcagaagggtggtgagagtttgggatgggcctgagycagggaggagagggtgagaggccggaaggagatggacagacccaaatgagggtgtcgaggctctctctgacatcagagggtggaggccctgggactcagg

SEQ ID NO: 44844 - DNA, 201 bp, Homo sapiens
agagagaccaccgactacctagtacaaggtattggggaagaagtgcctgggttgaggtgggagcaagggaggcaggttcagccttcagtggagaagaccaygctggaggtggcccacacaccaggtgcagcaaaggggaggaagtgggcaaaagaggccattcagggtggccctgatcttgtcactgtcagcaggagcctg

SEQ ID NO: 44845 - DNA, 201 bp, Homo sapiens
aaagccagtggtgtagctggaaggcctgagagctggagaaccaatggtgtagattccagcccaggtctgaaggcctgggaaccaggagcaggagaagatcratgtcccagctcaagcagttgggcagagagtggaaccaatcttcctctgtcttgttctatcaggagacgtttaacagcttggatggtgcccactcacatt

SEQ ID NO: 44846 - DNA, 201 bp, Homo sapiens
gggccatagtctcttctatgaggctttcctggggtgggggatggcacagtctctgcagagaaggcttccacgatggatctcagccctgggtgagaagaatmtgccctccctaatacctacatcaattctacaatctctcatgataaattatgagtttgggcacttctcaggattcttggtctcacaatccagacaactagt

SEQ ID NO: 44847 - DNA, 201 bp, Homo sapiens
gtgcatccagccaactcgcagttcagactcaacaaaccccaaatcaacccccgccatcttccccccaaacccacttgtgttcatttcctaaaactgccacracaaaatgccacaaaccgggtggcttagaacgacagaaatgtgtcatctcctcatagttctggaggccaaaagtcaaaaataaaggtgtccgcagagctg

SEQ ID NO: 44848 - DNA, 201 bp, Homo sapiens
atgataaattatgagtttgggcacttctcaggattcttggtctcacaatccagacaactagtgggtctacagtttgctgtgacctaagaccgcccccaccrtgcacaatgtccagagggccccttgccttgtgttatgggctgaattggttctcccctgaccaaattcttatgctgaattcctaatgccctgtcttagctt

SEQ ID NO: 44849 - DNA, 201 bp, Homo sapiens
gagactcgtccttggcagatgcaggagcccctctcacagtgctcacggatgtcaaatgaggcctcagaacctggcttatttgtcctcatgatgtcctctgyccagagggagatgggaggaagagggtggctgggagggtagggtagggatgtgggccccatgacaagtttagaagcagttggtgagttccttttggccagc

SEQ ID NO: 44850 - DNA, 201 bp, Homo sapiens
acacagctgggaagtaaagactgtggtggtcccagctccagggatggaggttggggcttggggccagtgcagagctggtgatcgtaaccattcctgtttctgctgctgttaccacagtgagcaagactccatgccctgctctctggccccttgggagtgagccctggatgccctgggcttcctcaagctcccaggactcag

SEQ ID NO: 44851 - DNA, 201 bp, Homo sapiens
ccaaggcccttcctgttccagctgtcttcccctgatactcttctcccactggggtcccacaataccttttctttagaccccatgcttggatgcgctccatsggatgccaggctacacactgggtgggttatagctcttgaccactcctttccttgcagatggggtcacccactggagcctgtcaaattcctgggacgtgga

SEQ ID NO: 44852 - DNA, 201 bp, Homo sapiens
cacagctgggaagtaaagactgtggtggtcccagctccagggatggaggttggggcttggggccagtgcagagctggtgatcgtaaccattcctgtttctgctgctgttaccacagtgagcaagactccatgccctgctctctggccccttgggagtgagccctggatgccctgggcttcctcaagctcccaggactcagg

SEQ ID NO: 44853 - DNA, 201 bp, Homo sapiens; identical to SEQ ID NO: 10252

SEQ ID NO: 44854 - DNA, 201 bp, Homo sapiens
agtagggacggggtttcaccatgttggccaggctggtctcaaactcctgacctcagatgatccgcctgccttggcctcctaaagtgctgggattacaggcrtgagccaccgtgcccagcctagacactcagtgtgcacacacctcctcagcatcttccggggattaaactctcagcatgagcaagaaaaatcaaatttcct

SEQ ID NO: 44855 - DNA, 201 bp, Homo sapiens
ttcctctcacagtgagcaattcaagagagaaagcgggaaggatgccatagcgccttttgttacttggtcttacaagtcaggctgttacttctgcctcattmtattctattccttttttttttctttttttgagatggggtctcaccctatcacccaagctggagttcagtggtataatctcggctcactgcaacctccacc

SEQ ID NO: 44856 - DNA, 201 bp, Homo sapiens
atttcagattttttgcatttgggatgcccaagtatacaggtagccctccgtatctgtgagttccacaggattcaatcaactacagatcgaaactattcagaaaaaaaaaaaaaaaaagtctgggtgtgatggcacgtgcctgtcatccctgcactttggggaagctgaatcgggaagattgtttgaggccaggagtcggag

SEQ ID NO: 44857 - DNA, 201 bp, Homo sapiens
aggtgggaggatcccttgagcccagaagttcaaggctgcagtgagctatgattgtgccactgcactccagcctgggtgacagagcaaaactccatctcttwaaaaaaaaaaaaaaaaattttaaaaattccacaaagttcaaaaacgaaaagttgaatttgctgcatgctgagtacaatattgaattcatgcaaatgaagt

SEQ ID NO: 44858 - DNA, 201 bp, Homo sapiens
aaagtattggaattagaggtgtgagccaccacactcagctaatgtcattattttgaattatttttccaaaattacatacatttttttttttactggaatcygttgctcaagaattattgtgtttctttggtgatgtcacgtttccttgctttttcacgtttcttgtgttcttacagtgatgtctatacgtttggtgtttgg

SEQ ID NO: 44859 - DNA, 201 bp, Homo sapiens
tcttgtcgccgatgctggagtgcagtggcacgatctcagctcactgaaacctccacctcctgggttcaagtgattctcccacctcagcctcctgagtagcygggattacaggcacctacccccacgcccgactaatttttgtctttttagtagagacggagtttcaccatgtgggtcaggttggtctcaaactcctgatct

SEQ ID NO: 44860 - DNA, 201 bp, Homo sapiens
tggagtgcagtggcacgatctcagctcactgaaacctccacctcctgggttcaagtgattctcccacctcagcctcctgagtagccgggattacaggcacytacccccacgcccgactaatttttgtctttttagtagagacggagtttcaccatgtgggtcaggttggtctcaaactcctgatctcaggtggtccacctg

SEQ ID NO: 44861 - DNA, 201 bp, Homo sapiens
gcaggtacccacctgggaggtgacaatgccatgggtttggatctgggagcctcagcccagcccacagcaccttccctgtggatttggaccctctgcccacrtttctctatgcccaggactcaggcggggctcctgctcagaactcaagacctttgtggaatactggggcacctgctctcaccttgttttttattttttgag

SEQ ID NO: 44862 - DNA, 201 bp, Homo sapiens
acctcagcctcctgagtagccgggattacaggcacctacccccacgcccgactaatttttgtctttttagtagagacggagtttcaccatgtgggtcaggytggtctcaaactcctgatctcaggtggtccacctgcctcagcctcccagagtgctgggttctttaccaaagttgagctctcctaggtcctttgcgtgtct

SEQ ID NO: 44863 - DNA, 201 bp, Homo sapiens
tgcctcccgggttcaagagcgtctcctgcctcagcctaccgagtagctgggattacaggtgcatggcaccacgcctggcttatttttgtatttttagtagrgatggggtttcaccatttggccaggctggtctccaactcctgacctctcaggtgatccacccgccttgtcctcccaaagtggtgggattacaggcgtgag

SEQ ID NO: 44864 - DNA, 201 bp, Homo sapiens
aggtgtggtggcaggcacctgtaatcccagctacttgggaggctgagacaggagaattgcttgaacctgggaggcagaggttgcagtgagctgagactgcrccactggactccagcctgggcgacagagcgagattccatctcaaaaacaaaaaacaaaaaactaccgtgggttacaatggcctagccctgcccattgctc

SEQ ID NO: 44865 - DNA, 201 bp, Homo sapiens
actccagcctgggcgacagagcgagattccatctcaaaaacaaaaaacaaaaaactaccgtgggttacaatggcctagccctgcccattgctccaaatccytttcccgacaaggggccaggcaggtagatggggggttactgaggcctaagcaatgcttctggggccttccctggtgccccctagcttagcaaatgacccg

SEQ ID NO: 44866 - DNA, 201 bp, Homo sapiens
gttatattgtggggggcattggtactactggcatctgttgggtggaggccaggggtgctgctcagcatcctacagctcacaggacacctccaccccagagrgccacgtggccccaggtgtcagtagtgcccaggctggaaatgactcgggtggcgggggatggagtgaatgagccgggctggctcatttccctcgtttgtc

SEQ ID NO: 44867 - DNA, 201 bp, Homo sapiens
ccagcactttcggaggcccaggtgggcggatcacttgaggtcaggagtttgagaccagcctggccaacatggcgaaacctcgtgtctactaaaaatacaaraattagccgggcgtggtggcgcgcacctgtggtcccagctacttgggaggctgaggcaggagtatcacttgaaccgggaggcagaggttgcagtgagcca

SEQ ID NO: 44868 - DNA, 201 bp, Homo sapiens
tccagatcctcggctcccgggacttcgacatctgcgtgagggacatgatcccagcggacgtccctgagcacttccggggcagggtcagcatctgggccatrgtgaccagtgtggacgggagccagcaggtcgcgttcgatgactccacccccgtgcagaggcagctggtggacatccggtactccaaggacacgaggaagc

SEQ ID NO: 44869 - DNA, 201 bp, Homo sapiens
cactccaaccctgagtgagcacgggctgtgtttttcctccctccagatcctcggctcccgggacttcgacatctgcgtgagggacatgatcccagcggacrtccctgagcacttccggggcagggtcagcatctgggccatagtgaccagtgtggacgggagccagcaggtcgcgttcgatgactccacccccgtgcagag

SEQ ID NO: 44870 - DNA, 201 bp, Homo sapiens
ccagatcctcggctcccgggacttcgacatctgcgtgagggacatgatcccagcggacgtccctgagcacttccggggcagggtcagcatctgggccatartgaccagtgtggacgggagccagcaggtcgcgttcgatgactccacccccgtgcagaggcagctggtggacatccggtactccaaggacacgaggaagca

SEQ ID NO: 44871 - DNA, 201 bp, Homo sapiens
ggcagagcttgccgtgagccgagatggtgccactgcactccagcccgggcaagagtgccagactctgtctcaaaaaataaaataaaataaaaataaaaatmcaaaaattagcttgtgtggtggcgcatgcctgaagtcccagctacttgggaggctgaggcaggagaatcgcttgaacctgggaggcagaggttgcagtga

SEQ ID NO: 44872 - DNA, 201 bp, Homo sapiens
ctctactgaaaatacaaaaattagctgggtgtgatggcgcatgcctgtaatcccagctactcgggaggctgaggcagaagaatcgcttgaacctgggaggyggagattgcggtgagctgagatcacgccattgcactccagcatgggcaacaagagtgaaactccatctcaaaaaaaaaaaaagttaaaggttcttgtcat

SEQ ID NO: 44873 - DNA, 201 bp, Homo sapiens
ccaggcaccatggcacgtgcctgtaatcccagctactcgggaggctgaggcaggagaatcgcttgaacctggaaggtggaggttgcagtgagttaagattrcaccactgcactccagcctgggtgacagtatgagattgttttaaaaacaaacaaaaactcccgtgccgatcagcagtgggattgtgcctatgaatagcca

SEQ ID NO: 44874 - DNA, 201 bp, Homo sapiens
accatggcacgtgcctgtaatcccagctactcgggaggctgaggcaggagaatcgcttgaacctggaaggtggaggttgcagtgagttaagattgcaccaytgcactccagcctgggtgacagtatgagattgttttaaaaacaaacaaaaactcccgtgccgatcagcagtgggattgtgcctatgaatagccactacac

SEQ ID NO: 44875 - DNA, 201 bp, Homo sapiens
tggagtctcgctctgttgcccaggctggagtacagtggcgcgatctcggctcattgcaagctccgcctcccaggttcatgccattcttccacctcagcctyctgagtagctggatctacaggcgctcgccaccacgcccagctaattttttgtatttttagtagagatggggtttcaccatgttagccaggatggtctcga

SEQ ID NO: 44876 - DNA, 201 bp, Homo sapiens
aaaaaactgatgagtcgaccaggcgcggtggctcacgcctgtaattccagcactttgggcagatcacttgaggccaggagttcgagaccagccgggccaayatggtgaaaccccgtctctcctaaaaatacaaaaattagctgggtgtggtggcaggtgcctataaccccagctactcgggaggctgaggcacaagaatca

SEQ ID NO: 44877 - DNA, 201 bp, Homo sapiens
tccagggatggagtgggaggtggtggtggtgggctggtttctctctggatttgagagtctttacacctcatgcgagctcagaatccttggagcctttttctttttttttttttttttcttttcttcctttttttttttttttttttgaaacggagtttcgctcttgttgcccaggctggagtgcaatggcgtgatctccta

SEQ ID NO: 44878 - DNA, 201 bp, Homo sapiens
agctcccaggactcaggaatagcggtgactggagcaggaggagatggcagggcagaggggtcagaggccagaccagcaccttgaggctggggtgtgctgtstgcaggagcagcctgggatcttgtttctgtggtaactgcagggaggagaccagggcagggagggcccctgggaggccgggcacacctgggtcttgttttc

SEQ ID NO: 44879 - DNA, 201 bp, Homo sapiens
gagattccatctcaaaaacaaaaaacaaaaaactaccgtgggttacaatggcctagccctgcccattgctccaaatccctttcccgacaaggggccaggcwggtagatggggggttactgaggcctaagcaatgcttctggggccttccctggtgccccctagcttagcaaatgacccgtgggtgccacatcgggcctagc

SEQ ID NO: 44880 - DNA, 201 bp, Homo sapiens
cagggcagaggggtcagaggccagaccagcaccttgaggctggggtgtgctgtgtgcaggagcagcctgggatcttgtttctgtggtaactgcagggaggwgaccagggcagggagggcccctgggaggccgggcacacctgggtcttgttttcctgatatcctcaggctattgcagttcttggcatcatcatggggttca

SEQ ID NO: 44881 - DNA, 201 bp, Homo sapiens
agctccagaggggcccagggttggcgactcacccagcctcccccagccccaggagctcatccacactgtcccagctctagtcccagggccctgccttgcckacagctgataacacaaggccccaatcacatcttagcaagcagaggccccgcccaccccagggacagctaaagccactgagtcactctccaaaagctggct

SEQ ID NO: 44882 - DNA, 201 bp, Homo sapiens
ctgaggcaggagaattgcttgaaccaggaggaggaggttgcagtgagccaagatcgtgccactgcacaccaacctgggaaacacagtgacaatctgtctcaaaaaaaaaaaaaaaagaaaagaaaagaaaagaaagaacgaaaagattcttaggctcctacaagagttctctcaggacccgattctttctggtttactggc

SEQ ID NO: 44883 - DNA, 201 bp, Homo sapiens
cccagggttggcgactcacccagcctcccccagccccaggagctcatccacactgtcccagctctagtcccagggccctgccttgcctacagctgataacrcaaggccccaatcacatcttagcaagcagaggccccgcccaccccagggacagctaaagccactgagtcactctccaaaagctggctgagccccagcagc

SEQ ID NO: 44884 - DNA, 201 bp, Homo sapiens
actttggccttccccctttcccacactgtgggggctgtcccgctgcaaagtgagcacctgcccttcccctgggaagggggcactgtggtttaggaagaacratgtcccagctggggacaggcagagccagtgagggtggggcatgaatgaatgaatacacagggaatgaatactcagggaatgaatacacagggaatacgc

SEQ ID NO: 44885 - DNA, 201 bp, Homo sapiens
ctgaggctgggccctccctgccatcttggctgtgaaattgagcatgctttatccttttgttccaggtatacctttgggaaacctgtggctggtgccttaaygatcaacatgactgttaatggtgtagggtactacagccacgaggtgggacgccctgtcctcagaacaaccaaggtgagaaacagggaccccttctacccc

SEQ ID NO: 44886 - DNA, 201 bp, Homo sapiens
cacccagcctcccccagccccaggagctcatccacactgtcccagctctagtcccagggccctgccttgcctacagctgataacacaaggccccaatcacrtcttagcaagcagaggccccgcccaccccagggacagctaaagccactgagtcactctccaaaagctggctgagccccagcagcccctaggaggcctcca

SEQ ID NO: 44887 - DNA, 201 bp, Homo sapiens
gcagtggtgcaatcttgggtcactgcaacctccatctcctaggttcaagcaattctcctgcctcagcctcctgagtagctaggattacaggtgtgcaccaycatgcccagctaatttttgtatttttagtagggacggggtttcaccatgttggccaggctggtctcaaactcctgacctcagatgatccgcctgccttgg

SEQ ID NO: 44888 - DNA, 201 bp, Homo sapiens
caccatgttggccaggctggtctcaaactcctgacctcagatgatccgcctgccttggcctcctaaagtgctgggattacaggcatgagccaccgtgcccrgcctagacactcagtgtgcacacacctcctcagcatcttccggggattaaactctcagcatgagcaagaaaaatcaaatttcctttttgttttttttgag

SEQ ID NO: 44889 - DNA, 201 bp, Homo sapiens
gacttgaagtcattgctgtgggagagccagctgctccgctgagctgaccatccccctcaccgccccagcactcagttctccttgtttctttgtttcaggcrgaaggagtcccccgggcgtacacctacagcgcattcttctgtcccagtggtgagtcccccgtgcccattctgctaaggtgtggccacctggctgggtcag

SEQ ID NO: 44890 - DNA, 201 bp, Homo sapiens
cacgggttgtgcttgagagctcaggtgcctggactttcgggtacttccttgttagaggatcatggtagtccgttccctccctaaagcgcagagtgggcttyggtaaagcagcttgggactcttcaggggctgcagcaagtgctccctgacccctgggtgaactatttaggaagaccatgtccctcatctcgtgcttgtcat

SEQ ID NO: 44891 - DNA, 201 bp, Homo sapiens
ttggtgggcagggggtgcatgggtggggcagaagagatgcctctggactagaccaaacctggattgaaccaagtttctttttttcattgtttgaaatggartttcattcttgttgccctggctggggtgcaaccacactctctcagctccctgcaacctctgtctctgggcttcaagcgattctcctgcctcagcctccta

SEQ ID NO: 44892 - DNA, 201 bp, Homo sapiens
ggtgggctggtttctctctggatttgagagtctttacacctcatgcgagctcagaatccttggagcctttttctttttttttttttttttcttttcttcctttttttttttttttttttgaaacggagtttcgctcttgttgcccaggctggagtgcaatggcgtgatctcctaactcagcctcccaagtagccaggatta

SEQ ID NO: 44893 - DNA, 201 bp, Homo sapiens
gtgggctggtttctctctggatttgagagtctttacacctcatgcgagctcagaatccttggagcctttttctttttttttttttttttcttttcttcctttttttttttttttttttgaaacggagtttcgctcttgttgcccaggctggagtgcaatggcgtgatctcctaactcagcctcccaagtagccaggattac

SEQ ID NO: 44894 - DNA, 201 bp, Homo sapiens
cctgaatggctgaggttgcatgtcggatgcggagaattcaccacctctctctacttttgctcacctcagagcccccaccagccccagaagctgaggtcgamgtgtgtgtgacctctcttcatctggccgtgacccccagcatggtcccccttggtcgcctgctggtcttctacgtcagggagaatggagaaggggtcgccg

SEQ ID NO: 44895 - DNA, 201 bp, Homo sapiens
ttttgtatttttagtagagatgggatttcaccatgttggccaggctggtcttgaactcctgacctcaaatgagccactcacctcagcctcccaaagtgctyggattacaggcgtgagccactgtgcctggccagaatctttgagcctttgcaagtcgagtgtggctgcttgggcactaagtaggaacatcaggggctggat

SEQ ID NO: 44896 - DNA, 201 bp, Homo sapiens
gagccactgtgcctggccagaatctttgagcctttgcaagtcgagtgtggctgcttgggcactaagtaggaacatcaggggctggatcagtacctggtcagaagggaggctattgactagtgatgtctgtgtccaggaaggggaaggtggcctttgattagtgatgtctgccaggggtaaggttgggtagccattgattca

SEQ ID NO: 44897 - DNA, 201 bp, Homo sapiens
atttccctcgtttgtccagctcactgcctgcccctggccctggctgcaaggctgtcccgggaaccgcgggtccagtcccttcctgcatcccttcgaagccygccggggtgtcaaacctgctccgctggcctgatcctacagggtgctgctctgcacagaccccgccagcttctctgtggtctccagttctcctggggggct

SEQ ID NO: 44898 - DNA, 201 bp, Homo sapiens
agccactgtgcctggccagaatctttgagcctttgcaagtcgagtgtggctgcttgggcactaagtaggaacatcaggggctggatcagtacctggtcagragggaggctattgactagtgatgtctgtgtccaggaaggggaaggtggcctttgattagtgatgtctgccaggggtaaggttgggtagccattgattcac

SEQ ID NO: 44899 - DNA, 201 bp, Homo sapiens
ccactgtgcctggccagaatctttgagcctttgcaagtcgagtgtggctgcttgggcactaagtaggaacatcaggggctggatcagtacctggtcagaagggaggctattgactagtgatgtctgtgtccaggaaggggaaggtggcctttgattagtgatgtctgccaggggtaaggttgggtagccattgattcacga

SEQ ID NO: 44900 - DNA, 201 bp, Homo sapiens
ggctgcgaccacgactgcggcgcccaggggaacccggtgtgcggctccgacggggtggtctacgccagcgcctgccgcctgcgggaggccgcctgccgccmggccgcgcccctggagcccgcgcctcccagctgctgcgccctcggtgaggaccctaccccccgcctagcctcggggacaccatcgctgctgctctgggcc

SEQ ID NO: 44901 - DNA, 201 bp, Homo sapiens
gtgggacattcatcctccctccaccctggcccacgcaacacccaccagcgaacagctgtgcgcgggcgcacgcgcgcgtgtgtgtgtgtgtgtgtgtgtgygcgtgcgcgcgcgcgcgcgcatacgggtcaaggatcccttatccgaaatgctggggggaccagcagtgtttcggatttcagattttttcacatttcagaa

SEQ ID NO: 44902 - DNA, 201 bp, Homo sapiens
ggctcactgcagccttgacctcctgagctcaagtgatcctcttgcctcagcctcctgagtagctgggaccacaggcacacactaccaccacgcccagctagtgtgtgtgtgtgtgtgtgtgtgtgtgtgtgtgtgtgtgtgttgtagagatggggtctctgtatgttgcccaagctggagtgccatggctgttcatagaca

SEQ ID NO: 44903 - DNA, 201 bp, Homo sapiens
agctcactgcaacctctgaccctggtttcaagcgattctcgtgccccagcctcccaagtagctgggacctcaggcatgcaccatcaagactggctaattttgtgtgtgtgtgtgtgtgtgtgtgtgtgtgtgtgtgtgtatttttagtagagatggggttttaccatgttggccagactggtctgaaactcctgacctcaa

SEQ ID NO: 44904 - DNA, 201 bp, Homo sapiens
gctcactgcagccttgacctcctgagctcaagtgatcctcttgcctcagcctcctgagtagctgggaccacaggcacacactaccaccacgcccagctagtgtgtgtgtgtgtgtgtgtgtgtgtgtgtgtgtgtgtgtgttgtagagatggggtctctgtatgttgcccaagctggagtgccatggctgttcatagacat

SEQ ID NO: 44905 - DNA, 201 bp, Homo sapiens
gctcactgcaacctctgaccctggtttcaagcgattctcgtgccccagcctcccaagtagctgggacctcaggcatgcaccatcaagactggctaattttgtgtgtgtgtgtgtgtgtgtgtgtgtgtgtgtgtgtgtatttttagtagagatggggttttaccatgttggccagactggtctgaaactcctgacctcaag

SEQ ID NO: 44906 - DNA, 201 bp, Homo sapiens
acgggaaaggacaatctactctattccacttggacagacatctgagtagccatttattaaagcaactgctctaaggcagtcctgtttcttcaatgggttcttttttttttttttttttttagagatagtcacactccatcgcccaggctggagtgcagtggctccatctcggctcactgcaacctccgtctcccaggttca

SEQ ID NO: 44907 - DNA, 201 bp, Homo sapiens
actcgacattcacagccagatgggttcacgctttcttgtgttggacctgctgctcaacacacagcacagctgtttggtcacctgggccactgttctgttgttttttttttttgatacagagtcttgctctgtcgcccaagctggagtgcagtggtgcaatcttggctcactgcaacctcggcctcccaggttcaagcgatt

SEQ ID NO: 44908 - DNA, 201 bp, Homo sapiens
agccagctgctccgctgagctgaccatccccctcaccgccccagcactcagttctccttgtttctttgtttcaggcggaaggagtcccccgggcgtacacstacagcgcattcttctgtcccagtggtgagtcccccgtgcccattctgctaaggtgtggccacctggctgggtcaggactttggccttccccctttccca

SEQ ID NO: 44909 - DNA, 201 bp, Homo sapiens
gggggcactgtggtttaggaagaacgatgtcccagctggggacaggcagagccagtgagggtggggcatgaatgaatgaatacacagggaatgaatactcrgggaatgaatacacagggaatacgcagggaatgaatacacaggaatgtgcactgcaggcaccaagcaagaaggttaggctgcccgggcacggtggctcac

SEQ ID NO: 44910 - DNA, 201 bp, Homo sapiens
tcctcagacaccttgcaccggtgtcagggctcctgaggccaccttagggacagaagccagcccctcctctctgcttgctttcttcagtgttgcccaagttygagcttctgattgacccgccccggtatatccaagacctggacgcctgtgagacaggcactgtgcgggccaggtgagaaagagggacccctggggcacact

SEQ ID NO: 44911 - DNA, 201 bp, Homo sapiens
tgtggagcagttccagggactccacatgtggtatgaggcagtttcaagaactctagatgtgatgtggagcagtttcggggaccccagatgtgctgtgggtrtggggcagtttcaagaaccccagatgtggtgtggagcagtttcagggaccccagatgtagtgtggggcagtttcagggaccccaggtgtggtgtggagca

SEQ ID NO: 44912 - DNA, 201 bp, Homo sapiens
cctcacatccaatgcagtgtgaccagatcacttggcgcctgatccccggatgacagggaacacagctgggaagtaaagactgtggtggtcccagctccagrgatggaggttggggcttggggccagtgcagagctggtgatcgtaaccattcctgtttctgctgctgttaccacagtgagcaagactccatgccctgctct

SEQ ID NO: 44913 - DNA, 201 bp, Homo sapiens
caatgcagtgtgaccagatcacttggcgcctgatccccggatgacagggaacacagctgggaagtaaagactgtggtggtcccagctccagggatggaggytggggcttggggccagtgcagagctggtgatcgtaaccattcctgtttctgctgctgttaccacagtgagcaagactccatgccctgctctctggcccct

SEQ ID NO: 44914 - DNA, 201 bp, Homo sapiens
ctcactgcagccttgacctcctgagctcaagtgatcctcttgcctcagcctcctgagtagctgggaccacaggcacacactaccaccacgcccagctagtgtgtgtgtgtgtgtgtgtgtgtgtgtgtgtgtgtgtgtgttgtagagatggggtctctgtatgttgcccaagctggagtgccatggctgttcatagacatg

SEQ ID NO: 44915 - DNA, 201 bp, Homo sapiens
tcactgcagccttgacctcctgagctcaagtgatcctcttgcctcagcctcctgagtagctgggaccacaggcacacactaccaccacgcccagctagtgtgtgtgtgtgtgtgtgtgtgtgtgtgtgtgtgtgtgtgttgtagagatggggtctctgtatgttgcccaagctggagtgccatggctgttcatagacatga

SEQ ID NO: 44916 - DNA, 201 bp, Homo sapiens
cagaggaaggctggtgggcgtgcctggcccactgcccctcaacaaggaatgcctttgagggctttaggtagccctggactgttgcttaatttttttttttyccccaagaccgagtctctcgctctattgccaatgctggagtgcagtggcactatctcggctcactataacctctgcttcctgggttctaagtgattctct

SEQ ID NO: 44917 - DNA, 201 bp, Homo sapiens
tggttcaagtagtgcctgcctggtttccccatttcttttttttttttttgagacggagtctcgctgtgtcacccaggctggagtgcagtggcgcaatctcygctcactgcaagctctgcctcccgggttcatgccattctcctgcctcagcctcccgagtagctgggactacaggcacccacgaccatgcccggctaattt

SEQ ID NO: 44918 - DNA, 201 bp, Homo sapiens
tttccccatttcttttttttttttttgagacggagtctcgctgtgtcacccaggctggagtgcagtggcgcaatctctgctcactgcaagctctgcctccygggttcatgccattctcctgcctcagcctcccgagtagctgggactacaggcacccacgaccatgcccggctaattttttctattttttgtagagacggg

SEQ ID NO: 44919 - DNA, 201 bp, Homo sapiens
tccaccctggcccacgcaacacccaccagcgaacagctgtgcgcgggcgcacgcgcgcgtgtgtgtgtgtgtgtgtgtgtgtgcgtgcgcgcgcgcgcgckcatacgggtcaaggatcccttatccgaaatgctggggggaccagcagtgtttcggatttcagattttttcacatttcagaatgcttgcattatatagtta

SEQ ID NO: 44920 - DNA, 201 bp, Homo sapiens
ctggattgcagtggtgctgatcttggctcactgcaacctctgcctcccgggttcaagcgattctccttcctcagcctcccgagtagctgagactacaggcrtatggcaccacacccagctaatttttttttgtgtcttttttagtggaaatgggggtttcaccatgttggccaggctggtctcaaactcctgacctcaggt

SEQ ID NO: 44921 - DNA, 201 bp, Homo sapiens
gccacagaccccttacaaaacacgtgctcaggacacacatccccgaatgtcctgtaaccatcaaaggcccactttgcctgaatatgagggggaaaaagccrttttagccatcacatcttctgactccaatgtgattgagagaagccgtgggcgccgctatgggttttcggttctgtcgtgagacccaggggaaccactctc

SEQ ID NO: 44922 - DNA, 201 bp, Homo sapiens
agagatctgccctgcccatcccctaccaggtgggagattgcagtaacttctgacaccagctacctggagctgggccacacttcacaggtggtaggcacagccctctccacaagactaccctaaattctgacaccagctgcaagtccaggggtccccgggccacctgtgcttcccacctactggctgcaaattccactaccc

SEQ ID NO: 44923 - DNA, 201 bp, Homo sapiens
ggccttatccaggtatacagcagaactgcctggggcttgtgcagaagcctcatgttcctccaatactagctgcttcctgtttggtgccaggctttgatccrgggtcaggaggagcaagggaaacatggagcaccacctcaagttgttcttagtctagagtcgcttaccgaaaaaaaaaaaaaaacatgtagcaagagctgt

SEQ ID NO: 44924 - DNA, 201 bp, Homo sapiens
tggaagctttgtgtgttctctgcacagaaccaggatatgtaatccccacaagctgagcattgctaagcaggaaagctcacctgagctttggtgtccaaagttttttgtgggggcctcatttcgtctgcatgattgattaaatcattggccatgggactaatctcaatctcctgccctctcccttccctggagatgggctga

SEQ ID NO: 44925 - DNA, 201 bp, Homo sapiens
ggaagctttgtgtgttctctgcacagaaccaggatatgtaatccccacaagctgagcattgctaagcaggaaagctcacctgagctttggtgtccaaagttttttgtgggggcctcatttcgtctgcatgattgattaaatcattggccatgggactaatctcaatctcctgccctctcccttccctggagatgggctgat

SEQ ID NO: 44926 - DNA, 201 bp, Homo sapiens
ggaaggtaacttgggggtgactgtgctgcctcccgcccaaggaccaccgtgaaaccaccaccactagccactagctctgcagtggtgactcagctgaaaayggatcccctgacataacctttgcggagagtggagagggctggtgttccaggtgaggggcaggggacattttcctccacgggaaaggacaatctactctat

SEQ ID NO: 44927 - DNA, 201 bp, Homo sapiens
acacagattttgtactttctatgcatgatatactgtattcttacaataatgtaagctacaggaaggaaaatattattaagaaaatcataagattttcttaygctggcaggcgcaggtaaaaaaaatcataaagaagagaaaatatcttgactgttcgtgaagtgggaatggatcattgtaaaggtcttcttccttgtcatc

SEQ ID NO: 44928 - DNA, 201 bp, Homo sapiens
cagaagcatccccaagaccccctttctgctcttggcactcgggtgttgatctaagcatcttctcttctcagaccaaggtgatggcactgaacgggaagccygtgggggctcagtacctgcccagctacctctccctcggcagctggtactcccccagccagtgctacctgcagctgcagccaccctcccacccactgcagg

SEQ ID NO: 44929 - DNA, 201 bp, Homo sapiens
acctgcccagctacctctccctcggcagctggtactcccccagccagtgctacctgcagctgcagccaccctcccacccactgcaggtaagattttcaggwgctacccttcctgggccatgcgggatccaaaaagcagcatgagccaggtgctgtggctcatgcctgtaatcccagcattttgggaggccgaggcaggcgg

SEQ ID NO: 44930 - DNA, 201 bp, Homo sapiens
gtggccaggcggcaggcggcctccccgaagggccagcgctggccacgcaggtggtaggcgatccgcgggggcagcgccagggccagcaggaggtcagcagycgcgaggttcatcagcagcatggtggagggcagccgaggtgcctgcgtggccagcacccacagcgccagcccattggccggcagccccaccaccaggacc

SEQ ID NO: 44931 - DNA, 201 bp, Homo sapiens
gtcagagggcaagtttcccgcgatgactctcgctagcctccgttttctgatctctaaaatgggagctcagataacactgtggatgagagggagacccctaractcagacatagctgagcacagctctgcaccccagatccataaaactggtctgatgattgtacctacacccgcttcagtgatttcaaggctaaaacgaat

SEQ ID NO: 44932 - DNA, 201 bp, Homo sapiens
ttttgagctctgaggtggccaggcagtctggccccttctcaccttatggagccccaaagagggcaggggttgggggtgagggacagatgcccctggatccyccatgggagcccagcctctgcctctggggacacaccaacctggctgtcctgaggcccccagtgccatgggtgtctgcactgggtccagtctctattccag

SEQ ID NO: 44933 - DNA, 201 bp, Homo sapiens
atggagccccaaggcccttcctgttccagctgtcttcccctgatactcttctcccactggggtcccacaataccttttctttagaccccatgcttggatgygctccatgggatgccaggctacacactgggtgggttatagctcttgaccactcctttccttgcagatggggtcacccactggagcctgtcaaattcctgg

SEQ ID NO: 44934 - DNA, 201 bp, Homo sapiens
aggccagcaccactgcggtcagcctcagcgcgtggccgtagcgccggccgctggccgccagcgtgtgcagggtggccccgtagcacagcagcatggccagmaggggcaggaaacagcccaacagcgccaggcaggtgaaggccggttgccagtgggaggcctgtgcgtccaggggcagcgcgtcatggcagagcacgcgat

SEQ ID NO: 44935 - DNA, 201 bp, Homo sapiens
caggcaggtgaaggccggttgccagtgggaggcctgtgcgtccaggggcagcgcgtcatggcagagcacgcgatcggagcgcgccagccggaaggtctgcygctgcagtgtcaggggcagtgccagggcggccgccatgagccaagcagccatgcagagtccaagggccaggcgccggccacgcagggcgcgggcccgcag

SEQ ID NO: 44936 - DNA, 201 bp, Homo sapiens
ggctggatcagtacctggtcagaagggaggctattgactagtgatgtctgtgtccaggaaggggaaggtggcctttgattagtgatgtctgccaggggtarggttgggtagccattgattcacgatgtctgccaggggcacaggaagggctggggctgccataggtttgcagatctgagatggagccccaaggcccttcct

SEQ ID NO: 44937 - DNA, 201 bp, Homo sapiens
cttcaagcccttcttcgtggacttcatgctccccgctctcatcatccgtggggagcaggtcaagatcccgctcagtgtctacaactacatgggcacctgcrctgaggtactcagccccccaaatacatagccttcctccattcagtggggagttgggactgcattggtgctataaggtaggcaggggtgggacagtgtcag

SEQ ID NO: 44938 - DNA, 201 bp, Homo sapiens
aacacagctgggaagtaaagactgtggtggtcccagctccagggatggaggttggggcttggggccagtgcagagctggtgatcgtaaccattcctgtttctgctgctgttaccacagtgagcaagactccatgccctgctctctggccccttgggagtgagccctggatgccctgggcttcctcaagctcccaggactca

SEQ ID NO: 44939 - DNA, 201 bp, Homo sapiens
atgaattcagaacattctggatcagctggcgtggtggccttatccaggtatacagcagaactgcctggggcttgtgcagaagcctcatgttcctccaataytagctgcttcctgtttggtgccaggctttgatccagggtcaggaggagcaagggaaacatggagcaccacctcaagttgttcttagtctagagtcgctta

SEQ ID NO: 44940 - DNA, 201 bp, Homo sapiens
aatcctggttcactccgtcaccagatacctgcacagctgagggctgttttagggttcttcagaggctacaatctgtgctccttttaaaacatctatgtctscctcattctagctggctctccaaccagtctgaatgggtgaggtttaagtgtcacactgaactgtccataccctggtatggcatcagactaatgactagca

SEQ ID NO: 44941 - DNA, 201 bp, Homo sapiens
ggacaaggaggcagtgagcgcagggcagtggcagcagcacccaccccgaagctggacaaacctcagctctgtctcatgtgagctgtgtggccttagacccratgatcaacctctctgagcctgtttccttaccacacatccctctaagaacctggatccatgggataagcatgtggtacactcagtgcagtgccgtcctgt

SEQ ID NO: 44942 - DNA, 201 bp, Homo sapiens
tagcacctcccctaactacttaccagaaggctccaagatcctgccagggagcctgaaaacttgggatctgttctagatgggttcccttatactcaacgcayattcattcatttattcattgagtgagctaggctctggtcttcatcctgggggaaaaaggaacacatggttcctacctccaggtccttgctgcccagtgca

SEQ ID NO: 44943 - DNA, 201 bp, Homo sapiens
tatactcaacgcatattcattcatttattcattgagtgagctaggctctggtcttcatcctgggggaaaaaggaacacatggttcctacctccaggtcctygctgcccagtgcaggagaaagaccctgtgagagatgcaatagttatccactgctgtgtaacaagtgaccccaaatgtagccatttaaaacaacaaacgta

SEQ ID NO: 44944 - DNA, 201 bp, Homo sapiens
aatattaacaactgctattagtaagtttttcgttgtttttgttttttttttttttttgagatggagcctggctctgttgcccaggctggagtgcagtggtrcgagcttggctcactgcaacctccacctcccagattcaagtgattctcctgcctcagcctcctgagtagctgggattacatgccaccatgcccagctaat

SEQ ID NO: 44945 - DNA, 201 bp, Homo sapiens
tgtatatatgtgcatatatatggatatgctgtgtacatgtgtgttcatagacatctagatacccacatatacatatatatatatatatatatatatatatwtttttttttttttttttttttttttgacagagtctctgtctcccaggctggagtgcagtggcacaatctcggctcactgcaacctccatctcctgggttc

SEQ ID NO: 44946 - DNA, 201 bp, Homo sapiens
ttggctgtgaaattgagcatgctttatccttttgttccaggtatacctttgggaaacctgtggctggtgccttaacgatcaacatgactgttaatggtgtrgggtactacagccacgaggtgggacgccctgtcctcagaacaaccaaggtgagaaacagggaccccttctaccccctgacccaacccccaggttcacctc

SEQ ID NO: 44947 - DNA, 201 bp, Homo sapiens
ctgaaccaccggcaggacggtggcctctacaccgatgaggctgtccccgctttccagccccacacagggagcctggtggcagtggctccttccaggcaccmccccaggtaacggcttatacattgagcaaggttttctaaccctggtcctattaacatctggggcttgtctttgtccttcctggctgctataacagaagac

SEQ ID NO: 44948 - DNA, 201 bp, Homo sapiens
tatatatgtgcatatatatggatatgctgtgtacatgtgtgttcatagacatctagatacccacatatacatatatatatatatatatatatatatatttwtttttttttttttttttttttttgacagagtctctgtctcccaggctggagtgcagtggcacaatctcggctcactgcaacctccatctcctgggttcaa

SEQ ID NO: 44949 - DNA, 201 bp, Homo sapiens
tatatgtgcatatatatggatatgctgtgtacatgtgtgttcatagacatctagatacccacatatacatatatatatatatatatatatatatatttttwtttttttttttttttttttttgacagagtctctgtctcccaggctggagtgcagtggcacaatctcggctcactgcaacctccatctcctgggttcaagc

SEQ ID NO: 44950 - DNA, 201 bp, Homo sapiens
tatgtgcatatatatggatatgctgtgtacatgtgtgttcatagacatctagatacccacatatacatatatatatatatatatatatatatatttttttwtttttttttttttttttttgacagagtctctgtctcccaggctggagtgcagtggcacaatctcggctcactgcaacctccatctcctgggttcaagcac

SEQ ID NO: 44951 - DNA, 201 bp, Homo sapiens
ttttttttttttttttttttgacagagtctctgtctcccaggctggagtgcagtggcacaatctcggctcactgcaacctccatctcctgggttcaagcamttctcctgcctcagcctcccgagtagctgggattacaggcacctgccaccatgcctggctaattatttttgtatttttagtagagacagggtttcaccat

SEQ ID NO: 44952 - DNA, 201 bp, Homo sapiens
gttaatataataaacaaccatgagactttcacctagatttataaattaatgctttgcctatatcctttcattcatccctccatccaccctccatctctctstccatccctccatctgtccctctcttcatccctccatccatctatcctctctccctccattcattcacccttcctccctccctccacccatccatccacc

SEQ ID NO: 44953 - DNA, 201 bp, Homo sapiens
tttcagctcttacatttaggtctttcatctgttttgagttaatttttttatatggtgtgaggtagggatccaaattcattctctctctctctctctctctcttttttttttttttttttgagataggaccttgctctgtcacccaggctgaggtgcagtagtgtgatcatagctcactgcagctcaacctcctgggctcaa

SEQ ID NO: 44954 - DNA, 201 bp, Homo sapiens
caaagccaggacaccagctggtctgagcaggcagagggtgccagtcccaaagggcagttgggtggctgactgcatgacactcactgtctcccatccctggktaaagctgtccctgttctctactgaactgggacagcccccaactcaactctcttctccttcccaccaggggacgtcatggggccaaccctgaaccacctc

SEQ ID NO: 44955 - DNA, 201 bp, Homo sapiens
tagtagagatgagtttctccatgttagtcaggctggtctcgaactcctgacctcaggtgatccgcctgcctcagcctcccaaagtgctgggattacaggcrtgagccaccgtgccttgccattctttttaaattattattattatttttatttatgtatttatttatttattgagacagtctcactctgtcacccaggctg

SEQ ID NO: 44956 - DNA, 201 bp, Homo sapiens
aagtgatctgcccacctcggcctcccaaagtgctgggattacaggcatgagccactgtacctggccttagctagctgtcttaacaaagacctggccatggrgctgggtgggacagggtggccaggactctgcctgcttcccctagagtatcactgtgctcatttgccatgcacttgggcatcctggccagacctcatttgg

SEQ ID NO: 44957 - DNA, 201 bp, Homo sapiens
ctcaagactcttaattacatctgcaaagacccatttcctaaataagtcagcatttacaggtcccagggaatatatctttttggtgggccaccgttcaaccygctacacctgtgctggaatcagatgagctggggggcaaccagcaaatgaccttgaccccttggagttccgttgcatccgcttgtctgtaaacgggaggat

SEQ ID NO: 44958 - DNA, 201 bp, Homo sapiens
accaggtgttgctgtgttgcccaggctggtctcaagctcctggcctcagccgatcctccacctctgcctcccaaacactgctggcatgagccacctcgccyggccatagatcttactttttagaagagttctaggtttccagaaaaattgagtaaatagaacagagttcccatacacctctacacccccatacacagcttc

SEQ ID NO: 44959 - DNA, 201 bp, Homo sapiens
aacactgctggcatgagccacctcgcccggccatagatcttactttttagaagagttctaggtttccagaaaaattgagtaaatagaacagagttcccatwcacctctacacccccatacacagcttcccatgtgataggcatcttgtattagtgtgctgtatttgttacaattgatggaccggcatcaaaacgttatgaa

SEQ ID NO: 44960 - DNA, 201 bp, Homo sapiens
gtgcatgggtggggcagaagagatgcctctggactagaccaaacctggattgaaccaagtttctttttttcattgtttgaaatggagtttcattcttgttkccctggctggggtgcaaccacactctctcagctccctgcaacctctgtctctgggcttcaagcgattctcctgcctcagcctcctaagtagctgggatta

SEQ ID NO: 44961 - DNA, 201 bp, Homo sapiens
aggcacgagaattgcttgaccctgagaggcagaggctgcagtgagcatggtggcttatgcctataatcccaccactttgggaggccattgtgggaggatcrctggagcccaggagttcgagacctgcctgggcaacatagtaagacctcatctctataaagaatttaaaaattcgctggatgtcgtggcacgtccctgtag

SEQ ID NO: 44962 - DNA, 201 bp, Homo sapiens
acctgcctgggcaacatagtaagacctcatctctataaagaatttaaaaattcgctggatgtcgtggcacgtccctgtagtcccagctacttgggaggctkaagtgggagaatcgcttgagctgggagttgtaggctacagtgagttaggactgcaccactgcactccagcctgggtgacagagcaagaccctgtcttgaa

SEQ ID NO: 44963 - DNA, 201 bp, Homo sapiens
ttggataaataaaatgtggtacagaaataccatggaatactatgcagccataaaaaagaacaaaatcatgtcttttgtggaaacatggatggagctggagsccattatccttagcaaactaatgcaggaacagaaaaccaaatactgcatgttctcacttataagtggaagctaaatgatgagaacacatggaaacaaaag

SEQ ID NO: 44964 - DNA, 201 bp, Homo sapiens
attcattgatcctgaatttgcgaagtttcctctcctgacaattttggttttcatccctcatggcctcctggcttccatcctgtgcttctctccttcatttrttcatgcattcattccctggccttgccagctcttactcagggtggcacctgcaaaagcagggcaagggagatggggtggatgagggacaggccacataac

SEQ ID NO: 44965 - DNA, 201 bp, Homo sapiens
tactccctggagctgcctgggggaagtggggggaagtggactgtctcctttggcttagggtgaggcctgtgagtccccttgcagggtgggatccacggcaytgtcccgctgacagcctacgtggtggttgctctcctggaaacaggcacagcctcagaggtgagtacagaaggggtttggggagactcggggctgggcact

SEQ ID NO: 44966 - DNA, 201 bp, Homo sapiens
tggggactgggcgcaatgggttgagggtggtcagtgtggtgagggcggggtcgagcggcgagggggaggtgagtgcggagggtgcggggttgagggcgggwgtgttcagtgcggggggcggggccgaacggggtgggtgtggtcagtgcgaaggggacggggttgagagtggatgtggttagtgctgaggggatgaggttg

SEQ ID NO: 44967 - DNA, 201 bp, Homo sapiens; identical to SEQ ID NO: 10199

SEQ ID NO: 44968 - DNA, 201 bp, Homo sapiens
actcgagttggaatggacagcacccaggatgctgcacaattgctaccctcctttactgagaaagggttttgggaggcacattttttgagacgttgcatgtytgcaaatattcttattctggccctgtatgatagctgggctgggtatagaattccaggttggaaattgttttcctgtagaataattgatgatgttctatca

SEQ ID NO: 44969 - DNA, 201 bp, Homo sapiens
gtacagccttccccactttgtgtcactggagcaaagaggagtgggtgcccatgccccggctgcccccttccgcagaggccttggaggccacggtgtccccyggcgaccgttggaagagccctgcccgcaccttgtccctgaactcggccgacacgtagtagtagatgaagggatccacgcagctgttgagggtgctcagcg

SEQ ID NO: 44970 - DNA, 201 bp, Homo sapiens
ccaaagggatattggagcatgagagggtgtttcttctgggcagagcaagcagaagcatccccaagaccccctttctgctcttggcactcgggtgttgatcyaagcatcttctcttctcagaccaaggtgatggcactgaacgggaagcccgtgggggctcagtacctgcccagctacctctccctcggcagctggtactcc

SEQ ID NO: 44971 - DNA, 201 bp, Homo sapiens
gaagctgaatcgggaagattgtttgaggccaggagtcggagaccagcctgagaaacatggcaagacctcatctcggcaaaaatgttaaaaataagctgggygtggtggtacatgccttagtcccaactactggggaggctgaggtgggaggatcccttgagcccagaagttcaaggctgcagtgagctatgattgtgccac

SEQ ID NO: 44972 - DNA, 201 bp, Homo sapiens
ccttaccacacatccctctaagaacctggatccatgggataagcatgtggtacactcagtgcagtgccgtcctgttagcacctcccctaactacttaccakaaggctccaagatcctgccagggagcctgaaaacttgggatctgttctagatgggttcccttatactcaacgcatattcattcatttattcattgagtga

SEQ ID NO: 44973 - DNA, 201 bp, Homo sapiens
ctcagcgccaggctgggcacgtaggcaccatagaggttgccccaggcgctggggctcgggtccgagtaatgcagcagcagcagcaggttgctgggcacgamgaaggccacggcggaggccagcaccactgcggtcagcctcagcgcgtggccgtagcgccggccgctggccgccagcgtgtgcagggtggccccgtagcac

SEQ ID NO: 44974 - DNA, 201 bp, Homo sapiens
tcgggaggctgaggcaggagaatcgcttgaacctggaaggtggaggttgcagtgagttaagattgcaccactgcactccagcctgggtgacagtatgagaytgttttaaaaacaaacaaaaactcccgtgccgatcagcagtgggattgtgcctatgaatagccactacactccagcctgagtaacactgagtaacagtga

SEQ ID NO: 44975 - DNA, 201 bp, Homo sapiens
accaggggacgtcatggggccaaccctgaaccacctcaacaacctcctgcggctgccgtttggctgtggagagcagaacatgatccactttgcacccaacrtctttgtcttgaagtatcttcagaaaacccagcagctcagccctgaggtggagagagagaccaccgactacctagtacaaggtattggggaagaagtgcc

SEQ ID NO: 44976 - DNA, 201 bp, Homo sapiens
aatcagatgagctggggggcaaccagcaaatgaccttgaccccttggagttccgttgcatccgcttgtctgtaaacgggaggatctgcacagctggggccrggctgggtccatccctgcttggtgtggtctccgcagcgtccttgagacccgtcctggcccgcgtgacctggggtaactcccatgtcactgttcctgcccc

SEQ ID NO: 44977 - DNA, 201 bp, Homo sapiens
gggcttaggcatcgccgagccctccctgctgaagaccttcaagcccttcttcgtggacttcatgctccccgctctcatcatccgtggggagcaggtcaagrtcccgctcagtgtctacaactacatgggcacctgcgctgaggtactcagccccccaaatacatagccttcctccattcagtggggagttgggactgcatt

SEQ ID NO: 44978 - DNA, 201 bp, Homo sapiens; identical to SEQ ID NO: 10210

SEQ ID NO: 44979 - DNA, 201 bp, Homo sapiens
tttgtggcagagacagggtttcgccatgttgcccaggctggtctcaaactcctgggctcaagcaatcctcccgcctcagcctcacaaagtgctggggttayagacatgagccactatgcccagccccttttttcctcccctttctgggcaaaaatggcccatctgtctactgaggagtagatggggtgaggtgggggctgc

SEQ ID NO: 44980 - DNA, 201 bp, Homo sapiens
ctcacaaagtgctggggttacagacatgagccactatgcccagccccttttttcctcccctttctgggcaaaaatggcccatctgtctactgaggagtagrtggggtgaggtgggggctgctccaacaggtggatctcccatgcggccactgtcactattattattattattattatttgagatggagttttgctcttgtt

SEQ ID NO: 44981 - DNA, 201 bp, Homo sapiens
gctcagagttcctggggacaaagtgggacattcatcctccctccaccctggcccacgcaacacccaccagcgaacagctgtgcgcgggcgcacgcgcgcgygtgtgtgtgtgtgtgtgtgtgtgcgtgcgcgcgcgcgcgcgcatacgggtcaaggatcccttatccgaaatgctggggggaccagcagtgtttcggattt

SEQ ID NO: 44982 - DNA, 201 bp, Homo sapiens
ggaaggagcgaagcattgatccatgctacagcatggatgaacctcagaaacatgatgctgagtgaaagaagccagacacaaaaggccacagagtacatgawtccattgacatgaaatgcccagaacaggcaaatccgtagagttggaaagatttgtggttgccaggggctgggggagtggggagtgagtgctgatggcgat

SEQ ID NO: 44983 - DNA, 201 bp, Homo sapiens
ccctccaccctggcccacgcaacacccaccagcgaacagctgtgcgcgggcgcacgcgcgcgtgtgtgtgtgtgtgtgtgtgtgtgcgtgcgcgcgcgcgmgcgcatacgggtcaaggatcccttatccgaaatgctggggggaccagcagtgtttcggatttcagattttttcacatttcagaatgcttgcattatatag

SEQ ID NO: 44984 - DNA, 201 bp, Homo sapiens
cggcgtgcgcgccgcgcagcctcaggccccgtgagtatcctccggcgacagaggaggtcggtcgccttctggggtgggggtcgcgggtactggctcagagkgttgcagcgacctgcccaaggccacacagcctccgcgctgggctggacctggcctcttgttcccgaatcgtcttgaggagggggcgccctaaagtttccg

SEQ ID NO: 44985 - DNA, 201 bp, Homo sapiens
ttgctataatgctcttggtgattgtggggacactgtaagcatttcatgaggttacagggcctttgtaattttccatggaaggctgcagatactgggagacmggagctcaggtggggaggacctgggccctcaggtcaggtcccctaagggcacctcagtgccctcttctgcctggctgtgtgatctggtgcatgttcctat

SEQ ID NO: 44986 - DNA, 201 bp, Homo sapiens
gagttagaatcctggtctgtcactgttgcggctggtgacttgacttctctggggtttcctttctgactttctaaatggggctgatgtcagcacttctcacrgtggtgggggacggggtgcaccgtgaggatgaagtgggatcctgccggttacctggcttgtggaggagagtatttcagacagtgggcatgacatgtgcaa

SEQ ID NO: 44987 - DNA, 201 bp, Homo sapiens
tggtctgtcactgttgcggctggtgacttgacttctctggggtttcctttctgactttctaaatggggctgatgtcagcacttctcacagtggtgggggasggggtgcaccgtgaggatgaagtgggatcctgccggttacctggcttgtggaggagagtatttcagacagtgggcatgacatgtgcaaaggtcctgggcc

SEQ ID NO: 44988 - DNA, 201 bp, Homo sapiens
ctcatacctagaaagaaagtccactggtattgctggccagcttctccccctacctcttgatgcaaccaggtctctccttaagatcaggggaagcaccagtytcccaagatggctggataaagtcccaggattccctctgattggcctatcttggttcatgtgctcaaccctgagccaatcactatgaccagaggggaaggc

SEQ ID NO: 44989 - DNA, 201 bp, Homo sapiens
ctatgctgattggttcattttgggtcatgtgctcagccctgaaccaatcactgtgaccagggggaaggcctatgcagattggctcagagtcccaggaaggyggatggagagcttgggagccacgtgcgttgtgtgctgggcagatagcttgtccaaggaaattgaggatctgttagcaggaaatgggataatggttgctgg

SEQ ID NO: 44990 - DNA, 201 bp, Homo sapiens
ctcccgtgccgatcagcagtgggattgtgcctatgaatagccactacactccagcctgagtaacactgagtaacagtgaaacctctgtctctaatacaaattttttttttttgagacgaagtttcgctcttattgcctaggctggagtgcaatggagcgatctcagttcactgcaacctctgcctcccgggttcaaggatt

SEQ ID NO: 44991 - DNA, 201 bp, Homo sapiens
ggaagaagtgcctgggttgaggtgggagcaagggaggcaggttcagccttcagtggagaagaccacgctggaggtggcccacacaccaggtgcagcaaagkggaggaagtgggcaaaagaggccattcagggtggccctgatcttgtcactgtcagcaggagcctgatgtctgtggctgttaggatgagatggtgctgttc

SEQ ID NO: 44992 - DNA, 201 bp, Homo sapiens
tctcagagtgctggtattacaggcatgagccactgcgcccagcccatgttttctattagagtcagggctgagggacagtttttttcctgttgccgcttttrtgatgccttcaatgcttgtttctaagctcctagggtgcctctctgagccatgcagcctgggtcatccatgcccactggcccccctgaggcatggccctgg

SEQ ID NO: 44993 - DNA, 201 bp, Homo sapiens
gggtgtacccctcccctagtgcatctcccttcctgtgactctctcctgtaggcaccccctcctcaggaggtgcccctccccctagagtatctccctccccrccaggctcctcccctgtgggcgcctcctccctggggtgtccccctccctctaaagtatctccctccctgctgggctcctcccctgtgggttcccctcccc

SEQ ID NO: 44994 - DNA, 201 bp, Homo sapiens
agagggagaaggaagtaggggatggatatggttataaatgggcaacggtgagaatctctgtggtgttgggaatgtttagtaccttgactgtggtagtggawtcgtgtacctacatatgtgataaaattacatggcactcacataaaaagtacaaatagaattggagaaagctgaataagattgatggattttatcaatgtc

SEQ ID NO: 44995 - DNA, 201 bp, Homo sapiens
tgagtgaaagacactcatgcgggtccagagagcctccggtgagatgggcaggcctgataccaacatctgagcaagacactgtgcatctttttctaacacayaaaacttcaagccatgaagccagccttgagtcccgctgcacatttggacgtttgcctgtgaaatatgaaatgcaagggctttgtgcctcttataactccc

SEQ ID NO: 44996 - DNA, 201 bp, Homo sapiens
gcgagactcggcaaaaaaaaaaaaaaaaaccaaggatgggcgcctcccagagggtaatagcgagggtcccttcagacccccagagcagcacgagcccagcrtcagggactctggctgaacctcgagagcccctcagcatcctcggctgaccccatactcacaaggcacccctgtatgagtgcctcacttcactcttgccca

SEQ ID NO: 44997 - DNA, 201 bp, Homo sapiens
tgtttcgtgtatccatagtttattctttttttaatctgggctcactgcaatctccgcctcctgggttcaagcgattctcctgtctcagcctccccagaagytgggattacaggggcccgccaccatgcccggctaattttttttgtatttttagtagaggtggggtttcaccatgttggccaggctggtcttgaactcttg

SEQ ID NO: 44998 - DNA, 201 bp, Homo sapiens
ctcccaaactgctgggattacaggtgtgagccaccacacccagccacgtccatttctaggtttgtacacggctccctaaatgaggaggtaggcccagcccrtccccttctgcttttcaaatccttctctatccagagctttttttttgccccggggttaatgattaatcttgggaccttcgctgcatggttgacatgccca

SEQ ID NO: 44999 - DNA, 201 bp, Homo sapiens
atggagccggccttgaggtggaggactcagaccctgagcctgaaggggaggcggaggacaggtaacagctgggcccaccccagagataagagacataggckcaatatctccccacctccctcccctaccaacctcccccgacgacctgccccgactcctccgccccgccccgaccccccactggcagtgggagtgactcag

SEQ ID NO: 45000 - DNA, 201 bp, Homo sapiens
cgccccgccccgaccccccactggcagtgggagtgactcagggtcagaggctcagagttcctggggacaaagtgggacattcatcctccctccaccctggyccacgcaacacccaccagcgaacagctgtgcgcgggcgcacgcgcgcgtgtgtgtgtgtgtgtgtgtgtgtgcgtgcgcgcgcgcgcgcgcatacgggtc

SEQ ID NO: 45001 - DNA, 201 bp, Homo sapiens
ctcttaccgcacatggacacccagagcccatcactgtggtccactggaaggggaaaggaggcagagttgtacagtgccaggcctgggccatgtgtcccccwtccagttggggttctgccatctaaatgaggaggtggcagctggcctgagccccgtggagttgggttcaggaaaggggtgtggggtcccatcccgaagtcc

SEQ ID NO: 45002 - DNA, 201 bp, Homo sapiens; identical to SEQ ID NO: 10194

SEQ ID NO: 45003 - DNA, 201 bp, Homo sapiens
cagtttggtcctggggaccattcatacccacacacccagcttgtgcctgtggttaacatctcagaaaactctggtaaatgatcactccaggatattgacamgaatacacgttactgatcttactcacatgttctggggtgcacatgaactttgtgtgtgcatgtgtgtgtgtgtgcatgtgtgtgtcccgggcacctgaca

SEQ ID NO: 45004 - DNA, 201 bp, Homo sapiens
tattagcattctggatgccttctttaggctaaacagccaaattgaagaattaccagcaggacccaagcctctcactgggtcttgctgtgtcctggaatacrcagcagtacctgttcatggaaccacctgcagtacattagggatcagatttctccactgcctctcagacattgaatattgttatttttaaattattatatg

SEQ ID NO: 45005 - DNA, 201 bp, Homo sapiens
tcattcccttatgcttctgggggctgtcagcatccacttccccaccaatggtttgggtgttgtctgttgcctaggaaacgggactggtggtgatgaccgamcgagtgagcctgaaccaccggcaggacggtggcctctacaccgatgaggctgtccccgctttccagccccacacagggagcctggtggcagtggctcctt

SEQ ID NO: 45006 - DNA, 201 bp, Homo sapiens
ggatttcagatattatgtaagccctggaattgcggcatttggggggttagctattccttaacttttaccacatgctcaaaggagtctacgaatgaatgggstaaattgagaattattttaaattataaggcgcccatctccattgatcagaatggaggctgagatagttccttttgtatgaggtataccactagtgcctat

SEQ ID NO: 45007 - DNA, 201 bp, Homo sapiens
accaacctggactaccaggaaaccttcgagctgcacaggaccaaccagaaggttctgcagacagcagcggtgcgtgttcctgggatgagggtttgggggtkgttggaggaggggtcagcagggcctcacggtgacttctgtctccagatccccagcctccccacggggctgtttgtgagtgccaagggggacggctgctgc

SEQ ID NO: 45008 - DNA, 201 bp, Homo sapiens
aggctggagtgcagtgatgcaatcttggctcactgcaacctccgcttcctgggttcaagtgattctcctgcctcagcctccccagtagctgggattacagrtgtgcaccaccgtgcccagctaatttttttgtatttttaatagagatggggtttcatcatgttggccaggctggtctcaaactcctgacctcagttgatc

SEQ ID NO: 45009 - DNA, 201 bp, Homo sapiens
ttttggcaccagggaccagtttcatggaagacagttttttccacggaccagggagcagaagaaatggtttcaggatgattcaagggcattccatttattgygtgctttatttctattattattacactgtaatatataacgaaataatgatataactcaccataactgaagaaacagtgcaagccctgagcttgttttcct

SEQ ID NO: 45010 - DNA, 201 bp, Homo sapiens
ctaggggctgccgtttggggtcggccccctttatgtgctcagcatagtctcttgcccgccagcctccctgtccctccagcatacggtcctcagcacctccrgtatctccctcctgcccatccttgccctgctcttgggtggccgggacctttcctccctcttcagcctctggccagtgttgagatatttccagaaacaggg

SEQ ID NO: 45011 - DNA, 201 bp, Homo sapiens
gaagcatccccaagaccccctttctgctcttggcactcgggtgttgatctaagcatcttctcttctcagaccaaggtgatggcactgaacgggaagcccgwgggggctcagtacctgcccagctacctctccctcggcagctggtactcccccagccagtgctacctgcagctgcagccaccctcccacccactgcaggta

SEQ ID NO: 45012 - DNA, 201 bp, Homo sapiens
ttttgccatgttggccaggctggtcttgaactcctgacctcaggtgatccgcccaccccagcctccccaaagtgctgggattacaggtgtgagccattgcrctcagcctgtgctgcgattttagagtgaggcagacacagacacatatacatgatagatatatctggacatgtacatatgtatatcaagggatccaggtct

SEQ ID NO: 45013 - DNA, 201 bp, Homo sapiens
cctgcaactttaccctgtactacgaggtggctgcacggggcaatattgtgctatcgggccagcagcctgcccacaccacccagcagcgaagcaagcgggcrgcccctgccctggagaaaccgattcgtttaacacacctttctgagacaggtgagccgggcagcagggagaaggttcctgttcttccttctgaacaattga

SEQ ID NO: 45014 - DNA, 201 bp, Homo sapiens
ccacaggcacacactaccaccacgcccagctagtgtgtgtgtgtgtgtgtgtgtgtgtgtgtgtgtgtgtgtgttgtagagatggggtctctgtatgttgyccaagctggagtgccatggctgttcatagacatgatcattgtgcactgcagcctcaaattcctgggctcaagtgatcctcccatctcagtctcccaaagc

SEQ ID NO: 45015 - DNA, 201 bp, Homo sapiens
gccactgtgcccggcctggagtttgttcttttgtattgctgggtagtgtgctatgggtagcttttcgatttggttggtggtctgacacaagctactccccycttaccgcacatggacacccagagcccatcactgtggtccactggaaggggaaaggaggcagagttgtacagtgccaggcctgggccatgtgtcccccat

SEQ ID NO: 45016 - DNA, 201 bp, Homo sapiens; identical to SEQ ID NO: 10255

SEQ ID NO: 45017 - DNA, 201 bp, Homo sapiens; identical to SEQ ID NO: 10257

SEQ ID NO: 45018 - DNA, 201 bp, Homo sapiens
aaatccgtagagttggaaagatttgtggttgccaggggctgggggagtggggagtgagtgctgatggcgatggggtttctttgggggagaaagaaaccgtyctgtaactagacagaggtgatgattgcacagtatcgtgaatgtgctgactcccacccacacatgctcagccatgcgtgcacacacacaaaaaggagtggt

SEQ ID NO: 45019 - DNA, 201 bp, Homo sapiens
cctccctccctcccacatgggtgtgcccctcccttcctggttccctcctccctggggtgtacccctcccctagtgcatctcccttcctgtgactctctccwgtaggcaccccctcctcaggaggtgcccctccccctagagtatctccctccccgccaggctcctcccctgtgggcgcctcctccctggggtgtccccctc

SEQ ID NO: 45020 - DNA, 201 bp, Homo sapiens
ctatgacaccccaaaacatctccagaaactgccaagtgtccccctggggcacagtcactcctggggtgagttccccctgttccaggcctccaaactccttycccagtatcttggcccattccagggtgaattcttgtcccaaagctccttcctctgcctgcaggtgcccacgggcctccggggccaagcgcttctgaaagt

SEQ ID NO: 45021 - DNA, 201 bp, Homo sapiens
gtagccctggactgttgcttaattttttttttttccccaagaccgagtctctcgctctattgccaatgctggagtgcagtggcactatctcggctcactayaacctctgcttcctgggttctaagtgattctcttgccttagcctcccgagtagccgggattataggtgcccaccaccacgcccggctgatttttttttct

SEQ ID NO: 45022 - DNA, 201 bp, Homo sapiens
gaggggtgtgatgccccaggagagggcaggggataggtagggtgtggggagtctggggatggccatgcacacacccaggctgtccagaaatggggtaacartagagccacaggcaggatcacgggggtctgttggtgacccttcctccttctgtctcctgccttgggtctcagcctcttttcttcttcttcatcttccttc

SEQ ID NO: 45023 - DNA, 201 bp, Homo sapiens
cggggctcagaggcacaggcgcaaagcaaatgacagctcccatgtcagcggctgatggtgtttctggggggatgtttggggagagagtgctctgttctaargtgtgtgcgtgctctagttcagttggggggtggttctcatggaggggtggggggtcggacaggcgattctgcccccaggggacatggcaatgtctgggga

SEQ ID NO: 45024 - DNA, 201 bp, Homo sapiens
gcttgaggccaggagtttgagaccagcctggacaacatagtccctgtctgtataaaactttaaaacaattatctggacatggtggcacgtgcctgtagtcyccgctactcgggaagctgaggcgggaggattgcttgagcccaggagatcaaggctgcagtgaactgtgattgcaccactattctccagtttgggtgacaa

SEQ ID NO: 45025 - DNA, 201 bp, Homo sapiens
aggagatcaaggctgcagtgaactgtgattgcaccactattctccagtttgggtgacaaagtgagaccctgtctcagaaaaaaaaaaaggtggccaggcayggcagctaacgtctgtaatcccagcactttgggaggctgaggtgggtagatcactagaggtcaggagttcaagaccaggctggccaacatggtgaaaccc

SEQ ID NO: 45026 - DNA, 201 bp, Homo sapiens
ctcaaaaaaaaaaaaaaaagaaaagaaaagaaaagaaagaacgaaaagattcttaggctcctacaagagttctctcaggacccgattctttctggtttacyggctgctccagggtgtcacctccgcccctggtgacaagatggcttgatactcccagggctgagtccagaagcaaatggagaaatcagctctctgttgcag

SEQ ID NO: 45027 - DNA, 201 bp, Homo sapiens
gttgggtggctgactgcatgacactcactgtctcccatccctgggtaaagctgtccctgttctctactgaactgggacagcccccaactcaactctcttcwccttcccaccaggggacgtcatggggccaaccctgaaccacctcaacaacctcctgcggctgccgtttggctgtggagagcagaacatgatccactttgc

SEQ ID NO: 45028 - DNA, 201 bp, Homo sapiens
aagacccttccttgcactgtgagcatggctgaggcctctgaccctggccacaaagctggtgtcactgccacctgagtgcctactgcctgcttcctgccagygtccagcagccttggtttctttttccaggttggccatggtccagagccatccaatgagtctgtcattgtggcctggaccctcccgaggccaccagaggtc

SEQ ID NO: 45029 - DNA, 201 bp, Homo sapiens
tcttgcacctcaggtgtgtgtttcagggacatccctcaaagacactccaaccctgagtgagcacgggctgtgtttttcctccctccagatcctcggctccygggacttcgacatctgcgtgagggacatgatcccagcggacgtccctgagcacttccggggcagggtcagcatctgggccatagtgaccagtgtggacgg

SEQ ID NO: 45030 - DNA, 201 bp, Homo sapiens
actgggtaatttataaagaaaaagaggtttaattgactcacagtttcacgtggctggggaggcctcacaatcatggtggaaggcgacaggtacgtcttacrtggtcccagggagaatgagagaatgagagccaagtgaaaggggttttcgccttataaaaccatcagatctcgtaagacttattcactactgcgagaacag

SEQ ID NO: 45031 - DNA, 201 bp, Homo sapiens
agagccctgcccgcaccttgtccctgaactcggccgacacgtagtagtagatgaagggatccacgcagctgttgagggtgctcagcgccaggctgggcacrtaggcaccatagaggttgccccaggcgctggggctcgggtccgagtaatgcagcagcagcagcaggttgctgggcacgaagaaggccacggcggaggcca

SEQ ID NO: 45032 - DNA, 201 bp, Homo sapiens
tttgggttccaagtggatgtgaatttgggaggacccacccagtacagaatttctttggtcaccggtcctgtctctgtggacacagccctgtccttcctgargctcagaccacacacagtggtgccctcagattcgtccttctttccctcacaggctgtgtctggctgagtagctctgccttcaccccaggaaggctcccca

SEQ ID NO: 45033 - DNA, 201 bp, Homo sapiens
ctgccaccatgcccagctaaattttgtatttttagtagagatggggtttcaccatgttggccaggctggtctcgaactcttgacctcaggtgatccacccrcctcggcctcccaaagtgttgggattacaggcgtgagccaccactcacagccaactgaaccaagtttcttatcccttgctgcatttgcgccaaggtttca

SEQ ID NO: 45034 - DNA, 201 bp, Homo sapiens
ccctcccacatgggtgtgcccctcccttcctggttccctcctccctggggtgtacccctcccctagtgcatctcccttcctgtgactctctcctgtaggcrccccctcctcaggaggtgcccctccccctagagtatctccctccccgccaggctcctcccctgtgggcgcctcctccctggggtgtccccctccctctaa

SEQ ID NO: 45035 - DNA, 201 bp, Homo sapiens
acaacaaacaaacaaacaaaaaagtgggcaaaagaaataaccagacatttcaccagaggagacatacagatggcaaattgcacataaaaagatgctcaacrtcatttatcattagggaaatgcaaattacagcataatgacatacccctacacaccacctataagaatggctaagattaaaaatagagctgggcgcagtgg

SEQ ID NO: 45036 - DNA, 201 bp, Homo sapiens
atgctcaacatcatttatcattagggaaatgcaaattacagcataatgacatacccctacacaccacctataagaatggctaagattaaaaatagagctgrgcgcagtggctcatgcctataatcccagcactttgagaggccaaggtgggtggagaacttgagtccaggagttcaagaccagcctggccaacatgatgag

SEQ ID NO: 45037 - DNA, 201 bp, Homo sapiens
cccggcccggcccggtccctgacccgtcgcgcctgcacttggtcacccgccaccctcgtcccgtagccttcgaggccactcgcttctacaacgtcagcacscacagcccactcgcccgggaactgtgcgccggacccgcgtgcaacgaagtggagcgcgcccctgcccggggcccgggtgagtgcgcggagccactgccgc

SEQ ID NO: 45038 - DNA, 201 bp, Homo sapiens
gctccagggtgtcacctccgcccctggtgacaagatggcttgatactcccagggctgagtccagaagcaaatggagaaatcagctctctgttgcagtcacsctggggatgccccttgttggctcccagggccacctctatcccatgcacagacacaggggctgggaggagcctcctggcctcgtgtccaccctgggatagg

SEQ ID NO: 45039 - DNA, 201 bp, Homo sapiens
tccccgaaacatggatttggcattgtctcaacatcaggtacattaagatttcttttctgcgctgactttgccggttgagtgaaagacactcatgcgggtcyagagagcctccggtgagatgggcaggcctgataccaacatctgagcaagacactgtgcatctttttctaacacacaaaacttcaagccatgaagccagcc

SEQ ID NO: 45040 - DNA, 201 bp, Homo sapiens
ttgggttctttcctaggagcggaattgctaggtcagagggtaacactatgtgtgaccttttgaggaactgccaaatggtcaatgtggctgcactattttayattcccacctgtttaaagttttgtaaccttttttggtctttcagcataatgttacattgtgagtgggctacagtacaacagacacccaccttcctggaga

SEQ ID NO: 45041 - DNA, 201 bp, Homo sapiens
agattcccatccctctgtaggtgcccggacattaagcctttcagcaccggctcctccccacctcccacccaaagctccttctcagtccctttcccacctgrgacacatctgctccaatgggctcccctctcttatgtctgagatatctttaatttaatttaatttaattaatttatttattgagatggagtctctctctgt

SEQ ID NO: 45042 - DNA, 201 bp, Homo sapiens
cagcctctttcctcttctgcccaatggagccaacatccatcttccctgggatgttgtccagatccagtgagggaccctctgcatggtcccgtggcatagaytgggtatgccaccaagtgacccctggccctccaagcagctgaagagtcttgcacctcaggtgtgtgtttcagggacatccctcaaagacactccaaccct

SEQ ID NO: 45043 - DNA, 201 bp, Homo sapiens
tatttttctgtgaagtccacatgtccctgcaactttaccctgtactacgaggtggctgcacggggcaatattgtgctatcgggccagcagcctgcccacaycacccagcagcgaagcaagcgggcggcccctgccctggagaaaccgattcgtttaacacacctttctgagacaggtgagccgggcagcagggagaaggtt

SEQ ID NO: 45044 - DNA, 201 bp, Homo sapiens
cccagaccccagcccatggtaacttgtgggcaagtccaagcatcccactgaccactgcccccaggggatgggagaggaagcaagtagagagtctgaggacmctgacttctggcttcctctgcagctgctccttgacaagcacatggggatgaagaggtatgaagtggctggacgccgagtgctcttctactttgatgaggt

SEQ ID NO: 45045 - DNA, 201 bp, Homo sapiens
cttgcacctcaggtgtgtgtttcagggacatccctcaaagacactccaaccctgagtgagcacgggctgtgtttttcctccctccagatcctcggctcccrggacttcgacatctgcgtgagggacatgatcccagcggacgtccctgagcacttccggggcagggtcagcatctgggccatagtgaccagtgtggacggg

SEQ ID NO: 45046 - DNA, 201 bp, Homo sapiens
tccacccccgtgcagaggcagctggtggacatccggtactccaaggacacgaggaagcagttcaagccgggcctggcctacgtggggaaggtaacttgggrgtgactgtgctgcctcccgcccaaggaccaccgtgaaaccaccaccactagccactagctctgcagtggtgactcagctgaaaacggatcccctgacata

SEQ ID NO: 45047 - DNA, 201 bp, Homo sapiens
gtcaattttttaattttttgtagagatgggatcttgctgtgttggccagactggtcttgaactcctgggctcaagcagatctcctacctcagacccccaargtgctgggattgcagatgtgagccactacacccagtcattattcttattttaactgttaaactggggtaggctgggcacggtggctcatgactataatcc

SEQ ID NO: 45048 - DNA, 201 bp, Homo sapiens
tgaggtttaagtgtcacactgaactgtccataccctggtatggcatcagactaatgactagcacatgtaatttgtacttcatgacctctttgccaaatccragggcatgaaggtctacccttatgtttcttctaagaatgttatagctttagctgttacatttaggtctgtgatccatttgagtttatttttgtatatggt

SEQ ID NO: 45049 - DNA, 201 bp, Homo sapiens
acaggaggtgaggacagagaggtctccaaactggagctcttgaggaagtagatccagaaggccttagtgtcccatcatcaggggaggcaagaacaggaggkactggagaggatgtcccagcccttggctttgggaactggcagtggacctggcggccctgcagagagtaaatacgtagatgggaactgaggacactgtggt

SEQ ID NO: 45050 - DNA, 201 bp, Homo sapiens
cctcggcctcccgaagtgctgtgattacaggtgtgagtcactgtgcccagctggacacttgcttcttgatgctaggaagaatgggctggacaactggctaytactccctgaggattggggagggggttccccaaagggatattggagcatgagagggtgtttcttctgggcagagcaagcagaagcatccccaagaccccc

SEQ ID NO: 45051 - DNA, 201 bp, Homo sapiens
gtagccagcctttttggcaccaaggattggttttgtggaagacaatttttccacagacgggggcacgggcacgggggatggtttcaggatgattcaaggayattatgtttattttgcacttcatttctattattatgacattgcaatatataatgaaacaatgatacaactcaccatcatgtagaatcagtgggagccctg

SEQ ID NO: 45052 - DNA, 201 bp, Homo sapiens
ccacgggcctccggggccaagcgcttctgaaagtgtggggccgcggctggcaggcggaggaggggcccctctttcacaaccagacctcggtgaccgtggayggccggggcgcttctgtattcatccagacggacaagcctgtgtacagaccccagcaccgaggtgagtggccagcatggatgcagggagggccggccatgg

SEQ ID NO: 45053 - DNA, 201 bp, Homo sapiens
ggccagggggtctgtgcacacctgagactcatgttgtgtcgcagcatgatgtaaggaattatgggaacatgagttgcatctttactgaagcatctccaaargtcacacaaaaggagattgcattcaaaacacatggggaaagccatcaattattctctgcctttgttgaattcaggatttaagggacagcacttgtttcca

SEQ ID NO: 45054 - DNA, 201 bp, Homo sapiens
tctactttgatgaggtaccaccagccggggttggtggaggaggcttccctggtgtgcatgttggtgagggtgcaccggtcactgcctggtgtggctccctscaagtatcttgtaccataaaaaagacactggggccgggcatggtggctcatgcctgtaatcccagcactttgggaagccgaggtgggaggatcacttgag

SEQ ID NO: 45055 - DNA, 201 bp, Homo sapiens
ctactttgatgaggtaccaccagccggggttggtggaggaggcttccctggtgtgcatgttggtgagggtgcaccggtcactgcctggtgtggctccctgmaagtatcttgtaccataaaaaagacactggggccgggcatggtggctcatgcctgtaatcccagcactttgggaagccgaggtgggaggatcacttgagc

SEQ ID NO: 45056 - DNA, 201 bp, Homo sapiens
tcaggtgtgtgtttcagggacatccctcaaagacactccaaccctgagtgagcacgggctgtgtttttcctccctccagatcctcggctcccgggacttcracatctgcgtgagggacatgatcccagcggacgtccctgagcacttccggggcagggtcagcatctgggccatagtgaccagtgtggacgggagccagca

SEQ ID NO: 45057 - DNA, 201 bp, Homo sapiens
ggcattgtctcaacatcaggtacattaagatttcttttctgcgctgactttgccggttgagtgaaagacactcatgcgggtccagagagcctccggtgagrtgggcaggcctgataccaacatctgagcaagacactgtgcatctttttctaacacacaaaacttcaagccatgaagccagccttgagtcccgctgcacat

SEQ ID NO: 45058 - DNA, 201 bp, Homo sapiens
gaaaaaggaaggagagagagaaagagaaagaaagaaagaaaaagaaagaaaagagagaaagaagaaaggaagagggagggagggaaggaaggaaggaaggmggcaggcaggcgggcaggcgggcaggctaatgcatcccatttttgtggttcatataaagagcctagagccacttgattttgaagacagcttattcattga

SEQ ID NO: 45059 - DNA, 201 bp, Homo sapiens
ccgacagccttcagtttgcagtcgagaccttcttcgaaaaccaggtagagcatcgtgcactgaacctgggacacagccaggggccatcggggcttctccarggtgctggccagggggtctgtgcacacctgagactcatgttgtgtcgcagcatgatgtaaggaattatgggaacatgagttgcatctttactgaagcatc

SEQ ID NO: 45060 - DNA, 201 bp, Homo sapiens
cacagttcacaatagggttcacactcctgagagaatctaatgctgccactgctgatgtgacaggaggtggagctcacatggtaatatgagtgatgcgagcrgctgtaaatacagatgaagttttgattgtcggcctactactcacctcctgctgtgtgacctggttcctaacaggccatgaatcagtactggtccatggcc

SEQ ID NO: 45061 - DNA, 201 bp, Homo sapiens
agaatctaatgctgccactgctgatgtgacaggaggtggagctcacatggtaatatgagtgatgcgagcggctgtaaatacagatgaagttttgattgtcrgcctactactcacctcctgctgtgtgacctggttcctaacaggccatgaatcagtactggtccatggccctgggggttggggacccctgctctaagggac

SEQ ID NO: 45062 - DNA, 201 bp, Homo sapiens
aaagactatgctttccccattgaatggtcttggcacccttatttcaaatcagttgcccttagctgtctggattcatttcagggctctcacttctatcccaytggtttctatgtctctccttatgctggtactacactgtcttgattactgtagctttgtagtaagttttgaaattaggaagtgtgagtcctccaatgttat

SEQ ID NO: 45063 - DNA, 201 bp, Homo sapiens
tcccactggtttctatgtctctccttatgctggtactacactgtcttgattactgtagctttgtagtaagttttgaaattaggaagtgtgagtcctccaaygttattcttctttttcaagattcctgagtcctttgtgttttcatataaattttaagatcagttccatttctgcaaaaaaggccattgagattttgatagg

SEQ ID NO: 45064 - DNA, 201 bp, Homo sapiens
cagttccacgtggctggggaggccttacaatcatggcagaaggtgaaaggtacatcttacatggtggcagacaagagagaatgggaaccaagtgaaaaggraaaccccttataaaattatcagatctcacgagactcattctctaccatgagaactgtattggggaaactgtccccatgattcagttatctcccactgggt

SEQ ID NO: 45065 - DNA, 201 bp, Homo sapiens
aattatgggagctacaattcaagatgagatttgagtggggacacagccaaaccatagcacccgaggctggagggtggtggcacagtcatggcttactgcarccttgacctcctgtgctcaagtgatcctcctgcctcagcccccctagatagctgggactatgggcttgtgccaccacacccagctattttttttattatt

SEQ ID NO: 45066 - DNA, 201 bp, Homo sapiens
ggggccaggactggatgctgggcactccgctccctcagccatcccaacctccctctggccccagaatggccgtcttcctgtggtgggttgcaacattggtrcgaggcagagccccccatgctgcgtgtcttccataggttggggaagaagcctatttttctgtgaagtccacatgtccctgcaactttaccctgtactacg

SEQ ID NO: 45067 - DNA, 201 bp, Homo sapiens
gctgaggggcgggatttgtggtgggtgtggtcagtgcggagggggcggggttaagagtggtcaggacggagggggcggggttgagggtaggtgtggtcacsgcggagggggcggggttgaggataggagcggtcagtgcggtgggggtggggttggggtgggtgtggtcagtgcggaggaggcgcggcaggggacggggct

SEQ ID NO: 45068 - DNA, 201 bp, Homo sapiens
gactttggccttccccctttcccacactgtgggggctgtcccgctgcaaagtgagcacctgcccttcccctgggaagggggcactgtggtttaggaagaaygatgtcccagctggggacaggcagagccagtgagggtggggcatgaatgaatgaatacacagggaatgaatactcagggaatgaatacacagggaatacg

SEQ ID NO: 45069 - DNA, 201 bp, Homo sapiens
gggttgaggataggagcggtcagtgcggtgggggtggggttggggtgggtgtggtcagtgcggaggaggcgcggcaggggacggggctgttgttgcagggyggcccagacaggacgccctgtctcctttctctcctacaaccgctttttaaaagtctgtttctgtttttgtaagtattaggcaaatacctgcgtgaaattc

SEQ ID NO: 45070 - DNA, 201 bp, Homo sapiens
ggccccataggaatctttctcctctcctggccagtcagagcggcttctcttcctaacggctgccctgctgagagcaggacgacaccatctggctgcatccygtccctatcagcctgtgactctgtatggtgggtgggcagacctcagcccaggtgacacctgcctctaaatgaacccaaggaacagaatgacagagatctg

SEQ ID NO: 45071 - DNA, 201 bp, Homo sapiens
tgagtaaatgcttataaagcattcagcgcattttctgcctcgtaataagaaggtcacaaatgatagctgcttctgctaccactattaatgctatcattatycttattatctggaggcagattgtggaggacttttggaggccaaacagagacactaagatttgaagaggtaggaagtagggagccaaggaatgttattaag

SEQ ID NO: 45072 - DNA, 201 bp, Homo sapiens
cagaggctggcacacagaaccactatgtatgtgtaagccattactgttaatgcgctgtctctacatcctcagtgctaggctgcctggaaacactatcctgygacttttggttgttgaagcctacaccaaatctaccttcccagtggaatgcatgcttgcccaccttgaaatccctgatgcagatcaccttgtccagggagc

SEQ ID NO: 45073 - DNA, 201 bp, Homo sapiens; identical to SEQ ID NO: 10258

SEQ ID NO: 45074 - DNA, 201 bp, Homo sapiens
gagtccaggagttcgagaccagcctggacaacatggcaagacgtcgtgtctacaaaaagtacaaaaatgagctggatgtggtggcgtgcatctgtggtccyagacacttgggaagctgagatggagggatcacttgagccccaggagttcgaggctgcagtgagctgtaatcacaccactgtacatcagctgggcgacaga

SEQ ID NO: 45075 - DNA, 201 bp, Homo sapiens; identical to SEQ ID NO: 10259

SEQ ID NO: 45076 - DNA, 201 bp, Homo sapiens
gggaggccgaggcaggcggatcacgatgtcaggagatcgagaccatcctggctaacacggtgaaactccatctctactaaaaatacaaaaaaaaatagccrggcgtggtggtgggtgcctgtagtcccagctactcgggaggctgaggcaggagaatggtgtgaacctgggaggcggagcttgcagagagccgagatcgtg

SEQ ID NO: 45077 - DNA, 201 bp, Homo sapiens
gctgagatgagaatcacttgaacccaggaggtggagattgcagtgagctgagattgtgccactacactccaacctgcatgacagagtgagactctgtctcaaaaaaaaaaaaaaagaaaagagaagaaaaagaaagtcatttcaggtgaggatcaggaacctggctggggagacaaggtggggagcaagaggcattattca

SEQ ID NO: 45078 - DNA, 201 bp, Homo sapiens
ggcaggcggatcacgatgtcaggagatcgagaccatcctggctaacacggtgaaactccatctctactaaaaatacaaaaaaaaatagccgggcgtggtgrtgggtgcctgtagtcccagctactcgggaggctgaggcaggagaatggtgtgaacctgggaggcggagcttgcagagagccgagatcgtgccactgcact

SEQ ID NO: 45079 - DNA, 201 bp, Homo sapiens; identical to SEQ ID NO: 10260

SEQ ID NO: 45080 - DNA, 201 bp, Homo sapiens
tactaaaaatacaaaaaaaaatagccgggcgtggtggtgggtgcctgtagtcccagctactcgggaggctgaggcaggagaatggtgtgaacctgggaggyggagcttgcagagagccgagatcgtgccactgcactccagcctgggcgacagagcgagactctgtctcaaaaacaaacaaacaaaaaaaaacaaacccac

SEQ ID NO: 45081 - DNA, 201 bp, Homo sapiens
gccgtggggtttcaaagcatctggggatgcagacacttccatcttcctcctgcttcctgccaggagtgcaaatcagacacatttcccaaatccaaaaacawaccaccgggaaagcagtgaatttacacggtggaatttgtctcacttgagaggggcagaaatagctgccctgcacggtggaaatgtcgaaggtcatataag

SEQ ID NO: 45082 - DNA, 201 bp, Homo sapiens
tgcccctacagtcactttcctgtgggggctgccctgctcacccaggaggggagaatcttcaaaggtaaaggtgggcaccccagggtcccccagcccagcarcctgggtggtgggtcagaggaagatgtacaggaagaggcgcagaggcacaggcagtggcaagagcgcggctctgtcccttcttcccccagtctccgctgg

SEQ ID NO: 45083 - DNA, 201 bp, Homo sapiens
ctgccaccatgccaggctaatttttgtatttttagtagacagggtttcaccatattggccaggctgatctcaaactcctgaccttgtgatccgcccgcttyggcctcccaaagtgctgggattataggcttgagccaccatgcccagcctcatcatgtgtttttataggccaggcttgtggcttctttggcgatccaattc

SEQ ID NO: 45084 - DNA, 201 bp, Homo sapiens
tatgggtatccatggcccatcaggctgactctgaagcccgtgctcctcacggctgcctctctgtctttgtggttctgtaagttggacaaaattattttcarccatggaggaaacataatggtactttggcatgtggatgctgcttgtaccgtgggagtttctgcttttggagttgtgttttgggagaaagggggttgtttt

SEQ ID NO: 45085 - DNA, 201 bp, Homo sapiens
gctgcctgcccggggtaccaacatggcccagaagcgtcctgcctgcaccctgaagcctgagtgtgtccagcagctgctggtttgctcccaggaggccaagmagtcagcctactgcccctacagtcactttcctgtgggggctgccctgctcacccaggaggggagaatcttcaaaggtaaaggtgggcaccccagggtccc

SEQ ID NO: 45086 - DNA, 201 bp, Homo sapiens
tgcccctgttccagcaacacaacgtgatacagactcctgtcctacaagatataacagaaaggcagcattgaaacataaagcggggggaacctgagccaggygcggtggctcacgcctgtaatcccagcactttgggaggccaagatgggcagatcacgaggtcaggagatcgaaaccatcctggctaacacagtgaaaccc

SEQ ID NO: 45087 - DNA, 201 bp, Homo sapiens
atgggcagatcacgaggtcaggagatcgaaaccatcctggctaacacagtgaaaccccgtctctactaaaaatacaaaaaaattagctgagcgtggtggcrgatgcttgtagtcccagctacttgggaggctgaggcaggagaatggtgtgaacctgggaggcagagcttgcagtgagccgagatggcgccactgcactcc

SEQ ID NO: 45088 - DNA, 201 bp, Homo sapiens
atctgtgaaatggaggagactggtctgttacagggtcttaagaaacgatttctgtaaagttcctgacacagggtatgtaatacattcaaactattatatakttttgttttgttttgttttgttttgttttgtttgagaacaagtctctctgtgccgcccaggctggagtgtagtggcaagatttcggctcactgcaacctc

SEQ ID NO: 45089 - DNA, 201 bp, Homo sapiens
ttctgagtaagtaaagcccgaggtgcactcaaggagaagggctccagtatccgatagccttccctgtcaccgaggtgtgtcctggcttccttaaggcttcyggaggaataaatgacggttggcgggcgcctgtagtcccagctacttgggaggctgaggcaggaacatggcgtgaacccgggaggtggagctcgcagtgag

SEQ ID NO: 45090 - DNA, 201 bp, Homo sapiens
gaagggtacattttattccaagaataaaggaaactgaagtgtacacttttttttttttgagacggagtctcactctgtcacccaggctggagtgcagtggyagagtctcagctcactgcaacctccgcctcctgggttcaagcaattctcctgcctcagcctcccgagtagctgggactacaggcgccagctaccatgccc

SEQ ID NO: 45091 - DNA, 201 bp, Homo sapiens
actgaagtgtacacttttttttttttgagacggagtctcactctgtcacccaggctggagtgcagtggtagagtctcagctcactgcaacctccgcctccygggttcaagcaattctcctgcctcagcctcccgagtagctgggactacaggcgccagctaccatgcccggctaatttttgtatttttagtagagactggg

SEQ ID NO: 45092 - DNA, 201 bp, Homo sapiens
ggtaaggtgccaggtgctggggatatcacagtgaacagggatgacacaatccctgcccccatggcagtcccctcatattgcataggtgatgactgaaggckcgagcctcatccagtggaaggaaggaatggaggagataaacaggactgtggcccatttgcattgcagggaaagacctggtgtcaccagagaaagggttgt

SEQ ID NO: 45093 - DNA, 201 bp, Homo sapiens
atgctttccagcactggaactggtgttctgcttggaacagcaggaggtcagacagcctcatcgtgcctccagagccaggggacccccatgccagaatgctygggtcctttcttgttttaaaacccacaatagtcgggcatggtggctcacgcctgtaaccccagcactttgggaggccgaggcaggcggatcacgatgtca

SEQ ID NO: 45094 - DNA, 201 bp, Homo sapiens
gccatgttggccaggatggtctcgaactcctgacctcaggtgatccatccgcctcagcctcccaaagtgctgggattacaggcatgagccaccacgcccarcctgcacatactatttatttccttcgcctacgacacagagaaacccagggcttccgaatagcatctctgcctcttcatcacactgaacctatctcctcac

SEQ ID NO: 45095 - DNA, 201 bp, Homo sapiens
ctgtcacccagactggagtgcagtggcatgatctcggctcactgcaacctctacctcccaggttcaagcaattctctgcctcagcctcccaagtagcaggkattacaggcatctgccaccacgcccggctaatttttgtattcttagtagagacagggtttcaccatgttggccaggctggtcttgaactcctgactttgt

SEQ ID NO: 45096 - DNA, 201 bp, Homo sapiens
agcaactctcccatggccctaaccatgcctttgttacggcatttgtgtgaaattttatctccccctccagagggtaagctccaggaattgtccgattggtytttgttgctcctttcccatgcctgcctgacatagagaaggattttggtcgacatgtgtggaatgaagtgaaaaataacccccaaaaagcttaagaggccc

SEQ ID NO: 45097 - DNA, 201 bp, Homo sapiens
atttggggttcaaatcctgattctgccacttcactaactctgtggccttgggcaagtcgtttcacctttcatgatctacagcatgcaggtgataagagcgmctgcataccccggccccttacagggttgttgggggattaaatgaactaatccacttaaggtccttagcacagaggctggcacacagaaccactatgtatg

SEQ ID NO: 45098 - DNA, 201 bp, Homo sapiens
taccaaaggcagagtgtgtagatttggggttcaaatcctgattctgccacttcactaactctgtggccttgggcaagtcgtttcacctttcatgatctacmgcatgcaggtgataagagcgcctgcataccccggccccttacagggttgttgggggattaaatgaactaatccacttaaggtccttagcacagaggctgg

SEQ ID NO: 45099 - DNA, 201 bp, Homo sapiens
catttttccagcacccaactgctgtactctaggtattcagctcagtttccctgagcccaagatgcactcattatcgcactcatgatttgttaaattgagarcgtttgtggatttagaggatgaatgagaagtaccagctcccttgttaacatcagatgggtctgagcaacctcagagagaacccctctcaggtctttaagg

SEQ ID NO: 45100 - DNA, 201 bp, Homo sapiens
atcgacttttaaacaaaactaagtatcactagcaatgattagcaaatgtccttatttacacaaaacctgccatttttccagcacccaactgctgtactctrggtattcagctcagtttccctgagcccaagatgcactcattatcgcactcatgatttgttaaattgagagcgtttgtggatttagaggatgaatgagaag

SEQ ID NO: 45101 - DNA, 201 bp, Homo sapiens
aaagcccgaggtgcactcaaggagaagggctccagtatccgatagccttccctgtcaccgaggtgtgtcctggcttccttaaggcttccggaggaataaakgacgctgtgctgagaacattttgtgcagataggccaagatcaggatgtgaattgcactttatgaaaaaaaagagaaaaggagggaaataactcaatttca

SEQ ID NO: 45102 - DNA, 201 bp, Homo sapiens
catgcctgttggtctttagggacatctgggtgcataggtcacattctgtgaggtaattatctcttcactcatagtggagttaattcctgtggtagagctayagcacctttctggctaaaatacagaaagagagctacaccttttagcacctttctggctaaaatgcagaaatgcaggggtttagtgcaaggccagtgggga

SEQ ID NO: 45103 - DNA, 201 bp, Homo sapiens
tcccaggactttgggaggccaaggctgacagatcacatgaggccaggagtttgagaccagcctggccaacacagcaaaaccccatctctagtaaaaatagaaaaaaattacctgggcatggtggcacacacctgtaatcccaggctacttgggaggctgaggcacaagaattgcttgaacccaggaggcggaggttgaagt

SEQ ID NO: 45104 - DNA, 201 bp, Homo sapiens
ggaatgttcctaccctgccgactgccccagaccgcgctcaaatgtggcttaaatccagggtctttcaatgcttagaggactgggatgaggaaggaagttgratgggaggcaggaaggggaggccataaatcaaaaacatcaacagtcctggggtgcaggcagggagagcgttcgtgctttcccagcctcggatatgtctgg

SEQ ID NO: 45105 - DNA, 201 bp, Homo sapiens
tggcaagatttcggctcactgcaacctccgcctcccaggttcaagcgattctcatgcttcagcctcctgagtaattgagactacaggtgccggccagcacrcctggctaatttttgaatttttagtagagacagggtttcaccacgttgaccaagctggtctcgaacttctggcctcaagtgatctgcccacctcggcctc

SEQ ID NO: 45106 - DNA, 201 bp, Homo sapiens
ccactcaaatctcatcttgaattgtagctcccataattcccacatgtcatgggagggacctggtgggaggcaattgaatcatgggggcgggtctttcccaygctgttctcgtgatagtgaataagtctcatgagatctgatggttttataaatgggggttccctcacacaagtcctctcttgcctgttgccaggtaagaca

SEQ ID NO: 45107 - DNA, 201 bp, Homo sapiens
aacctccgcctcccaggttcaagcgattctcatgcttcagcctcctgagtaattgagactacaggtgccggccagcacgcctggctaatttttgaattttyagtagagacagggtttcaccacgttgaccaagctggtctcgaacttctggcctcaagtgatctgcccacctcggcctcccaaagtgctgggattataggc

SEQ ID NO: 45108 - DNA, 201 bp, Homo sapiens
acatccctttgctcttccttcctcttccgccatggttgtgaggcttccccagccatgtggaactgtgagtccattaaacctccttttttattttattttatttttttttttttttgagaccgagtctcgctctatggccaaggctggactgcagtggtgtgatcttggctcactgcaacctctgcctcccgggttccagag

SEQ ID NO: 45109 - DNA, 201 bp, Homo sapiens
catccctttgctcttccttcctcttccgccatggttgtgaggcttccccagccatgtggaactgtgagtccattaaacctccttttttattttattttatttttttttttttttgagaccgagtctcgctctatggccaaggctggactgcagtggtgtgatcttggctcactgcaacctctgcctcccgggttccagaga

SEQ ID NO: 45110 - DNA, 201 bp, Homo sapiens
acacgtaggcagtgtcttacaccacacctgctgagtccaaaccatgggaggctcctctcctagaccctgcatcctgaaagctgcgtacctgagagcctgckgtctggctgcagggacacacccaaggggaggagctgcaatcgtgtctggggccccagcccaggctggccggagctcctgtttccgctgctctgctgcctg

SEQ ID NO: 45111 - DNA, 201 bp, Homo sapiens
tgagaccgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcat

SEQ ID NO: 45112 - DNA, 201 bp, Homo sapiens
gaccgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctc

SEQ ID NO: 45113 - DNA, 201 bp, Homo sapiens
cttcatcatggaggcattgggtaaattaagacagtgccaggttcttgggaagggccactaccatgggccaaagaatctaccagtgccccaggtcgaattgycctaattgccctgtccttctccccaccttgtttggagtaaccagttccttcctgctttggaatggggcaaacttcttactcaacacacgcaacaggaagt

SEQ ID NO: 45114 - DNA, 201 bp, Homo sapiens
ccgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcga

SEQ ID NO: 45115 - DNA, 201 bp, Homo sapiens
gcattgggtaaattaagacagtgccaggttcttgggaagggccactaccatgggccaaagaatctaccagtgccccaggtcgaattgccctaattgccctktccttctccccaccttgtttggagtaaccagttccttcctgctttggaatggggcaaacttcttactcaacacacgcaacaggaagtgtctctgccagac

SEQ ID NO: 45116 - DNA, 201 bp, Homo sapiens
tcactgctgcactcctagcaccaatgacagtgcccagcactgctcagtaaatatttgttggttgaaatgagacaatgcatataaaatgctttgcagaatgyctggcacattctaggcacacattatcttttttttttttattttattttatttttatttttatttatttatttttatttttttttgagatggagtcttgct

SEQ ID NO: 45117 - DNA, 201 bp, Homo sapiens
cgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcgaa

SEQ ID NO: 45118 - DNA, 201 bp, Homo sapiens
gcatgcctgttggtctttagggacatctgggtgcataggtcacattctgtgaggtaattatctcttcactcatagtggagttaattcctgtggtagagctrcagcacctttctggctaaaatacagaaagagagctacaccttttagcacctttctggctaaaatgcagaaatgcaggggtttagtgcaaggccagtgggg

SEQ ID NO: 45119 - DNA, 201 bp, Homo sapiens
gcctgcaaagcaggtaaataagcaaggcaactctcatacaagggccagtatgcccctgttccagcaacacaacgtgatacagactcctgtcctacaagatwtaacagaaaggcagcattgaaacataaagcggggggaacctgagccaggtgcggtggctcacgcctgtaatcccagcactttgggaggccaagatgggca

SEQ ID NO: 45120 - DNA, 201 bp, Homo sapiens
agaggtaagcagcttctcttgctgtctggaatgcaaatatcttccctgtcgcaggctatgggagccacgccaagttgcaggcatggcaggcatggcaggcrtggagacacagctactgtcctgtttgcttggttggctgacttctaaggcctccctacgcttgcatgagtcactggaaattattccttcatttaacaaata

SEQ ID NO: 45121 - DNA, 201 bp, Homo sapiens
tgctaacagcctgtgaaaggaaggtgattaatgctatccatttaacccctgcaaccctgaaaggcagagaaggaaacaggtttggaaagtttcagagctcraaatcacagagctgggattggaacccagacttcccctgactccaaaagctgttgctctgtggggagtgaaggatctctgagtaccgtgttgaaattcaga

SEQ ID NO: 45122 - DNA, 201 bp, Homo sapiens
tgcttagaggactgggatgaggaaggaagttggatgggaggcaggaaggggaggccataaatcaaaaacatcaacagtcctggggtgcaggcagggagagsgttcgtgctttcccagcctcggatatgtctggcaccttactgaggcttccacaacactaagtccacacctcctgcccactgacctaagtgttaatgctcg

SEQ ID NO: 45123 - DNA, 201 bp, Homo sapiens
cacctgctgagtccaaaccatgggaggctcctctcctagaccctgcatcctgaaagctgcgtacctgagagcctgcggtctggctgcagggacacacccarggggaggagctgcaatcgtgtctggggccccagcccaggctggccggagctcctgtttccgctgctctgctgcctgcccggggtaccaacatggcccaga

SEQ ID NO: 45124 - DNA, 201 bp, Homo sapiens
catcacctccaccttccagtctgtggaaggagaaaagaatggaagtaacaggcaagcaacctccttaccaaaagtatgatccagaaatttcccacatcacyttgggccacatcccattggccagaactgcatcatgtggccacactgtgctgcaagggagtctgggaattacagtccctagctgagcggccatgctggaat

SEQ ID NO: 45125 - DNA, 201 bp, Homo sapiens
accactgtgaccacattcaccctcaccctgacaagggacctgcagctgtggcacccagtagtgtctaatgacatccgtcaactctggacatgaatgcctgygatcctgagaacgagttaaatgactaatcactcctaacatgccaatgtaaataatgaagggaccagaaaatatgtgaggaaaaatatacaagaagataat

SEQ ID NO: 45126 - DNA, 201 bp, Homo sapiens
ttgagtagtggggcatgtgagtgtgccccctgccacaaccatctttctttctcattaactggcctattacatgttttacacaaagtaaaggaagatttctstctctgaggcctttctgaacttccagagcagacacatgtgaccatcctgagagactgggtcttctgcaagtgtggaaatgtgctttaacggcatgtcagc

SEQ ID NO: 45127 - DNA, 201 bp, Homo sapiens
gagatgacattccaccattgtgatttgttccttccccaccccaactaaccaatcgatcttgtgacattccacccccccaccaccgacaatgagtctcacgrtctccccaccctgcaccgtgtgacccccgcccctgcccacaagaaaacaaccccctttaactgtaattttccattacctacccaaatcctataaaactgc

SEQ ID NO: 45128 - DNA, 201 bp, Homo sapiens
aactcctgagcatagtgaattttgtctgttttgttcactgctgcactcctagcaccaatgacagtgcccagcactgctcagtaaatatttgttggttgaartgagacaatgcatataaaatgctttgcagaatgcctggcacattctaggcacacattatcttttttttttttattttattttatttttatttttatttat

SEQ ID NO: 45129 - DNA, 201 bp, Homo sapiens
gagctccctcatactgtgtgttccttctgcaattttttttttttttgagaaggattttcattcttgttgcccaggctggggtgctatggcacggtcttggstcactgcaacctttgcctcccggattcaagcgattcttctgcctcagcctcctgagtagctgggagctacaggcgcccaccaccaagcctgggtaatttt

SEQ ID NO: 45130 - DNA, 201 bp, Homo sapiens
tgtgggaggctgaggtaagaggacctcttgaggtcaggaattcaagactagccaagtaaacagtgagattctgtctctaaaataaacaaataatataaatwaattaaataataaaataaactaaataaattaaattagcttggccttatgatgcttgcccgtggtcccagctacccaggaggctgaagcagacggatctct

SEQ ID NO: 45131 - DNA, 201 bp, Homo sapiens
gctccctcatactgtgtgttccttctgcaattttttttttttttgagaaggattttcattcttgttgcccaggctggggtgctatggcacggtcttggctyactgcaacctttgcctcccggattcaagcgattcttctgcctcagcctcctgagtagctgggagctacaggcgcccaccaccaagcctgggtaatttttg

SEQ ID NO: 45132 - DNA, 201 bp, Homo sapiens
taggctaatgcaggagacagatgataaacaaggagcaaaataaataaacaaacagtggcgtttctgagtcaagagggctatagaggaaaacaaaatgcagaaaaaaaaaaggagtccagtgacaaacgggcaaacaggggacactgcagattggggtcagcaaacaacagcccttgggccaaatccagcctgctgcttgta

SEQ ID NO: 45133 - DNA, 201 bp, Homo sapiens
aacttcttactcaacacacgcaacaggaagtgtctctgccagacataccactggactctgctctcttctcagggtgcaacatagaaaatgcctgctacccrctgggcatctgtgctgaacggaccgctatccagaaggccgtctcagaagggtacaaggatttcagggcaattgctatcgccaggtgagtgggaaagccag

SEQ ID NO: 45134 - DNA, 201 bp, Homo sapiens
ctctccatgtggggcctgcaggcaagtcatgagagaggtaagcagcttctcttgctgtctggaatgcaaatatcttccctgtcgcaggctatgggagccamgccaagttgcaggcatggcaggcatggcaggcgtggagacacagctactgtcctgtttgcttggttggctgacttctaaggcctccctacgcttgcatga

SEQ ID NO: 45135 - DNA, 201 bp, Homo sapiens
ttttataaaagtcctcttgatggaaggctgcaatttcttcaactctaaaaacaaaacggtaagccaggtatggtggctcagcctgtaatcccagcaattarggaggcagaggcaggaggatcgcttgggtccaggagttcgagacctgcctgggcaacatagcgagaccctgttctccacaaaaaaaaaaaaaaaggaata

SEQ ID NO: 45136 - DNA, 201 bp, Homo sapiens
aggagagatgaagtttcaccatgttggccaggctcatctcgaactcctgacctcaggagatccgcctgcctcggcctcccaaaagtgctgggagtacaggygtgcgccacaacacccggcctaaacctcttttctttataaattacccggtctcaagtatgtctttattagcagcttgagaacagactaatacactgagta

SEQ ID NO: 45137 - DNA, 201 bp, Homo sapiens
gaggcttccccagccatgtggaactgtgagtccattaaacctccttttttattttattttatttttttttttttttgagaccgagtctcgctctatggccmaggctggactgcagtggtgtgatcttggctcactgcaacctctgcctcccgggttccagagattctcctgcctcaagccttctgagtagctgggattaca

SEQ ID NO: 45138 - DNA, 201 bp, Homo sapiens
tttgccttttttttttttttgagctagaaaattcaaggaaattacttgaatttgttacaggctccaaatacagttattcctctgcgtcttaagcatctagmactgaagtggaaaattccactctttcaataatggttagccatcttagctcaggccatgctgtggtttgaaggtttgccccctccaaaatgcataagcgta

SEQ ID NO: 45139 - DNA, 201 bp, Homo sapiens
attgcacagcatttcaggatgcagtacgtgggcaaaggcttccttcctttttttttatttgccttttttttttttttgagctagaaaattcaaggaaattrcttgaatttgttacaggctccaaatacagttattcctctgcgtcttaagcatctagcactgaagtggaaaattccactctttcaataatggttagccatc

SEQ ID NO: 45140 - DNA, 201 bp, Homo sapiens
tcgtagtattatttggtcctatcttattattatggatttctaacttagcaccatcccaatctctctcatgtatgttttgaagtaagcaaaggcaatagcaraaacagaattggtttgcctggtcagaagacagcctgctttctgggctgagagaagcaaaacaaaattgcacagcatttcaggatgcagtacgtgggcaaa

SEQ ID NO: 45141 - DNA, 201 bp, Homo sapiens
agaaagaaagataaaagaaaagaaagaaagcaaagaaaatggtccacggaaacggagtcagctccgggccttgcacatggctgaggctcagccggtgttcrtgcagcgccgggtgggtgatgggcagggaagagaaggaccacctgtaaccctaggggcactgcacgaggtgtccctgggctcgtggggagtatgcatctg

SEQ ID NO: 45142 - DNA, 201 bp, Homo sapiens
gctggtctcgaacttctggcctcaagtgatctgcccacctcggcctcccaaagtgctgggattataggcatgagcaaccgcattcagcctcaaactattayattgttttaaagttatcattatttcttctgcaagctgcaaaactaccaaaggcagagtgtgtagatttggggttcaaatcctgattctgccacttcacta

SEQ ID NO: 45143 - DNA, 201 bp, Homo sapiens
gccgaccatttcctctgtgccaggctttgtgttaagtgctttacacgagtgatctcaatttattctcacaacaggactatgagggagattctatcattagygatttacaaatgaagccagtgagcctcaaagaggttcagtccctttccccaattctcagagccagttgggcaaagagtcccagggcagaatgaaacctaa

SEQ ID NO: 45144 - DNA, 201 bp, Homo sapiens
cacgcctgtaatcccagctattcgggaggctgaggcaggagaatcgcttgaacccaggaggtggaggtcgcagtgagccaagatcgtgccactgccctccrgcctggatgacagagcaagactccatctcaaaaaaaaaaaaaaaagactaaaataaaaaagactccttttatcctcttgttatctgggaagcttttccta

SEQ ID NO: 45145 - DNA, 201 bp, Homo sapiens
cgaccatttcctctgtgccaggctttgtgttaagtgctttacacgagtgatctcaatttattctcacaacaggactatgagggagattctatcattagcgwtttacaaatgaagccagtgagcctcaaagaggttcagtccctttccccaattctcagagccagttgggcaaagagtcccagggcagaatgaaacctaatg

SEQ ID NO: 45146 - DNA, 201 bp, Homo sapiens
cttccccttccagtagcgtggcaccaccttctgacccacccctcagtgtgtccaccagtgagagtggttcctaagggagagtgtgaagcacacgtaggcastgtcttacaccacacctgctgagtccaaaccatgggaggctcctctcctagaccctgcatcctgaaagctgcgtacctgagagcctgcggtctggctgca

SEQ ID NO: 45147 - DNA, 201 bp, Homo sapiens
tgctgagtccaaaccatgggaggctcctctcctagaccctgcatcctgaaagctgcgtacctgagagcctgcggtctggctgcagggacacacccaagggraggagctgcaatcgtgtctggggccccagcccaggctggccggagctcctgtttccgctgctctgctgcctgcccggggtaccaacatggcccagaagcg

SEQ ID NO: 45148 - DNA, 201 bp, Homo sapiens
atcatctcacagtctctgtggggcaggattctgggctgagccagcttctatggctcgaggtctcttacaaagtggcaatgaatatgtcaggaagggcttcrgtctcatcggaagatttgactgggggtggatccacttcaaagctcactcagtttctggcaggattcagttcactgtgggctgttgctgttactattcagt

SEQ ID NO: 45149 - DNA, 201 bp, Homo sapiens
aatcagcccttgattctttcgaaagcctccacatcctttccagatggcacagaaagggccctcctacaatcccccggcacccacactgacccctcctgccrtgcttatcacatggtgtcatcactgtccacttatgtatctgcctctcccttgggactttgtgctgcagagggcaggagctgtgtcttgaatctttgtgcc

SEQ ID NO: 45150 - DNA, 201 bp, Homo sapiens
aggatgtatggattcctataactaaaccgtgggaagacctggagtgtagccagacctcaggggcaactggcactggccagactcctttctttccatctctmttctctcatccattcttctgagtgtccatttcagcctctctcattggtctcttccataatgaatggaaacatggcggcccacactcagtgtctcaagaga

SEQ ID NO: 45151 - DNA, 201 bp, Homo sapiens
ccgtgcttatcacatggtgtcatcactgtccacttatgtatctgcctctcccttgggactttgtgctgcagagggcaggagctgtgtcttgaatctttgtrccattgactttctcgtgctgtgacgtagcacctgcctggctcagaacaggcactcaataactgttgagtgactgattggatgaatgaatgagatgagtac

SEQ ID NO: 45152 - DNA, 201 bp, Homo sapiens
tacaaaaagtacaaaaatgagctggatgtggtggcgtgcatctgtggtcccagacacttgggaagctgagatggagggatcacttgagccccaggagttcraggctgcagtgagctgtaatcacaccactgtacatcagctgggcgacagaatgagaccctgtctcaaaaaataaaaaacaaaataagaaataaagtaaag

SEQ ID NO: 45153 - DNA, 201 bp, Homo sapiens
agccaggcgtggtggcacatgcctagagtcccagctactcgggaggctgaggcagaaggatggcctgagccccggtggtggagattgcaatgagccgtgakcacgccactgcactccagcccagcccgggcaacagagcaagactctctcaaaaaaaaaaaaaaaaaaaaggccaggcacggtggctcatacctgtaatct

SEQ ID NO: 45154 - DNA, 201 bp, Homo sapiens
gcaacagagtgagactgtctcaaaaaagaaaaaggaattctagagccaccactggcacccacgctccatacagctgggtttggaatgagcgctgtcctcaygtatgaccacgtgcaggtaaagagctttgaaggtgccaagggccatgagtagcttgggaggtcatctaggttctcccagcactgtggagtcaaggagtcc

SEQ ID NO: 45155 - DNA, 201 bp, Homo sapiens
tgtggggcctgcaggcaagtcatgagagaggtaagcagcttctcttgctgtctggaatgcaaatatcttccctgtcgcaggctatgggagccacgccaagytgcaggcatggcaggcatggcaggcgtggagacacagctactgtcctgtttgcttggttggctgacttctaaggcctccctacgcttgcatgagtcactg

SEQ ID NO: 45156 - DNA, 201 bp, Homo sapiens
taagtccacacctcctgcccactgacctaagtgttaatgctcgtctttagatgaaactacggaggtctcgagaggtgacatgacttgcccaaggtcacacrgggcgctggtggtgaaaccctgggctggaggttccccaaagccctgctctcttccttccacccactgtgctcagtgctggccagggtggtgacgtgtttg

SEQ ID NO: 45157 - DNA, 201 bp, Homo sapiens; identical to SEQ ID NO: 10264

SEQ ID NO: 45158 - DNA, 201 bp, Homo sapiens
ccctttgctcttccttcctcttccgccatggttgtgaggcttccccagccatgtggaactgtgagtccattaaacctccttttttattttattttattttwttttttttttgagaccgagtctcgctctatggccaaggctggactgcagtggtgtgatcttggctcactgcaacctctgcctcccgggttccagagattc

SEQ ID NO: 45159 - DNA, 201 bp, Homo sapiens
ggtggtcggtggagaatcttggaggagaaaagccagctgggctttcggagtccagcagtgagcagcgccctgcggggcgggggcgggtaatggaacctgarcccatctgagtctgctctaatctgttcctaaactcttttctttgatttattgcttttgtagaaaagttcatgtgagcaaaaattcaagcttgtttttgct

SEQ ID NO: 45160 - DNA, 201 bp, Homo sapiens
tggaaagccaccacgtggccttctcagccttcaggacacagtggatctgtgaatcaggaactgcctgatggggtatgacccaaatcaggaacagaccgagwctcagggcctgaatcttagcaattgtcctcagtccttgggagagactaatttgagtttgattctttgcttccccagtgacatgcaagatgattttatctc

SEQ ID NO: 45161 - DNA, 201 bp, Homo sapiens
acagagaaacccagggcttccgaatagcatctctgcctcttcatcacactgaacctatctcctcacccttaaagtggccattctgacatcttgatgtcagscctctgagcccaagctaagcggtcttaacccctgtgacctgcacatatacatccagatggcctggagcaactgaagaaccacaagagatgacattccacc

SEQ ID NO: 45162 - DNA, 201 bp, Homo sapiens
agcccatctgagtctgctctaatctgttcctaaactcttttctttgatttattgcttttgtagaaaagttcatgtgagcaaaaattcaagcttgtttttgmtaagcttagaggcattctccttcagggcagtaggggacatggtgtggaggtaccccttggtattattccctgtctgttgaggttctgtcgggtgtgactt

SEQ ID NO: 45163 - DNA, 201 bp, Homo sapiens
ggtaagctccaggaattgtccgattggtctttgttgctcctttcccatgcctgcctgacatagagaaggattttggtcgacatgtgtggaatgaagtgaaraataacccccaaaaagcttaagaggccctggctgcaacagctgtcacccagtaattccaagagttcactcggcatcctgggcaggagtccccaccctctt

SEQ ID NO: 45164 - DNA, 201 bp, Homo sapiens
tctccccctccagagggtaagctccaggaattgtccgattggtctttgttgctcctttcccatgcctgcctgacatagagaaggattttggtcgacatgtstggaatgaagtgaaaaataacccccaaaaagcttaagaggccctggctgcaacagctgtcacccagtaattccaagagttcactcggcatcctgggcagg

SEQ ID NO: 45165 - DNA, 201 bp, Homo sapiens
cataatctggctgctgagagaaggaaagttcgattacaacatgaagatacctttaacaatttaatgaaggaaagtagcaaatttgatggtcagtaaatccrcttataagaattttaattctataactgtgacaggcaaaggagtcttttcttagagcacacttattttcaccttattattaccattcagtcctggtgacac

SEQ ID NO: 45166 - DNA, 201 bp, Homo sapiens
actagaaggtcttatgggatttattaaaccaggattcagtataggtgataggtctcttaagtgtcttttaacataaaatgttcccttccttcttttatctygcaatttattttttaaagaaacctggtcatttgttttatagaatttacatccactgtagccttgattaatgtgttctcctgtcctttgtatttcttgtaa

SEQ ID NO: 45167 - DNA, 201 bp, Homo sapiens
tcttactagaaggtcttatgggatttattaaaccaggattcagtataggtgataggtctcttaagtgtcttttaacataaaatgttcccttccttcttttrtcttgcaatttattttttaaagaaacctggtcatttgttttatagaatttacatccactgtagccttgattaatgtgttctcctgtcctttgtatttctt

SEQ ID NO: 45168 - DNA, 201 bp, Homo sapiens
cgtggtggctcacacctgtaatcccagcactttgggaggcctaggggggtggatcacctgaggtcagcagttcaaaaccagcctggccaacatgaaacccygtctattttgtactaattttgtactaaaagtacaaaaattagccagttgtgatgacgggcgcttgtaatcccagttactcaggaggctaaggcaggagaa

SEQ ID NO: 45169 - DNA, 201 bp, Homo sapiens
aataacatggtgactatttgtgtatctaaacatagttaaacattaaaaagatacagtaaaatacagtataaaagatgaaaaaatggtacacctggccaggygtggtggctcacacctgtaatcccagcactttgggaggcctaggggggtggatcacctgaggtcagcagttcaaaaccagcctggccaacatgaaacccc

SEQ ID NO: 45170 - DNA, 201 bp, Homo sapiens
tcaactcacagacactcttgctttatcaatacctctccacactcccccatatgcctggattgttttgaggaaaaccccaagcatcatctgtaaatgtttcmgtctatacagtcatgcatcacttaatgacgggatatgttctgagaaatgcatcactaacgacttcatccttgtaggaacatcatagagtgtacttacaca

SEQ ID NO: 45171 - DNA, 201 bp, Homo sapiens
ttagtccattttgtcattatgtatctgtattagtccattttcatgctgctgataaagacatatctgagactgggtaatttataaagaaaaagagatttaayggactcacagttccatgtgggtggggaagcctcacaatcatggtggaaggtggaaggcacttcttatatggcggtggcaggagagaaaatgagaaccaag

SEQ ID NO: 45172 - DNA, 201 bp, Homo sapiens
ctaagaacagaaaaaaatgaattttaaaaataaagtgtggccaggtacaatggctcatgcctataatcctagcactttgggaggctcaggtaggaggatgrtttgagcccaggaacttgagaccagcctgggcaacatagagagatcctgtctctaccaaaaaaagaaaatgttaaaattagccaggcatggtagcatgta

SEQ ID NO: 45173 - DNA, 201 bp, Homo sapiens
ccagaaggcagtgcaacaatatcttgaagaataataattacaaaaactttgaaccaagagcttcaaggccctgtgcatagcctgtcctcagccttcactcyagcctcatctcacccactctccctcctactctctgcattgcagtcaccaggacctttgtagtcactgttccctctgctcagcaggccttcccctcctctg

SEQ ID NO: 45174 - DNA, 201 bp, Homo sapiens
ccaaatatggtgaaagacatacaattacagattcaaggtcatagaacatcaagaaaaactaatacaggctgggcctggtggctcacacctgtaatcccagyactttgggaggctgaggcaggcaaatcacctgaggtcagaagttcaagaccagcctggccaacatggtgaaatcccatctttactaaaaatacaaaaatt

SEQ ID NO: 45175 - DNA, 201 bp, Homo sapiens
cttctcacttcacatactctatgcatggagcaagtcctatcagtgttaccccctaaaggagtctctgaaatccaagcactttgctgcacccccattgcgamcatctactccaagctatcatcatgtttcatgcagacttcagcagtgatttccaaactcatctccattcattctggtctcctctccacactgcttctaaag

SEQ ID NO: 45176 - DNA, 201 bp, Homo sapiens
gcattgaatctataaattactttgggcagtatggccattttcatgatactgattcttcctatccatgagcagggaatattttcccatttgtttgtgtcctrtcttatttccttgagcagtggtttgttgttctccttgaagaggtccttcacatcccttgtaagttggattcctaggtattttattctctttgaagcaatg

SEQ ID NO: 45177 - DNA, 201 bp, Homo sapiens
gctgtaaatacatgatgcaattctgtccgtgttagcttggttatgaaactctgagactatgctgcctagagacatttaaaaaaaggaaaaaaaactctgakagtaaaggctaaaaaagttatggtacatctctctggtggttttataaggcagacaccaatatcttgttttcaaaagcatatttagtaatcatgaaattta

SEQ ID NO: 45178 - DNA, 201 bp, Homo sapiens
gccctcactaggacctacaatgggcaagcacctcgatttggaacttccctgcctccacaattgtgagaaatcaatgattcgtttaagccttttttttttttaacaggatttgagattggttatattaacaatggaaacatgaatacaaaattaatccacacataggaaaaaagaataatacataaaccactgaggttgcta

SEQ ID NO: 45179 - DNA, 201 bp, Homo sapiens
ttaatctgtccttttgtttgaaggtgaatgtttaaatattttggttcaaaaataaaaatgagatgacagttttaatactttattctgaattatgaatattsatcttatgaaactgcaactcattgtcttgatagcttatgacaaagtaaatgcagaacagaaatagaagacaggcttcacacttaaaaataatcagtctag

SEQ ID NO: 45180 - DNA, 201 bp, Homo sapiens
agctttattctttttgcttaggattgtcttggctattcaggctcttttttggttccatataaaatttaaagtagtttatccaattctgtgaagaaagtcawtggtagcttcatggggatagcattgaatctataaattactttgggcagtatggccattttcatgatactgattcttcctatccatgagcagggaatattt

SEQ ID NO: 45181 - DNA, 201 bp, Homo sapiens
agccctcactaggacctacaatgggcaagcacctcgatttggaacttccctgcctccacaattgtgagaaatcaatgattcgtttaagccttttttttttttaacaggatttgagattggttatattaacaatggaaacatgaatacaaaattaatccacacataggaaaaaagaataatacataaaccactgaggttgct

SEQ ID NO: 45182 - DNA, 201 bp, Homo sapiens
gacctgaaaatggattttaatagttgcacaggtttgctgataacaaacaagaaaacccaggcccttatcctcctgttgcttagaggaggtggcagcggtgkgcaaggagggcctgatgggtcaagatcctctttgcccaccgccctgcatcacccttcacagtgttgaagttggagttcgcgtggaggcctttgactgtca

SEQ ID NO: 45183 - DNA, 201 bp, Homo sapiens
ctctaaacacaaatgaaactcgaccttttattcaagcataatagtaaaaatctttgacaccagagagaaatggaggtaacaaatgttcatgcatgcagatkacattttcattgtaaaaggaagaaagggaccattcagaaaaacacaagaatagtaaaatgaaaattagtatgaaaccaacaaaagatatgaaaccataat

SEQ ID NO: 45184 - DNA, 201 bp, Homo sapiens
attggtctatatatctgttttggtaccagtaccatgctgttttggtgactgtagccttgtagtatagtttgaagtcaggtagcatgatgcctccagctttrttctttttgcttaggattgtcttggctattcaggctcttttttggttccatataaaatttaaagtagtttatccaattctgtgaagaaagtcaatggtag

SEQ ID NO: 45185 - DNA, 201 bp, Homo sapiens
tacctttaagtctttaatccatcttgagttaatttttgtataaggtgtaaggaagggatccaatttcagttttctgcatatggctagccagttttcctaaygccatttattaaatagagaatcctttctccattgcttgtttttgtcaggtttgtcaaaggtcagatggttgtagatgtgtggtgttatttctgaagcctc

SEQ ID NO: 45186 - DNA, 201 bp, Homo sapiens
cttaccctgactcaggtcatgaacttcaaaaaatattcattgagaaaatataaaccatcaggcaggagtcttttcctattcccatccatgcgcctttcacytctttgctttttcttctgttataatggatgaaatatctctacccctagcagagaacactttctctcaccttctccaggactcccttccatcagttctctt

SEQ ID NO: 45187 - DNA, 201 bp, Homo sapiens
ctgcatcacccttcacagtgttgaagttggagttcgcgtggaggcctttgactgtcaggaatgggccgagggccgagggcgtcacatcaacagtgcttttstcatttacaatgctgctgatgataaggaaaatctcatcacgtttcccagaatccaacccatttcaaaggtcagttattatcacacgaggttcaatagccg

SEQ ID NO: 45188 - DNA, 201 bp, Homo sapiens
attaacctgaatttcgcatgcatgaaaattatcagcatgataaggtggaactgctttatggcatgcatttaagtaatctttaagtcttatctgaaatgaartgtgctaaaactactgaggtttttttgtttgtttttccctagagttggacaagttataaccatcaaagcaaaagttactagagcattcagcacaagcatg

SEQ ID NO: 45189 - DNA, 201 bp, Homo sapiens
gcaattctgtccgtgttagcttggttatgaaactctgagactatgctgcctagagacatttaaaaaaaggaaaaaaaactctgagagtaaaggctaaaaaagttatggtacatctctctggtggttttataaggcagacaccaatatcttgttttcaaaagcatatttagtaatcatgaaatttaaaagagctttcatata

SEQ ID NO: 45190 - DNA, 201 bp, Homo sapiens
tcagtattatattggctgtgggtttctcataaatagctcttattattttgagatacgttccatcaatatcagtttattgagaatttttagcatgaatggaytgttgaattttgttgaaggccttttctgcatgtattgagacaattatgtggtttttgtcatcggttctgtttatgtgatgaattatgtttattgatttgt

SEQ ID NO: 45191 - DNA, 201 bp, Homo sapiens
atcctgccagtcactatgtcaccttctaaggccgtttcctgatgggaatgaaatgggaatgataatgcccacctcatggggttactgctcagtgaatgacrtgttgttagattatgatacaaagcgtttagcatggtgcttttttttttattattattgtactttaagttctggggtacatgtgcagaacgtgcaggtttg

SEQ ID NO: 45192 - DNA, 201 bp, Homo sapiens
ttcttgtgttagtttgctgagaatgacggtttccagcttcatcaatgtccctgcaaaggacatgaactcatccttttttatggctgcatagtattacatgrtgtatatgtgccacattttctttatccagtctatcattgatgggcatttgggttggttccaagtctttgctattgtgaacagtgccacaataaatatacg

SEQ ID NO: 45193 - DNA, 201 bp, Homo sapiens
ataacaaacaagaaaacccaggcccttatcctcctgttgcttagaggaggtggcagcggtgggcaaggagggcctgatgggtcaagatcctctttgcccamcgccctgcatcacccttcacagtgttgaagttggagttcgcgtggaggcctttgactgtcaggaatgggccgagggccgagggcgtcacatcaacagtgc

SEQ ID NO: 45194 - DNA, 201 bp, Homo sapiens
aagctgtaaatacatgatgcaattctgtccgtgttagcttggttatgaaactctgagactatgctgcctagagacatttaaaaaaaggaaaaaaaactctsagagtaaaggctaaaaaagttatggtacatctctctggtggttttataaggcagacaccaatatcttgttttcaaaagcatatttagtaatcatgaaatt

SEQ ID NO: 45195 - DNA, 201 bp, Homo sapiens
ctgccagatagcgaaaaatctcttaatttacccagatgtcctaattaattgtaatcttgtaatttgtgtccacactatgggaatcctaaggtcatcctttsggatcatctattccagaaggtcccccagaagattagggtcttagcctcccctacaccagcaagactcagatcctttcttgaaaaagctccaagtcaataa

SEQ ID NO: 45196 - DNA, 201 bp, Homo sapiens
aaaatcatgttttttccaggttttcaatataaattagatggtaaaaatttaagattgtagtatatgtgatgaaattggatagggcttatggttttaattcrtttcatgtttcatgtataatgatagaattaattgtagtagtaatacaaggagcaaaatgtatattttggaaacatcacacaggtatgtgaaacagctgaa

SEQ ID NO: 45197 - DNA, 201 bp, Homo sapiens
tacaaagcgacctttgtgggacccccattttgtgtaagaacaaatttaaaaatttttctcaatcaaccttgacataatgtaaaagatgatctccatactgmagtccatctccatcgtccaatgtgtgacccattgtttaaagagtatttttagaagtttgacccagcatagcactttgggaggctgaggcaggtggatagt

SEQ ID NO: 45198 - DNA, 201 bp, Homo sapiens
tataggaaacagaccagaggggagctattctcatggagccgggggaggggctgggcccagagctccgcccttccgacccccacccgcttggcccccgtggkcatctccagatacctccagggaaaatgaaggctcccctaggcttctgtaaaaaccacttttgccctctttaccacagtgtagtctccataacatatttgt

SEQ ID NO: 45199 - DNA, 201 bp, Homo sapiens
tttatttgtgaatcttttccagggtttactatctctggagtggcacccaactcatctagttgagcaagtcaaaagtctaggagtcatccttgatatttctstctccaccttacttctcacttcacatactctatgcatggagcaagtcctatcagtgttaccccctaaaggagtctctgaaatccaagcactttgctgcac

SEQ ID NO: 45200 - DNA, 201 bp, Homo sapiens
aagaccccactgctcggggacatggtatttcccaaaatattggcaggtagcgtgcagacctaccctcaacccacataatccagttatttatttcagtcaamtttaaagaaatgcttatttgaagacttgtctgtgcatttgttcgatgaatgaatgtgtgatcgctttcttctctctccctccctttgtctccccagccgc

SEQ ID NO: 45201 - DNA, 201 bp, Homo sapiens
gttttttatttgtgaatcttttccagggtttactatctctggagtggcacccaactcatctagttgagcaagtcaaaagtctaggagtcatccttgatatytctctctccaccttacttctcacttcacatactctatgcatggagcaagtcctatcagtgttaccccctaaaggagtctctgaaatccaagcactttgct

SEQ ID NO: 45202 - DNA, 201 bp, Homo sapiens
cccattatttttccagtcccttaagtctaaagtcttgaagctatctgagtaatcctctatctcacacgtccatgtattattttggaacatctcacacacayggttttttatttgtgaatcttttccagggtttactatctctggagtggcacccaactcatctagttgagcaagtcaaaagtctaggagtcatccttgata

SEQ ID NO: 45203 - DNA, 201 bp, Homo sapiens
tagtaagaaggtaaatttagaagatttttattctgcatccacttgattttattttctctaccattgtgaatactggattctcaggggctcttgagatctcyattcaggttaaattagcaggaaaggagttgctggatctcatattgtacctcccaggttgctcaggatcagtcccttcaatctctgggcatgaagacatgg

SEQ ID NO: 45204 - DNA, 201 bp, Homo sapiens
tgttgtctttttccattatcattaacctgaatttcgcatgcatgaaaattatcagcatgataaggtggaactgctttatggcatgcatttaagtaatcttyaagtcttatctgaaatgaaatgtgctaaaactactgaggtttttttgtttgtttttccctagagttggacaagttataaccatcaaagcaaaagttacta

SEQ ID NO: 45205 - DNA, 201 bp, Homo sapiens
aaactgcaactcattgtcttgatagcttatgacaaagtaaatgcagaacagaaatagaagacaggcttcacacttaaaaataatcagtctaggttgggcakggtggctcacacctataatcccagcactctgggaggccgagacaggaagattgcttgatgccaggagttcaagaccagcttgggaaacatagcaagaccc

SEQ ID NO: 45206 - DNA, 201 bp, Homo sapiens
taatttttttgttgtcttttagataaaaatatatactctggaagagcatgatgttttatctgtttgggttgaaaagcacgtgggaagtccagcacatttgrcttatcgtctcttgtctgactttacaaagcgacctttgtgggacccccattttgtgtaagaacaaatttaaaaatttttctcaatcaaccttgacataat

SEQ ID NO: 45207 - DNA, 201 bp, Homo sapiens
gtttccgcaggaggccacatttccattctgaaggtagtgtttcaagcttcctggtgtctctggtcctttgtagctcagattcctttatctttaacaacttyattgtggtgtaattgacaaacaatgaatggcccatatttaaagcatacaatttgataagttttgaagtaagtttacacctgtgaaaacatcaccacaatc

SEQ ID NO: 45208 - DNA, 201 bp, Homo sapiens
gagtaaaaaccaatttgttagtaaacggagcagatatgattcaaaagaagcagaaagctaggcgcggtggctcacgcctgtattcccagcactttgggagsccgaggcgggcagatcacctgaggtcaggagttcaagaccagcctggccaacatggtgaaaaccatctctactgaaaatacaaaaattagccaggcgtgg

SEQ ID NO: 45209 - DNA, 201 bp, Homo sapiens
aggaataacaatgcctaaactttggtgttatgctttaaaaatgtttctcccactatctctatgtcacttgacattccagccaaattgaagttgaacaaatkggggagtgaatgaatgaattctaatccaactaacttttcttgtacatgtactatgattcaggtactatgccaggtgttttcactgaatccttgcaataac

SEQ ID NO: 45210 - DNA, 201 bp, Homo sapiens
cacatgcatatatacacacacgtatttcatgtcatatgtatgtaatataaaatgtgtgtatatattatgtaatatgatattatatatgtgtatgtattatrtgatatgtatgtgtatatattatatatcatatatgacatcatatatatcatatacacttatatatcatatatgatatatagaaaaagctagaagaaaatt

SEQ ID NO: 45211 - DNA, 201 bp, Homo sapiens
attctgagagaagaggaacacttctcaattttcttgcatcaatttagtagatactctaccagtacaagcttttaggaataacaatgcctaaactttggtgwtatgctttaaaaatgtttctcccactatctctatgtcacttgacattccagccaaattgaagttgaacaaattggggagtgaatgaatgaattctaatcc

SEQ ID NO: 45212 - DNA, 201 bp, Homo sapiens
acaccaatgaaactccttcaactccccctgtgctgggggcaaagttaggcatgcccatgctaagtagggtgtgtctcaccagccacctggagccccatccstagttttcttggtgtttgataagtgctcacagcctcagtcatgtcttcctttgcaggctggatttaaagggaggcttggaaccaagttcaattggagagg

SEQ ID NO: 45213 - DNA, 201 bp, Homo sapiens
cacggtttcataggagctgcatgtaatctcaacagagcagaaagctgcaactctgagtaggaaagaaatttgctaaagatcatatggggtatgagcagagrcttaagatcctgctcctgttgcctggtgctttccacaatcaccctgcgttttatgagccacacttccttagttctctggcagtgatttcctgggctcttt

SEQ ID NO: 45214 - DNA, 201 bp, Homo sapiens
taattacatctgcaagagccccatttccatataaggtcagattctgaggtacaggaggttggggctacagcatatgaatttgggggtggaagggtagagamataattcaactcttaataagtgctcagcacaatattgcatcccactccatcttgttccaccagaatggagcatggctgccccaagggcagattaggactg

SEQ ID NO: 45215 - DNA, 201 bp, Homo sapiens
ctgtaagggcagaattcagtggtggttacaacttagcttgatgtttggtttggctccaggataggaagcagaagcatgtgactgcaacctggggagcagcmcccccagaaaagtgctgtattagtttcctagggctgctataacagaggaccacaaactgggtagtggacacattagaaatctattgtctcacaattctgg

SEQ ID NO: 45216 - DNA, 201 bp, Homo sapiens
ttgaacctgagaggcggaggttgcagtgagccaagattgcaccactgcactccagcctgggcaacgagagcaaaaccccatctctaaaaaaaaaaaaaagrttttaatactgcatttttactgcatcttttctacatttagctatgtttggatacacaaatacttaccattgtgttacggttacctacagtattcagcaca

SEQ ID NO: 45217 - DNA, 201 bp, Homo sapiens
atttaaacttgcacaaatgtaatttttaatttcagcctggaggtgagtatgggaactactttagtgaaattccatttttttcatgcaattttcaaaatccrtgaacatatttttaaccctttgttctgcttggggccttttcacaattagtaaattgtgaaggactggtttttgtcttataagggtagccgtatgtcccaa

SEQ ID NO: 45218 - DNA, 201 bp, Homo sapiens
tagtgctgagctgtgcctgagatagctcattattttcagaagatagtattactcatctgaaatatgtagggaaaaggtttattagccagaatctaaagacragtacctgagtttaccaacacttctgcgaagtgcaatcctgaggaccaagcttcagcgctcttcacacagggggaaatctagcccattttagtatcaaca

SEQ ID NO: 45219 - DNA, 201 bp, Homo sapiens; identical to SEQ ID NO: 10278

SEQ ID NO: 45220 - DNA, 201 bp, Homo sapiens
aagctgttcttgtctggggtttcaccctgtatatggtccagttagtatcaacccaaagactcacaggcatatttctggaattctttctctttttttttagyttccttctctggtactctaacccacaaattttagctccattcaattcagcagagttaggtttttcttctctaacctaaccgtaaattaccttcagcctga

SEQ ID NO: 45221 - DNA, 201 bp, Homo sapiens
tttcctgtcttttgtgctctctctccttttggactttatagagttttagacttcttgttagtgttccacgggtcactgatactgttcgtttttcttctttyagtcttcctttctcttcatgctacattctgtgtagcttcttttgtcatcttcagcttcactgactttttcccctgcattaactaaactgctgttaatctt

SEQ ID NO: 45222 - DNA, 201 bp, Homo sapiens
aacgattctcctgcctcagcctcccaagtagctgggattacaggcatgcgccaccatggtcagctaattttatatttttagtagagatggagtttctccaygttggtcaggatggcctcgaactcctgacctcaggtgatctgcctgcctcagcctcccaaagtgctgggattacaggcgtgagccactgcacccggcctg

SEQ ID NO: 45223 - DNA, 201 bp, Homo sapiens
gaggtcacgtgttacattggcacagatgctagagttgaaatgggaggagttcccttatcctcctcatagggcctgcgacaagggtgtggcttgtttcttcsgtgctgctcaaacccctagagggatcatgcagacgcttaagtcgcttaagtcgtggggagtgtttttgagctctgaccccacggcagcatctagggttga

SEQ ID NO: 45224 - DNA, 201 bp, Homo sapiens
tcatgtcgcacactatctctgcaaagtctcttttctgtttaaatattggtggtccgctaacaccataagtgtggtttacagttatcggcctttgtttttargtgttgtctttttccattatcattaacctgaatttcgcatgcatgaaaattatcagcatgataaggtggaactgctttatggcatgcatttaagtaatct

SEQ ID NO: 45225 - DNA, 201 bp, Homo sapiens
tttttatttattctaacaatctctgccttctacctggagtatttaaactatttacatttgattatctatatggtagagttgaaatctatcatctggctgtytgtcttctatttcttccatctgttctttgtttcttcctgtccccatcttttcctgcattttttagagcagagtaatttttagtaatccattttatctcca

SEQ ID NO: 45226 - DNA, 201 bp, Homo sapiens
tcagtttcctgccacaactgaggccagccctctgctaatttgctgagcagaaataaatgactgacttctccctgaatccaaagcaagcaggaactctgctstgtgccaaacctacttccaggggattctcagactctactgatcagtctcttccctcttcccacctctggaaggtgtgtgatgcattactattaatagatg

SEQ ID NO: 45227 - DNA, 201 bp, Homo sapiens
agtacagagctgtgcaccctgccaactgcactgacagagaccagctgcactggggcccagccaccttggctatagcaccccgcagggcttcatggcccacyttgttgacacggaagagttgatgagatgggcttcctatgtgttaagcgtttcctaatcttgacaagatagaggctcatcttcaaattttctaaaactcac

SEQ ID NO: 45228 - DNA, 201 bp, Homo sapiens
gactggcactatggagttcaccctggccacctgccctcagctcctctgagattgcagagccccagcaggccatcctagagccacttacctaccaaccaccrattggatgactgatgaatctgataatctctctggatatacaccaatgaaactccttcaactccccctgtgctgggggcaaagttaggcatgcccatgcta

SEQ ID NO: 45229 - DNA, 201 bp, Homo sapiens
aactgtggggctcttagcctttgcacacaggagcctctgggcttggcctgtctcctgagggccacacattctcctgatagacagtccaaatatagataaawcctcctttacatttctccttttcctcctcttccctaagacaggctagaatttctaaaggaggcttatctaaaagctaagaaaacaaaagtaaaacccagt

SEQ ID NO: 45230 - DNA, 201 bp, Homo sapiens
cgggggaggggctgggcccagagctccgcccttccgacccccacccgcttggcccccgtggtcatctccagatacctccagggaaaatgaaggctcccctrggcttctgtaaaaaccacttttgccctctttaccacagtgtagtctccataacatatttgtcaatagatggtacaaaaattctcaaatttttagttgttt

SEQ ID NO: 45231 - DNA, 201 bp, Homo sapiens
tctgataaaagatgtttttgaagagttttcctcctcttctctcccacgttttacagcttatatgtttttaatttcaaaatatgactctaatttttttctgycaccttttagtggaataattcttacaacacagttgtctgttaagaatcatacttttgggccaggctcagtggctgacgcctgtaatcccaacactttggg

SEQ ID NO: 45232 - DNA, 201 bp, Homo sapiens
tcctggtgtctctggtcctttgtagctcagattcctttatctttaacaactttattgtggtgtaattgacaaacaatgaatggcccatatttaaagcatayaatttgataagttttgaagtaagtttacacctgtgaaaacatcaccacaatcaagataatgacatatccatcacccccaacatttctgccccttcctgtc

SEQ ID NO: 45233 - DNA, 201 bp, Homo sapiens
ttcaaacatctgcctgttggtgctcacttcttcattgtttacaaagggtagagcaggaggcctagactaatatttggagttagtgagattctctatttcasaaggctctggaatgtgtagtcaggtcacaggtaaataataagcagcagatgtttccactgtttcccagctaaaattcaacatggccaggcatggtagctc

SEQ ID NO: 45234 - DNA, 201 bp, Homo sapiens
gggagctattctcatggagccgggggaggggctgggcccagagctccgcccttccgacccccacccgcttggcccccgtggtcatctccagatacctccarggaaaatgaaggctcccctaggcttctgtaaaaaccacttttgccctctttaccacagtgtagtctccataacatatttgtcaatagatggtacaaaaat

SEQ ID NO: 45235 - DNA, 201 bp, Homo sapiens
ggcctttattagcagggtttaaagagaaccaaaactaactactgcatttccttgtctgctttgtttgcatcaatatcattgatttatacagcagggcaacrgggactttctgctaccctcaccttctaggggaaagatcaaaatcgaatttgctcatccagtactgtacctgacattggataagtcaagtgagctctgtaa

SEQ ID NO: 45236 - DNA, 201 bp, Homo sapiens
gagttcaagaccagcctggccaacatggtgaaaaccatctctactgaaaatacaaaaattagccaggcgtggtggcacgcacctgtaagcccagctactcrggaggccgaggcaggagaattgcttgaacctgggaggctgaggttgcagtgagctgagatcgcaccactgcactccagcctggatgacagagtgagactg

SEQ ID NO: 45237 - DNA, 201 bp, Homo sapiens
tttaaatattggtggtccgctaacaccataagtgtggtttacagttatcggcctttgtttttaagtgttgtctttttccattatcattaacctgaatttcscatgcatgaaaattatcagcatgataaggtggaactgctttatggcatgcatttaagtaatctttaagtcttatctgaaatgaaatgtgctaaaactact

SEQ ID NO: 45238 - DNA, 201 bp, Homo sapiens
ataggtttgagagaaaaattttagaaaggagaagctttgagcattgtcatagactgatggagattcagggaagaggcagagattgaaggcagaaaagagarcagagctgatgaggcagagccaacaagggaggggacagggccactggaggatgggaccaatggcacaggtaaagaaagagattaggtctcaagagatccc

SEQ ID NO: 45239 - DNA, 201 bp, Homo sapiens
tagagatggggtttcaccatgttggccaggatgatctcaatcttctgacctcatgatctgcccaccttggcctcccaaagtgctaggatcgatcacaggcrtgagctactgtgcctggctgatgtgttcactttctagcagtatccaaataagcagaatacaaagcacttgaagaaagcagaaaggaaatgtcgtgaagaa

SEQ ID NO: 45240 - DNA, 201 bp, Homo sapiens
agttgagtccgggagttcaagaccagcctgggcaacatggtgaaagcccatctctataaaatacacaaaaattagctggacatggtggtgcatgcctgtartcctagctacccgggagacccaggtgggaggattgcatgagtctgggaggtcaaggctacagtgagccaagatcacaccactgcactctagcctgggtga

SEQ ID NO: 45241 - DNA, 201 bp, Homo sapiens
cactggcattgagaagcttgttagtgtggctttctccacatttgtagccaaaccagttggaaaagaaaaggtaaattttgtatgtgaagatgtatctagcrtgtaattcagggacatagtaacaattgcatcagaatgttatagaaaaaaatgacacttcttctttccatgagatatacttccccaagatttgttattcac

SEQ ID NO: 45242 - DNA, 201 bp, Homo sapiens
aagtcttgactctttccctttattcattaagagcctatggattttcatgtacttgatgtgttacaattcatccatgttattcttcttctttttttttttttgagacagagttttactgttgtcacccaggctggagtgcgatggcgcaatctcagctcactgcaacctccgcctcccaggttcaagcgattctcctgcctc

SEQ ID NO: 45243 - DNA, 201 bp, Homo sapiens
agtgtaaagtggtgctgtgttgtaggaccccaggggatctgcagctgcaaatgcagctcctttgtgaagaaatgactttaaagccagctcccaagaatttycacagaaaaagatccaagcaatatgagatcctagtgaaaaatcataaaagatagaaataaagcaaggcttcaagatctggaagtgacaccaggccccaca

SEQ ID NO: 45244 - DNA, 201 bp, Homo sapiens
tgtataagtcagaaaaataaacgatgtttttaggaagtttgaattgaagaaaagaaaagcaacttgagatagaataggtttgagagaaaaattttagaaargagaagctttgagcattgtcatagactgatggagattcagggaagaggcagagattgaaggcagaaaagagaacagagctgatgaggcagagccaacaag

SEQ ID NO: 45245 - DNA, 201 bp, Homo sapiens
gttcactgtgggtgtgtgaatctgtttctgggttcccagttctgttccattggtctatgtgtctgtttttatgccagtgcctggctgttttgcttactacractctgtagcataatttgaagtcagataattgtattaatttattttaaacaaaaaatgtgccatttgagtaagtaacattagcctgaaaacaacctcaat

SEQ ID NO: 45246 - DNA, 201 bp, Homo sapiens
agtctcaatgagatgaactgggtacctcatttggaaatgcagaaaaatcaccccccttctgcatcgatctcgctgatagctgcagactggagctgctcctrttcggccatcttgccagcaaatcccatggtgcctgatttacacacaacattcagtagagagtagtcattgttattagtatggccacactgagaaacatta
